United States Patent 9,328,346 (POLYCOMB-ASSOCIATED NON-CODING RNAS) - sequence listing, part 141

SEQ ID NO: 192104 - RNA, 100595 nt, Homo sapiens
aggcgcgagggcuggcugcugggccgacgaggggcggugccaggccguggguccuuagucaagugacgcgaagcggccggccugggcgccgacugcagagccgggaggcugguggucaugccgggguuccugguucgcauccucccucuguugcugguucugcugcuucugggcccuacgcgcggcuugcgcguaagucugcgggacccggguacggggaggcauugcuaggggacaggcuggcggggaaccgggcuggggucgcagccacccgcggucccgcagggcggggagccugagccccgaagugccccccagcaggcucgcggccggcggaacgcaggcaguggaccggccuucccgucgggggcgggccgggcggggcgcgcguccuuccaggcagcucggucgcuugugcguuccgcuccggccgcccuuugcgcuuggauccacuuccccaucuguaacgagguguugagacgaggugcguguaaacauuuccuaaguuggcuuuccgggaggggauuccaaguugcgcggguuagagggugccuccggcucugguuuggggcgcccucgcuuucccaguuggugcucugcggagcgcuccggaaggagaaaaauggggucaggagaggcccuugcagugggaacauuggguuauuuccccucugggugcucucccucuucgugcaucuuguuccuuucucaccacuccccgucgccugcccuuuggcuuggguuuuucuuuguauuugugggaccguuuuccuucggcguuuggggguccagguugagggggggaauaggcaggcugccgggggaugccaucguugaucggggcagggcuggcgaggcgaauaggugaggugcggggcgugcacaguuggugggagaggaaggacagcuucacucgcugcguccgagcugaggcgacuggcugaggggcuccaaagcgcugccuggggagguuugcaucacaccugcggaaaggagaguggguaguugcaagcugcuccucugcacguuccgcggaccaacuuugguuccuccaggguguaggugggcugagccugcaguaugcuuuaaguaagagcugguagcauuugacaccguugacuuguaaguuacacccuuuaauaacgcuuucaauaacgugccuagggcagagaaaagugguacauuuaucuacaaccaagauugaacaucuuaaguauuuggaaaacagcugcugaaaauguuuucauuuugggaaaaagucagcacagauuauuugcugcucccucuucaccccgucugugguuccccuaccccaguauguagacagaguuuucuuguccagaaggcccguaggaccuuaggagucagagcuagccagcugugagaaccacuggggaagguggaacuggggcacaguucaggagaacaguggcaggguaaggggcuaggggaaaggcagaucuuaaccaguaucugggaguggggguagggagagagagaaggauuuaugaaccaggaacagguggacagggucaaucugucugaugugagcucaucagucuugugcagcgucauugggucaggguggaugcccuguggcugccauaccugaggcccacacagggaggcuggcaucaccccaggaauucucauuucaggugccuaggugucccucuugggcuucugugcccacagcuaaagaaagauaccagcagucuagcuuuccauuaucuccuuguuuacauuucuuuaggguucacgccauucuccugccucagccucccgaguagcugggacuacaggcgcccgccaucacacccgacuaauuuuuuucuuuuuuuguauuuuuaguagagacgggguuucaccauguuagccaggauggucucgaucuccugaccucgugacccagcgguucucaaauuuuaacuaaauuuuagcuguccuagaaauuaagagaauauuccuuuuuuuuuuuuuuuuuuuuuuuuugagacagagucucgcucuuuugcccaggcuggagugcaguggcacgaucuuggcucacuacaacuuccaccucccagguucaagugauucuccugccucagccucccgaguagcugggauuacaugcauccaccaccaugccuggcuaauuuuugaauuuuuaguagagacaggguuuuaccauguuggccaggcuggucuugaacuccugaccucagguaaucugccugccucggccucccaaagugcuggaauuauaggcgucagccacugugcccagcccuagagaauauuuuaaacuauuuguuaagaaauacuacaucauuacacguuaauaaacaauauauauauuugaaaaacaauaguauuucuccccaaauuuuagggugaagaguugcacuguuuuacauuucugcaaaucucuuucaaugucucuuaauagaagacagucaaauuuucauguuuauuucugcauuaaaucuguugccauaucacaugucacauagccucuggaagacuccacccccucaggacagagugagaauggaaaaggcaguaauggcuuggaauuauaauaaaaauaguuuugacuaauuggaccccugaagggcucucuccagaccacacuuugaauaccgcugauuuggaauguuuuuauaaaacaaguacaugcuuacuguagagaaacuuuaaacguauagaacaugugguaagaaaaugaaaacugcccaucaugucacaaugcugugaguuucuuuuugaauaauaaaguauagcuagcaacugacugguauuugaguagcuuggauucaagguggguugggcagauguaaguggccuuugaguuuugaauggguacaaggacacucuaauaucccacaaagcugaugcugguuccugguugcaggcggaguugaccuggaaaccucuccuuggccacuguccuuucuaaggaacucauuuccagaguccaccagcacagaacuggugggggagccuacuaggagcagagaaaauggccaucuucaggcagcugucccuaggcgcgaaggccacccuggcugcugucacugucuucguguccaugaucgccucccgcucguaucuggcagagagccuugagcucagggccuggcguuggcugcuucgcuugcagcuugcccuguuugucaacucgcucuugcucauuggcucccucuacauuuggcgcagcacagugagcaaccucugccacuccccagcugcagagucaaccuguuuucagcuuuggaagguggugguucuggcauuucuggcccuggcccauuccaguuucuuuaccauguucuuuuuaguggccgaagagcccuaucucuuuuccuuggcggccuacuccugccugggugcuuacaucaucaugcucuucuuccucuucauccucagcggcauggagcaggccuaccagcucuuggccuggcgcagugguagggucgugggcagccuugagaagacaaggaagcucgugcucaggccugcccuggcagugggagugacugcugugcucagcguggccgggauucugaaugccgcgcagcccccggcugugaaaacuguggaggugcccauccaucagcugccugccucaaugaacaaccucaagaucgugcuccucucagacauucacuugggccccacagugggcaggaccaagauggaaauguuugugaggauggugaaugugcuggaaccagacaucacggugauugugggugaccucuccgacucagaagccucgguccugcggacggcugucgcuccucugggccagcuucauucacaucucggugccuacuucgucacaggcaaucaugaguacuacacgucagaugucagcaacugguuugcacuucuggaaucccugcauguccagccucuucauaaugagaacgugaagauuuccgccacacgggcccaacgugguggugguggcaguggcagugggagugaggaugaggacuggaucugcuuggcugggguggacgauauugaagcagacauccugcacuacucuggccauggcauggaucuugacaaggcccuggagggcugcagcccagaccacacaaucaucuugcuagcucaccagccccuggcugccaagagagcucuccaggcucggccagauauuaaccugauccuuucugggcacacacaugcugggcagaucuuccccuugaacguagcagccuaucuccugaaucccuucuuugcuggucucuaccagguggcccaggcuacauucguguaugucagcccaggcacagccuacuacgggauacccaugaggcuggguagcagggccgagaucacagagcucauccugcagcggucucccugaacuggcccugcccugugcaccucugcccugcccuuguccucgacccuccauccugcuucagagugguuugccugcuuuuccccuccagccuugcccacucauccuugccuacacacccuuggucacaagccugacucaaacagugacuuauggugggccugccuggcauguucaggcugguuuaacuauuuccuuggccaguugcuuuuuuugaugcacuugugagaucacuaaggucacauauauuagcacuccccucuauuuuccagaugauguggaauggggaccuucuccugcagagcucccagggaugaaccuccccucgggguugcuagaaaggcauaccucuagaagguggggcggggaggagcaggagcauuuuucuccugguguuuuaaaauugucuuuaggacuuaagugguuuccagaaucauugauccagagccuuucuggggaagggguaguguugccagguaauuugggagaacaggcaagauggaagggcccucuggcugcuagagaagaauauuuucuuuuccucugauucuaucaggaucaccucuauugagggcaucagcaaaaucuacuggaaugcaaagcuccuccuguuccaggccuugagggaugcuauuuaacugucugugcuccugggccuuugggggcaaggucaggggagaagaacggugggcgccauggucggugauggugagaacauggcugcuuaggaauucagagggcuuugccucccuugucucauuuuauacaacccuucggggagcucacuggggacaggcugcuuuucccuauuuggagauaaggaaaccaaggcaaagagagauagggcacaggcaguaugacaagauauguaggagauuuggggcuagaaaccaggucuuguaccucccaguaaaagcggugcuuuugcccuuuugccagaagcaauagauccuuugauccugagauggagauaagcacccguguuagaaaaggccucacugagaagacagggcugggcugguuuccugcugggugauuuaggcuugugauggaaagucuuccuccaauggggagugaagacacucgcucugacuggagaggcuaacccugcugcucacucauagggcagcguugggugggugacuuucccucacucagccuugguuuccaucaacccuaaaauggggauaauuaucguaucuaccucaagauuguuuugucaggagggauccaucaagccuugugcaugaguuccacauggcacagcgugcacaguaaacacucaauguuaauuuuucaacguuccaguggagcuugcuaaggaacucuguugggcacaggugcccagaggauucauggagcagccaguccuggggaaugugaguggguagcgagcugccugcugcuggggcaggugaugugucaaagcagcaacugcuagggguuugccuuccuucccucaugugcauucuggcaggcaaaggggguuucuuccuuuccuccuuguccuccugguguauagugggguucugggggaucuggagaccacccuuuuuguucccaggcagccacgguauugacagugggccauaccaugcaguuuaaaauguaucuuugaguugaaauuuuggugguuuccuuauucuuuuuucucucuucacuguccuuccaaacucacuuuucuugugucccgaccgcauuuugugaaucauccuuacucccuuuaaguucucgcuuuggauuucaccaggugggcuagauggugccauuucacuuccacuguuugaugcggcugguaauguuugacucaccuguuacguguuauuucacugguuucuugauuuuacaucuuucucaucagugaccugggcuugaugaaauuagcuuucauuaaguccuauuuuuuuuuuaauuuugcauccuuaccucuuuucuuucucuugaaugccaucauuguguggucuuauguacccuucauccacucugaaguccuugcuugacugauugcuuucuauuagcagaaagaaaacagguccauccuauguaucugagaaacaacaucaacacccucucguaugugguuuguauucccugacgcggcggacauuuuugcagcagaaauuucuccaucacuguccagauucuggcccuggugggcaggucuccaugacaccuuuagucccuuuguucaacauucuuaaaccauggaccuuuuuguuuguuuguggccgggggagguggugagaaacguuacuugaagcuugaucauucuuucaauuucauuuguuucuuuauuuuuaaucuguuagaugcaaauugaaaugcaaugcuuuuugaaaaucagcaauagugucuguaguauaugaugcugucacaaaaucucaauaaauugauccugcugccauuccuuccaaauacccauccaugcuuuucuuccccucguguuuuguuugguuuguuuuaaacuuuucguacauguaccucucucccagcuuuaacaagcaugacgagaccacucugccauccuuucucagcuaccccugccccaccuguacucuuuauuuuuuggcuggaguauauuaagguaaaucauagaaaacauaauguuaccccaaaauuacuucaguaugaauccuuuuucaaaaagcauagcuauagugucauuaucauauccaaugaaauuaacagugauucuugaauaucaucuaauagcuaguuaggagauuuggggcuaguagccagauuuuugaccucuuuaaagaaguguucuuuccacucucugaguauuaaguagcuguaucugucacaaaugaguacagaauucaaaugcaguuaacugugugaagaguuaguguuuaguuuuuccugauuaucucaacuauauuuuuuauuguggcaaaaaaauuacuaucuuaaccauuuuuuuuguucuuuuuguuguuguugaucuuaaccauuuuuaagugaauaguucaacaguguuagguauauucacauuguugugaaauugaucuaauugaucuguagaacuuuuucaucuugcaaaucuauauacccauugagcaacaaggcuccauuucccccuuccuccagccccuggugaccacaauucuacuuucuguuucuaugaauuugacugcuuuagauaccucguauaagugaaaucaugcaguuuuugucuuuuuguggcgggcuuauuucaguuaguauaaugaccuuaagguuguggcacgugacuggauuucuguccuuuuuaaggcuggacuacaguaauacucuuguauuuucaugccacauuuuguuuauccauguugagcauguuuucaugggcuuguuggccaccuguauaccuucuuuggagaaaugucuauucaaguccuuugccuaucuuuaaaucagguuauuuaauuuauuguuguggagauguaggaguucuuuauauauucuggacauuaaccccuuaucagauacguaauuugcagauauuuucuucaguucuguacauugccuuuucacugauugugaccuuugaugcacagaguuuuaaaguuuaaugcaggcccauuucucuauuuuugcuuuuauuuuggcaucauauccaagaaaucauugccaaguucaauaucacguagcuuuuuuccccauguuuucuucuaggaguguuauaguuuugggucuuacguuuaggucuuuaacccauauugaauuaauuuuuguguaugguauaagauaaggguccaacuucauucucuugccugugaauauccaguuuucccagcacuguuuucugaagaaauuguccuuuucuaacaucaagagaucuuggcaucuuuguugaaaaucauuugaccauauacacaagaguuuguuucuugguguucuauccucucauugcucuaugucugucuuuaugucauuaccaugcuauucugauuaccacagcuuugcaauauguuuugaaaucaggagguaugagucuuucaacuuugcucuucuuuuucaagacuuuagucuauuuggugucuguugagauuccauaugaauuuuaggauaaauuuuucuauuucugcaagaaaugcuauugggauuuuuauagggauuguguugaaucugugaaucacuuuggguaguaugaacaucuuaacaauaugaaccuuccacuccaugaacauaggauguuuuuuccauuuguuugugucuucuuuaauuucuuuuuaacaguguuuuguaguuuucaguguagucuuucaccuuaguuaggccuauuucuaaguauuuuauucuuuuugaugcuuuuauauauggaauuuuuugaaauuccauuuaggauuguucauuuuuaguguauagagaagcaacugauuuugguauguugcuuuuuguauccugcaacuuugcugaauucauuuauuaguucuaacaguuuguguguguguguguguguguguguguguguguguguguguguagucuuuaggguuuccuacaucuaagauuauaucaucugugaaucgaucauuuuacuucuccuuucuaauuugaaugccuuuuauuucuuucuugccuaguugcucugacuaggacuuccaaaacuauguugaguagaaguggcaaaaacagacaucuugccuuuuuccugaucuuagaggaaaagcuugcagucuuucacuauugaauaugauguuagcuaugggcucuucacaugugggcuuuaugauguggagguaguuuucuucuauuuugcauuuguugaguuguugguuuuuuuaaucaugaaaggguguugaaucuugucaugcuuucucugccucaauuuagauuaucaugugguuuuugcccuucaaucuguuaauuugguguauuauauugauugauuuuuauauguuaaaccauucuugcauuuuaggaauaaaucccacuugaucauaguauauaacccuuuuaauguacuguugaauucaguuugcuaguauuuuguugaggauuuuugcaucaauauucaccaggaauauuauuguucuguaguuuucuuguaguguauuugucuggcuuugguauuaggauaauauuggucucauagaauaaauuuagaaauguuccuccucuucaacuuuuguaauaguuucaggaggauugguauuaauucuucuuuaaauguuugguagaauucuccagugaagccaucugguucuagguuuuucuuugagugugugugugugugugugugugugugugugugugugugugugugugugugcgcgcaugcugagacauggucuugcucugucgccggggcuggagugcagaggcaugaucuugggucacugcaaccuccaccucccagguucaagcgauucuccuuccucagccucccaaguagccaggaccacaggcacgcgccaccacacccggcuaauuuuuguauuuuuaguagagacgggguuucaccauguuggccaggcuggucucaaacucuugaccucaagugaucuggccgcuucccccucccaaagugcugggauuacaggcgggagccaccguacccggccucuuugagguuuuugaugacugauucaaucuuuuuaauagcuauuggucuguauagauuuucuguuucuucaugauucggucuuggugggcugggugugucuagaaauuuauccauaucuucuagguuauccaauuuguuggcauacaguuguucaugcuauucucuuacaauucuuuauuucugugucaucaguuauaauguccccucuucauuucugauuuauuuauaucuucuuuuuuuuaaaucuaguuaaguuucucaauuuuguugauuuuuuuuucaaaaaccaacuguuuuuuuuuccuacuaucuuucuauucucuuuuguuuauuucuacucuaauauuuuauuuccuuuugcuagcuuuggguuuauuuuuuucuucuuauggaauugucuuuuuauaguuauuuuguuugaaacaggaucuaaaaauaggucuauauuuugccugugguguauuucuucagucuccuuaagucuauaacauccccuuuuccuuauuuuuuaucauuuauuuguucaaguuaucugggucauaugucuuaaaauuuuauacauuuuagauuuuggugucauuuaacauguucauauuuucugugagcucauagagcuaaagcucucuaaagguuagagcuagaggcugguuggauucagguucaacuuuuucgcuuuuuggguaggaagaauucauugcuucacugauauuaagauugaccuguugguccagguguugucagcuugaucccuccacuagaaaauuccgcauuaucuuuccauuuaauguuucagcagucauuggugauuguugccuaaugucauuauuucacuaaagauugcagaauagugauuuguaaaauucuacccuuuuuuuccugcauuuacuggcuauggauccuuuacaaagaacucuccucauuaauuaugugguuacucugaaaaagccuauaacaaaggcaagacagauaccagauucuuucacuugauuccuuaguuuauagcauaaugaucugauaccacagcaaccuccaagaaugaccaauaagcuuuucuucugggugggugaaauauuguuaggaauuuagauauuuagauauuuuauauaucugauguuuuuuaguucaucaaaguguuacaucuuuuaauacucaaaauagcccaucuuuggccaguugggaccuuuucauuuuucauuuuuuacuuuuuagagucuuagucuugcucuguuguucaggcuggagugcaguggugugacuguaacucacugcacucucaauuuccugggcuuaagcgauacacucacuuuggccuccagauagcuaggacuacaggcaugcaccaccaccaccacuccuggcucuuuuuuuuuuuuuuugguagagacagagucucucuuuguugcccaggcuggucucaaacuccuggccucaagcaguccucagccucccaaaaugcugggauuacaggugugaaccuguaaucagccucccaaaaugcuggcauuacaggugugaaccacugcacuugagcugguuggagcccugucaucuugucauuuugaugagacccuaauaguuuuguuuuuuuuuuuaaucuagcccuguuuuguacaucuuaugccacagacuuggauuaacuaauuucuugaagaagcagcuuugguuacuuuuagugggaaauguuugcagaucacaauuuaggcgcuauauggguuagauugcuacccgcugauaucauuuccaaacugugucuuuggguauugcuaggaaaugcaauacuuuuuuagagagaaaaaaaaucauaaguguauacuaguauuuacaauucaaauaagagauuauggauuuuauuguuuuuuaauggacuauauuuuuuagaauaguuguagccuuauagcaaaauugaguggaaaguacagagauuuuccuguaucuccugauuaugggguucuuaauuuuguuugauuuuauguuuguuucucucucucucgcuuuuuuuuuuuuuuuuuuugaaacagacucuugcucugucacucugauuggacugcaguggcaccaucacuacucacugcagccugaaccauucugggcucaagcaauccucccaccucagccucccaaguaguugggaccacaggcaugugccaccauacccagcuaacuuuuguuuauuuuuuauagggaugggaucucauuuuguuguccaggcuggaacuucuggggucaagccauccacccgccucagccucccaaagugcugggauuacaggcaugagccacugcacccagccuguuucucuuuuacacugaaaaauuugguucuuaguaaccuaauguaguuacuuacuucuuuuauccuacuacauauauaauagaaccaaaauaguaacgucaaugugguuauuaagaugaagucuacugaaugcaguuugcuuuuguuuuuuucccugaaugcaguuuaagcuguauuuuuauccuuaggccaaauauggucaauguaguguggaaaguuagaucuguauguuuuuaauuuuaaagaaauuacauauuuuuuaauuuaauuuuuauuuuuuuaaacugcacauuuaccuuuucucugagaugagggggcacauuuaaaucuguguauguccagaguccgugaggauugggaaucagucuaaagcugugcucgcuucuccucuuccauugcgauuugccuucuuuauccagucuuuuggaaugcugaacaaaaauguuuuuggcacaaggcaggcgugaaaacauaaaguuaauaaaaaucgaaugcauaagcuagagcagauuauccacagauucuuccaucuccauauagauuaucaccauugccugcaccuguuuuccuucuccagccuaucugauggaauggugcuuccaugacaugugguauuuggaaggcucuuagcucugauguaaucaggguuugacccauagucaccugaaauaguucuucuguuucucuuuguucuaugaacugaagggucucagaagcccguguuaugcaaauacccuuccauccccuucccucuccccuugccucuauccauguucccucagccucagggugcuugcaggcuaagaggauugggucucuggcauccuggagcugaacagcucgugucaggaauuccccaggcccuugagucucuggggugaguuguagggguguguagggugcuggggauuaagaucugcugaguaggugcuuaccagaguuauacugaaggaccugaagacagaucaucuucacauaaucagcaugacccauaaucugugaugucacugagcuucuuuuauuucuguagucaaggaaugugcacaaguaaugcaaauauaauuacuuuuaguccugaggauuagggaacuugggggauguucacauuaccugaugaugucaauauuguguuauguuuaauuuuuuuuaaaaaagaugcuuauuuauuacugaaauaaucuaaacugaauaaauaacuuuuuaaaaaauuacauuggccaguauuagguuccugauacguauuugguguuuuguuuguacugcuggguuuuuucucuccaguauuggaugcguuaacggggagccuugagaaguuaugaauuuugguuuguucggaauugcuuuuuauaaguuuucugugaccucaugcacuaaauacugaugcuaccacacuccugcaaguaugaaauaaaaguaugucucuucaguauugcauuccugcgccaauucauuuagaaggguagaauuugcacacaggucaaaucuugcauuauuugcauuuggggggaauacacucugaaggcaguuuucucucucucugucuccuuuuuccuccuuucuuccuccuauucccacuuuuuuuuuuuuuuuuuuuugagacagaguuucagucuuguugcccaggcuggagugcaguggcgcgaucuuggcucacugcaaccucugccucccagguucaagggauucuucugccucagccuccaaguagcugggauuacaggcaugugccaccacacccagcuaauuuuuguauuuuuaguauagaugagguuuugccauguuggucaggcuggucucgaacuccugaccucaggugauccaccugccucggccucccaaagugcugggauuacaggcgugagccacuguaccuggccuauucccacuuuuuuugaucgccuucugucaguaguuccacagcucagaggaagcucaaaggaagcugggucuuuuuuuuagguccguaacuuuugagaggggucaucuuggguccaugaaguggacugucccuguuuacuuuggcugugacagucaacaaugaugaacugucuuuuaagugauacugcuucugcagcuguccaucuugauccccucucuguggcuuuucuagguuuuuguuucagagacauguccccugcucuccugguucaaauaacauggugauguucaucucucagaccaugacaguccaugaaugcacagacaguccaggucucgugugauacagcagggcaguggacacagccccgggcaagagggagaauauacugcuguccugcccacucacgaacuguuuucaauccuuuuuaucaguaggauuugaaaagauuagaacauuaaucgcaaaccaaauaucagaggcuguguuguucugucccagugguaaucccauaccuacaugguagcugcuuuuggagcuacuacucgguuaauuaaguggccaccaucauguacugugaucuguuuuuucuggcagaggcucacgggcaauuugaaugaacaugauggaaaugaucuuuaagucuuuguggagggggcacuaauagcuacaauucccagaggauuguggucuugcuucagauuuaucuugagugggaguggggagugggcaguuccagagcuuccacuugauccaugauggcuccuacucauuaugaggguucugcaggccauuauguaaaaccaucccacuuugaacucauagccagggaaauaaccgugugauggauccucugauuuguuggacucucugugaaaaggacuggggccaaggcucccauuaucccuggccucccuaagagugauaagggagagugauggcauuucagguucccuggugcuaccaugucaguucagacuguauccaguaguccucagaaggugguggccuuggggugccccuuuucuuaggacacaguuacccugagucuuguugggaaggauuggaggaauauuuacuguguggacuuggggugguaaugcaggauccuuccucaaggggauccauccaaccuuccaucaaauuuuguugacuguauguuagagaacuggcucaaagcugggaauuggaugaaggaaucucaauuuuccaugcaguuguugacaucagccuuuugcucacaaguuuuuaaacaugucaagcaguacucuugcugauugccuggccaacucaccccacagaaacguguggcuuaugagccacugcauaaggucacuccugguccacaggucagcacacccugguugccacugugaccuugcugguuguugugguaauugugccuuccugcuucugaugguuaagcggucccaugcugguuaugccagaaccucaucauccccagcgacacuagggcgccccuugccugcagaggauggccccacugggggggcuucccaaguaugccagggcccuccucaccagugccuuccuuccugaagggagaguucucugggcucuccuggggaauagagccagguaguggggucucuggucacccuuuuuacauucccaccucuugagccauuccauaccuuucucaggaugccaaggcaguccuggcauccucaccucauuuccuguagaccagcgucaugucuagguuccaaggauccucccaacagcauagggacugggcucuuaccaauagaauauaggucaugggagaauacacccuaccaguaacuuccccauauccggccugggauuuucccccucaagauccauucccagugacccccauaguuaggucuuacuuuucuggccugagaugugagucucuuuaaacauugccacagaagccucugauauucauaggaugcccugaguggauggcucaccugagcccaucaaaccgucacugucuucaaagcuuccaaaucuguuaauaaaagccagcuaaccucacacuccuuucaaugaccagugacccccaccucugccccgcuccagggguggagccagugcagauaccgacugcucccccucucuccaugccuccucccggucccacagaguugagggccuugguauuugucuuugaggcguuaccaccccacuuagcaccagcuauaagguucuugcuauuugacauucaugagacaacaaggugcagacucacauccugaugaucugcuguugaggccacuccugguaucaaggucguacuuugggucccucuagaagcagaacauugggugcaagugguuugagaagugauccaagagcauaggagcaagggacagguggaaagaagggacagccugggucagaaugcauauuguaguuaucacucugggaaccgggacaugauucuucugagaccuccugaaaagugcacaaagugucuccagaauuauuugccuaaaaaacaagagaaugcaguucuccacccucuuugucccucauuggcugaagguugcccucaggggcauggacugccuggugcuccuggacuucugggcugaacccauucccccaguguuggggcagaaaggcaaaaagacaugagaucugagugugaguugagacaaucagcacaaagcauacugagcuugcacaagaccauucacagagcuacagcugauguaggcauguuuuuaaaaacuuuuaaagaccaggcgcgguggcucacgucuguaaucccagcacuuugggaagccgaggcggcggauuaccugaggucaggagcuccaaaccagccuggccaacguggugaaaccccgucucuacuaaaaauacaaaaauuagccgggugugggggcaggaggcugaggcaggagaauugcuugaacuggggaggcggagguugcagugagcugagacugugccauugcacuccagccugggccacaagagugaaacuccaucucaaaaaacaaacaaacaaacaaaaaaaaacaguuuucaggcugggcacaguggcucacgccaguaaucccagaacuuugcgaucgugaggugggaggauugcuugaggccagcaguuggagaccagccugggcaacauagugagauccuaucucuacagaaaauuugaaaauuauuaacugagcaugguggcgcaccccuguggucccaucuacuugggaacagaggugggaggaucgcuugagcccaggaggucaaggcugcagugagccaugaucaugcugcugcacuccagccagagcaacugagcaagaaagacccugacucaaaaacaaaaaacucucuccucugccuucucuuuucacccuauaucccucccaaagugcugggauauccaucggagaucauuucacaauggcaagggcuacauacucuccagagcugcguaacauuugaucauguauguguauuuguauauauacaaacaugcauguacaauacacauacaauauaaaccauaauucauuuuaucagucugcauuuuuauuugugucaacauuuugcuaggaaaauuuuucagagaggguugaaagauuauaccauuaacauauuacuaucaguccauuccuccaucuaucaauucaucuuauuuuuugaauguauuucaaaauaaguugcagauaucaaugcccuccucuugcuaaaauaaauacuucaguaggcauaucauuaacuagcagucaguguuuguuaguagccccuuuuucuuccaagguaaaauuuacauacaaugaaaugcacauaucuuaaacguaccauuugaugaguuuuaacaaaugccuacaccugcauaauccaaaacccuuaucuagcuauggaauauuaauuaccauuaccccagaaaguucccucacgucccuucccaggcaauaccuaccucuacucucccagaguuaacuauucugauuuuuucuuccaccauagauuagauuugccuuucccaggacuucauauaaauagguucaugcaguaugaacccaauuguguaaggcuucuuucucucaacauuuuugagauuuauuuacauuauuacaaauaccaguaguuuguucuuuuuuauugcugaguaguagucuaucauauacauaugccauaguuugcugaagcaggagaaucgcuugaacccaggaguucaagacugccaugagauaugauugagccauugcacuccagccugggugacggagcaagacccuguauccaaaaaaucuuaaaaaauuauaauaguaaauaaaaaguaauaaaaauaaaagaauuaggauccaaaccagguucacacugaccuaaugaauaucguaucauuucauauuacgaauauuguaccauaccuuauuacacauaucauaucacauauaaugaucuaaugcaaucauuaggccauuauuccucugaaguucuuucauuuccaaauaauacucccuuucuuucuuuuaauaccauugauuuguuggaacaacugaaucauuggacuuuuaaaaugucccacauuuuggauuuggcuuauugcuuccuuaugguauuauuagauucggguucaauugugauuuugauucaauaaugaggacuacuuucuagaugagacuguacuucguguuaaaucauaacaugagagacauaaugucuggcuauucgacuuuuuuugaggcugaaauugagcagauggagcacaaaaaauaugcccaauccuucacacaauuuccaucaguguuucuaaugguuuuagcaucuauugaugauuauagcuuaaauccauuucacuaaguguuggggaaaagguguuuucagaugcuuuuauuccuucugcauuuauuguuauuuugagacagggucccucucugucacccaggcuggacugcaguggcccuaucacaucucaccaucgccuugaccuccugggcucgagcaaucuuccugccucagccuccugaguagcuaagacuaccagugccugccaccacaccagcuaauuuuguuuguuuauuuauuuuaaacaagaaguuuaaacaacaagcuucuugacuugaaggaaaaacuaucuaggauuccuuuuuuuuuuuagacuaauuuaucccuacuuaaagacaaauugcccuacauuuaacaacuauguacaacaaaguuauaaaauuguccuugguuuuacaaugauaaaugaaaaacauuaacauucuacaauugaauaaaguaugcaaggauuuuuauguuuuuuuuuuguuaaaacagcaaaauaacuuacugaaauauaaagauaagagcugaaugagcaugccacuaaugaagaaaagggaguauuuuuacagaaucgguauuuuuccccaucucaucuccacuugauaucaaucaaaacguaccauuggcuguuuaguuaaaaaaaaaaaaguaauauacuugugcacauuuaccaguuacuuuauguacaauaaaggaauggggaagggggaaaugaaagaauagagaaaacuauacuguaguagucaggaugugguggaaccaaauugcaguuuucuauuugagaaugugaucuuggucuguaaagaacagaguucuggagugaagugggagguucccuuuuuaguagacacccccugacugcuguuggaacauaucgguuguaucuucauccuccauuuccaacugagcaggugugucucuuucauugauugguugccugucaaauuggaaucugaucugucucauugaccaucccuaucguucacaacaggcuuucauuaguuuacuaagugguguaugccucuuaauccuaaacugcaccacagaacccuccugcccugccaccuucaaauuaauaugaucuuuguucucagucucgauuccuuccuugggcuuuucaucugccacggcaagcgccuaagucucagcugccgcuucacaaaagagguaccaagacugcaccgaaugagcacgcaagcagcaacaggagugggagaagaaggaggcggcagcagugggugagggagacacuaauuuuaauuuuuuuuuuuauagagacagggucucgccauguuccccagacuggucuugaacuccugggcucuagcaauucuccugccuuggccucccaaauugcugggauuacaggcaugagccauuguguccgggcccuucuguauuuaauuaacugggauccaguggagaauuuuccauugucaauguuuugauaacccugaaauacaguuuuuaugugaaggggaaguaaacugcuugacucuuucucuguauuuaucacuuuucauaguaaugaguugguacucuagcagucuccaaaagugaccaaugaauuuuuucucccuguaaauuacgaugaacugauagguguuaauauacacguagucauauuuuuuaaauugauauaucucuuaagucucucacaugcucgcucucucugucucucauuuugacacucagauuucuccccaagaacagugggagccucuucagguucgcgccugugccucacaucuaacuggccaccauccuggaauguccuccuucugccuccugcccaccucauugucaccaccgugggccauagccacaucucuucugccuuuuuugcccauucaggaaaaagccaaacauuugaaaacacauaucugguccuaucauucuuucauuucaguugcucuccauggcucucagcauaaaauccgggcccuugaaucuggacuucagggcucauucgaucuggcccuggccuccuccucugccucagcagcugccauguuucaacuauauugaggcucuguggcuccuggccuguaguccugcccucccucccccaggccucacacgcaguuuucuccaucugugucaccuucccccauggcuaacuucgcuuuauccuaggccuuggcucaggccagugguucucaaccuuggcugcacauuacaucaucuaggcagcuuuaagaaauuccaaugucuggguuccucccaagaccaauuaaaacaugaaugucugggggugaggucaacuuugcuuuuuuuuuuuuuuuuugagacagagucucgcacugucgcccaggcuggagugcaguggcacaaucucggcucacugcaagcuccgccucccagguucacgccauucuccugccucagccuccuguguagcugggacuacaggcaccuaccaccacgcccggcuaauuuuuuuuuuguauuuuuaguagagaugggauuucacuguguuagcuaggauggucucgaucucccgaccucgugauccaccugccuuggccucccaaagaacuuugcuauuuuuaaaagcuugcguagaugauuuugcugugcagccaagauugagaaacacaguuugggguguuucuuccuuugagaaacuugcccuugccccuccccucaacccugccaugccuggguucccugccauuuauuucugcugcagcauucugcucuaacccuuacuuuaccgccucgaccucacuguguuaacccuuggguuucuucuaggcuagauggaagcuccauauggguuguggccacaucugugugguucuugucugugauuacucagcacguaagaggugcuugguaauacuauauuuguaaauggaugguagggagauauuuagacuagacugaggucauuggaggguagagacagugucccaccauguaugggacaaaggccagauuccauugucucccaccaucauuuuuucccagccuuaucuccugcuccucugaacuuuuucacuuagacagguggauuucaaacagcucuacccuuuuccgaauucugccaguaguugcuuggccuccuuucuaccugucuaaugaauguucccaccucaugggccaccuuugaacuuaggaaacuugugaggaacacuuauuugacacuuagccauguauauacuaugagaauguuuucaagagcauccauugagacaccugguguaagaaauaauuuuucuauuuuugugaguuuaggggacuuuuccuuugaacagaaauuaaaaccuuauuuacuagaagaauaaagugauguuaaauugacacuugcccuuuuaaaaaugauucuuaguuguuuguguuuauuuagcuuuauugagauguaauucacuuacagugaagcucuccauuugccccuaugaauucuucucugaguuguuuaacuuccgcucgccaguuggauuucaggcaugugugaucuaggacucaugcugccacaguugcuuccaaauacagcuucaagggcaacccccaaagccaccauggacuaugaugcuacugugacuagagcuaguauugugaccuuugaaagccuaaagaugcacaaggaaucugacccauaauggaaagcacuaguuaguuggcuucuuaaaacccugguucucuuggcuccuguggccuguugcugccuuauccaccagagggcaguguuccacucggcuuaacagucgaacccccacccccaccacccguugaggucuugccuuucaaaauccuaacauuuuagcuccugaagugaccccaaaacaguguuucuuaaaaucgugcuugguagaaauaaaucuuacauugcaaccaaauauacaugcguacauauacaacuccacauauguauauauaacaaaaguuuuauaaaguaauacuuuacuauguguaauauucuuucuuucuuucuuucuuccuuccuuccuuccuuccuuccuuccuuccuuccuuccuuccuuccuuccuuccuuccuuccuucuuucucguucuuucuuuugacggagucucgcucugucaccuggcuggaguacaguggcaugaucucggcucaccgcaaccuccaccucuccgguuccagggaugcuccugccccaaucucccgaguagcuauuuuuuuuuuuaauuuuugguagagacgggguuucaccauguuggccaggaugcuuucgaucuccugaccucgugauccaccugccucagccucccaaagugcagggauuacaggcgugagccaccgcacccagccucuauuuucuuucuugccuuuuuuuuuuuuuuuugagacaaugucuugcucugucacccaggcugcagugcaguggcaugaacacgguucacugcacucucaaccuucugggcucaagcaguccucccaccucagccucccaaguagcugggagcauaggcgugugccaccaagccugcuuaauuuuuguuuguuuguuuguuuguuuuuuuguagagacgaggccucgcugaauugccuaggcuggucuugaacuccuuagcucaagugauccuccaaccuuggccucucaaagugcuagcauuauaggcauaagcaacggugccugcuauucuuugauuuuuauuuuuauuuauuuuauuauuuuuuugagacagagucucgcucugucgcccaggcuggagugcaguggugugaucucagcucacugcaaccuccgcuucccggguucaagcgauucucgugucucagccucccaaguagcugggauuauagacgugcaccaccaugcccggcuaauuuuuguauuuuugguagagaugggguuucaccauguuggccaggcuggucuugaacuccugaccucaggugauccaccugccuuggccucccaaaguucugggauuacaggugugagccaucaugccuggacaauucuuucauuuuuaaaagaugcuuauugccaccaaaaaugaguuuauuauucacaaaucaggucauggcccacaauuuuacaaauauugccuuaaaugccuuaaaguucuuuuagucuaauacccuggauaguuauggaugaagagagguaggguuagagaugggacuuauccaggucacuaugggauucagagcaauaucuaggauggggcgucaggcucuggaguuuuaauccauugcuuuuugcccuguauuuuacacuuagaauuuuguuaaugggucuugguuaucccagugacauuguuguugaggugcauccagugcucaggcaggucacagcaacaauggcgugugugcgugcaugcgugugugugugugauguuccccagccccaugaacagcacaguggaauaucaucucagccacugauugucagcucagugcuggccucuagaagcuaagccuuauggaauccugcauguggauccucuuagaugauuucucuuaccugaguaccccugguggaccuggcuuagcaaugguuuguaugauagcucagaaaacaagcauuaaguccaucagcacauuauacaaauucaauaggcagagagucacuugcuacucucaaaggaucggcuucugaaaugcagaagguggaaguucucaugugaccccauccuugcucuguagaaugccacccagaggauguuugaaauugacuauagccgggacuccuuccucaaggauggccagccauuucgcuacaucucaggaagcauucacuacucccgugugccccgcuucuacuggaaggaccggcugcugaagaugaagauggcugggcugaacgccauccagacguaaguaggagggcauguggcucucaccuaggccugaacacccacucuggagagaagauacaacuguauuucucaggguggcuauuuuauugcucagaaaugggaaaugguccagugugauguucugggaggggcuugucaugagccggacuggcccuuuuucaaauaauuaacuacuucuuccaaucuucaauuuuaaucaucagaaaucauuaaauaaauagcuuaaaaaggaaaaggaugggggaagcaaacagaaguaacaaugauugagcacuuaccagauacagggcacuuuauacuaaugauuccauuuccucgagauagguauuauuguuccuguuuauagcuggugaaacugaaauuugcccaaggccauaucuuuggucagagguucagcuaguauuugaagggaagggaaggcaugcaggcagcuguagcacagguauggcuguagucauacaaaaagcuagguuaacaggagaaaagcauaacagauauguaaguuuuaucugacaugagagucuucagaaaagaagacccaaggaaaacuuuuuacacuuagauuccaugaaagguucugaccuaauggugguggacugaagugggaaacccucaaggccugccucaacagauucuucuuggccuuucuggguggcauuccuuccuucuggguauggagcaggaccccucugcaaugagggucuagaagggagaagggagaggugaccuuucuagguuuucuggcuugcuuugggagagagggguucuaauuucuaugacccacacugggggaagaugaauucugguuugacuugcuucaggggagaaggaggggugggcaacagaagagcaggagaaggccagagaaagaagauuugcuucuaaggccuuccgaucuccuuuaguucaaaguacuuagcaugccaaggugccauacuuugggguauuguuuucugagccccaauaacagaauaagccuugugcuuagguagauuucugaaacccaguuuggcuuugugguucugcugcgguaauuguauaacuucaggguguagaauuaucccaauagcuaucucucugcaucucuuuugcuauugcaaaguaacuaacuaacaggcaagaaaguugguguggcuggcugcucuggcucuugcagugcugauguggauugcugauaacuucucaaagaugaagagugagaaaacccagaggcagauuccgaagauagauacuuagggagaaugcgcucauuauucugguucuaaggccacuggcagagugaacccaaguucaccuguuuauaauuccgacagugaguucuggaagaccaagacuguuccagggaacccugaaaucaugggaucacacacacgcaaaaugacacaacccagggucuucaaagagagcuuugugaugguaauggauggcuccauauuuaacuuuguaucccaugcugucuguagguagacagaggagcugguagaagguuuugucauuuuaccuccugccacaugauuccugacaaaaucuuuugucagaggaucuagggcuuggaguuuuuccuacacguacuaaaaauuauuucuucaaaaaauaaauaugucucuuacuacuuuucagcaaaauauucuuauuuuuccuaagccucacauggacauauauaauuuuuauuuuuauuuauuaaaacaauuuuuuagagcuggggucuugcucugucaccuggcuggaauguaguggcucaaucauaguucacugaaaccuuaaagugggcucaggugauccucccaccucagccuccugaguaguugggauuacaggcacugcuaccacaccagcuaauuuuuuuguuuugcuuuguuuuuagagaugaggucucacuauguuucccaugguggucuucaacuccuggacucaagcgauccuacugcuuuggccucccagagugcagggauuacagaagagagcuacugugcccagcuauaauuuuuauguaauaggaauuagugcugauauaacucuggaguuuucuguuguuguuguugauuuuaagaaguguccccaugaagucugacuagcuuggggagcugcuguaaaaauucauaacaaggccccucccaagaggcugccaagcgggaaggucuauguguccugugguuuaugguucuacaccauaucuuucucuauagacaguuuagaaauuuauguaggauacuggauuuuugagcucuuuccccuuccacagagcaccucaauucaauuauuuaugcaaaauauaauuacaaaaagcuaaaaaccugacuuacaaacaaguauauaauggacauaugucagaaauuuauuuaacuggauaaagaaaaugugguacauauacaccauggaauacuacaaaaaucacaaaaaagaaugagaucauguccuuuacagcaaacuggaugcagcuggaggcuauuauccugagcaaacacagggacagaaaaccaaauaccacauguucucacuuauaagugguagcuaaacaucgaguacauauggacacaaagaagggaacaacagacaauggggccuacuugaggguggagggugggaggagggugaguuccccuaucguguacuaggcagauuaucugggugacuaaauaaucuguacaccaaacccccaugacacgcaauuuaccuguauaacaaaccugcacauguaccccugaaccuaaaauaaaaguuuuuaaaaauuuauuuaacuuauuacugaggaaacuagcuagaugguaaagcuaauucaaaggagaauuugaggaagggagguuuacggucagucaagaaagucauguucaaauaaaguuaucuuuagagauaaaacugguuaguaucauaaagggcaaugaaugaaaaagcaaccuuuagaguugucuucucuguaugacaaucauuuguuucucucucaggcaauaaucuacaaauuaaucuguaacuucaaaguucuucccuuaaucaauaguaaauaguaagucaaacaaaauaucuccccuggagaaugaaggaagccucagugggcccauuggacaguccuccauuauaacauggaaaggaaaugcagucacccuuuugccuuauauccaaauucuggauaauuuuucuuuucuuuucuuucuuuauuuugacacagggucucacucugucauccaguuuggagugcaguggcacaaucacagcucacugcagcuucaaccucccuagcuuaagcaaaccuccaccucaagccuccaggguaacugggaccacaggcauacacccuggcuaauuuuuuuguguuuuuuguagagacgggguuucaccauguuuuccaggcuggugucaaacuccugggcucaagccauccacccaccgugacuucccagagugcugggauuagaggccugagccacugugcccagccuuggauaauuuuucuuucaaagcgccuucucccucuuauccauguguuagcaauaguccuaaugaggcccuuuccccacgcuucuuucuucuugacucugccaaguauccaggaaggggcugugugugucuuggcagguaugugcccuggaacuuucaugagcccuggccaggacaguaccaguuuucugaggaccaugauguggaauauuuucuucggcuggcucaugagcugggacugcugguuauccugaggcccgggcccuacaucugugcagagugggaaauggugaguguggcuagacugggcucuaccuggugugugugagcuggcaggcagcagcucuggggcaaagggaauuaaagcagaccugcauuccagagagcauggggccugggacuguacccagcacaggugucuuuuaccuugacaaggugcccaggcagagaaacaggccagggucagggcaugggcucuccucuugguggucacucacauaccucagcuugcucaucuguaagaagcaguuaauggugucuucucuaucuacgucacaggguauuugugaaauuaaauugaaaaaucuuuaugaaaagggcuuugguccuuaaaacauugcauucaugcagagugaucuuaauuguccuacauuccaauuucuaauuucucugcaaguuauaaaccaaaaagcccagcucaaauaccccuugucccuugaagcuuuuauucuuuuccauaacuacuaauaguaauuucuaucuccucugagcacccuucacggaacagacauuauaauggcuuguuuucccugaacuagggaggauuaccugcuuggcugcuagagaaagagucuauucuucuccgcuccuccgacccagguagguuguuacagaugucuugagaagauuuauaaaagcuucagccuaggugcgguggcucacgccuguaauccugacacuuugggaggcugaggcggguggauuaccugagguugggaguucgagaccaggcuggccaaaauggcaaaaccucgccccuacuaaaaauacaaaaaauuagcugggcaugguggugggcgccuguaaucccagcuacucaggaggcugaggcagaaggauugcuugaacccuggaggcggaaguugcagugaaccgagaucguaucaaugcacuauagccugggugacaaagcgugacucugucucaaaacaaacaaacaaacaaaaaagcuucaacaauuuauaucaaaagggggagguauuuugaaggcugggguaccucugcacaaauacuuuugaaaguuuagugaaagucugaguguuuaucacugaccagugcauagcaacaaacuaaaccucuaggaaauuaggcuuugaacuacguaaccagaucuuacugauaaacugguaauucuuugaauugguauugaacccuguuugcgguugaccaacugacuucagugcuuucucuuccuauuuacuuagcauauuccacagccaaugauagcaccucgcuaaucaaaaugacaagucaggcauggugacucacacuuguaaucucagcacuuugggaggccaaaguggagggauugcuugagcccaggaguuugauaccagccuagguaacauagcgagacccuaucucuauaaaaauuagccaggugugcuggcacaugccuguaguccgggaggcugaggugggaggauugcuugagccugggagguugagacugcagugagccaugauuguaccacugcacuccauccugggcaacagagagggacuuugucucaaaaaaagaaauaaggucgggcguaguggcucaugccuguaaucccagcacuuugggaggccgagguggguggaucaccugaggucaggaguucgagaccagccugaccaacaugaggaaacccugucucuacuaaaaaauacaaaauuagcugggugugguggugcaugccuguaaucccagcuacucgggaggcugaggcaggagaauugcuugaagcugggaggcagagguugcagugagcccagauugcgccauugcauuccugccugggcaacaagagcgaaacucugucucaaaaaaaaaaaaaaaaagaaauaaaaacaaaaugacaguuucugggauggugucauuggauugcuugguagcugcaaugccuucuauauucuggccacuuuuauagagcaauguguaaaugauaguuuuuuucuuugucuuacuccaguaccuucauguuuugcacgcuuagcauauuauugguguuuucacugugguaacucauuuaaucuuuaugccaacuuuauguggcauguacauuuauuauuccuauuugacaauauaaauauagaauuuauuagaacuucauuuuauacggaaaaaaagccuuccugugacugagaagaggauacacuguucagucacucuuuucuucauucagcaaacauugcuuggauauguucuaugcuccaggcuuuguguccuguggcaaggauggucuuagucuguuuucuguugcuuguaacagaauaccugaaacugaguaauuuauaaagaaaagcauuuauuuccuacaguuauggaggccaagaaguucaagguggaggggcuauaucuggugagggccuucuugcugguggggacucugcagaguccugagggggcacagggcaucacauggugagggggcugaguguccuagcucagaucucucucccucuucuuauaaagccaccagucccauucccaugaugacccaugaauccauuaaccuauuaaucuauuaauccaugaguggauugaucuacuuaugagggcugagcccucaugacucaacaccucuuaaaggccccaccucucaauacuaccacauuggggauucgauuucaacaugaguuucagagggacaaacauuccaaccauagcagauggauacaggcacacugguccucguccccugaggagcucagcugaggagacaacuacaugcaggacaacuuuuaugagacuuuuacuucagaagguacuugucgaguccuguauauccugaucucugcugccagcccugguguaauaaggcugcacuggugucucuuuguacuaaaucauaauuuuuuuuuuuuuuuuuuuugagacagaguuucacucuuguugcccaggcuggagugcaauggugcgaucuuggcucaccgcaaccuccgcccccccggguucaagcaauucuccugccucagccucccaaguagcugggauuacaggcaugcgccaccaagccuggcuaauuuugcauuuuuaguagagaugggguuucuccauguuggucaggcuggucucgaacucccgacaucuggugaucugccugccucagccucccaaagugcugggauuacaggcgugagccaccgcacccagccagaaaacucagaauguuuuuaaaaaguuuacgaauuuguguugggccacauucaaagccauccugggcugcauguggcuuacaggcugggguuggacaagcuuguguuaaacuuuucuuguuuuccagauuaccuggcagcuguggacaagugguugggaguccuucugcccaagaugaagccucuccucuaucagaauggagggccaguuauaacagugcagguaacccuggaguugagcauggauggauugggggagggguucccauccaucuacauuacauaaaugauagaagugaugcagacaugagccucauaggucuguuucuuuaagagguaaugccacagauagugcuuuuaguucaauugcauuugggaaggcauugccauuuuugaaugccugcuauguggcaggcuuugugcugggugccuuguaaaugcuauucaauucuuccaaccaccuucuuuuuucagugaggaaguuugaaaagguuaagugacuuggcuaaggucacccagccagcagguggcagaauuaggauagcacccuaauucuguggaucccagaguuugucucucuguuucuccugcaauauuguuuucuggcagcaggcaugcagcguggacugaaacacuuugguaucggcacugccuugacagucagauaacccuggaauggaaaaggauauggucaauuggggcuggcuguuauguuuccucucuuacuuccugccccauucuccuucuucuauguguucuuggcucugcaaggacuaauauacugugggguacauugaacuuuaacaguuuuugguguugguaaaauuacuuaggugaaacauaaaaccauguucauuggacauugaccaaggaugccauggaugcucuuuuuuuuuuuuuuuuuuuuuugagagagagucucauuccguugcccaggcuggagugcaguggggcaaucucggcuuacugcaaccucugccuucugaguucaggcaauucucccaccucagccucccauguagcugggauuacaggcgcaugccaccaugccuggcuaauuuuuguauuuuuaguagagacgggguuucgccauguuggccaggcuggucucaaacuccugaccucaggugaucugcccgccuuggccuuccaaagugcugggauuacaggcgugagccaccgugcccggcuaugaccaaggaugcucuuauggaaaagaguaaagguuuuuuguuuuuuuuuuuaggagacagagucucgcucugucgcccaggcuggaaugcaguggcacaaucucggcucacugcaaccucugccucccagguucaggcgacccuccugugucagccucccaaguagcuggcauuacaggcgugcaccacgaugccuggcuauguuuuuguauuuuuaguagagacaggguuucaccauguugaccaggcuggucucaaacuccugaccucaggugauucacccaccucagccucccaaagugcugggauuacaggcgugagccaccgugcccagcuaugaccagggaugcuuuuauggaaaagaguaaaguuauguaaaaguggcugcauccuggacaucccagggaugcaaaguggcacucccuaggggagugugggccaggcuuccuucuuaugaacaguacuaugggcagcuuguggggauggaucauaguagggugggagcaugggcacugcuuugccuuucaggugucgguggacagaggugcugagagggcugcacuggccaggguguccguucugaggcuuuguggugggaggagaugucuucuugagagaggccagguugcugcucacagagggaugugugagucaccccacgugccccuaguuuuuaccaucuugugucuguacugguuaagcuaauaggaaccacauuuuccuacaugaagauaucaagucugaaacuugggugcgucuuugcucugcauggcugugucuucuuccuuucuucuggccucaggugcaaacccucuuuugaugcccucuuuuuuucagucucugccucuccuugaaucacuuucaauuucugcucacaacuuuucugccccuuuugguuuuggaaaugccacaaaaaguauaaucaaguauuaauucugcaaaggagaaugaaguugacuguguggagauauuucuucuuguguccaucccuagcaaccucagaugacuuuaacuugacccuggguccugccaggugacucugucccccuccuccuccuccucuccccuucccaucuccacaugcuugaaucccacuaaucauuuuugccccuuguuuacaaaauaaacaaguauagacauaagaaagcagaaaaaacauaauuguuacucaaaccucaggagccauagcaaagcucuucacauuuugggaguuuccuugaauauuuuuuaugccuuuuuuuucugcuuucuuacagaguaaguucauucugugugaccuauuuucuguguggcuuuuuuugcuucauucuuugucaugagcacuuuuucauaucguucaaaauucuuucaucaucuuucaugguuguccuacuuaccuucugacgcacaguuccuauacguguuccuucugucuggaagccaucccaguugacauauuggcuuccguaggacuuucagaaccgucacugucgccuccuuuugugaagcacaugugggagcaguuucaucccugacacacugugucucuagucuccuggccuuccacgccucugccugguagccaugagggcacaucaugcauuugugcacaucacauacccaccgaacggcucuggaauggaauagaagcugauugcuuugauaagaaggaaccgggggauuuguagacaguaauucuuuucguuguuguuauuguuuuuguuuuuugagacagagucucucucugucaccaggcugagugcagugaugagaucucggcucacugcaaccuccaccuccuggguucaagugauccuccugccucagccuccugaauagcugggacuacaggugcgggcaaccacgccagcuaauuuuguguauuuuuaguggagaugagguuucaccauguuggucaggauggucucaaucucuugaccucaugauccgcccaccucagcuucccaaagugcugggaugaaagccaugagccacugugccaggccuguaaacaguauuucugugugugaagauuucuguaaaagggccaaggcugauggcucaaugcccguaaucccagcacuuugggaggccgaggcaggaggaucucuugagcccaggaguucaagaccagccugggcaacauagugaaacuccaucucuacaaaaaauuuaaaaauuagcugaguaugcugccaugcacccguguucccagccauucagggggcagaggcaggaggaucacuugagccugggagguuggggcuguggugagccgugaucacaccacucacugcacuccagccugggcaaaaaagugagacucugucucaaaaaaaauaaagauuucuguaaaagcugauuucugucucugucuuaauucauguugaaggguagaaaaugguggcuuuccucaauucuugaugcugguuuucucucucagugcucagaguuugagauggccagggaggagcuacguguuugcagccaggguaaaaaugagucagaccagaaggcuuaaaucccugucugagaacauuuagggcccucaacacuguuguguuacagauacaggaaaccaggucugugcuuuuauucaucgucaugauucagucagauaugcagauguuucucuuuuggggggauuagcugagccagugccaccuaugaugguuugcauauguggauguuuaucucaguuucuaccugaaaaagcuaaagccauugauaauauccaaggugaaaauaauuaggaguggacgaccuuccacccacaacuuaacuucauccaauuaacagggcauucaucaugagguaauaagccuauuuaugacuguuuggaagaucaacaucuuuaaaagucucuggugcuuaaggagcuuacagaauggagacaguuacucuaaaacaaagaccugcaaauuauggcugccaccuacauuuuuuuguaaguaaaaguauauuggaaucgccacaccguuuauauaucaucuguggccgcuuuuguacuauaguggcagaguugaguaguugagauggagaccucuauggcugcaacaccuaaaauauuuacucucuggugguuuuuuguuuguuuguuuguuuguuuguuuucucugucacccaggcuggaauccaguggcgcaaucucugcucauggcaaccucugccucccggguucaagcaauucucgcaccugagccucucaaauagcugggauuacaggcaccugccaucaugccuggcuaauuuuuuuuguauuuuuaguagagaugggguuucaccauguuggccaggcugguuucaaacuccugaccucaagugauccacccgccucagccucccaaaguacuaggauuacaggcgugagccaccacgcccagccugguguuuuauucaaaaaguuuguugacuccugcucuagaaacaucgguguuccucugaaccuagccaugacuuuuucuauggguuuuucaagccuuuucauuugugugucucaccuacccccagccuucacccaccuuuuuuuuuccuaauugguaguaacauagaacuugaguagagucuuagcugcuaacauuuugagcacuuacuagaugccagaucugugcaagguucuagucauguauugacucaguuaauccucaugauaacccaucgaguuagguacacuuuacagguggagucccauggguaggaaguggcagagcucagauuuacauguagacaguugggccccugccagccgugccugugacuagaacucuaagcugccucgcaauugugcuuuucucgcucucucaaaaccuaaccaaauuauguguacgcauuuuuuacaagccuguuuauuuuagaguauaugauacaaugaugauaauggauaaauaagaccuggaaaagcaagaugauaagaaaaccaagguuggguuugggcaugggggugagcucaagagaacaugagguacagaggcugugagaccauuuaguugcuggagcuaacuuuuaagaucuuuagcucugaauuucuugacagccagaugauaaaaaggagacacagucauguaaguagcacuuauaaaggaggagaaaagaacuuugccaguauuuacaaagcuuuucuuagcauuuaucuaaauuauugcaaaaggaacuuucauggaacucaucaaugggaguuuucuacucuuguaagcagcaaauacuuccucuuccaggaugguuucaugaccagugaagucucuguccugggcaugcgugcuacagucuguuuuacuucuugaaccccaaaucugaaaguauugccagagggauccucucugagagaaggaucauucaugaaaccuugugggaggcaggacugugcagauaacgacggcagcauuuaauucauuuuugucacucaccauucuucucccacucuccaacucugcacguggaugaaauugagcuguuggugaugucaaauauguaggaauauccucuacccauucccuucccaaguucagagccuuuucuucuagagcuaccucgggcugucccuccaaggaaccuucccuaacaaucucucccaggcacucaggcuaagcaccucuuuucugggacucacaguuucuugugcuuacguuuaaagaucauguauucccaggaucacaaauauuuuuguauuaugugcauguuaaaauguuaugguuggguauuuuuuaauuuuuuauaaaugaaauauagcauacauacguaaaugcgcaguaugaugaaucacuauggugugaacacccacauaaacaccaaccaaggucaggagacagcacguggccagugcccuagaagcuucccagguguccuuguugaucauacaccauuucgucccacuguccugacgcuuaugaccaucaguuuucugcuuuucuuuauacuuuuaccaccuauguguguacucagacuuuauaguuugguuuugauuguuuugaauuuucucuaaaggggauuguacuguauguauuuuucagugucaugcuucuuucacuucacauuauauuccugauucuuugguguauuggguagagcugaaguucauuuguuuuauugcuucagagcaauguuucuuaaccugauuuuuucaucauugcccccaaggaucccuuuuaaacuuuuuuucuaauugccuucuccucuccaccaugaaauuuuauuaccugagauauuguauauugguuuauuugcucuguguguguguguguguguguguguguguguguguguguguguguguauguuuuauauaaauaaggaauaauuuuuuuuauccccaaagcaucaauuuuuacccccuuggggaugcuacccaccucacugggaaugcaugcuucagagcagggaccccacccucagcacuauugccauguugcaccugauaauucuucauuguggggcuucccugugcacugugggaugucuggcagcaucccugggccucuacccacuggaugccaugagcaugucugccgagguaugacaaccucaaacauuuccagacauagccacauguccccuguggggcuaaagagcuccugguugagaaccaccgauguuauugagcacaaacugaacaccggugugugugugacagcaggucaaauaaacaugcugugucugucccuggcauucacccuucuucuuauugccauggagauuuugcauaguauauuaagggaaaacacaauuacaauuggugcauauaauaugccaguuuugagggaagaaaacacugcuguauauuauuugcguauauuuggggagugugugggucuguguaaaucuagacggcuguauacuaaaaugcuugcagugauuaucucugggcaauggaauuaauggauacuuuuccuguuuucuuuucauuuuucuagcauuucuaccaugggaagguauuauuuaugugauguuuaaaguaucuacuuucuauucuagggaagaauaccacuacaaucugaacaccaguuugguguuuuuuguuuuucuuauuucucaguggugggagaggguuaauaggagguaaacuuuuauggugaauuguugguguuuuuucuuuuagucaguuuugaggucugagugaaggaaauuuuuccagcagucauuaagccuugucaucuuagcagaugcucagauauuuucccacacaaaagcuugcauuaggguggcuacauuaggaucuccucauuuuucccugcucuuuuuucacucacagguugaaaaugaauauggcagcuacuuugccugugauuuugacuaccugcgcuuccugcagaagcgcuuucgccaccaucugggggaugaugugguucuguuuaccacugauggagcacauaaaacauuccugaaauguggggcccugcagggccucuacaccacgguggacuuuggaacagguugguguuuguaguaacagaaauugcagcuuaaaaucagcuuuuuacucagucaguugcucugggcagcuguuguuauaagugucaugggcagauugagauuuuucauguuuucauuuuucaaggaacagguagaauagaauacuugcaccccucaguaacagaggguuaucuguaggccaagagcuuccaggguagcugcauuuucagcacugguggagcuagccuggaaaauggaguacugcuaucucaggggcuaggcuggcccacccaagaugaagaagcagguaggcaucuccagcugugagaagcucuaccuugaggcagucaccuuuuaggcugugucuggggcgcgcuucucugcucuuucugcccucccuguccucccaccuuggcaggacacucgggguuaugccuuggcuguagccaaccuugaggucagccacuggcugggaacuuaccuuaugcuuuguugucuuucugcauaacuuagaacacugaacugucagggcuggaggugguuuggcagaugcuacaaaggcuaugccagauuccuuacacagugcuguguaaacuguggagaugcugcaagugaagguuacagaugggugggcaaugugguuaggaugcuucuggccauaaguaauauuaagagagacuucauuuaggagaguggcuuucauaaaggauaugacagcuguauucguccauucuugcacugcccuaaauaaauaccagagacuggguaauuuacaaagaaaagagguuuaauggacucacaggcuguauaggaagccugguggcaacagcuucuggggaggccuuaggaaacuuaaaaucauggcagaaggcaaagggaaagcaggcacgucuuacauggacagagcgggaggaagagauaggaagggaagugcuacauacuuuuaaacaaccagaucucauaacucauucacucacuaucaggagaauagcacugaggggauggugcuaacccauucacaagcacuuugcccccacgauccagucgccugccaccaggcccuaccuccaacacuggggauuauaguucgacaugagauuugguggggacacagaucuaacacagauccaaaccauaucaacagcuaaaugucugacuggacuuuuuuuguguguguggcuaugaaagacauuauugagaaauugcaaucuuugaauaaagucuguagauuagauaagaguacuguaucaguauaauuuccugauuuuuagaaguauauuguguuuauuuaaagaaugccuuuguucugagagaaugaacacugauguauuuagggauaaagggccaucacaucugcaauuuauucucagguggcucagaaaaauguauauuuuuauagagaaacugauaguguauaucuaguaaaaugcuaacaauugggaaaucuaggugaagggaauaggagaguuuuuuuguacuauucuuacaacauucuguaaguuugaaaucacugcagaauaaaaaguuacaggcuaggcaugguggcaagugccuguaguccuagcuacuagggaggaugaggugggaagaucacuugagcccacgaguucaaggcugcggugagcugugauugugccacugcaccccaagcugggcaacagagcaagacccugucucaaaaaaaaaaaaagauacacacacacaaaaaagaccaguuccuugaguagcauaaagacccugauguucuccccucugagguaaaaggcacuucaugugcauugcacagccaauguuugccucucuuaagagggauguacagaagacugaaaugaggaaauuagccugguguugcuuuuuuuuuuuuuuuuuuuuuuuuuuuuugagguggaguuucgcucuuguugcccaggcuggagugcaacgacccgauccuggcuuacugcaaccucugccuccuggguucaagcauucuccuaccucagccucccaaguagcugggauuacaggcaccugccaccacgccuggcuaauuuuuguauuuuuaguagagacaggguuucaccauguuggcccggcugguuucaaacuccuaaccucacaugaucugccugccucggccucccaaaguguugggauuacaggcgugagccaccgcgcccggucuguagucacauuuuuuaagagguucuucuaccuuaucaaaaaagagaagaacagaaaagaacugaccuuaagugaauggaguguuucgagagcauuuggugauaaaaggacucauccguuagguugguuagguuggugcaaaagugauugcaguuuuugccuuuuaaaaaaaaaaaacgggcccagcgcagugccuccuaccuguaaucccagcaguuugggaggccaaggcaggcggaucaugaguucaggaguuugagaccagccuggccaacauggugaaaccccaucuccacuaaagauacaaaaauuagcugguacaaaaaucgugguggcgcacuuuuguaaucccagcuacuuaggaggcugaggcaggagaauugcuugaacccgggagccagagguugcagugagcugagauugcgccacuacacuccagccugggcaacagagcgaaacuccaucucaaaaaaaaaaaaaaaaaagaaaagaaaaccaugacaaaaaccacaauuacuuuugcaccaaccuaauacaaagcgcugcagaggaagugacaugccgguuuccuccugcuuuggccaggcuucucaucacagcgaugaaaaagcacggcauuuuucuguugggaggaacaaauugaaggugauuaugauuguguuuuaagcauaauuuguaugugaggugacagcgugacugucacugcuagggguuggagaauagacaaccacaaggccagggugccuggggcagaugggcccuccagucugaggcuuuugccagcuucauugcuuugugugggagaggggcauugcccgaugggucucaugagaacaguguuuaaagagcugaaugccaccuaaugcuuaauagugagaaagacagccaaugagauucugcucuuucucaaucagcauauucuguccugaaagcuggccuuacagagaagccaaaggcccaucucagagcaagugguuaucagagggucuuggcuggggccacguccacccugggauaccugcugugggaacuggguugugaaguguggggccagggcauucucugcucggguugguguggacacugcucaugcuuccucuuuccccaguguuuggcagcccauuccuucucuguggagaaauucuuuuuuguuuuagaggaggaagggaaaauagaagacacgagaggcaagacaagacaccccuaaugggacauuucaugaggaaaacuugagagcaagugguuuggaauggcugauguacaaauuagaauccagaguauauuccauuauucagggguaaacacaauuagagcccccacaucccuuugauuucuuaauuaacuggcaaauauuugugguaguaucauguguaugguguuauugaggcuguaaguaucuucaaaccaggcucauccuguggggugcauccaggucaaccagauguucuugugaagagauaagcccacaagauauguguccaggcccuggggaaacacagauaaagaagacaggccugugaagggaacucuugugcagacaggaaaggccacggggaccuccucagagaggaagcaauguucucugguccacacacaucuucaaauggguccaaucagaagcuagcuuggaaguauuccaggcccauggggugugggaagggaaaggggccugucuuagucagugugggcugcuauaacaaaauaucuuagacuggguaauuuauaaacaaaagaaauuuauugcucacaguucuagagguggugaaguccaaaauuaagaugccagcagauucagugucuggcaagggcuugcucucugcuucaaaaauggugccgugccuucuugcugugcccucacauggucaggaagcuccguugagccucuuuuuauuuauuuauuauuauuauuuuuuuuaauaaaaaaaauauuuuugagauggagugucacucuguugcccaggcuggagugcaguggcacgaucucggcucacugcaaccuccaccucccggguucaagcaauucuccugccucagccuccugaguagcugggauuacaagugugugccaccaugccuggcuaauuuuuguauuuuuaguagagaugggguuucaccauguuggccagguggucuccaccaugccaggcuggagucuguuuuuauaggggcacuaaucccauucaugaagguggagcccuuaugacuuaaucacuuccaguggccucaccuguuaauacuaucaucuuggguguuaaguuccaacaugagaauuuuggggggauacuaacauucugaccguagcagggcuucaggcccgagucccaugaagggcucuuguuauuuaacuucuugucauuuccacgacugaccuaccuucucccucuuacaauuuucaggcagcaacaucacagaugcuuuccuaagccagaggaagugugagcccaaaggacccuugguaagaaucgagggugagguguguguuugcagcuguuaagagagaaaaguuacaugcugcugaaacugggcaguaggcccuugauguuuuuggcucuggagucagcagcuaaugggauuguggagucauagccauucuggacaugugaaugacagcagaaacaauguuucuauuugaaauugagcuccugcacugggguggaacagacuggggaccaacaugaauggccuguuacacaucagguucugugcuccugcauccuggucucaucugguccucagggcaacucucauaaguggucuuauugucuccauuuuuauugaggcucagggaaccuaugucacuugccagggucauauagccaguguguggcuaagccgggaugguuggcaagcugcaggugggugucaacaaucuaucaauccuucucucuccguucuucccgucuuuggcugaaguugcuauucuuguugucacucagcccaguuuaagggguuaauauccugcgccuucucugcacuaggucagacugccccaccuguguacaagccugauuuauaaaacagccuuuucugagucuagucucugcuuagugagcagugcagacccugcauucauagacuuuggguggagcuauuuccuggaaccuaaaacaagaaguccccacaagaagguccagacuucuuuuuuguucucuagaccaaggcuuggcagggcaaugcccaagaaaaacaugaaguguuugaggccugcuuugcagaauacugggacaagccuuccucguuauaaaucaaccugagaucugaaaaucuggauucauacaaagguugaauuuggagcuguuauuuauuuauuuauuuuuaaauggagucucacuauguugccagacuguaguacaguggcgcgaucucagcucacugcauucuccaccucccggguucaagcgauucuccugccucaggcuccugauagcugggacuacaggggcgcaccacgaugcccagcuaauguuuguauuuuuaguugagaugggguuucaccauguuggccaggagggucucaaucucuagaccuugugauccgcccaccucggccucccaaaguacugagauuacaggcaugagccacugcgcccggccuggagcuguuauucuauaaaaauauuuugcuacccaguuucuuugcccaacaagacuuuccuacuguguuuaaacaggggaucagcuaucuaaauuuuaauauaggcaccacuuuucaggaauacuugcauuguauaagaugagaucuacuuuagguuagaaccugaggacugaacauaggcauugcugguauuggaagugcucacuggggggcgucucuggguuaagcagugcaugucagcaugucaacccccuuuacaccugucauagauggggcauugcagggaagcccuggcauuggaaggucauaagucuauccuaagggcuacguucuuuuuuuguuuuagaucaauucugaauucuauacuggcuggcuagaucacuggggccaaccucacuccacaaucaagaccgaagcaguggcuuccucccucuaugauauacuugcccguggggcgagugugaacuugugaguguucauugccugaggggagggugcccucaguagccaugggcucacagugaaguaccguguucuuuuguuuccuuguagguacauguuuauaggugggaccaauuuugccuauuggaaugguaagagcacuuuaauaucuguagaaacuuaugcuagaauguuucuguugauuaauuugaggaggggugugcccacagacaauuuuauuuuccuuuuuuuguuuauccucuccuaaauuuucuuuuuuuuucuuuuucuuuuuuuuuuuuuuuuguagacagucucacucugucacccaggcuggagugcagugguacaaucucaacucacugcagccuccaccucccagguucaagggauccuccugccucagccuccaaguagcugggauuaugggauuacaggcaugcaccaccaugccuggcuaaguuuuugcauuuuuaguagagacgggguuucaccauguuggccaggcuggucuugaacucuugaccucaagugauccucccacuuuggccucccaaaaugcuaggauuacaggcgugagccaccaugccuggcccuaaauuuucuaacauauaaggauuaccuauguaauuuuaaaaaauaauauuucuuacuuuuuuuuuuuuuuuuuuuuuuugagacgcagucucgcucugucgcccaggcuggagugcagaggugcaaaucuuggcucacugcaagcucugccucccggguucacaucauucucccaccgcagccuccagaguagcugggacuacaggcacccgccaccacacccagcuaauuuuuguuuuuguauuuuuaguagagacgggguuucaccguguuagccaggguggucucgaucuccugaccucgugauccaccugccuuggccucccaaaguucugggauuacaggcgugagccacugcgccuggacaaaauaauuuuuaagggaaauaaaugugagcauuuagaagccuuacuguuuuaaaccaggguaguugggcaggcuucagucacagucuauaacuguagcuuauuuguucaaauauucuacuguggucucuuucuuuuaacguuuuguuuuguugagguauaauucacaaaccauaaaauugacaauuuuuaaguauaugaugcagugguauuuacuguauucacaaaguuguguaaccauuaccauuaucuaauucagaaacauuuuaucaccccaaaaagaaacuccauacccauuagcauucauuccacacucucccuccucucagccccuggaaauaauauacuuucugucccuguggguuugccaauucugaacauuucguauaagugaaccacauauauacaccuguaugacuucuuucauuuagcccaauguguucaacgcucauccacguuguugcacguacuagugcuucauuccuuuuuauugcugaauaguauucccuuguguggauguacaguauuuuauuuauccauucauugguugauggacauuuggguuauuugcacauuuugguuauaguguugcuuugaacauugauguacaaggauuuguuugaauuccuguuucaguuccuuuggguguauaccaagaaguggaacggcugugucauaugguaacucuauguuuagaguuucaggaacugccauaguguuucccaaaaaggccacaccacuuuacauuucuguauuuuuuuguguaggaaaaauuaugacaaaauuuuucuguaacgucuuugauuuuuguuguuuuuuugcaaagacagaugaugcuguacuggcuuuucgcuaagcuucauuucccaccugucucuuuauuugcauuuuucucucugaaucauggaggaugcccagcuguugaguuuugaaggcuuaguuugggccuaaaucucucaggaucugaaauuggauacuaucagcucuuaaugaaguuucuccuuugaacugcuaucuuuuuugcaggcugagaugggcuaggagaagacaucgcuuacaagcauuaucaauuuuaauacuauuaguagagccaagaaaugaagauauugcaaaacucaaaugucacugcauauaagauaauagugugccuggggcgugucugggugggugaggggagggagagcaucaggaugaauagcuaaugcaugcagggcuuaauaccuaggugaccaggcugggugcgguggcucacgccuguaaucccggcacuuugggaggcugaggugcguggaucacgaggucaggaguuugagaccagccuggccaacauggugaaaccuugucucuacuaaagauacaaaaaauuagcugguugugguggcgcucaccuguaaucccagcuacucgggagacugaggcaggagaaucacuugaacccaggugguggagguugcagugagcugagaucgugccauugcacuccagccugggugacagggugagacuuugucucaaaaauaaaauaaaauaaauaccuaagugaccaguugauagguguggcaaaccaccauggcacacguuuaccuauguaacaaaccuacacguccugcacauauaucccggaacuuaaauuaaauuaaaaaaaaggaaaagauaauagugugccaagguuggucacugauauuuuagauaaucccucuguguucaucuuaugagaaacaguugagaccuggugggugccuuuuucacuuaguagauggggauucccccuagcugccauugaugggaucgggaccaaucauccgauccaggaaaaaaggcaucguuuuuggaacuuuaugguucaugacacaauuuuuuaaaaaucuuacuguuauacuuaaaauaacacauucaucuuaaaaaaaaauuggacauuauagaaacugucagaacauaaauguuguccuuaauccucucuccugccccucccucugccauaauccauagaauuccccuuucuuccucuguugccuuauuuagccugcauauuagccucaucuuaauuagagauuaucagcaccacuuuucagauaagaauagcugaauacaaaaaaaaguccacacguuuucuguucagcuggcaaggggugaagcuuggacuggaacucaggugguggugagccagagucacugcgcuuuggaucacccuuugcacccuggagccccugagccagcccccacacccaccccacuguguucugccaagccucccugaagcugcuuuuugcccugucucuuugaggaagugagagaaggccagucuguacuuagcagcuguucuucaggccagcuuccuagaggagagcagggagagaaaggcaucaggaguggggaguucacugcccaucccacccacaggaacaugcaccugccugugcaggugugugucuccuuccuccacaccuguguguguccacagcugugugauggcugccuacaggguccaggcgcuccuguacuucucacacaauguggaauguugaugaaugcaaagucucaccauuucuuucaccuucccaccucacacccucuuaaguggccagaggaggcuugaaucugcaccauuucucugcgaugcugcccuuugguggucuaaaaacacccaaaguaagauucugccaguagaacuagaacaaauacuuagucuuccaauccauccuuaaacccacuggacagcuucccagccugggcucccucggccuguaaagugugcuucuagaggucacacuuucccaacucaaccuggcaacccccuccaugcugggcucuggcuaaggacucaagggcaagugaggcacagucucugccccugaggugcaagcaguguagcauggagagagacauaacaaauaagaaacacagcacagcaugggugacuaccacauuagaagcagacgagggccacaaagaaggugaguuccuugcagcaacggauguggguuuuuuuuuuucuuugugucucacaggaagggauguguuuuaaccuaugaaucccuuaaggcaggcagaccuguuggcugugaguugucucugauuaauaagaaaugggggaaaugguaugacuagaucaguucaguugguugagugguccagaucuuucaaaguuuagauucugugcagagaacuaaugaaaaagucuuuggagcugaccugcuugaucugauccucagccuugcucaucugucaccuccacaaccaguaggucacccaagguggcuccaucauuggugagcugcauccaaggaauuuauuacuaauccuagguaaacuaucauguuuugugccucauugauguacaaauuagguuggacaaaagacuauuccuaaaauaacuucauucucacacacuugcauugcaauaugcucucugaaguagaggaggaaggcacaaagccuugcuggucuauggauggcagcaucagcgucaccuggacaccuguuagaaaugcaguuucaggccccacuccagaccugcugaauuagaaucucugggauggggcuuaggaaucuguuuuaacaagcucuccaugugacacuuaagcauggguaaguuuuugaaguaccacccaauguugcagacaaccucauaccugugaacaucaucccugacaaggucgggauccucuggucuagaccccgccccuugcacagugacugcaggggcauuuguuuuucuaguccuuuuguauacucaguguuggcauuauccauuggucuuuguuguaggucaaguucccagggaaacagacucugagauuaccugguagaaagcuuauugauugugcucucuggagcaaugccuguaggauagagagggagaaguggggcuaugaugcagcuucacaaguggccucauccaaucuuagagggagcucugcagcuggguuggcuguucgaggcacauuggucaguuguuggaugugggcuaucccugaggguuguaaccuugggugaggcagcucagcacaggccagcacccagagacggacacaucugagaaaugucagcagacaacagcccuagcugcugggagaaugagugagugcccugguucuaaagggggauccaagaggugcaccacagccccaucgacagucuuuguagaugcaacaaaggcccucggauuauguuugaaccucuguggcugaugugggucugcugucaucucccgcuguguuugguuuaauaagcccuggguuuucugcugauccauggccuagucaucugugucuucaccacugagcuuuucucagccacagcuugaggacgugaaaaaguucagaguugacaggauuaacagucagagaugggggucauaucauaagcccugccauuacugcuugugagguguuagcagauuuuuguggggagcuucagauucccugcuuguccagugggggugauaccugcuagaaucacagcugugagcuucuguagagaguggauggaaagaguccuugguaaacucuaaggugccugguaacugcuaccuguagaaagaaauuccuuccucuaaacguugcauccugagggucacgucugugucucccaacaagugguuuuaaugugucuucuaguuuucucucucuacagugcugagcucauggaucccaaagaacuugucccagagcugcaccaucaguaauaacuaguggcacauuuuugucuucuaggggccaacucacccuaugcagcacagcccaccagcuacgacuaugaugccccacugagugaggcuggggaccucacugagaaguauuuugcucugcgaaacaucauccagaaggugggugcuuuguaugagcuguggugggcugaucuuggacagagccucuuuugaacucacuguggcucuguggacaacuuccugccuggagcccuccuguuuaaaaggauggaugaagggaggcaucagcuagacuuggguuugcaucuuguacccacgugguuaagagugagucuaugagcagaugcuuauaggagaguaggagauauaagacauguauuuaaaaacugcaauauauaauacaguguuaaaugcuacuuacagauucacuucuuauauggugagaauucacccggggaaauuucugucuccauuuucuucuccuuccaggccagauuaucuuuccaaaaguucaggugagagguagggugaugggagagaaugcacagauccucuugagacuauagccccuauuaaggcagcauggauauaugggagccccuauccuugagacacagcuaauguacuucaauaucaaaagagguaaagcuaagcucugguuucuuuauuuaaugcaucaucugaaaaaaguaaguuuccaguaaccaaaguguauaagaauuauuucucacuagaaaauaacuccguccuuauuugcaagagagaagaagauaaacuauuuuccuuuuuauguguggcccaauauacagacuaugugauuucagaaugaggaacaccagauuuugaaccuggacacuauuucuucaaccuuaagccaauuguguaaauucccuuuauauaaaaguagagguagccguacuuaccucacagacuuguacaguuuaaaaauaaauggcacucaauaaauguuuguuuucuucuuucauagucaaauaaaugaacaauaauuauuuauuuaccuaaaaaaaaaaaagagugagucuaugagcaaaucagucuacugauuguuaauuuguaaaacugggauuacagcaucugguugugcuguaaagcuugaaaagaacguauguaagccauccaggacaguuccugacacauauaugucuaauaagugguagccguuaacuauuauuuaucuuaaauguaagaaaaugugugucuacuuaaauagcugauguacauaggaaaaaaaaucuucagauacugugaagcauggugcagaugucagcugucagugaagcuucauuuuucuauuuggagcaagugauugcuguuucuggacugcaucugaacugcuuaguccugcuagcguuguacccuuuugaggcaccuaaugcaccuaggugggguuuccugucucugcuguggguuaaaagaaaaaacccacaguuuuuaugcucagucaccugaguuuugaaguuaaaaaaacaaagguuuucugccuauaaaugguaugguuuuuuuuguuuuaaguaugaugucguuuuaauuuuaagcauguguuaaaaugaauauuacaaauuuuuuaaauauaaaaaauacaaucuagacuuaccacacuuauaauuuguccauuucaucuaaauuuucaaauguauuguuaaaauguugcuuauguuauuccuuuauuauggguuuaaucuccacagaauuuauaguaaugucucccaagcucucccuuguauguuuguucuguuuugaagcuuucuguuccuaucuuuauuauuuccuuccuuuauuugaagcuuagcuuuuuaaugcagccuuucuucuuuucuaauauaaauauuuaagguuauaaauuuccuucaaguacugcuguggcuuuaucucguaaguuuugaugugcaaucuauuucuuacuguuugcuucuaaacauaucuauuuugauuucucuucaccauugauauguguuuuuuaaauuacuggaaauaaguacuuuccuguuuuuuugauuucuagucuuuuugcauucugguuagagaauauagucugugauaccaaucccuugaaagcugcugagccuagucuuagagccugacauacaccaauauuaauggucaaugugcgcauaaaaagaaaguauauuuuacaguuguugacuauauucuacauacauguucaucagauuaaguuuauuaauggugccauugauaucuuugaucugcuuccuaauuuuuugucaguucagucuacuauuuagugagaguuguccucauguauuucccuuuguagcucugccaguucugagguuauguuauuaggugggcaaauugagaauuacauccuucaguacuuaauaguaaagggauuauauaacccucuauuucuaauaaggcuuuuugccuggaagccuuuuuuuuuuuuuuuuuucuuuuuuuggucuguuauucauuaacaccauuuaccugcauacuuuugcuugguauuuuucugagguaucuuucccaaugcuguaauuucauccuuuuuauauccuuuguucuguuuacaugugucccuuauaaacaggauauaaucgaauuuuuaaaauaucuaguuugaaauuucuugucuuuuaacugauauauuuauacauucucauucauuguacuucuugauauacauagaugaauuucaauuaucuuauuuuauaauuucuauucguuuaccuuuuuggcucuuucuuucccuuuauugcuuucuuuuagauugagguuuuuuguuuuguuuuguuuuuuccucuuauuucuuuccccccucuucuacuuuggaaguuauucacugcauucuaauuuuuuuagugguuaccauuuaagugugacaucuauacccccagaaaagaacaacucguaguacacagcucagugaauuuaggcaacgggagcgcagcccugugacaaacacauagcuccccggaagccccucuaaugucccucucuagucauugacacacauacccauuccugagcucacagcuguccucaccucuaucaccagagauucauuuugcucguuuuuaggcagcaaguuccuacaauauacacuccugugucuggcugucuuguaauaguuuaaaauuaaucaauaucuuuacuuucuccauauugcaucccucuuuaacuuacuguaacuccaauuacagcccucuugauuuguauguuauuauugucauguauuuuaauucucuggguuuaguuuucauguauuuuaguucucuccuuaaaaaauaaaacccauggggcauuacuacaauggcuucagauaguauuucacuugacccacauaguucauuuauuggcaaaugauuuaacaaacauucaucaaguacucugcaugcgccagguugcaguuuuaggugcuugguggcuguaggcuuuccugaaaagguggagcucaaacaaaaauuuuaagguggugagagagccauguggcauaucuccgccuggacaagagcauuccaggcagaaugcagccagugagaacuugggaagguauauggcauuuuuaaagacuagcaaggaggccaguguggcuggagcccaguaaaugaagggguaagaaguaggagaggcugugcgcgguggcucacgccuguaauccaagcgcuuugggaggccgaggcgggcggaucacgaggucaggagaucgagaccauccuggcuaacacagugaaaccccgucucuacuaaaaagacaaaaaauuagccgggcauaguggcgggcgccuguagucccagcuacuccggaggcugaggcagaagaauggcgugaacccgggagguggagcuugcagugagccgagaucacgccacugcacuccagccugggcgacagagcgagacuuggaaaaaaaaaaaaaaaaaaaggaggagaugaggggucagggauauagauggggaacagaucacauggagcauuacaggccauuauaagacuuuggcuuuuacucugaauguaaugggaauccauugaggaguugagcagagccguuguuaaagcauucuauuaaagcagauuccagcugcuguguugagauuagacccugggaggugcggcaaggguagaguaggaagaccaguuagaaaguuuuugcagccaucucagugagaggugauuguggcuuaugaagguaguaggaacuaggcaguuucagaauauauuaugaaacuagugcuaauauaauuuucagauggggaguaugaaagagaggagagucgggugacucuaaaguguuuuaaauggcaacuugaaggacagaguuaccauuuauguggggggaagaucaggaguucaguuuuggcugugcaaaguuagacuugucuaguauauguacuaguggagauguagaguaggcaguggauauaugaaugcacagcuugagacaaaggucugguaccuuugucccaggaccacacuuuucuuuaucuucuauugcuucuucugccugaaguauauucuuuagaauuucauuuaguaagcaaguuauauuaauucuucuuugucugaaaauuuuuuuuucacccucauuuucaaaaugcaguuuuucuuuucuuucuuucuuuuuuuuuuuuuuugaagacagggucucacucuguuguccagaaugagugcaguggugagaucuuggcucacugcaaccucugccucccagcuucaagcgauucuccugccucagccucccaagcagcugggauuacaggcgugcaucaccacaccuggcuaauuuuuguauuuuuaguagagaugggguuucaccauguugaccaggcuggucuugaacuucugaccucagaugauccaucugccucagccucccgaagugcugggauuacaggugugagccaccaugcccggccucaaauuguaguuuuucuaaacugauaguuuucucucagcauacugacuuugggcuuuuauuguugcugcugagaagucaguuuacuguacucugucacucucuugaagauaaucuaucuuuccucuuggacagcuucugagauuuucucuuuauauuugacgcuguauaguuucucugugaugaaucuaagugugacuuucuuuucguuuauccugcuugguaguuuuggaacuuguggcuugguaucuuuuuucacuaguccuaaaaaguuuaugccauuaugucuucaaauauuuauuucuauuagauaauuuguuagaccuucugauucuagccuucacagcucguaaucucuuuuucucugugcagcauucugauugucuugaaauauguucuucaauuguugcuuucucuuuaguagcuauaaauucuaagauuaaaaccuuuccauugaauuauuaaauuauauuuuucauucuauaaguucacauuagcaguucgaauuuuacucagccauuuuuaaauucucuugcuuuuuccuuauguauacauguucuucuuuuauuucuuuaaacauacuagagauacuucuguuauauaucucuauuugaucauuucaguaugcagagucuuucuuugucucauucugccuuuuguuguuucugugaccucuuguucauggugucuuguuucugcguguguguugugauuuugacugagcugaauuucuuggaacuuuuuguuguuguuguuguugucauuguucuuagagacaggguuucacucucgcccaggcugagugcaguggugcaguccuggcucacugcagccucaaccucccgggcucaagugauucuccugccacagccuccugaggagcugggacuacaggcaugugccaccaugccuagcuaauuuauuuuuuauuuuuuuuuuguagagccagggucucacuauguugccuaggcugguauugaacuccugggcucacucauggaacuuuuaucuuuaggaauuauuugagauuuggggugaauguggguucuuccagagagaauuagcauuugcuucuggcagguaccagggaacauuacgccuuaaauuaaaaucuuaaauugagggauuuuuuuuguacuacagaagcagugugaauuuuagcuacaaaauauaucagagggcugacugugcauaugaauuuucaaaggagauuuauuuucucccuaccuauugccauguaacaaaguaccccuaaaccuaguagcucaacauaacaaauauuuauuauaucacaguuucugaggguaaaggaucuaggaacagcuuagauagauguuaugucuaagcuacuccuagggcuauuuuuuuauuucuaucaguuuaugcagucuuaaaaaucagcauuuucaaaauaccauuccauauuuguauguaugaccuccaucauuucuuuugaaaaaucaccugucacugguuuuccuuugaugguauaggucuuuuuuucucuagugcuuuuaagauuuccuuuucaucuuugauuuuuaggaauuuuccuaugguaugccuaugcauaguuuucuuuauauacaucuuguuugaggguguuugaacuuccuaaaucuauggcauuauuucuuuuguggauuuuagaacauucuuggcuguuaucucauccaauguuauguuuacuucguucucccaccuugccuuucagaacaccagugauauguguguuagacguuuuuuccuguguucuguguaucuccuaagcgcuuccauuguuucuauccuuucccccgaacauauuuuaguuuagauuuuauucugaccuaucuucuaguuuauuaauccucuuuucaacugucugagugaaacccauauuauagacucaauuucaaugauugcauuugucaguucuagagcuuccauuagauuuuaaaaauuguuuccaguucucugcugaaauuccucaucuucuuuuguuguaugucuauuggcauaauuuuaagcuuucuucagauuauuccaauaccaugaugucuuaugggucuguuucaauggcuuuuuuuuccuuuuuuuuuuuuuuuuuuugagacagagucuugcucuguugcccaggcuggagugcaguggugugaucucagcucaccgcaaccuccaccuccuggguuuaagugauucuccugccucagccuccugaguagcugggauuacagcugugcaccaccacaccuggcugauuuucauaguuuuaguagagauggggauucaccauguuggucaggcuggucuugaacuccugaccucaugaucugcccacuucggccucccaaagugcugggcuuagagguaugagccacuacgcccggcccuggcuuuuuuuucuauucguuuuugaucagauaguguugucuccuauauguuggguuuuuucucaucuagaggucaauaaaacaaaaaagaaagagauaauuuggguuauauauguuuuuucuuccaaaagagauuuacuuuuacuucuaccaggcaguuagaguagacagagaucaucuucaugcaaucagggauuaagcuaauuugaaagugggcuucugucuucuugaggguugguccgcuucugguucacuuucuuaggggucucaacugagagcuugaaguauuuaccaggguucuuucuccguucugaucucugaaguccaauuuuuaucuucucagcccuagaagacucccagaaguuguguucggcuucuagccucucaguuggcccuugugaauugacaaauaccuugaugggaaaacuaguaacaaauaucagacuugcaucaugacauuuuccauuuuuuuggaauuguaaccacuuaauuccuuucugcuuugguagcuuucugaugcuuucaaaaagauauuuuaaaacaucuuguacaauuguucuagauguuuuccacagcaagauuugucaacaaaaaccuaguuucagagauuuacuuacucccuaagagauucuccagaauuugcuauacacaaagguguuaaccuucagagcacagggcaaaccuuucacaaauuauuuuucugagaucugucgaucauccacuuaaucauuauacaaacauucaacaccagucuuacaauuuccguguuaaaugcuagaggugagugauaagucuaccaugguccuguguuggaggggcucacagaagagauaaauuugaauuuuucucuuuaagcaucccucuuacuccagaguuucuccaaauagaaugaaaucaucuuuaagcaaguuuuaaagauauggcagauaugcaauuuguuaccucucucaccaaucugagccuuuuuuuuuuuuuuuuuuuuuuuuuuugaagagucgcccaguauugugugagagguagagucacagauuggagaagcuuuggagagagacagaacaaaacuugaguguugacuccaguacucagugggcaagguacccuccuuccacaucugugcaauacgguuagcaugucuucucagagaauaauacauagcaguuauuuuuauuacuguuuuucuucacuuaugucauuguaaaauuucaaacuagaguuaaauauuccccuggaaacuugugcccacuuaugcucaaagccucuguugacagugcccuuuaguagcugcaguaaucaccauugcucaauugcucccaagaaaaucaaggaggaaguauuauucugccauucuauuaguuuuuaugugguguccagacccaaaggguauccuguuacagagagugugacaugagcacuguaguuuuuucuagguaagaguuacuguuccauguuuaguuugggugucuucuaucagccaggacuacugauuuacuugauuugauuauaaugccuguggacuuguuucuuuuauagacuauugcuucauuucacaauccacuucagguuuauuuauuuucuaaacagauuuguugagguauaauucacauacauuucucccauucaaaguacaccauucaauguuuuuuguuauauuauuaauuuuuuaggccaggugugguggcucauaccuguaaucccagcacuuugggaggccgaggcaggcagaucaccuaaggucaggaguucgagaccagccuggccaaaauggugaaaucccaucuccacuaaaaauacaaaaauuaggcuggcaugguggcgcacaccuguaauuccagcuacucgggagacuggggcaggagaaucgcuugaauaugggagucagagguugcagugaccugagaucacaccacugcacuccagcaugggugacagagcaagacucugucucaaaaaaaaaaaaaaauuaauugugguaaaauauauauaaaacaaaauuugccauuuuaaccauauuuaaauguaaauucagugccauuaguuauauucacaauguuauacagccaucaccauuaucuauuuucaaaacuuuuucuuccuuccagacagaaacucuguaaccaugaagcaauagcuccccagucacccucuccucagcuucuaguagcuccuagucuacuuucugucucugugaauuugccuauucuagauauuucauauaaguggcaucauaaaauauugguccuuuuguaucuggcuuauuucacuuagcacaauguuuucaacguuguaacgugucagaauuucauuucuuuuuauggcuuaauauuccauuguaugcguauaugauauuuuaauuaccuauucauuuuguucaucuggugaugaccauuucaguuguuuccaucuuuuggcuauuugaauaaugcugcauugaacaucagaguacaaauaucaauauggauaagucucugcuugucauuccucuagggacauaccuagaaguggaguugcugguaggcuuauuuuuagaauuauuuucuuucugaaauagugaacuuuccuaauguggaaaaaaucaaaucaaguuuuaaaacacauauuuacauaagcuuuauugcauaaaauaucacuuuacuuuuggccucauuauaacagcacauuuuuauucucucauacuucuagcuacuucuuccugccauccccuaucccugaaacuccacacacuuuucuugaccuucccuugcucuucugaucgauggcugggauaaucuuacaccaucacccucaauccuucuguaugcagcuguuuaagaggcccugcucuaugaaccacugcugggaccauucugacugucacacucuggaaccagagccaggcagaagaauuuuaaacuucaguauugacuggccaggaagggaucuuacuuccaaucugauuuggaucuuucaugaucucuaguucucuuuuugcccuuugucauuccuucuucucacuguaugguauaaaccaucacccuuacacuuuauccuaauguacaggugacacugucuccuacuucaccaagaaaauaaaugcuauugaauacaccaaguuaaggagcuugaauuauagguaauggugccuuugaaguaguuuaaagaagaaaaugauauaaucggcuaugcauuucaaaauggcuauuggaugaggcaacaaaaaggaauguguaguuagaaugaaucaagaaaucauuacaaauuccaagugucuuagucaguuugagcuacaauaacaaaguaccauagacugggugguacuuaugguucugagggugaaaaugccggcaugguuagguucuggcgaggguccucuuccacauugcagagcacugacuucuaauuguauccuuaauuacaaaaagggggcuaaagagcucucugggaucucauuuaaggcacuaaccccaucucaaaguccuuaccacauaauaccaucaccuuaagaauuagaauuucaacauaugaguuuugggaggacacaaauguucaguccauaacaaaaagauuaaaugauuaaucacaaauaucaccuuuuuuuuuugagacagugucuuguucuguugcccaggguggagugcaguggugcaaucauagcucacugcagcuucaaaccccuggacucaagcgguccuccugccucagccuccugagcaguuagaacuacaggugugcgccaccacaccugucuaauuuuuaauuuuuuuguagcgauggagucucccuauguugcccgggcugcucucgaacuccugaccucaagcaauccucccaccuuggccucccagagugcuggcauuacaggcaugggcaacugcgcccagccuacaacauuuuuuuaaaaacaucauuugguuuuauuaacugcuugaaacuucuaccauucuucauuccuuaccuuuuguuuauuuuuuuaauaagcaauaugacuuuauuuagugacuuuggaaacaaaaccucccaaauaaugccugaacccaaaguuaccuaaaaauggcuaaaaauauuuuaaaauaauagauuugaacaucauuuguaguuucugccucauaacaugaaugcuuucagcuggacaguagauuacaaaccaucucugaucauguuaaggcagauuagaugaucagucaguccuggagcuggcaggugggaggcucugccugucuugucacugcuuguuaugcuggcccucuaugacugaagcugacacagagcccuggcccuuguugacaucacugauacacacccacugcccaucaaccaacugcuuccucagggucaccuuauugucuccaccagagauggccaauauguuggcugugauggaccugcccgcaugcuacaugacaucauugaacuugugcagcaauuugggagaccauauauuucccaaggcaucaucacagguccagaugaacacacgaccaucccaggagcagcuggcaauggugcuggugggcaggcugauggagggggcccaggccacaucucaaacccagucacugugcuuccagcuucugcucuccuuccacuggccauccuugaagagguugucacagccaccugauggaaacuucuugauguaauuggguuucugccugaacagcuggucuaugaggcuuccagguacaacagcaggggccuagcugauggcauugcagccaaugguguaagcguuguugaucuuuuucacuucccauuggccuuccccuguauaagucagcaggaagauggccccaucugagcuccuacaggccaggaucaggccguagucaugggggaccuagcauacagaguucacggaggagucauauccugaggggucgugggucuucucccaggugccguuuuccucuuuccagauaaugacuuuccaaucauaggagcacaaugccaggauauugccauauguggggugagcccaggccacuugccacauaggacucucaugacuucugagguuggcaaugaggaucugcccucuguugugcacuuugaagauuuugacggauuuuucugaugagcagguugccaggcgggugccauaguaguccaucugggcaucauaaaucauauccuuaugggagguauccacaguguuaauuacugacaccaugauaccagcgugacugcucuagggacguggcagcuccugguggugccuccccauuccuuaccaccuuuuuuuuuuuuuuuuuuugagacagucucgcucugucacccaggcuggagugcaguggcacgauauuggcucacugcaaccucugccucccagguucaagcgauucuccugccucagccuccugagugacugggauuacaggugcacgccaccacaccuagcuaauuuuguauuuuaguagagacgggguuucaccauguugaccaggcuggucucgaacucuugaccucaagugauccaccugccugggccucccaaaguguugggauuacaggcgugagccaccccgccuagccucuuaucaccuuuuuuagcaacaauguuugccucuucagauggccacaauguuuguaaucuuuuccucuagagagaauagaaaucuuucuuuuuagccuggcugauugaaauuuguuuaguauugauaguuuagaaaaacaaaagcuucacauuuuauuacugauaauauuauauaaauguuuaagauuguaaucaaaauuggggaacuaucucuccaguuuguucauauaugagcuauaauuuuuggaagaaauuuucacagacagguucuggccccauacauuucaaaccuugcuucuccacaacccauguacuuccggggcugggugccuuuaggcauaauuguauugcacuaugaugcuaagugagucagcacauugggugaagggaugauccauuauucauaacuuaccuacucacggaaguaaccaggaaucauaucaguauauccuacuguacccauguaaaguaaaucccuacuuuaacugauuuuuacuuggguccccaaaaugccuauagcaaccuguaaaaccucccaaaggaagaggacauuugacacagggaagcuggaacagaaagagacaaggaucuuagcuuguuauggucaaauuauauuacuuuugcaaguuuuacaaaaacauaugacacuaugaacaugcuggugggauuccucccuuggggcacuucuggaugcagcugccaugguagccuaggaaugagaugacggcaggggcaucagggaguggagaggaagaaaucaauuugaaaaacauuuagggcugggcacaguggcucuugccuguaaccccagcacuuugggaggccaaggugggagguucacuugaggccaggaaaucaaggccagcuugggcaacauagugagacugucuccacaagaaaauuuaaaaauuuaaauuaggaaagaaaaguguucaggagguaaaauugauaggauuuggugauugacugaacacagaugugagaaagaaugaggaguuguugauuuuuccagguuaaaaccuuaguuagauaacuagguggguacugggaucggcaccugagauagaggauugcagaggaggcccuggcagggacaggggaagcaaguucaauucugggcuuauucagcucaauauuuccaggaacauccagguagacagauuucuccauaagcaccaacacuuaauaguaagacacuccagggagaagucggaaagguuggcgcagauucuggggcgaucagugcaaauggaagccgaaguccagggagagguugagacugcacauggggagcugacugaggagggcaaugggccaagcaaaagacaaacccaggggaucccaagcuuuaacaacugggcagaguaagagaacccacaaaggagacagagucuuuagaaauugccaggcucaguggcucacguguguaaucccagcacuuugggaggccgagguggguggaucaccugaggucaggaguucgagaccagccuggccaacauggugauacuccaucucuacuaaaaauuaaaaaauuaggugggcaugauggcguaugccuguagucccagcuacucugguggcugaggcaggagaaucgcuugaacccaggaggcagagguugcagugagccgagaucaugccauugcacuccagccuggguaacaagagcaaaacucugucucaaaaacaaaacaaaacaaaaaaagaaaugaauguaauucaauagcuuaugauagauugcagcuuaacaugucauauuuucccucuuuuuuugauauuucugguuugaaagagaaauuaacuacaagauuuaguggagauuauauauauauauauauauauauauauauauauauuuuuuuuuuuuuuuuuuuuuuuuuuuuuugagacagagccuugcucugucacccaggcaacuuccaccucccugguucaagugauucucuugccucagccucccgaguagcugggauuacaagcgcacaccaaugcacguggcuaauuuuuguauuuuuaguagagacggaguuucgccauguuggccaggcuggucucaaacuccugaccucaagugauccacccgccuuggccucccaaagugcugggauuacagguguaagccaccgcacccagccagugggcucuuucuuaugagacuuuguagacauuccauuagcugauuuguuaaaugaucuucaaaauauuugcuugcaucaaguaaaggaaauuggaugguagauauccccuguauauagcucuaccugccuccuuccuucaucaaagacucaaaaagcggaauaugucuccucuguaauccauuucaagaacacauuagguggugaugggcaauauauuucacugacauggacuccuggggauaaucucccagcaggcugcauaagccugugcucaguggugaaggcccccaggcgguugucuucauaugaaucuucaaggcauggcaaagcucaugacauuugcauuuuaaaagguauuugcuuugguguggguaaaacucaaccaaacaugguuaacacuuugaccucgaggaugaaccauaaaaauauagggcagcgaccuccucuucccuacugauuccugagaggggcaguggugaguuuauuuuuguaugcugucaaaucaacuuaagacccauuuuaagaguuuuguuucuguucuuuauagggauuccaucaacguaagaguuccgcugauguuuuggaaaugggucacuguagaaauuaaucaagugguagugaggaccuugauaauuggaguggauucugggauucccaaagguaguaacugggcugaguggugaagaggggaugggagaacagccacagugauuuuuucuguacuucaaaagcuuaaugaaguuugaaauuugauccaggauuugucuacacuggcugauugaucauccugcacuguuuaugacuggaaugacauuggcuugauacgcagacacagcugucucuugcugauguauagugcuggugaaaaccaguguuuuaugucugaugguuacagaugagaaaggcaauauuacuuagcaacuguuaaauagucuuuuaaagugucaccugcucucuuguaguacuggucucuucguuuccuguagaguuggcuuuucuagucccucucccagagugauuucucuaaaacacugaugugaucgcuucucagucuuuuggcuaagaucaaguguaguaucuaaaacacugauguggucaggauaccuuccaugacuuggccccuauauuuuuccagccucaucuuucaauucucccuucuuagaugugacuuccuggccuuaaguuggagcuauauacaauuccaugaaugaaacagcacuguuuauaccuccuggucucugcacccucugccuuuauucaccuggaaaugaagacacaccucaguuaccuuaucugcagagucuucuuugacccacuugucagccaaguuagucacauuuuguuuucuaucacuuauguuguagaaaucuuuuaaacauuacuuuucuuuuuuuuuuuuuuucuuaacuuuuagguucauggguacaugugcaagauuguuguguagguuaacugugugucacagggguuugguauacagauuauuuugucacccagguaauaagcauaguaccugauaggucauucuuugauccucugccuccuccuaccuaccacccucaaguaggcccugaugucuguuccccucuuuguguccauguguucucaucauuuagcucccacuuauaagugagaaugugcaguauuugguuuucuguuccugcauuaguuugcuuaggauaauggccuccagcuccauccauguugcugcaaaggacaugaucuuguuucuuuuuuauggcugcauaguauuccaugguguauauaugccacauuuucuuuauccagucuaccauugauugucauuuagguugauuccgugucuuuacuagugaaaauacuacuuuuugugguguauuaauauaacugauuuauacacauuucucacucucuggaauagguuuauaagucuaguaccaagcauaggaccugacacagaguacuuucuuaauaagaguuuguuggaugaauguaugaaaacauuagaggucuuggugaaggaaaagcuggucaccauugaaucuaguggauuccacagggaaaagagcagcuucccguguugaauguguccgguuaaguaugagaagcaacauuucugauugcucugaaaaguaugauuaaagcacaaauuauuauggaaaaauaaugguuuagaaguauagcauuuugguauauuuguucauuucuuuucugaaacauuaauuagcuaagguaaagaugaggauuuugcuauaugauaaucaaacuaguaucaaugaaaaucaucaauauuaaaaugaaaaguuagaaaauuguaguaaaugggauagacagaugaaagcuuaauaucuguauuauaaugagcuaauaucacugaucagaauaucaagaucuacauagaaaauuggguaaaugaugaccaggcgcaguggcucacgccuguaaucccagcacuuaggccgaggcgggcggaucaccugaggucaggaguuugagaccagccugaccaacauggagaaaacccguuucuacuaaaaauacaaaaaauuagccaggcgugguggugcaugccuguaaucccagcuacucgggaggcugaggcaggagaaucgcuggaaccugggagguggagguugcagugagccgagauugugccauugcacuccagccugggcaacaagagcgaaacuccguaucaaaaaaaaaaaaaaaauuuuuggguaaaugacauaagcaaguauggauacuugaugaaaaugugaguauacacuauuuuaagagucuuauacucauauccuuugaccuagucaccccacacucagaguguuacuuuuaaaaaauaaaaauuuaaaaggauaaugcuauagacaugaaguuugagacuccaucucaaaaaaacaaaacgagaaaaaagaggcgacauaggguaauaugcuaauugauggaacuaauaaauaaagauauaaggauauuauuuuaaagguacaaagauaacuaggagagaagcugaaaauggugauauaaccauaauagcaagaaaggaagauaaacuuucuuuaucuucugggcuguacucucauguguuaaagaaaucaaugauaagaaaaagcaguacacauauauuacuuagagaccagaagaagcaaaaauaggaacaauuaaauaaucuuaaaaugugcugggcgugguagcucacaccuguaauuccagcacuuugguaggccaaggugggaggaucgcuugaguucaggaguucgagaccaggcuaggcaacauagugagaccccauuucuacaaaaauaaaaauaaaaauuagcaggucaugguggugcaugccuauagucccagcuacucaggaggcugagacaggaggaucacuggaacucaggagguugaggcugcagugagccgugauugugccacuguacuucagccugggcaacagccuaucucaaaacaaaauaauaaaaaaugauaauuuuuaaauggcuuccucugaaagaacuaagagaaaagugaggcaggggacuguugcuuuucacuauaacagucuuuuguccuccucuuuuuauuuauuuuauuuuauauuuuauuuuuugagauagaaucucacucugucacccaggcuggagugcaguggugcaaucucagcucacugcaaccuccgccucucagguucaagcgauuuucaugucucagccucccaaguagcugagacuacaggcaugugccaccaugccuggcuaauuuuguauuuuuaguagagaugggguuucaccacguuggccaggcuggucuugaacuccugaccucaagugaucugccugccucggccucccaaagugcugggaauauaggcgugagccgggugucacuuuucuggcuggaaaccucuguggccuguggcgccuuugcccgaguuuugcucgggcccacuggguucguucugcccacucggccuggcaggcugcacucgguucaugcuuccugccuggaucccauaccugccaagggcaagucaggcauaaagcggcaaggggugugugagcaagcgugggguugagccacugugcacggucagacacgcuggcugcugcugcugcagggugagcagcuccagguugcccgcacaggcgccagcccucugcaaggcugcagcuggaccaggugcacugcagacagcuucucuggcuggcaucaggguaugcaauagugcccagaagcuuggagaugccaggaaccacagggccccaaagagagagucacagccccagcucggguagcucccaggucugggcuccccaaaggaccauagcucuucucuccuuuucccccacaacguggugagcaaggggcauguuucagcccuauuuguguuacagcucuuuuagccucaccauucagcggaucuugaguucuuguccuacauccaggaagaaugagguauacagacaaguggagggugagcaagaugaagaguagcuuuauugagcgauagaacagcucagaggaggcccacaguggauagcuugucuccauagccagggugucccagcgaguguucagcucucagcagagaggguagugccucucuguggguagauugucccauccucccuccauccucucagcagagaggauaguuucucucugcagcugauugucuccccuugucucuccaucuucuggucuugcugagccagcaguuguuaugggcuucaguggggaggaggugcugcuuggaccauggcggccauuggcaggcccagggaaaagcaccacaaguuaccccucugguccaugagacuaguggcccgaaccccaggcuucgggcccuccccagcuugaagguggggcuucaccagggacucgcccccuuccacccaggagccugucuaccuucugccaccauucauggcgcccgggcuguuugugccaagggacgccuacaggccagugcugagcugcccucagcacccccucggccucccuccugugcucaucggugcccaaaguccagagggggcugagguggcagggggcuggcaugucagugcuacccugaacguuugcacacccagccagcgugcgacagcacgugggcucagccccauccuugcuccgaggucggaguggcgcugggagaagagagaggcuaggcagcgggagcagacaccucuuagccuuuugggggagggggaccuuccuggauccccaagagugcagagauguuuccgucugcagcugcagcuugguagcugcagccacgcccagcuccugcuuggcuccauggaucguggcacugccccgggcacagcucuaccucggggcccuucucuguccgccccuccgugcccaaccacgcugcucccccaccagcgggugacucggcccagucccaucguggcgggcuucagggacugaccaccuccuuccugcugcacccuuuccacagcagcagcaaggcaagagcagugacgcggggccagggucaacagcggcagaggcuccgggccugggaguggguccugccuggccccgugaggcuggggacggcacagucagcugccucggggacauggggcacagggguccucuccgccgccacuacuggcccugcagcugcucccaccgccacggcccacgaccuccuuccgccacagccagcgugauggcagcagcugcucccaccgccacggcccacgaccuccuuccgccacagccagcgugauggcagcagcugcucccaccgccacggcccacgaccuccuuccgccacagccagcgugauggcagcagcugcuccgggcuacaaagaggcgaugcugccagcauugugacuuuuagaaagggaaaccaaaaaaaaaagaaggaaagaaagaaauagaaggaucuugagaacucacaguacacucuacuugaaaagccggauggcuacagacauuucuaagacgugggacuuucucccagaucuucuuacuccauaauuguauacauacaugcacauauaugugugugcauguguauauguccagauauaauauuuaacauuuaauaaggauuuauuuugaaaaauaguuucagacuuucaaaaaaguuacaagaauaaaaguaguuuaaaaaaagaggauuuguggccaggcgcgcuggcucacgccuguaauccgagcacuuugggaggcugaggcgggcggaucaccugagaucaggaguucgagaccagccugaccaacauggagaaaccccaucucuacuaaaaauacaaaauuagccaggugugguggugcaugcuuguagucccagcuacucgggaggcugaagcaggagaaucacuugaacccgggaggcagagguugcggugagcugagaucgugccauugcacuccagccugggcaacaagaccgagacuucgucucaaaaaaaaaaaaaaagaggauuuguauauucuccacccggacuuaucugugucaacauuuuacucuacaugcuucaucacucgugcauagacuuguuucuucucucucucugucuguguguguguuuucuaaaucauuggaggauugcauacaucacggccuuuaccuuuaaauacuucguuauauguuucauaacaauauggagaaguauucucucuuguaaccacaguaaauuuaacauugauacagaacuuuagcaauaagauuaauauuuuuccuaugauaggcugucucccuucagagucugucacguaccuguuuccuuuuuuccucccacuccccuagccuucugcuguuuacccucauucucucuacuuguuuuugcucuuuuguuuugaggucuuucgguuuauaauuauuuggauauuccugaagcuuaaaacacagacauacacuuagagguaaaaaauuuaccagauccugcuuuggaagaagucucuaguuccuuugauuuuccaaaaaagcaguggcacuguugagucuuugaccuugcuuucaaauaauaaauuuuaugaauauguuucugaagguuuaccaacuuuuuuucuuuucucucuuuuucuacucugguuuauaguuugaaaaaguaccagaagguccuaucccuccaucuacaccaaaguuugcauauggaaaggucacuuuggaaaagguaagaaaaaaaaauaacagaaacuuugaaagugagagaugggagugagaaaguggaauuuaguagcagugagugaaagugcugugcuggaggaauugguucguuauuuuucugcgaauuuguuuucugcaagccuaaugggguaaaugauguuucugggaaaauggggagagagaggugagaagauacucaugccuguugacaggaugagcagaugagacaugggugggaguaguaggcauucuuggaucauuugggucaucuugguuccuuuaucagugguuuaaacagugucaagugccuuuguggaaauaacaugccaccucauuguuauggcugccaaggcucuuugucguauuuaccuuuuuuaggaguuccccaaaaucacaggcauuuugauagaccucugcccuaaauuauauacuuaccuccaucucaaagucauguccuaauuuuuauggucugugguuuauacguuaaauggggacacugggggaaaagcuagaaaucaaucauaaauaggaguuaagggcaauguauucuaggaaaagcgaaaaagaagagagguuuuacuuaauagucagaggagugacauagccaaagucaauuuguuuugaccaucugugucuucagguuuuccccuuuuauaaucccuaacuccuacauguauuaacucacaagaaaaaaaaaaaagaaccguuaccuauuucuuaagaaucucgauauccuaaaauaguaucguaaguuuuuaucuucaagcaaaaugccaaacaugauuauguaauuuuuccauccaagaagcccuuugacaugguugguugguugaguucuuauaacauuuuccaccuagugucagauaccugugcuacauucuacaaagaauguggucuuucugucugauaaggaucuuucuuuagauuaaucagacuucagucacucuuguaaagggagcaccuucuacuuguucauugcuacagcuacuuaaggaaaacuuugguuuguuuguuucagagccaugacaaaucuauuuuuaugcaacagaaaauagcuccaaauguucaaaacaacaacauugcuaaaaccaagcuagcuuauuaccaaaagcacauucuguuuaccgugaaggaaaauugugugagcagaaaugacuuuuuauuuuuaaauaaauauauacaguugaagauagcaaaucagcauauaacugaauuaaguuuauguagaacacaguuauauagaaaauaaguuuuuaccgugaguugaauuucuuaguguucaggugggaaaacacccauaugaguagcuggcuugaugaaauuguaaaugagauuuuuuuccuugaugcugcacaucagcaagguaaccaugggaaguguuuaugaaauuccuaacugggcugggcaugguggcucacgccuguaaucccaguacuuugggaggccgaggcgggaggaucaccugaggucaggaguucaagaccagccuggccaacauggugaaaccccgucucuacuaaaaauacaaaaauuagccaggcauggugacacaugccugcucaggagguugaggcaggagaaucacuugaaccugggaggaggagguuacagugagccaagauuacgccacugcacuccagccuaccagccugggugacagagugagacucucucaaaaaaaaaaaaaaaaaaauccuaaccaguauuauagucauggaaaauccugggguuuggagccaaaucuaacuacaaauccuggcucugucauuacucaaguggacuucugugagucuccacaacacagggacaguaguaccugccucacaggguagcugugaguauucaaugagcuagugcauguaaaacgcuguaucucaucuggaguguguagacaggcaaugacugguagcuguuauuauuauuguuguuauugcaucagaauaaguauccuggguugcaagaauacacaauccuuuguauugaauauaauaaauacuuaccaggcauuuacuauguucugggcauuggggcugagaauggaacauaucuuauccuuaaggagcugacagucuggugaggaagacaaagaugagcaacugaaaagugauacaggcauggaagauaugccacacacaaguucagaggagggugaaguaacuaggaaguauuaaauauuaaggugauauaauaauagcaugucuaaucuuaguugaauguaacuggccucugguuacuacuuuuacuucuuaguuguuuuacucggggguguucagagaggguuuauaaggaggcagcaucugagccuucguuuucauucauuuuaagaaucuuuuauaggucucugagcagguuggacuuccgaauagguauguuugaaaccuuuuuaagacuacuaucauucauaguuuucaucaggaguuagggaguagauggagaggacugaaggagacugggaagcaauacugaguggaauuugaaugauuuagguuuauuuagggguuuggucaaacccacugaugucuuugauaauuagggaaugacucuguaaccugaugaccagugaggggugcagugugugaaugcugcuuuuguuucuuuucaguuaaagacagugggagcagcucuggacauucugugucccucugggcccaucaaaagccuuuaucccuugacauuuauccaggugaaacagguaggccuucaaagguaaugccucgccuuuuuucuacuugcaaaagugugcuuucugcacugccuugcagugcccauucugaauucaggggccaaaaugguaagcaaaugcaucagaucccagguaaaugaaccaugaauuuccaggcucucuuuagcuugaagugcugcguggugggcugaucaugccuauauuuuuugccccacuucuucucacucauacaggagguagcccaaccugcuucaacauaauucuguacaaguuauaaauugaguucacugaccaaucuaauuaaucuuuauuacuaggcaucaguggaagaucacuguuuuaauacucaaaacagacaguuuaauuauuuguucuuaguucaauggcauaaggacuguguuuuuugguagacuagguucuuugagauucuuuuuccugcuuuugaagagaacagagcacaucuuuuuuuuuuuuuuuuucaguguuuguauauguguauguguuugaucuccagacacugccucaucuuuauuuuuuuaaaguuuuucccagcauuuuguuuuggaaaauuuuaaauccaaaaaaaguugcaagaauaguacaauaaacacccauaugcuuuuuaccuagauucaccaauuguuaacagugcuuuaauugccuuuuucucucuguguauguagucaacugcuuuucuuuuucuaaccauuugaguuaucagcaccaugucacuccacagcauacaucuuuuaagaaaaagaacauuauccugcagaaccacaauacaaugaucacacaugagaaauuuaauauugaugcaauccuauuaucuaauauaaauucuauagucaagugucccuggucauugcaauaacguccuuuacagcuuaaucuuuucucaauccaguuuccaauccauaaucacacauuaauuauauucuccuuagucuucuuccgucugaaacuguuccuaagucucucucucaugacauggacauuuuugaaaaggucgggguguuuguagacuuugccucacuaauuagauucaguaagacauuuuggacaugaacacaacaaaggugauauguccuucucagggaaugauagcaggaugcccgugagaccagcuugucccuuaacugcaauguuaagcuucaucacuuaggaucucagccccauguuuugaaauggaagguuauccacguccuccuuucugauuuucuguggcaaccaccuucuggaaggagucugaacaguaaggcaaaauaauaacagcauaucuaaucuuaguuuagugaaguuugcugucaguuccuguuuuuacaccugugauuuuauuccaacaauucuauuuugcaauaaaaugaauaauuaaguccccccaccacacacacauucacuguuucaugaacguuguauaggguacucugcaguccuagcacccacaucuauaaauggaacuuaccugcacuuagcagagcuguugagcacuucagacaaugaucccagagcacguguagccuggggagggaguuccagguuacuauaugaacacgugcagccauuguucuuucucagaccccuucugcuuucugaucuuuggccaagguagugcucucagauuggguggggcuuccugggcccuggcucuuucagaucuggggcaaguccacagaauaucuauuuccagcaaaaaaccccaaagggcacagacuucagggaguggggcucagccuacugucucugcagggauccccugagccucagccacaccugccuggggagcaucacagcuucuaccccuccuucuggaagcccuugacaaagcuuuccucagcccuugaggaaacuuaccacuuuagcuaguuuucaaaauaaguaaauaaaugaaccagaaggagauggagauguggagccugggcgggagguguucuugcgcuagaagguuuguguggucuuaguagcauuucuugugcucagcucauuccugcaacacaggaagguggauuagugcucuccucagcuccucccagucaccuuuccacuugccugaaguuuacuuucuuucuuucugggcccuagaaguagggaaacuuuucucuguuccaugcuggaucucuauuugcauucuguuccauaacuggauuuaugucccagcucagcccugcuaauaauguccacagcaggaaguaaauaagcaaagucaauaacuauaauucuguggauuauuaugucaauaacuauaaucugugaauaauuccguuacugcugaggcugauuguuugaggcuuuccuuuuggaccagggaugucagcaucuaaaaauauuuucugacuuagugguugguuacaaucuagucucuuaacuguuucuuucccccguuccuccacuuaaaacaguucugauggacuuuguuguuauuauuauuauuauuagagaugaggucuugcuauguugcccggacuagccucaaacuccugggcucaagagauccuccccaaguaacugagacuacaggugcaugccacugcacccagcucauugccuuuuguuuuguauguuaaagcagauuuagcccaugaacuuggagacaguuuugcugagcagaacuucaucucuuggcuuugcuguuuguuugccuuguuuuuuuguugguuuuacuuaguuuuguuuuuggagcuaacauccauaacuuuugcuauguaugauauaauccccuguaugacccugggcaaguaacuuaacccauucaggguccagguuccucuuaugggaaagggaugcuugauaagacacuguucaugguuccuugcaguuuacuauuaugauagauauucgaugaccuaaaaauuaaaccaguuuccuuuuucaaauuuaauuuuuucgggagguggaggaagauuuucauuccuuaugguuugagaaacaucgcuuucauacaugucuaggguaaccaaguucucuaaaugaauggcaauagugauguauuuuucuuaaauccuuuucuaaccagcauuauggguuugugcuguaccggacaacacuuccucaagauugcagcaacccagcaccucucucuucaccccucaauggaguccacgaucgagcauauguugcuguggaugggguaagaaucgucucugaacugugcguuuugucccagugaggguggggaugagcagccugcacuuguuaacacagcauuuggggucuuugcucaccuuuucagccucaggcucuacccaucaucuuuuuuuuuuuuuuuuuuuuuuuuuuuuuuuuuuuuuuugagacaggguuuugcucuguugcccagccuggagugcaguggugcaaucacagcucacugcagccucaaccucccaggcucaagugauccugcuaccucggccucccaaguagcugagacuacaggggugcaccaccaugccuggcuaauguuuugauuuuuuuuguagagacagggucccacuauguugcccaggcuggucuugaacuccggagcucaagugauccuccugccucaggcucccaaauugcugggauuacaggcaugacccaccacggugggcuccaccccucuucuuggugacccuuagcugugccucuugcuugcugugaggccucaugcaugugccauuugcugaaauccacccuacccaccaucuuaacccagagggcugugcuugaugcgccacccucucagaagccuucggggucuccccagccaaggccgcccuucugugacugauguugccugugcuuucuuugcuccuuaagggugggguccauuuccaauucaauuuuguaccugccacuguacaaaguuuguugaacuucgugccuuuauccuacaugagaaauuauauucugaaggacugcucgugacaacuauuacugaaaugcacaaagaaccguguuucauaacaaaagcagaugcauuucaggacuuccaguccucucaccgaaauggucacaggaaggaacacaggaaaagauuuucuucaccaagaaaauuuguucagaagauuuuaaaauauuucccauucucuuguaaucaacagcuuucauuucagugggagcagauuacuaagacauucugcucuauugauggugacuguuucuucgcuucuaacuuggguguugucuuagugaauuaugaucauuguaaggucaauuuuuaaagucuaaccuuuuaaaaaguuaggaauauguuguugauaaaauaccuguuguuuuuccucauucuguuguaugauuuucgugguuaaugcaucaugucaaguauuuugaggugagaauacuccaccuaacuucucugauuuuaucucuuuugucugauuuugucuuaucucuccauguuguucagaagcaauuuuuugugagugacuuuugugcugucagaacacgaagcagcuacucuaguaagaauccuccccuggaauuuuccacuaaaaguaguuggcaguaaaacauuccagggcaaaggaaaccagcuuagaccguuccaugcucugagcugugucuggcaguuuuccuguuuaggaagcagugauugggggaucuuuccgaccuggccgguaacuugggcuaagaugcuaucaaagcauuucuuuccaagucuggugacacuucaaggcaagaaaaugagugcuaaauuaacugagcaugcugccucuccuugcugaccuucuuacccucaauucaauugucauuuggucuugaaccccacagaucccccagggaguccuugagcgaaacaaugugaucacucugaacauaacagggaaagcuggagccacucuggaccuucugguagagaacaugggacgugugaacuauggugcauauaucaacgauuuuaagguaggacaaaccacacugucaagacuaagguuuaaggggugacaacuuagaaguugaagcccaguacaguggcucacaccuguaaucucagcacuuugggaagccaaggcaggaggaucacuugaggccaggaguucaagaccagccuggguaaaauagugagaccucuacaaagaauuaaaaacuuagccagguguggugacaugcaccuguggucucagcuacucaggaggcugaggcaggagaauugcuugaguccagaaguuggagauuaaaaugaccuaugaucaugccacugcacucuagucugggugacaaagugagaccuugucucaaaaaaaagaaguaguugagcuauuuugaagagcuguuuuccucuguaggugaugagaaaguugagcuuugcaaacagaaccuuuccccuguguuugaguuuggucauccuauagaaagaaacagaaggaggaagccccuccaccaugcuuuuccucugcuuuaaaagaccaccaagcucacugaaggcacuccuuugccaguaaagccagcugagccucuguucugcccuguuuuauggguuuggaugguuagccuguggcaaacucuucacuuguaggaagccucuucccuuggggcacuggcucucaccucuguugauuacuccuguguccagauguguagcccaaauaaguuuuucuaacacauauuuuuagagcauuauucagcaagcauuuguuaagcucccacuccgcgagaugccccaccaggugcuuuggggaaugcaaaggugucaagagacaggcuucucucagggagcucaaccuccgcgagaggagagaaugccuuaucaagggaacaauggcaccacccaggcuagggcaggacaggugucuggggcuauuuccugacccucuugagaucaggcaauuacaucuuagggaacuuagggaauagcugugugcaggccaccuuugccuccaguauaaaugucucucucauaguucuugugcucaggguggacuucauggccuccugccuggcucucacaggccacauugacccaugggagugacucgacucuguuguguagucucugggucuccaguaccugucaaagagccugacauacagccaccugguuaauauuuaucaaauuauuaaaugggcaaucgagacuugguaucugggauuccacugggaauggggaaguucccuacauacaagccagggaaggggaaguuagcugagccuugacagcccagcccuggccuguguggaacaaauagagcagcuucugaauucaggucugagguuugccaucgucaucauuaccuuccuauccucuuaagguaucacaguauucucauguauguuaucucacuuggcccucauaacaggugagugacucgggugugguccucccugugaugauggcugaggugcucaaggccaauauuugcuccuggcugcauccgucguaccugcuccauccgcagugggaugacuauuccuuuguaucccacacucacucauuccuucuguccccagauuccaucuugagacaggaucuugcugucacccagccuggagcgcaguggcacaaucucggcuuacugcaaccucugucuccugggcucaagcaauccucccuucucagccucccaaguaguugggacuauacgugcaugcccccacacuaggccaauuucuguauguuuuguagagacuggaucccuuuuuguuuugagauggagugucgcucugacacccaggcuggaguacaguggcgcgaucucagcucacugcaaccuccaccugucagguucaagcgauucucaugccucagccuccugaguaucugggauuacaggcaccugccaccacacccagcuaacuuuuguauuuuuaguaaagaugggguuucaucauguuggccagguuggucuugaacuccuaaccucaagugaucugucugccuuggccucucaaagugcugggauuacaggcaugagccacugcgccuggcccaucuuucuuggugcccaucuuucucuauucuagcaguggcucucagccaaacucugaaaauuugggaauuugggaucaaucacucuagcaacucaaugcccuuucuguagaagcagaaacucugggccuuuuauagagacaucaugaccugcaaaggagaaagcuauaguuuggggaauauaucucuucccaaggauuuguaauucaaccuccaguuagaucuguguuacuucgauguacacauauuucgagguucauuuccuguugguguuuuguaucccgguuugcuuuucccauuucccuggaaugcagagacaugugaagccuuuuuccuucccuccccagcucacugugcucuguuucugcuuugcaggguuugguuucuaaccugacucucaguuccaauauccucacggacuggacgaucuuuccacuggacacugaggaugcagugugcagccaccuggggggcuggggacaccgugacaguggccaccaugaugaagccugggcccacaacucauccaacuacacgcucccggccuuuuauauggggaacuucuccauucccagugggaucccagacuugccccaggacaccuuuauccaguuuccuggauggaccaagguacgugucuucaugggaaggguuugaauucaggccuaaacuuuugguuguuagugucugagaaagaaucacaaagagcuguuagugagauaucgugugaugguuuugaguguggcguuucggacauucuucaggaggcggauuguggcagaucuucagggauucaguggccagcucggaggugcugccaucugcccccuugucauuggcuuccuguagugaaugacaccauccugccuccuccaagaagaaucaugaccccuuuugaugcugauuauaggggugcuuucucuuuaucuugaggacaauccagucaagacaaagagguggaucccucugggagagucugucugguuuucauuuaugccaagcccagugcucccagaauauccccaccugcauccagccccacaccccuggggcuucuaucauaagcugucugcuucuccacucuuccucauccauuuucacuucccagucacuccgccuugucguuugaagacauuggcauaucuuccuucaccgccuucuccucucccucauguccuguuuucauccuagaucaccuuaccaucacucauucaacacacuucucauucuguggccacuaugugcccaaggugugugccaggcacuaaggauacaaucaugaauaaaaccaaacaugguccuuucccucauggaacuuucagucuagugagggaggcagacucauauuaaaaaguaaaaccauagcugugauggaugcuaagaagggcuaugggguugauaauaauuggugcauuuugccuugucagggaggucagggaagccuucccuaagauagugaugcuugucagagauaugaaggaugaguaagaauuagcauggcaagaagggaagaaagcauguuccugggagagguaacagcuugugcaaaggccaugggguuggaggggaaaaugucaaguguggaaaguagguagagacuagauugggacgggccuuauaggccacguuaaaguuuugucuuuguguugagagccauugaagcaggagagugacaugauaagacugugaucugacaagcuccucugaccccauugugcagaaugguuuggguaaggacacuuauggauucgaggaaaccaucuaggaggcuggaccauagucucauugagaaacugggauggugguaucuaagauggagaugacaucaacuauuugagagauguucaaaguuggaucaauaaauugugacaauggauuggacaggaggguuuggggagagggauaugucucggaugacucaggucucaagcuugcagcugggcagaaugguaccauuugcugaaagaagcagcuucagaaggggacuuaggcuuagaaaggggggucaugaguuugaauuuagaccaauuguguuugaaaagcugccuuagucuauuugggcugcuauaacaaaauaccauaagcuggguggcuuauaaacaacaggcauuuauuucucacaguucuggaggcuaggaagucuucaauaucagggcaccaguagauuugcugucuggugagagucuacuucaucauagacagcacccucuauguccuuacauggcugaaggggcaaaggagcucucuugggucucuuuuaugaggacacuaauuucauucaugagggcuccaccuucaugaccuaaucaccucccagagggggccccaccuccuaacccaucacaugggggcuagaauuuuaacagaugaguuuuggguggacacaaacauucagaccauagcagaggccuuggagaauggcugggaaagacaguauuggaggaggguuguuggaucuauaggcugggaauucagggcagggaucugggccaggaauguauguagaagaucauuguuguauagaugauuguugaaaacaugggcuggaugaggucucucaaggagagaggaugcagagggaagaaaagaggacguaaggcugauguuugagggacaaaaacaugaugaagacugaagaggagagaccaaacaaguaggaagaaaaccagcauuuaugcugccaagaggacaaauaagauaaagacagaagcacuucggugguuuuagaagcaaggaggcccuugggaaucaguaagccuuguuccaguggagugaagcaucucccagccagauugcauucuauagagaagaccaggguaaggaauacgaacaggaauacuugaauauaaacguucuuuuugagaaauuuaauucugaagaagaggagaaaauuauguuaauagcuggaggaggagaaggcaaaagauguacaugguguguguuuaauaaaaugcccuuuuauuuauuuauguguugcuuguuuaaaauuuauugaaauguauuuucauuauucuguuugaaauauuuucuuuuuuuuuuuuuuuuuugagauggacucugucaccuaggcuggaguacaguggugugaucucugcucacugcaaccucugccucccgggcucaagcaauucuccugccucagccuccagaguagcggggacuacaggcacacaccaccacuccuggcuaauuuuuuuuauuauuuuuauuuuauuuuuuauuuuuuguuuuuuuuuuauuuuuauuggagacgggguuucaucauguuggccaggcugaucucggacuccugaccucaaaugaagucucgaaaagugcuaggauagacaucugaauucauuccaacuuauaguuauuauaguuauuauaauacugcuguaaacacuugcauguaaguuuuuaugugaacuuggccucgaaaagugcuaggauuacaagugugagccaccacagccauccuguuagaaauauuuucuacuuucccauaugauuucuucuuugaaccauagauuauuaaaaaguauguuuuacugggugugguggcucaugccuguaaaucccagcacuuugggaggccgagacggguggaucaccugaggccaggaguucaagaccagccugggcaacauggcagaaccccauuucuacuaaaaauacaaaaauuagccaggcgugguggugaguaacuguaaucucagcuacuugggagacugaggugggagaaucucucgaaccuggaaggcagaggcugcagugagccaagagcaugccacugcacuccagccugggugacaaagcaagacugugucucaaaaacaaaacaaaaacaaacaaacaaaaaaaguaugcuguuuaauuuccacauauuuuggguuuguaaaaauaucuuguaauuauuaauuuguaacuuaauuccucuauaaaacuucuaaaauuucucucuagggagagaaaucuccaugaucuuggguuaggcaaagacuucuuagauuugacaccuaaggcauuauccuuaaagaacaaaaauugauaaauuggacuuuaucagaauuaaaaauauuuguucuucaaaaagcauuauuaggaaaaugagaauccaagccacaaacugggagaaaaauaauuuucaaaucauauaucuaacaaaggacuuauaucuagaauauguaaagaauucuuacaauucaauaauagacaaacagcccagucacaaaaggagcaaagaacuugaauagacauuuuaccaaagaaggcauaagauggcuaaguacauuugcauuuguauaccuucuuugguaaaaugucuauuauaaacuaaaauuaguggcugauuaauguucaacauuauuaaucauuugggaaaugcaagucaaaaccaaaaugaaauacuacuucacacucaccaagauggcuaaauaguaagaaggacaauaggcaauguuggaaaggacaugggggaaagggaaucuucccacauugcugguagaaagauaagaagguacauuugggagcauaguuuggcaauuucuucaagggcuaaacauagauuaccauagaacccagcaauuccgcuccuagguauauacacaagagaaaggaaaacauguucacauaaaaacuuacaugcaaguguuuauagcaguauuauaauaacuguaaguuggaauuaauucagaugucuaucaccugacaaguggagaaagcauguauauccauacgauuccucaauaaaaaggaauggaguacugauaacaugccacaauccagaugaauuggaaaaauauuaugcuaaguaaaagaagccaaaacuaaaaggcuauguauuguaugacuccauuuauaugaaauguucagaaaaggcaaauccauagagauaguagcuuacugguugccuagggcugagggugggaauggagcgugacuguuaagugggcaugggguuucuauuggagcugauggauaugcucugaaacuaacuugaaugauggcugcacagucuucuuaaauguauuuagacuuguuuuauggcccagcacaggcauauaucuugcugaacauaccuuuggaauuuuaggcuuuaauauccucucucuggcugcauguuucuaugcaccaaacucucaugccuaccaaccuugcucuuaaaucuuuuuuuuuauuuuuuugagacagucuugcucuugucacccaggcuggagugcaauggcacaaucucggcucacugcaaccuccgccuccuggguucaagugauccuccugucucagccucucgaguagcugggauuacaggcaccccccaccacacuuggcugauuuuuguguuuuuaguagagaugggguuucaccguguuggccaggcuggucuugaacuccugaccucgugguccaccugccuuggccucccgaagugcugggauuacaggcaugaaccacugcacccggccuuaaaucuuauuaaugaccugaaacauuccaccauuaaggcugcaguucuuccucuaccaagccuaggccuuaccacaaucuuuuuuauuuauuuauuuauuuauuuauuuauuuauuuuuuaagauggaguuucauucuuguugcccaggcuggaguacaguggcacaaucuuggcucacugcaaccuccgccucccagguucaagcgauucuccugccucagccucccauguagcugggauuacaggcaugcaccaccacgccuggcuaauuuuguauuuuuaguagagacgggguuucuccauguuggucaggccagucucaaacucccgacgucaggugaucugccugccucggccucccagagugcugggauuacaggcgugaaccacugcgcccggccaccacgaucuuuuuuuaagagucaucaguccaccugcccccuugccccuuuggccuucuacucugccuccuucauuccuccuccauguagaauggauccacuacuggugucucugcugguucaccagucacugagcacagcuaagggacuucucagcgcauucaucguggcuaccauccccucauuguugccagccuccagaagcccucagauuugcccagcaguccuuggucucucucugcuccuuucccccacuggccuuuucaaccuucagcacccuccuuaagccaccugacucuccacccucuccacugaagaccucauccuccuugacugcuaucagguguaacuccuuuguucccucagcuuccugucagacuuaucucucugccuccaaccucauuuccugcccagugguaucuaggaggaagucugaauucugaaucuccuccccaccuucuuccuucagggcaagauccuguucucauauuuccucuaccugcauuuugucagccucuccaucuuucugccgagucccauuuuucagccaaaaagugguaacuaggagcucuaggaccuaaacacaaagaaagcccucccuggaucuucccccuuuagcuagcaaguucuuguucccucgaucccucuuuuucuccccuccuaaugcaguagagaccaauggaaaagugugggauguguuggaggucagagggagguucaucuuggccaagucuuaaaggugucacacgcaagaguuacugacccaggcguucugcucaacgcuuuauagacacuaucuccguagccaucaaaagaggcaccugugguagauggaucauuaucuccaguuugcagaugaguagcuggaggcuuagauagcuaaguaacuuguacgagguacagaagugcucaguggcacaucuaccugagccccagccgugucuugaaggcccaugugaaaaagcaggcagcauugagaaccggugaggaacucauacucauuaucuaggcuggggcucuuuacuuauuuggucagucugaugaaugcucugcaucuccaggcuugaaaguacaucuccacacaguauuugugaaugugucaaaggguucagacccccaaaagcccaucuaauccauauguccacucaaacacuuguacacaacuguucauugcaccguuauccauaauugccaaaagguggaaacagcccaaauguccaucagcugaggaaugaauaaacgaaauguaguacauccauacaauggaauaugauucagcaauaaaaagaaaugaaguauugauacauguuacaacauggaagaauuuugaaaacauuaggcuaaugaaagacgccagucacaaaggacuguauguugcaugauuccauuuacaugaaauguccggaacaggcaaauucauauagacaggaagaucugugauugccuagagcagggaaaagagaguguugguuggaugggaagagaauguuaaaggguacagggcuucuuaacggagugacgaaauguucuauaauugacuuugguaaugguugugcagcucuguaguauacuaaagacugcugaauuguaugguauaugaauucuaugucaauaaagugccacacacaaggcccauccaagaaguuuguggacuuuggacugaaugcgugugaagguccaaggguacacacacauccuaccuaacacagaaccaaugugguuucuguuuucuggugcacaguggucccugcugcuggggacagucccaggccagcucuggggcuucuaaaugaucagccaccucagaacaggcagaucccacucccacacugagugcuaagcucugacauuugaaagaaugagcacguuagcacaugguuugaaugcagggagcuggcaguugcggugugggguuggacaaaaugaucccugaagccccagcuguuucuaaggcugugcacuaacccccacauccuucaucaggagaggcccuugucaaaggcccuggcacaggacucuaugcucuuccuauucauuuuacuguaaagaaacuaccuugauuuagagagcaaagucacugauaagggcgauucauaagauuaaaaaaucacuuuuguuuacacuggcuuuacuugagucggauguggcuuucugguuaaugccagaugugaaugaauaucaacugggacuucaguagaaaggggucaggcauguucugcucuguccagcagacacagggcaaugcuuugaccucacugaguucuuaucugacuggaaaguccauuagauaggaagcguucuucuccagugcuuuccacaauauguccuguaugccagugguccccaaccuuguugguaucagggacuaguuucguggaagacacuguuuccauggacuguguggucagggguggggggguggaaaugguuuugggaugaaacuguuccaccucaaaucaucaggcauuaguuagauucucauaaggagugcacagccuauaucccucgcgugcgcaguucacaauaggguuccugcuccuaugagaaucugaugcugcugccgaucugacaggagguggcgcucaggcaguaaugcucgcucaccucucacugugcggcccgguuccuaacaggccgcagaccagucuguggccugggguuuggggaccccugcuauaugccaaaccugaaaugucauguucugccacugcagcagugcuugugcuauuuaucucucuuucagcuggguguggauaagucuccugucaauauccuaugcagccuucaacauuuugugguagguuuaggugcaugacagagcauggugugagugggauaguguccauuuuuccuuaaccaaaauuaugcuuugaagagucaagaaucaaaauagaauacugaugaaaaguaauucuguauuuuaaagauaaauugucccaccuucaagauguaaaauaacuaugaaauaaaacaauguaugauaaacgguugaaagaaauuccuucuuuuaacuguuuguugcaucuugcuuuugaaauuuccuggccgacgcgauggcucacaccuguaauccuagcccuuugggagaccgaggugguaggaucacuugagcucagggguuugagaccagccuaggcaacuuaauaagaccucaucucuacaaaaaaaauuuuugaauuagcugggcuugguggcaugcaccuguagucccagcuacuuggugggagaugggaggauugcuugagcccagcaaaucaaggcugcacugagacaugauuaugccagaaaagaguauguaaaacuuuuaaaaccuuaucaguguuagucacuuggucucaauccauuuggagagacagagguauagaaagagcccaagaggauuauaagagucuguaagagauauguaaaccaugcaguugggccuuggagaggaagaaauuauaagugcuuaagauugcugggaaaggucuggucuuccuagugggaaggauauuuugugcagagggauugauauuuuucaagggaauaguauaguaagaaauauauuuggucuuugucccugguuccagggcccuaaaacccuuggaauuuucugagugguaggagugucuuuuguuauucauaacuagccucuuucaaucccaccuggguuugugcuaaugaggcgacuuaggauggagccccuagauaaccauaggauaguuacaagggcaugauggcaccugcagucccagcuacuuggugagagguggggggauugcuucuccugacuugcgugcccaaacuucuccugguuuucuucccucucuuugcuccuucucaggcuucucugucagcuucuauguugcaguccucaggacuugguccugggcucucuucuuacacuuuuggggauuguccucacagaugugcuggacaugcuuacauuuccuuuuccagcucagcucuuacaaggcucuggagcccaccuuugggggucucauaggcaccuccagccugauagguauaaaacagaacucucucccuguuaccccugaaagcuacucuucugcuggagaagugguccagagagaaggaacagagcuggacuugaguguggcaguagggagggagggcgguccagcuucaggaaauaguaauaguaccagccacaucugagagcuuaccaugugcuggcuacaguacugagugcucacaggugucuucucacccagcuguucucagcaauccugagaaaggcacagacauggcugaggaagccccagugggauuuggugauugaucagugaaagugggacugacuaaguaguggauggcucuacuauuuuuaaauugaguuuuuaaacgucacucacuuuccugaaaaguagcaugcuuaggcaccuucugaccauggagauguguaucaguuagcuucugcugcauaacgagccacccaaaacuuaguggauuaaaacgacaacaguuuauuuaguucacgauuuugaguauuggcagaccaaguagugguuuugcuggucucagcugggcaugaccaccuggguguuagccaucugucagcugaggcaacagagaagaugagaccaucucucuuucaucauccagcaagcuagccuaggcuuguucacaugacuagcaggguucacacgacugagcaggguucaaagaaagaaugcaaaugcgcaaggcuccuuaaggccaaagucaggauucacaugucacuucuuccacguuguuuggccaaaauaugucacuagaccagccagauccaaggaauggagaaacauguucuaccccuuuuuuuuuuugaaauggagucucacucuguugcccaagcuggagugcagcgacacgaucucagcucauugcaaccuccgccucccagguucaagcgauucuccugccucagccuccugaguagcugggauuacaggugcacaccaccauaccuggcugauuuuuguauuuuuaguagagaugggguuucaccauguaggccaggcuggucuggaacuccugaccucaggugauccacccaccuuggccucccaaagugcugggauuacaggagugagccaccaugcccagacagauucuacuucuugauagagggacccacuaauaauuggggccaucuguucaauaucccacaggucuuaacacuauuggacccuacuuucauccuaaauuugaugugcuuguuaaacuucuuuuuugucuaauuugcaguuaugcuuaccuccuacaagaccuacuauuuccgucuaauucacuguuuccaguugcacaagucccgugaacuuugaaacuagaccaucagacuacucucaacaaauauuauguuaauuuagcaacaaaacuuguuagaacuuuuguaaauggguaaauaggcuagaagugaaagaaggucuucuucaauuuuuagguugugaacuuuauaacaaauaugacaugaggcaguaguuuuugcuuaucaguuccuagcuugguuccagauacgugaggugguuugacgacuguuguuagguaagcuauuguauuaaaaaggucuagcuaugguggaacuguuggaaguugagaaggaaaaagaauuuuuauuugggauuugaugagaagugauuuaucuuuuaugcuguuauuuuaugcauuugauggcuucaguucuauuuggaccugucccaaaauauagagaaaccauaaaguuauuuaauuuuauuacuuuaagacugaggaggaagcaaaaaagugugauuugcgucagcugcagagccuuuugggguucugaaggaaggggagaauuaaucuucuguguauuucauugagaucuauuuaaccucuuauuucuaagcaagccuuguaagaggcuuuuaccuuuuuuucuuuucaauucuccucuuuuucuucucuuucucccagguaagcaucacagugauucaugaguucggugugugagagccuuuaaccuugggaacuggaccuuugucuuucccauuuuaaguccugcaagugucuaaauguuuucuuucagagugugacaaaggcagcauucacccugagcuuauuguugcuuuuaaaggagcucccaaaaaauuuuggaaaauuuuaaacuacaacuuaaaacaguagugagaccaggcacagaggcucacaccuguaaucccaacauuuugggaggugaaagcaggaggaucacuugaggccaggaguuugagacaagccuaggcaacauagugagauucuaugucuauuuuuaaaaauaguuuuuaaguuagcuggccaugauggcuaacaacaacacgugcauaccuccccccgauaguuucacaccuauagucccagcuccucaagaggcugacacaggaggaucgcuuaagcccaagaauucgaggcugcaauggacuaugauagugcagcugcagucuagucugaaugacagcgugagacccugccucauaaggaaggaaggaaggauggaaggaaggaaggaagggagggagggagggagggagggagacuuuuguuuuaaauuccauuuauccagauaguuuaaaacagacagacaaacacauguaucugucugaucaacaaaaaaguaggucaggcauuuccaggaaccucacauuuaugaaacuauuauuauugccuuagugauuacagcaaaggguggagagucugccagggucaagccguggucagagaaagucacuuugucauggaacuauuuuaacugagacugccuuaggaagccccagaaaccacugcuugguccccauggggcugacuucauuaagaguguaucuacuuuuagaucauauucagcaacacgugcauaccuccccaccaaaaauaauugcaaaagcauaacuuuuuaagagaaauaaaaaucaauguauauauuuuuuaaauagaauuuuuaaagguaaauuauauuaaaguguuuuucauugguucuaaucaaggagggaaggcaaauguuuuucuuuuagugaacaauauucuuuaaaacucuuaaacugggagcagaggaacgugaagaauucuuucagaagggcuucaugucaccucuucaacgaaucuuuucuuggcagaauuaucaacaaguagcagcagccaugagugcuacuaaguguauauugaauaucacucuccugcgugcggagaaucucgccucaaacaaaauggacaaagacuuucccuuccuagagccuguguuauagcuggaaauagcucauaaacuagucaucaaacaaaagauaugaauuucaaaucaugauaauaacuagaagaaaaagaaaaaaugaaaggauagugagugacuuggaauggaaagcccagcauuaaggaggagggucguggcccugccugagugaugagaaggcuucaggcugaggugaguaguguuugcacauggggacgagcugaugcccaagcaaaacuaacugaaaguaauuggggagcuguguguggugaugcacaucugaagauccagcuucucgggaagcugaggcaggaggaucgcuugagggcaggaguuugaggcuguauugugccugugaauagcaacuggaguccaaccuuggcaauguagcaagauguaagagugagagagagagagagaagagagaagacaggaaggaggagaagagaagaaggagaaggagaagaggagaggagaagagaagagagaaaggaagaacaagaaggagaagaaagagaaggaaagaacaagaaguaguggagaguggagugagcaagggggagugcggcagacacaaggaggaaaggaggaagguaugggcuguggaccacaggaaggagguuugaaacaggaaugugugaaaagaauccuauuuucacuuuggcagcuaugcagagccuagauucuagaguuaauaaagucaagagacugugaggaggcugcagcagucuaagacaacauugauuuaugacuugcucuggaagucaggcugugaggauagagagaaauggaagacugauggucuaauaaugaagucacuaggaucucaccauaccuuagcucuguaguccagugcaguagcuucuuguauaauauuguuggguuuuuucuguuuguuuuguuguuguuuuuuuuaacugagucuugcucuaucacccaggcuggagugcaguggugcaaucucagcucacugcaaccuccaccuuccagguucaagcgauuccccugccucagccuccugaguagcugggauuacaggcacccaccaccaugccuggcuaauuuuuguauuuuuaguagagacaggguuucaccauauugaccaggcuggucucgaacuccugaccccaagugauuugcccgccuuggcuucccaaaguacugggauugcaggcaugagccaccacaccuggccuuguauaauauucuuuacaagaacguucauuuuuaaccacauaugguuaaguuuaaauuaauuaaaugugaaaauucaauuccuccuucacacuuuuuuaaaaaauagcuacucuuuauaguaucacuaaaguuggacacaugcauaucccaugacccagcaauuccauuccuagcauuccccuccuguaagaaacaugugcauggccaggcgagguggcucaugccuguaaucccagcacuuuuugggaggcugaugggggaggaucacuugagaccaggaguuugagaccagccugggcaacauggcgaaaccucaucucuaaaaaaguacaaaaauuagccaggcaugguggggcaugcccguagucccagcuaugugggaggcuaaggugggagguugacacuacagugagucgugauggugccacugcauucuagccugggugucuggagugagaucuugccucaaaaaggaaaaaagaaaaagaaaaaggccaggcaugguggcucacgccuguaaucccaacacuuugggaggccgaggugggcggaucucuugaggccaggaguuggagaccagccugggcaacauggcaaaaccccaucucuaccaaaaauacaaaaaugagcugggcaugguggugcacgccuguauucccagcuacucagaaggcggaggaacaagaagcucuugaacuugggagguggaggcggaggcugcagcgagccaggauugcaccacugcacgauaaccuccccagagcaauggcugcugcuucucuccacccucccaaucucaagcaagggccucuucugaccaacgcuaacccagaaccauccagggaaggggauccagggaaaacaauucccagcuuaccuaccaggugcacaguccacccggcaugugagggcccaucucuuggaugcuuaugaaauggaacuugagguuugagaaaggaccaaaccuccacuuuguucaccugcgauuuggucaagaguuggcuuggccuguguccugaccauagcaugaagccuguguggugcgugccauuccuuggcugcugcucguaaugcccucccacuucucugucuucccccuugaccgcaaaaguaaagugcuacuguucucuaauacugcaaaaacaaggcaccggcagauuuuaagcugauaaaaaccugcuaaagcugucauuguauauaccuuuuaggauggaaugagauaacauaucccaggguaaaaacaagagugaaauaguucugagaacugugaaacugucguccucuuucuaaaugacuuaauccaacagacaggugguuuuuaaucacggacccccuucuuuuguaggcauuggaacaccaacaucuuuucacuuuaaucauguaaggagugcuaccgcuuacaggccacacacuguuccuucaucaucauuguccccaaugacugguaugaaaaauugaguugagaccugcccaaggucagacagcuaguaaguggcaggacacagauacgaacucagguaggaaauucagaaggaucuaaaguaaaggggacacuuggaggcugaaaaauacccaaacguaagaagacugaggagcccuggggugagcagcagaguuguguugcagaacgugaugaggauuagggcucagcaggugucagccauggcugggccuccuccaggcugucuccuaggauaucugggccauuguaggucacaguuucuuuccugccucccucccuucuuccauuccucuuuccucuuccuucucccuuuauguuuuccuuucuucucccagauuuucucuuucuuuugcguguaugugaucuccccaucuucacuuucuuucuuuguaauagaaugguccaucuauucagccagcuguugauccuagccuuugagcuuugagcaaaucuuuuuuuuuuuuuuuugagacggagucuugcucugucacugcgcaaggcuagagugcaguggcgcaaucucagcucacugcaaccucugccucccuggguucaagugauucucuugccucagccuccugaguaacugggauuacaggcaugugccaccacaccuggcuaauuuuuguauuuuuaguagagacgggguuucaccauguuggccaggcuggucucgaacuccugaccucaggugaucugccugccuuggccucccaaaguucugggauuacaggcaugagccacugcacucagccccuuugagcaaauuuuagcacauacagagaggcuguguagacagaccuaaacauggucccuguuuuuuaggaguuuauccuccacuuucaguuuuguuaugggaagcagcuuccccuacucacagaaauuguuuaugcaaccuauagcaucaccucugcuccugaaccaaacauggaguccacacccuaacucugagggugccuguaagaguccuuagaacauagcaguaauauagacacccaacuggauaagccucuuccucucccucaccccaaaccccccuaucccucuugagggguuguuuuggggaccacuccugguaccugucugaccucaggaugcaggcccuggaguccucuguucccuguguucaccagguguacagcagauagugaggucaagaccugccucugggaaaggagaacaaagaaggaaaagaucuauuuaaggaagcaguucagcaguugucuucuguguacagaaaagucagggagaggcuggucuguggguacaggcagcaccugggaaccaggaugaaauucagaaauuuccacacuguucucugguaccaacaucuguggccacugaagcccgucagagggaccaaaccuguauuuuccugaagcaggagugggucuuuggggcaaguuuuuguugccccaaagaagguggaugggggcauccaccuucuucccaccuuggccaguuaucccagcaagaagcuaaaaccaaggcuggcaugggccuggcugucagccucgccuuucugggggcauuucuuuccuccauugcugcuggccugcccuacaucagggcccccaccuuccucagggcuuucggugcaucugggguugaugguucucugucucucucucuccagggccaggucuggauuaauggcuuuaaccuuggccgcuauuggccagcccggggcccucaguugaccuuguuugugccccagcacauccugaugaccucggccccaaacaccaucaccgugcuggaacuggagugggcacccugcagcagugaugauccagaacuaugugcugugacguucguggacaggccaguuauuggcucaucugugaccuacgaucaucccuccaaaccuguugaaaaaagacucaugcccccacccccgcaaaaaaacaaagauucauggcuggaccauguaugaugaugaaagccugugucuuugagggauucuacccugaacauaccucacagauccucccugucaugccacauuucacugauuggaauguggaaauggaaaaggaauuuaggaugugcauuuucaccugagguuucccugcaucccugcagugccaaagccccaccuucagggaccaccuggaaugugugaggggcugacagcacaguaacgugcauacauaucugcagggcuggaauggaagcuuuaaaggugguagugauuuuuauuuuggaagaaucauguuaccuuuuuguuaaauaaaauuuguacucaaaugaugaugucacuguuuuuaaugugcagguauugaauuauauggucugacuuaaaucauaacuagacuugagugggcugaauaaaccacuucacuaacuugaaguucaaaaggauggaaaaua

SEQ ID NO: 192105 - RNA, 88657 nt, Homo sapiens
gugaggcggaagcuguguauggcgggaggcuguggcggucccuugguggggaagcuguugcuguugcuagacgacgggaacuagcucucgucacuuccucagcccgccgucugcccacuccucuagccggaaccugggggcccggagccgggguaggcacagaguuguccucggagguccaggacagcggccagcccggcggcgggagucagggccacgccaccugcagggaagaacccgagucgaagcgggaagauggcugcagacaagccugcagguagggcgccaaugucccgagcgacgagacggcgggacgugcggggccgggcggacccugaacucggaggcggcggggcccgggguggggacuccagggcgacuugaauuugggcgugcauuucuuuaccccauccucugucucggcugucgcuaacaugagucuucgggccccggguccaauaguuguuuuacucaagugcaguauuugaagucgccacuggccgccuuugcccugcucuucagaauaacuccggcccaaaaagcuuaaauguauuuugccgcuucgcagaauuuuccgcuucuucgugggaaaagcagacaagagaaagucacccuggagcacacaucugccuauaauaucgcguggcugaggcugggauucaccugggcuguuuugaccacauguggcuuccucuggucauugacuccugugaaauuaacuuuguaaaaaccacuuuuuuuuuucuugauagagacgggcgggggucucgcuauggugcccaggcugaucucgaacuucugggcccaagcgauccuuccgccuuggccucucaaaguaaaccacuuauuuaaaaaggcauaaaauccuauugucucucuacagucugugcuccuaaaaucuugcauuugguacuuaauugcucuaguuccucgaaauuacuuaaucucaaugguuuucuuuauggauuauugcucccauuccuagaaucuuccacauuaaggaauauaaaauuauuuccugaccuuguccggaauguuucccgcaagaaauucauauucuuuguggcauccagguuuuauuggaaagaacuuaagugacaggauuuaaaagugauggaacuuaaaauuuuuacagugaauuuaauuuaaaauuaaagaaaaacucagugugcuguggauuuuaguagguucuggucacaauaacugacaaaugaacuucacuuggaaauuaagccaauucuauuuuagguacagaggaauaaaaaucauuagaggaucucuucaauaaucuaagaagaaaaacaacagaacaaaggccuugagaggguauaaggaaugugcugugaaauuuuggauagguuguucagggaaggccucuggugagaugauauuugagcagagauauguaagaagugagggaaugagccauaagaaaugaggaaagguggaugagggagagacuauuagacaggaaaacggcauggccuguccaaggcuggaccaggggaccaacaucuuccuccuuauuuuagaauagugucuguguuccccacauuuaccauuccuacuugcucauaccauugcgcuugcccgaaaucacccuuuuagaccuaaagcccauccaguuuucaaauccucagucauaaagccuucuacuuguucauuuauucauucgcaaagauugaguguugaauaauggauaugacacacucccugccuuugaagaccugcuguucagucuguuggaggagacaggcauauccuagcugcacuccuguuugguaagagcuguguaauguguguaguugaagaauaagguccacagugauuaggggacuguuuuuuucauugguuuaaguuuauaggccauauugaaggaaacuuccugcuuugauauaagguuaaauuugaauaaaauagaugaguguuuaguguagcuccuuugaaucucugcucaucuccaucucaucugcuguguuucuggccuuuaucuuuuaauaugaucuaugucgcauugaguagucuucucacugguguuugucucuugucucuuccuaucccauccauuuuccucacugucgccccccgcuuuuuuuauguccuaagacauucauugaauccugucauuccccuuccuauaaaguuucuaagacuguacaugcuuugggcaucaagucaucauucuuuuuauuuaauuuuuauuguauuuucuuucuccuuuuaaguccucacgguuuuuuuuuuuuguuuuuuuuuuuuuuuuugagacggagucucgcucugucacccaggcuggagugcaguggugcgauaucggcucauugcaagcuccgccucccggguucacgccauucuccugccucagccacccgaguagcugggacuacaggcgcccgccaccacgcccugcuaauuuuuuuguauuuuuuaguagagacaggguuucaccauguuagccaggauggucuccauuuccugaccuugugauccgccugccucgcccucccaaagugcugggauuacaggcgugagccaccgcgcccugccguccucacucuaaugugguuugugagcaucuucaaaaucuauuuccagcuggauuucuguaucaacccacccagcucuucacaucauaaauuacuguugcaaagcauuguguuuuuugagcuuuugagccguaguguccuuucucuucuccgucuggugaacacuauucauucagucuaucuuacaugcugcuuccucucugagcucacgaggucaggauauuugucacggagggucuuguguguguguucuucaucagguaagaaaaaagggucaugaaaggacuuaaggugagugaucugaucacacugacuguuguaggugguggauuuaaaugaaguaagacaggaagccuagagaccaccuaagaugaguuaauguugugauauuaauuuauucaguaaauauucaccaauggccuguuuugccagguacuacuuuaggaacugggcaggaacaaaacaaagucucuguucuggagcuuauuuacuaugaaggacagauaagcauguaaauaaaaugaaaaauaagaugauuucaaguugugauagauacucugaagaaggccaagugcaguggcucacaccuguaaucccagcauuuugggaggcugagggggguggaucaccugaggucaggaguucaaaaccagccugaccaacauggugaaaccccaucuacuaaaaauacaaaaauuagccaggcaugcuggcgcacaccuguaaucccagcuagcugggaggcugaggcaggagaauugcuugaaccugggaggcagagguugcagcaacccgagaucgcaccacugcacuccaggcugggugacagagugagauuccaucucaaaaaaaaaaauaauacucagaagaaaaaaaugaguaagagaggcugucugcaguugcucacaccuguaauccuagcacuuuggguggcugaagugggaggauugccugaggccaggaguuugagaccagccugggcagcauaagugaaacccugacucuaaaaaauaaaaagccagauaucauggugugugccuauagucucagcuccuagggaggcugaggugggaggauugcuuguaccuaggaguucaaggcugcagugagcuuugaucacgccacuguccaggcaacaggaugagacccucucucaaaaaaauaaaauaaaaggccggacgugguggcucacgccuguaaucccagcacuuugggaggccgagguggcagaucacgaggucaagagaucgagaccauccuggcuaacacagugauaccccgucucuacuaaaaauacaaaaaaauuagcagggccugcuggcgggugccuguggcucccaccuguaaucccaggacuuugggaggccgaggugaguggaucaccugaggacaggaguuugagaccaggcuggccaacauguugaaacccugucuugacuaaaaauacaaaaauuagcuggucgugguggcagacgccuguauucccagcuacucgggaggcugaagcaagagaaucacuugaacccagguggcagagguugcagugagccaagaucgugccauugcccuccagccugggcaacaagagcaaaacaccaucucaaaaaaaaaaaaaaagaaaaagaaaaaaaagaauagaggaugacugaaagccuuguuuuucagauagauuagagaagggcuuucuuagaguugacauuuagacagaaacccuaaggauaaagagccagcuguguugggaagaaugauccagguaagaggagcaacaaauaugcaaauguacagaacccuugcuuggaaaaugucuaaagaacaucaagcagaccccuugaauacaagcuccccgaagauagagacuuuugucuguguuaguuguguucuagcucuagucccuagaacaauaucugacaagagacacucaacacauaauuuaaggcugggcauagaugcucacaccugugggaggcugaggugggagaaucgcuugaggccaggaguucaagaccagccuaggcgacauagccagacuugucuccguaaaaaauaaaaaaaaauuagcuaggcaugguggcgugacccugaaguccuagcuacuccagagucugagaugagaggauggcuugagcccaggaguugaagguugcagugagcuauaauugugccacuguacuguagccugggugacagugcgacccugucucaaacagaaaacaaaaaagccaauacacauaauuuauagcauagggagcaaaggcagcauggcaagagauaaagucacaguuguaucaggaguugguguauguugggcguuacaggccauggagggaguuugaauucauuuuaacuaaugggaagagaguggaaguuuucaauaagggcaugauggugugaucugauuuauauuuaacugauccagguaaggaaugauaagaguaggggcuuugaaaucagauaguuuagguucauccuagcuguacuacuugguauuugugggaaauugggcaaauuucaagaagucuuuuuuuuaagcuucagcuuuccugcguguagaaugagaacgaugaaaguaucuaccucacagguaugguaacagguuaaaugauauaaucucaggcucugaguuuuuugguuuuuuuguuuuguuuuguuuugagacagggucucacucuuucacccauguuggugugcaguggcaccaucauagcucacugcagccaugaacuccugggcuuaagcaauccucuugccuuagccucuugaguaguuaggacuacggguguguacuacuguauccagauaauuuuuuuuuuuuugagacagagucucgcucuguugcccaggcuggagugcaguggugcgaucuuggcucacugcaagcuccgccucccggguucacaccauucuccugccucagccucccaaguggcuaggacuacaggugcaugccaccaugcccggcuaguuuuuuuguauuuuuaguagagaagggguuucaccauguuggccaggcuggucucuaacuccugaccucaugauccgcccgccucggccucccaaagugcugggauuacaggcaugagccaccgcgcccagacuuauuugguauuuuuucaacuuuuuauuaugaaugauuucaaacaccuaaaaaauuuaaaaaauaaaaugaauaucuauauaucuacccccuaguucauucagcaauuguuauauuuuaccauauuugcuuccucuaucacuagcuaugacuuuuuuuuuuuuuuuugagauggagucucacucuguugcccaggcuggacugcagugguacgaucuuugcucauugcaaccuccaucucccgaguucaagcgauucucuugccucagccucccgaguagcugggcuugcaggcacacgcuaccacagccagcuuuuuuuuuuuuuuuuuuuugagauggaaucucacucuguugcccaggcuggagugcaguggugcaaucucggcucagugcaaccucugucuccuggguucaagugauucuccugccucagccuccuguguagcugggacuacaggugugugccaccaugccuggcuaauuuuuuguauuuuuaguagagacgggguuucacuguguuagccaggauggucucgaucuucugaccucaugauccacccaccucgaccucccaaagugcugggauuaacagacgugagccacugugccuggccaugcccagcuaacuuuuguauuuuuaguagagacgugguuugaccauguuggcccggcuggucuugaacuccugagcuuaagugaucugcccgccucggccucccaaagugccgaugugagccaacacaccuggcucuagcuaugacuuuuaauguugaaucauuucaaaauagguuauaaacaucauaacacuucaucucuaaauauuucaacaugcguuucuuaaaaauagggacauucaccuauguaaccaugaugccauugucauaguuuagacaauucauguuuuaauauauuaaaaauuuccugccagccaggcauggcgccucacgccuguaaucccagcacuuugggagucugaggugggaggaucaguugaguucaggaguuagagaccagcguagguaacauggugaaacccugucucuaccaaaaauguaaaaaauuagugguggcgcaugccuguagucccaccuacaagggagggugaggugggaggaucauuugagccugggaggcagagguugcagugagccaagauaaacaccacugcacuccaaccugggugacugagugagacccugucaccaaaaaaaaaaaaaaaaagccaauuucccgccaggcauggugguucauaccuauaaauccuagcacuuugggaggccgagguggguggauugcuugaaccuaggaguucaaguccagccugggcaccaugguaaaacccugucucuacaaaaaauacagaaaguuagcugggugugguggcaugugccuguagucccagcuauggcuauauuuuaaaaauuuauuuguaggcacagggucccaauauauugcccaggcuggucucaaacucuugggcugaaggaauccucccagcuuggucucucaaagugcugggauuacagguguaagccacugcacccagcuuuaucuccuguauuuucuuaaacucuaacuuauuucuacaggcuugauuagauauagguucaacauauuuuugagaaacuuuguaggugauguuauauacuuuauuuucuguauaaaguacauaaugucagguuauccaguauuagugaugcuaaauuugaucaauuugaggugcugacaggaacaucuuuuuccauuuucaguuagagguaauuuauggaguaauuggcauuucguaaauauccacuguuguugauucuuuccucaaucaguuguauuauugaggguuacaaaaugauuuuuaccuaguucuauuguaguuucuaccuuuguuagugaauauucuucuuuaaagaguagcucuccugggcuggguacagugacucaugccuguaaucccagcacuuugggaggccaagguaggcagaucgcuugagcccaggaguucaagagcagccugggcaacaugagagccugucucuacgaaaagauugaaaaaacuuaguuggugugcugcugcgugccuguagucccagcuacuugggaggcugagguaggaggucacuggagcccaggaagucgaagcuacagugagccgugaucacagcaccgcacucuagccugggcuacaaagugagacccugucucagaaacaacaacaaaaaagaauagcuuucccauauugacuguuagucuucccagaaagccauguuaaaugcuaaaagcuuaauucauuauuuucaauuaccaguuuucagaacaaggaguugaugugguagugaccuauguuugauauuuaaagugguuuuuuuucuuuuuuaaauuuaauuaauuuuuuugaggcaggcuuucacucuguugcccaggcuggaguacaggggcaugaucuuggcucaccgcagccucgaccucccggauucaagugauccucccaccccaaccucccaaguagcugggacuacaaguacaugccaccacaccuggccaguuuuucuguuuuucuguagagacaggguuuugccauguaucccgggcuggucucaaacuccuggacucaagcaagccuccugccuugacugcccaaauugcugggauuacaggcgugaguaaguguuuuuaauauuagaauuuagaguaauauauuggucuuuuuuuuuuuuuuuccagacagggucucacucugucacccaggcuggagugcaguggcaugaacacugcucacugcauccuugacuucccaggcucaagcgauccucccaccucagccucccaaguagcugggacuauaggcaugcgccaccacgccuggcuaacuuuuguauuuuuuguagagaugagguuucgucauguugcccaggcuagucuugaacucuugagcucaagccauccucccaccuugaccucccaaagugcugggauuacaggugugagccaccaugcccggcacuuauauuagucuuaugauuucaauuuaaaauguauaauugacugaauauugauuuauacuugugaauuuaaauugaaaccuuauugcaguuauuuuauuuuguggacauuagagaguaccuaagagucacuauaaguuuaauuuuuuagguauguaaguuauucucaggaaauuuuuuuuucuugacacauguuaaaauacaaaaauuuugucuuuuuaagucuagcaauuauacuuaaaauugaauauauuguugggguuugguggggggguugcaauaguucucacuugauaaauuuuuuuuuuuuuuaauuuaaaaaaaguguuugguacucuacacuuucagagaaacuucuccaguaacaaacuguagaaaugaucccugaaaguguagucuugguaaaauuuuuuaaguaguuaacauuuuauguuugaagauguuauguugaaggugaacuuugaaaugaguuuagacauucaucacaggccuuuaaaauuagaccuccaaguagaauaaguugucuaaguucgguguaaaaauuugaguaaaaucuaggcuuuuugaauuuguaacuuuaauaaauuaaguauuaauauuuuaaaacuagaguaaaucucagucuuuucuaugcauaaaaacuccuccucuuagaugugaaaacaaaauacucaucagcaguggcaauauucugcuuugccuagcuuccuuaaagcaugcugauauuguuuuuucuucuuucaguuuuuuguuuguuuguuuguuuuuugaggcagucuugcucuguugccuaggcuggagugcaguggcaugaucucgggucacugcaaucucugcuuccuggguucaagugauucucccgccucagccuccugaguagcugggauuauaggugcgcaccaccacgcccagcuaauuuuuguauuuuuaguagagauggggguuucaccauguuggucggaaugcucucaaacuccccaccucgugaucugccugccuuggccucccaaagagcugagauuauaggugugagucaccgcgcccagccuaacuuuuauauuuuuaguagagaugggauuucaccauguuggccaggcuggucucaaacuccugaccccaggugauccuccugcccuggccucccaaagugcugggauuacaagccugagccaccgugcuggccaugcugauauuauugauuugaauuucuguuccuuuauuucuacacuacugggcaggaugcucaauucuguaacauugcuuguuacaaauggcuuauucuuugggcugcgaagugugugcuuucccauuucuccagcuccucuuguccaguggagggaauaugguuuagugaauaaaccauuugagguuuugguaagucaaguauacuuguucagaugauagaaaucauaugugagguauguuaaccuagcuguauagugacauuagugggccugaauuguuuuucuucgaaguggcauccuucuuaagauuuaaaacuuuccuucacaagggcaucauugguauuuugugacugugauuguugauuuccuuaggucuuuuaacaucccuuuuuucuuuggaaaaguuuucuuuucuugauauaucaguggagcuguauuuugaugaguguagcuuguagucuccaccaaucagauuugaaugauuaacauucuguauuggaaugugucugugcuuucaguuaacugaugauuuucaguuuugaaaacguggugcauuucuuuucugcuuaguucaaaccuaaaggcaauuguuuauuuagaaaugaagucuauugguguaaagacugucaagguuugugggucaaagagcucuguacgcauagaaggucagccauguucauuaggccagaguagaaggaaagucaagcuuaugggugaacggucguauacucuuucaauuggcaacggagacuacuuuugggcaaauaaagaaaugcugugggauuaugugcagacucugucugguaagaagucaguaguuauaaauaauaaauguuuuuaaaacauuaaaaaaacugauuacaaaaaugaauacccauuucuggcagaaaacucgagaaauguacaaauacacaaggaaaauaaaaauaauccuguugaagagaguguguguguguguguguguguguguguguguguguguguguguguguauuugaaauggggucuuggccgggcguggugacucaugcugguaaucccagcacuuugggaggccgaggcaggcggaucacuugagaucaggaguucaagaccaaccuggcugacaugguaaaacccugccucuacuaaaaauacaaaaauuagcugagcaugguggcgggcaccuauaaucccagcuacucaggaggcugaggcaggagaaucacuugaaccugggaagcagagguugcggugagcugggauugugccucugcacuccagccugggcaacagagugagacuccgucucaaaaaaaaaaaagaagaagaagaagaaauggggucucacugauugcucaggcugguagucauauacugggcucaagcaaucuucccaccuaagccuccugaguagugaaguguguuuuuuuaaaaacagaaaauuuucauccugaaguuaaagaagguagguaaaauaaugguucguuaacauguaaaagguuauuuauugagcucaguucugugaaauguguguagaaaugggaauuucagaggcucuugucagccuuagaguccagcuuaucuauuuauuuauuuauuauuuauuuauuuugagaugaggucucacugucacccaagcuggagugcaguggcacaaucucagcucacugcagccuccacuuccuggguucaagugauccucccuccucagccucccaaguagcaggacuacgggcaugugccaccacaccuggcuaaguuuuguguuuuugguagagauggguuuucaccauguuguccugagcucaagauccacccuccucagccucccgaagugcugggauuacaggcgugagccaguguguccagcccagcuuauauauuuaucuuaaauuggcuucucuccuuuucuggagaauuuuaggagacuuacauuuucuuuuucuuuucuuuuuuuuuuuugagauggagucucgcucugucacccagacuggagugcaguggcgugaucucggcucacugcagccucugccuuccggguuccagugauucuccugccacagccucccaaguagcugagauuguaggcauaugccaccacgcccagcuaauuuuuguauuuuuaguagaaacggguuucaccauguuggccaggcuggucuggaacugcugaccucaggugaucugcccaccuuggccucccaaagugcugagauuauaggcgugagccaccauguccagccugauacuuccauuuucugggguugcuaacagcaguggccacaugaacuacucuacuuuuaguggagaauagaagcucaaaauuuucaacaccugggugaguuguuggguuuuccccuuugcccuguauuucuaaggugcucuuacaguuggucccaaaagucccauuaaagaaugucaucuaaucuagggcauauuuuacuuauuuauuuuauucauaucuuuuauuauuauuauuuuugagacaggguuucacucugucacccaggcuggagugcaguggcauggucacggcucacugcagccucaaccucccaggcuucaacgauuaucccaccucaccuccccaaguagcugggacuacaggcacaugccacuaugccuggcuaauuaaaacaauuuuuuaaaauagagacagggucuuguuuuguuucccaggcuggucuggaacuccuaggcucaagcaguccuccuuccuuggccugccaaacugcugggauuacaggugugagccacugcccagccaaggggcauauuuuagaagaagcuuuagagaaaacucaauagcaaacuaagaauuuuuggcauuugguuuaaauuaugcuucuuuaugagagaagacacauuuuuuaaaauguuagguuuuauaaaaucuuuaauaauaaaagaaacaugaaagauauuuauauucuuuguuaaaguuuuauggugacaauauguggauugaggauccuguuucaaucuaaacuuauaacuugccuucugagguccuaaaguccugugucacauuuuuacacguuuuaaaauaauugguccuuaccucuuuugugcaccugacaguucugcaaaacacauguauuggauaaacaguauguucuugcagugaaacucauuguuauuggcuuuccaaagaaaaaacuguuuaacauuguccuuugaaacuggcaaacuuuauucacuuaacucuuagcuuuuccuccucccugucguaugcuaaaguggaaauaaaauaacuacuugaccugcuaacuuuaauuaucacaaguaacacuuuuuaauaagcccaaauacuggaaugccuuuuuuauacagcagauaaguucuuagaugaguuuuuuuaaguacaaguuauacaguauuacguuguuauaaguggugacucucaaaaggguguucagucuucuggggguuucguagugaucuaaagagcuguuucauagucaagucacaugaaauugaauuuuacuguuaauuuuuauguuuaaauuacagacauaaauauauuuuuaaaaauauaaguacaagaauuuuuaguucuggugaaaggaaaguggggaagggagcuauauuuauuuagcaucucuaauuaaaaacaggccaaaggacgacuggacugaagaugugacugauucuaagacuugugcucuuuuaauuaugucauauugccuucuuggaaaagggaaguugggaaucuucacugacugcugacaugugccaggcuaggacuucccaaaguuaguucuguugacaacugguucuuuuauuuuuaguuuauuaagauggggucuuacucugcugcccaggcuggagugcuuuggcacaaucucagcucacugcacacuccaccuccuguguucaagcaauccucccaccuucgccucgcuuguagcugggacuacagaugcaugccaccaugcccagcuaauuuuuguauuuuuuguagagacgggguuucaccaugcugcccagacuggucuugaacuccugggcucaagugauccacccgcguuggccucccaaaaugcuggaacuacaggugugagccaccacaccuggccaacaacugguucuuugagaugcuccuguugucuaggcaguuaucaaaaagugcccagaucauaagugcacauacaguuuggugaauaguuugcuguguauccuuguagacuuuauacuuauucagagguacauauuuguguauauauuuuuauaaaacaugggauucaguuguacaaagcaguuugcaaucuguuucuuuuauuuaacaacauguuguaaauauuuuuccacaucaaguuauauagacuuaauaacuguuaaugugccauuguauuccuauaccaugauuuaguuaucaaaucucuugaagaauauuuauuucuagacauuuaguauuaucguuuuaauuuacaauuauuuaauaaauaaugaggcugaauuucauuucacguuauuaagccauucauauuuacucuucuuucagcaaguuucugguguuugaggaacacugugaaggacuguggcaggguucuugaagauaagggaguuuguuuaucuaggcaacuccuggaagccauuauagagggagucacacuucccaguauccuggaagggggcuugugauggaugaggugcgaaaguggaggcuacuaugacagaugcaacucuagggcaccauacugggggagcauuccacuagcucuagccccaacuugaguccauguuggcagaucuauagaaggagagggaagaauggaaaggagccaguaagcaaaagaaccccauaaccagugugauucuugacaacuuucuggaaaguugguuguaggcacucuugagggguaaacuuggggacaagguggucuacuauuucucauguggguauuugucuuccauagaaaccuuaauuggauaugagugcugcuuuaggaacaaacauaucaguuucuuuuuuuuuuuuuuuuuugagaugaagucuugcucugucacccaggcuggagugcaguggcaugaucucggcucacugcaaccucugccucccagguucaagugauucuucugcuccagccucccaaguagcugagacugcaggcaugcaccaccaugcccggcuaauuuuuguguuuuuaguagagaugggguuuuaccauguuguccaggcuggucuugaacuccugaccucaggugauccgccugccucggccucccaaagugcugggauuacaggcgugagccacugcgcccggccucaguuucuuuauagaagcauguuuggaguuacugaaucugaguuggaagggaugcuaaaaacuauuuaauacagacucucauuuuaguaaauagggaagcugaaacuugccccaguuccacuuuguagcaucuguuuaauuucagaagugacauuaaaguuuuagucuuauuucaauucuaaaaauugucuguacgucacugugcaaccugccucccgucuguauguugaaaaugauagaaucugcacuauugugcuacauaucagggguuuacucugccagguacaugccaauugcuucacauauauucuuacuaaagccuuacaauaacuugaaaaaggguuuucuuauccccauuuugcggauagguucaagcuuuggaggucuuugaguuucagucugaagcaacaauucuguaugaaaaaaauuccuguauaaauaagaaauucaaauauugugagacuuugaaauucuuuaaagucauacacagugacauugccaucaccuaccuauguuugcagcccaugacaucacauuuauacaguggucacauuuccuuuuaaugauauuuccauuaguggugcauggagcuuuugcuggugaguagaaccaagaaacagaauauucuuugggagauaguaaaauauaaaaggcaucuuuuaaaaacaaauggcaaauuuuugcagaaaagaaaacuuaacauuaaaaaugacuaagccaagcgcaguggcucacaccuguaauccuagcacuuugggaggcugaggccagcagucaccugggaggucagaaguuugagaccagccugaccaacauggcaaaaccccgucucuacuaaaaauaaaaaaauuagccagguguggcggcaggugccuguagucccagcuacuugggaggcugagccaagauugugccacugcaguccaaccugggugacagagcaagacuccaucuaaauaaauaaguaaaauaaaaauaaaaauaaaaaugacuaauauuuacauuaccuauauauaguauucuugccagaaauguuaaacugcauguaauauugaggaaauaaccagaaaaauucagaauguaggacauucuaauucuauuuaauuaauucuaauuggcuuagacucuuuugaaaaaauaaaaaaccaaaaaacaaugaccuaaugauaucguguagcucuguguccccaaccaaaucucauguugaauuguaaauccccaauguuaggggagggaccuggugggaggugacuggaucauggggguggauuucccccuugcuguacuggugauagugagugaguucucacuagaugucguuauuuaaaaguguguagcaccucccccuuugcucucucuucugcugaccaugugaagaucugcuugcuuccucuuugccuucugccaugauuguaaguuuccugagaacucccuauaugugcuuucuguacagccuguggaaccauaagccaauuaaaccucauuucuuuauaaauugcccagucucugauaguuguuuuuguuuguuuguuuuuugacagagucucacucuguugcucaggcuagagugcaguggugcaaucucggcucacugcaaguucugccucccggguucacgccauucuccugccucagccuccugaguagcugggacuacaggugcccgccaccacgcccagcuaauuuuuuuauuuuuuauuuuuaguagagaugggguuucuccauguuagccaguauggccucgaucuccugaccucgugauccacccgccuuggccucccaaaaugcugggauuacgggcgugagccaccacaccuggccuuuuuuuuuuuuuuucucaagacagucucacucugucgcccaggcuggagugaaguggcgugaucucagcucacugcaaccucugccucccagguucaagcaauucucgugccucagccucccaaguagcugggauuauaggcaugagccaucacgcccagccaacagugacucuugagagaacuauaaaaaguauugaagcauuuguuagaguacuuaacacacuuuugcucugaguaguuuagguuugguucagcugagauuuuuaccuuuauuuuggaauucuauuuucaaauuaaaacaaaaagcaaaacaucuaauauuuaaaauagcaaauuauagagguaggagguaguuuucccagcuaaacagauuauuaaccuuuacugugaauuuauauggacacuuaacauauuaaagaaacuuuuuaaauguguuaauauuuuggauuucugagccuaugaaaauauuccuugccuggaaauuagcuguaagcccuuaucaguguaguuuucugauuguuacuacuuuccaacuaaauuauaaaucucuuaaagccaucguagguguguuuauaucuccagcaccugccauaguugcuugaauaugugggacuguauauugcuggguggcagaucuaauauuuuuuaaagagcacaauauucucagcuugaauguccucaucuacagggcuuguggucuuuauuuaagugggcagguuuucauuguguuucaacuuggccauaggaaccuuuucaagcuuucagaggaguagcuucuuauuagcuuauaacauuaaucagucauuguuuuuuguuguuuuuuuuuuuuugagacggaguccuacucugucgccccggcuggagugcaguggcauuaucuuggcucacugcaagcuccaccucccagguucacgccauucucccgccucagucucccaaguagcugggacuacaggcgcccgccaccacgccaagcuaauuuuuuuuuuuuuuuuuuuguauuuuuaguagugacgggguuucaccguguuagccaggauggucucgaucuccugaccuugugaugugcccgccuuggccucccaaagugcugggauuacaggcgugagccaccgugccuggcaacauuaaucaguuauuguugagagagcccuaacuuuggccacuuuauuaggaagaacacaagaugaaaacuagggacaaauucacuauacaguagucccccaccuuuuccucagaagauacauucaggguccuccgguggauacuugaaaccacagauaguacugaaccuauguacugcuuuuuuuaauacguacauaacuaugauaaaguuuauaaaugaggcacaguaagagauuaacaacaacaguaauaaaauaacaguuaucugaaugugguuucucuuucucaaaauaucuuacuguacccuacucaccuuucuuccugugaccuauugaucugauaaccaagauggcuacuguguguccaagggggagguaucuuauacaacauggaaugcuagacaaaggaaugauugacuuccuggaugggacagagcgggacacugcaggauggcaagagauuucaucauguuacucagaacauugcuguuuaaaacuuaagaacugcuuauuucuggaauuuuccaucugauauuuucauacuugaccuuggguaacugaaacugcagaaagugaaacuggauaaggagggaccacuguacaacuuuuauuucuaaagaacuguaaaauuuguguguuugcagaucagggagcagagaaacaugaaggcacaggucaguccucugggaucacugaucaagagaaggaguuauccaccaaugcuuuccaagcuuucacaguaagaaauggcuucucuuagucugcucaaguuguaggguucugucaaguaugaaucuuuucauagugaauuuuuaaauuuacaauuuuuacucuguaauaauucaaaaguuaauuuagagauaaguagguuuaauuuuuaaaauaaauguuuuagaguuuaaauauggugaaaggaaugggaauaauuggagccauucccaaguuuuuguaaacauguuuuaacucauauacuguuguuuuuaagucuuuuaaauuuagauuuguaaguaugugggucagucuuuucauuucacuaagcuguucaauucuuuuauuuauuuauuucugaaaauaucagauucaaaaauuauuuucuugaagguacuuuaaaauggaaccccaaaacuuuauuggcagaauuuuaacuuuuucuggcauuaaacaauaugaaagaaaaccuuauuugguuaucagguuacgugcauguaagcagaagaacuugaugcuuggguauuuaaaauauauuuacuagaaaauaaaauuuggagugauuauauuaccuuucuugacuagccucagccauuaauacccugcuagcacuauauguauaugccaguauauuuaucauaucaauauaugugucuuauaugugucaaugucaggguuuugagucuuaggaaguaaauauccacaguuuaacugacaugaauguugcuuuagugacuuugauuaguauauguagggaaacuacaucuuucuuuuuaagaacuuuuaagauaaagaugaaugaaauauauuuggaaugauauacuguauuuaaagcugguauguaauuuugugugugugugugugguuuuuuuuuuuuagucuggaaauuaugaugccugucuacaacaccuugccugucuacaagauauaaacaaagaugauuauaaaauaauuuugaauacagcaguagcugaguuuuuuaaaaguaaccaaacaacaacagauaauuugagacaaacacuuaaccagcugaagaaucaggugauacauaaaugaauuuaacuauaaaaaauauuguucuguucuuuaauuuaugaaacacaaauaguuaaggaaaauaaaugugauuugucugguauuucuugucagaaacauuuguuagcauuaauuuuauuuccguaaaauuauuauuccaggagauaaaagguauguugugggaucauuuuuuuuaauugggguuuuaaugaacuugaacagaauagacuaauauaccaaauuugaaugagcuuuggaguuuugagaaagaacuauaugaagaagcuuagcuguggagauauaucuuguuuauaaugaaaaaaauaugauuaauccuaaugucaagucguuuuagcauuuggaucaggagaugauugauuaaauagaagauauucugcuuuguaucuggcuuggggcuugaauuggggauuggucuggugauaauggcaauguuucuugaauccuggggcuagacuuuugguguucaagagggcugauaacagugauggugcugauaggaucagcuagcauauguuaaguguucacugugugacagggcucugccaagcgcuuguaugcaacuucucagcuuguucuucucaguagcccuaugaaauagcuauauaauuuuucuuauuuuaaaaguggaaaagccaaggcacagauagcuguguaaauuguccaaaaacacaaaguuuuugaguaguaagagcuacaugaacucaguuguauuuaacucuauagccuguaauuuuaguuacugcuucaugcuguuagggagucaugagaccuuuccuguaaucaugaguaccaugauacucuauaguaucacccuaaagugugacacagguagagaagcaaguugucccuucaggcucucuguaauccuuuauaggcauaaaguaauuuuuaaaccccauuaaaauucaaaaaugagaauaauagcuaccauuuauugaaugcauacugggugccaaauucuguauuaagugccuuuuaugccuuaucucauauaauccucacauucaacucuugaggcaguaggugcuuauuaucucaguuuuaaaaccagaauuuaggaagucuaauuuaaauuuacacaacuaggaaggggaagaacagauuuaaaccaggccuucugacucuugagccuguucuccuaccugucucagucuucauaaauuuguauguccucacguuuccucauuacuccaguauuauuacugaugauuuuaucuaguguuccagaaucaaaagaaagaugaugcuuacugauaaucuaguacaugcacccuaugaccccauagacaguuucuuccaagacaaauuuguuugguuuuugagaauaaguucagccuuuaaacuuuuuuugaauaagcaauuccugcaaacuuccaguuaggccaaaaaaacuuugugaaguucuuucacuagcuuuuauuguuuauaagguuuguuagggccuuccaacucuugaguuuccuagaaguguuuguacuugugguuacugacuucuuuaaaucauacuucuguucgcagucacaucgggcacagugacacaccuuuucaaccuauuccauuuuaauuagcaaacgucuaauuucacuuaaugaguaguuuuucuuuuggcuggagcaguuacuagacuauuuuggugagucauagaauauguggcaaaguuauuugugugauaauuauucaaccauugcugaauccaaaacgccauaguuuaucuaaaagcuuuucuggcuaaacucuucuuaacucagucucucuccauuacauaacuacagaaagaguugccuuuggaaauugaguuuucacuguuugaagauacuguuuuuaaucucuuuaagauagugacuugauaagugaagauuauaaaaaguucccaaacucauugagaugcacauguuggucagcuaggaccacuugcuaacauuugaaccaugucaagcuuaaccacgugggugguugacgucugcugaaguccaguuacaaaauuuacaauucauuguguguagugaaccuucagguuccuugccauuagucaaaccaaggcuguuaaauccauguacuguauaucagaguucuauggaaguguuggucuuagaguuaauuacuuaauauugaacaauaauuuauugcaaucuucauaauggcaaagguuaguuuuaauacaaguagacuuccaguuucauguguuacauggaauugugcaaugguuguaaagcuugauuaaaauuuaaaagcccauugcuacagcuuacauaaggggguauacaguuugagaaugcaaagugucaugcuuuuuuuuuuuucuuuugugucaguuacagauguuagccuuuagugaagcccauaaaagccuuuucuaaccaucaugugugcaauaauauauuuuuauuauugaguacuuuaaaaaaaucuauucuuuuuuacgggaacgaaaccugaaaauauacuuucuagcccuauggccuugggcaagauaauuaaguuuucugugcugguuuccuuauguauaaaguggaaaugaaauuaucuauguccucggccaggugcgguggcucaugccuguaauccaagcacuuugggaggccgaggugggcagaucgccugaggucaggaguucaagaccagccuggccaacauggugaaaccccaucucuacuaaaaauacaaaauuagccagguguuguggugcaugccuguaguccgagcuacucaggaggcuaaggcaggagaaucacuugaacccuggagguggagguuacacugagcugaguucgugccacugcacuccagccugggugacuccaucucaaaaaaaaaaaaauuaucuaugaccuugagguauggugaggauuaaccuguaaaaguuuuaacauagcaagucuggcacaugguaaauaguuaacuauuuuuguuuuguuugauacagagucucgcuguguuguucaggcuagagugcagugaugugaucuuggcucacugcagccucugccuuuuggauuuaagcaaguuuccucccucagccucccgaguagcugggacuacaggcacgugcgaccacacccagcuaaauuuuuuuuuuguauuuuguauuuuuaguagagacgggguucaccauguuggcuaagcuggucucaaacuccugaccucaagugaucugccugucucggccucccaaagugcugggauuacaggcaugagcugccacgcccggccagcuauuauuaauguuuaaauuuuaccuuaguuuuuacaaaaugaaaucaaacuaugaauacuacgugacauuuuuaugggaaaggucauuuugaguuuguugcacgccugguguagccucuuguagguugugagacuaggagaugggaauccuacucagaagugguguuaccaauugaaacagggaagauagcuucacagugacaaggaagauaauugucuagccaugugcuggguacuuaauaaagucucaugaaaacauuuuaccuaaaauuuuauuauguguggcacagaagaaugaaaauaauuuuuaguaugugagaguaauuaaaaucuaaagauacuguugaaaguauggaaaaauucagaauaagaauguuggccuauguuccuuuuuauucauaugaauucuuucacuuuugcuuuuuauuuccuuaauguuaaaauauaaccucuguugauugcuuuauagguccacucagcuguugaagaaauggauggauuagaugauguugaaaacagcauguuguacuauaaucaagcagucauucuuuaucaucugcggcaguauacagaagccauaucaguuggugaaaaacuuuaucaguucauagagccuuuugguauguuaucugucaagucaaaaauuucccuaucuucccuauacuugcagaauucucugguacuuuuaccuagauaaccuaaauccgagaaguccaugccaguauucaaagaaaagccguaucagcuuugcuuaaugguuagaaaagauaaaaauguaauccagguuuucuuugagugucccuucccaaauuuugaagauaacuguuaaaaaugcuguuggaaagugcugaaaacacuuagugauguuugugggguuuuugcuguuucaacacuauuuuaguguaccugauccuuucuuacuuuaguacauuaaggaaguagcauuuuggaauguuaggggacagugagguauuucauuuuugcccuuugccuuacugaaauuuuuggugguaauuauggaguaggaaguauagaacagaguuaguuuuuugcuaucuuaauuagcuuacuaaccucaaguaggaguagcaagaaaaguaagggcaaaggaaaaaagaagagcaaaggagaaagcuagacccaggaaaugguuguuagagaaggcuguugguuucuagcccacaagcagucaaauuccauuugugaguuacauuuuugucuuuuuuuuccauaauugcuuucuuuuacauucaaaacacaaaugagaauuccuaauuuaucaggaacgccugauugcucaugugguuaccacaggacaaguggugggguaugauagcgcucugugguucuuugggaagagguagagaguccccuuuugcugacagcugguugaacagcugauuacuauggcuccagagacccauucugaggugcuucucuucuuucccucaauccugagagcuugguagcuggacagacugggcgggagagacaccagugguaagggauuauguaauuagugaccagguccuucuguauagcuagaaaucagaguuacacuuuuaggacuguacacauuuuucuguaaaguuacuguuauugaugcuucuuagaauuucaauauggagaaacugccuuuaaaggcagcuauuaaaauauaaauaugcccagcgcaguggcucacgccuguaaucccagcacuuugggagguugaggugagcagaucaucugaggucaggaguuggagaccagccugaucaacauggggaaaccccgucucuacuaaaaauacaaaauuagccaggugugguggcacaugccuguaaucccagcuacucaggaaggcugagacaggaggaucacuugaacccgagaggccgagguugcagugagccaagauugcaccacagcauuccagccugagcaacaagagcaaaacuugcucucaaaaaaaaaaaaaaaaaaaaaagagaauuuccugaauucaugaaauccuguuaaucugcacuauggcugaacagaauauauuaauaguaaucaacuagucaguauucacauucauuuuucuuuuauggcuuuuuuuuuuuuaaacuuuuacugcuuggauuuuuuuuaaagacuguuuuuuuagagaagguuuagauuuacagcaaaaccaaguuuccucuuguacagagauuuccuguguguccucugccccaacacauccauagccucccucauuaccacaaucccucaacaguguggugcauuuguuauaauugauaaaccuacauugauacaucauaaucauccaaaguucauaguuuacguuaggguucacucuugguguuguauguucuauguguuuggacaaauauauucauuauaguaucauacagaguauuuuucacugcccuaagaauucuguguugugccuguucauucccuuucuaccuauaaccacugaucuuuuuacugucucuacaguuuugccuuuucuacagugucaaacuuggaaucauaacuacucagcuucuuucuucuuuuuuucuuuuugagauggggucucuuucuguugcccaggcuggagugcaguggcgugaacuccacucacugcaaccuccaccugccaggcccaagcgauccucccaccccagccucuucaauagcugggauuacagucacgcgccaccacacccagcuaauuuuuguauuguuuugcagagacuggguuucacuauguugccuaggcuggucuugaacuccugggcucaagcccagcaccuuggcuucccaaugugcugggauuacaggugugaaccaccaugccuagccaguacucagauucuucauacaacauaugcuaauugagcacaugguccaauacugugggccagacacuguucugggucuggagauaaugcaaugaaugaaauacagaaacucuuuacccccguuaagcuucuauucuaauaggagagaaagcaacauaauaaaaaaacagccaucccuugguauucaagggagauugguucuaggacaccccucuucagauaccaaaaucugcugauacuuaaaucccuuauauaaaaugguguaguauuuacauacagucucuguguauguccuccuguacauuuuaaauaaucgcuaaauuacuuauaauaccuaauacacuguaaaugcuaugaaaauguuuuuauaccauauuguuuagggaacaaugauggggaaaacgucuguacauauucagugcagaugcaacaacuuuuuuuuuucuucuaacauuuucaaucugagguugguugaaucugugggugcaggucagauacagggggcuggcuguauacugaaugcuaugaaguaaagcuaaaauugagugagaauguagagauugacuggggauguuuuaaguaagguaaucaagcaaggccugggaugagaugguauuugaaacgagaccugaauaaagaaaagacauuauccuugcuacuguuuagagggaaagcauucccacuggagguaaugggauauggagaagacuugaggugagaggcuguguuuggugagagcaauagcagcaagaucauugugacuggagcuagguaaggaggauaauaggaaauaaagucagaauuagccacgggcagaagagguaaagccuagggcagggcuuacugucuuaggugcagugagauucccuuggagauauaugaccuuugcacaccagcuguguuaauuucaguuuuuuaaaugaauuccacucuuuaaaggcuuuugaaauuuucucuucuagaccuuauuuuuccuuuuaucuucuuuuuugaaaggaaagauaguuuuaugucacaccagguuaacuuuccucucuucauuggguucuuuuucuuuugaaggucuugucucuuggcagucucaauuuucugauauacuccagcccauaccuugcugcuuuugcuucuguaaucagguguuuguuuguuuuuuuuuuuuuuccaucuccaugaccuagaaaagcaauguauuucauggagucauagacuuuuuuaguuagaaggaaccucacaagauccccugguccacccuucugccuucaggcagguaaaauauucuccucauuugacaggucagccagcugaggucugaaaaguuaaaugauguacagagaccacacauaccuaguuaguggcugaauaggugcagauugaguaucccuuauccaaaaugcuugggacaagaaguguuucagauuugggauuuuuuuuaacuuuggaauauuugcauuauacuuacugguucaguauuccuacccugagguccaaaaugcuaccaugagcauuuuauuugagcaucauuggugcucaacaaguuuuggauuuugaggcuggacacaguggcucacaccuguaauccuauccuuugugaggccaaaguggguggaucacuugagcucaggagcuugagaccagccugggcaacauagugaaacccuguuucuaugaaaaaauuagccaggcauggugacacauguuuguggucccagcuacucaggaggcuaaggugaaaggaucucuugagccuaguaggcagagguugcaguaagccaagauugcaacacugcacuccagccuggguaacacagugagauaccaucucagaaacaaaaaaaguuuuggauuuuggaggauuacaaauuucagauuucaacauuucagguuaggaaugcacaaccucuauuggaauucagguuucuuuccgccuaaaguaauauuccucauuacaugugcuaguguuuaguagauauuuuccuaaggaagauuuaaucacuggaauuucugaaaugagaggccuugcagugccuaguaaaaugacauuguuggcauugcaaguugcuuucauucguggcucuaggugauaggcauucauuugaguaaagacuuaugcuuugcuauuuaaagcuuuguauacuuuuuuggaggguggucugaaaugugugcuuuacuuuagguugugacuauucuuuucuguguuuuuuuucucccagaagaaaaauuugcccaagcaguguguuuuuugcuuguagaccuguauauauuaaccuaccaagcugagaaagcuuugcaucuucuugcuguccuagaaaaaaugauuucacaggguaacaauaacaaaaauggaaagaaugaggugagucuuuagaggugaucagacuaaaaucuaaaaugugauuaauucucucuacuuguugguuuacuggauuaaaaagaaagcaauuaaaauaugauuaauguuugugguuaugaacuauuaacagcuuaaagauacaauuuucauauuauaagcuuuaccauuuuaaaguguagaguuuagugguuuugaguguacucacauuuguacaaccauuacuacuaucuaauuucaaaauauuuuuaucaccccaaaaagaaacccuguaccauuugcagucacuccccauuucccccuuuccucagccccaagcagccguuaaucuaauuacugucucugaauuuacugucuggacauuacauaugaauggaaucauaauaugcggcuauuugucacuggcuuuuuuuacuuaguguaaugcuuucaagcuucauccauauuuuagcauauacuuauuuuuguuucauguacuucaugccuuuuguggcugaauaauauuccauucauuauaugaauaugccacauuuuaaaaaauucuuuaucaguugguggacauuuggguucuuuucuacuuuuugguuauuauauauagugcuucugugaccauucauguacaaauuuuuguguggauauauguuuucaguuacauuggauauaauauuuaggaauagaaucacuggguuauaugguaucuuaacucuauauuuaacccuauacaagacuguuuuacaaaguggcugcacuauuuuaaauucccaccggccacuugugagguuguaauuucuccacauuguuaccaacacuuguuauugucuaucuuuaaaaaaaaauuagcuaucuuagggggugugaagugguaucuuguuacaguuuugauuuuuauuuuccuaaugacuaaggauguacauugagcaucuuuucauauaugagcuauuauuuuuauagaauugaaagauuggaauuaagacaauagaauccauaaccuggauaaacacuauugcuuucauuagggaaaauuucaucauuaaaguucuucaaaaaaaaaaaaaaaauacauggcugggcgugguagcucacaccuguaaucccagcacuuugagaguccaaggcggguggaucaccugaggucaggaguuagagaccagccuggccaacauggugaaaccgugucuuuacuaaaaauacaaaaaauagcugggcaugguggcacacaacuguaauuccaacuacucaggagguugaggcacgagaaucacuugaaacugggaggcggagauugcagugagccaagauuacgccacugcacuccagccugggagacagagcaagacucaaacucaaaaauaaaaaagcauacauuuaugauguuuaagcuucaccauguucuggugagagacuuggugcccaguaugaguauauccugggucucauguuuuucuuuuauuugugcuucugguuaucaagggaugacccuucuuacuuccguuuucugucccuuuguuuuaaaaggaguauuugcaggaaacguugccaauaccuuuuugccuguguacauucuugauguuuaaaaagaaaauaaacaucuggcauuacuuuuuucaauuuaaguguguauucauaagggauuucaguugaauaaccuuagcauuauaccgaaacauuguguaguaaaauauuuauauucaguacuuguaaaauuugauuaaauauaauuuaauuuagcagaugcuuaugugcucugcccgguucuaagguacucugcuagguacuaaggugacaaaaacaaaaacguugcaguccuugcuuucaaggaucucaugucuaggaagagauaaauugggcaacaucuggucauggacaaggaggaaagaggugaaagagguuagggaauguuucaaaggaauuuggauguuuguuuugggccuuggaagaugguuaauaguuugacaagucagacaaggagggguagagcaggauaaccagccuggcagagaauaucacaaaagguaugagcuuaauggugugcuggagaccuuucugguaaugaaaugaacaguaccagagaaaugcagaggagagcagugggagaugauguuggcaauaugagugugagugauagcuugaagaacuuugaauacuagaaaguucaaauuugauaugauuggcaguguucauaacagagaaaguuuuaagaaguggguagaucuguucuggguuuuagaaagauauucugaguuuugcuuaaaguaauauucauguuuuuuaaaacaagcccaggcuggccacaguggagacccccgucucuaugaaaaauuaaaauuguaaauaaauaaaaccagcucauuauuacguucgacugugagcuucucaugaguagagcuuccugucacccacucuagacuacugaaccucagucucuaggagugggaccugggauucugcauuuuuuaaagacagggucuugcucugccaccucaggcuggaguauaguaguagcacaaucacgccucacugcagccuugaucuccugggcucaggcagucuucccaccucagcuuccugaguagcugggacuacagguacauggccaccaugcccagcuaauuuuuguauuuuuuguagagaugcgauuuugccauguuacucaagcuggucucgaacuccugggcucaagcgauccgcccgccucugccuuccaaaguucugggauuacaggcaugaaccaccauuucccacaaauucuacauuuugaaaaugcucucuagguaauuuagauuagcucacuuggaaaucacugauuuaaauuauggucaaaaauauuuaauuuugauaaacuuuguuucaucacccuacagacugguaauaacaacaacaaagauggaucuaaucauaaagcugaaaguggagcucuaauagaagcugcaaaaucaaagauacaucagguaguauaaauuuuaaaggggggcaauacaucacauauauuuaauuguaguuaugacaaaugaagcaaugagauagaucauuggaagcagucaauaauucaaggugcauauauuuguuugucuuuugaaguauuguaguuuagaagcacauuuauccuaaauacauuuuucuuaagaggauaauauaauuuauuuaaauugcucuauaaauaaaguuugagagaaauggcacgggaauguacugcaugauaaaaucaacuggaauuuuaaaaagucauuguuagccaugugcagaagaggauugauaggauuuuugcccggaacuugaguauuuaaguuuuuuguuuguuuuuugagacggagccucacucugucacccaagcugcagugcaauggugcgaucucggcucgcugcaaccucugccucccaguuucaagcgauucuccugccucagccuuccugaguagcugggauuacuagugcgcaucaccacacccggauaauuuuuuguauuuuuaguagagacaggguuucaucauguuggccaggcuggucucaaacuccugaccucaggugauccaccugccucggccuccaaaguacugggauuacaggcgugagccaccacaucuggcuaaguuuuuauucuaccgugauuuuaguauuuugaaguauauucgaagaguacagugaaaauagcauauuuucuaaaauuguaaacuugauuuagcaaguaauuaguguaacuauguuguaaauagauuggguuuucuuaacuagaaaguaaaacuguauguaaauccaccauaguuuuaacauacuaacauuuucccuuugacaguacaaaguacgagcuuauauccaaaugaagucucugaaagcauguaaaagggaaaucaagucagucaugaauacagcuggaaauguaaguuucuucuggacuuuuguuuuucaauuugugucuuucuuauuuagacuauggguauugucagguuuaaauaauuuaucuuagucuuuuacauauacugccagauaugaaccuugcuauuuuaaaguugggaaguaguaauaauacugugucuauaguuuaauuuuuuuuuuuuuacuuaaaauuacaacaagcacuuuucuauuuuauguaaccuucaaaaccaccauuuuaaauaacugccuauuuuucugugacugguuuaucacaacucacuuaaacauuuugcuaauauuagacauuuagguuauuuuagaauuuuuuaguauuauacucaaaacauuuauggccagguggugacucaccuguaaucccagcacuuuaggaggccaaggugggcggaucaccugaggucaggaguucaagaccagccuggucaacaugaugagacccugucucuacuaaaaauacaaaaauaagccgggugugguggcgugugccuguagucccagccacuagggaggcuaaagugggaggaucacuugaaccugggaagcagaaguugcagugagcugagaucgugucauuucacgcuagccugggcaacagggugagacccugucaaaaaacauuuuuuaaauaaaaaaaaauuuauuaaaaaucuaacagucaaauuauagccaaaaccugccccuuccaagugacuuuuggcuugacaguaccuucgauuuaacugagauagaauuacuucuuccuuccacucccuccacccuaaucuuucauugauaauuuuuaagaugguguaggaaagaaacagaauugugaacaaucuugaugcuucuagaaaaacuauaaauuuagaaguauaaagucaugagaaaauaugguuaaaaaucucaggcaggauccagauuagucacugaguuaguuaauaugcuagugauuuuugagaacaauuguggccuagaccugagccuaagagggaaaggcccaguuagccagccacccauuaucaaacuuuuuuuuuuuuuuuuuuuuuuaaugauaaaagacauaauuccuagccaggcgcgguggcucacgccuguaaucccagcacuuugggaggcugaggcgggcggaucacgaggucaggagaucgagaccauccugguuaacacagugaaaccccaucucuacuaaaaauacaaaaaaugagccgggcgugguggcgggcgccuguagucccagcuacucgggaggcugaggcaggagaauggugugaacccgggaggcggaucuugcugugagccgagaccgcgccacugcacuccagccugggcgacagaacaagacucauucucaaaaaaaaaaaaaaaaaaaaagacauaauuccugccuuaaaggagaccacagucauagaggaaagacaauugaaaauuaauagucauccuaaaucggcgaaaacuucaggaggaauagcuaccacuaagaauaagcacugaaagcccuuguuucuuuagugaccagaacuuuggggugggugggaggcagagcaaaggauaaacuaggauuuagaaggaaagccuguugcuaaauuaagugaauaaauaggccaggcgugauggcucaugccuguaauugcagcacuuuggaaggcugagacaggcagaucaccugaggucaggaguuugagaccaaccuugccaacauggggaagccccaucucuacuaaaaauaaaaaaauuaggucgggcaugguggcucacgccuguaauccccacacuuugggaggcugaggcaggcggaucccaaagucaggaguucaagaccagccugaccaacauggugaaaccccaucucuacuaaaaauacaaaaauuagccaggugugguggcaugcgccuguaaucccagccacugaggaggcugaggcaggagaauugcuugaacccgggaggcggagguugcagugagccgagaucgcgccacugcacucuagccugggcaacggagcgagacuccgucuaaaaacaaaaacaaaaacaaaaauuugccuggcaugguggcgcaugccuguaaucccagcuacucaggaggcugaggcaggagaauuguuugaaccuaggaggcggagguugcagugauccgagaucaugccacuguacuccagccugggugacagagcaagacuccgucucaaucaaucaaucacucaaucaggauuccagauguccuccuggauggauguugagucuccagagcucucugcaugcuuucguacucuaaacagguaguacuaucuaggguccuccaccaggaggauucuuaggagaagugaaaggugaucuaccauucaaaacgugaucuuuggaacagcaagauuagugcuugcaaauaaggcauucuguugaaaauucuucuauuuguagaauggcacuuuuuuuuuccuauuuggaaaaguauuugauuauuuauaucucuguagguucuaaugaaaggugcauuuguauccuaaaaaguaagaaagaucaccagucucucuaauaacuauuaaaaugaaggacauagauuguguugucaaauugguuuucaguuaguaguguaguagaugaacacaaucaguugauaaucuacagacuguauucuuauacauauaccuauauuuauuuuuucagguggacccuuaguaauuauuuuuacaaagugcucucugacaaguuucaauuuuuuugauugugagagcaaugaaaaauuuagagacuauauaauuuuuugugacugacuuaauugauucauuuaugguuuugaacacgucaguacaacaguauaauuaagaucuuacauuaggcgucugaaaacaaauuauaaguaacuuuuauauuuucucuacaguccgcacccucucucuuucuuaaaagcaauuuugaguacuuaagagguaauuaucgaaaagccgugaagcuauuaaauaguucaaacauugcugagcauccaggauucaugaaaacagguaaaagaaaauugugaaauuuuaacuuuuuuuugccuugcucuucuaccccuucuugcuuguccaccucccaacacccagucuuuugagugauuuaugcuaauuuuuuaaugaaaauguuuuaauauuucuggugcaaaaauuuccaggaauucuuguuucuacuuuagaagaaaccucauuacuucuugcuuucacuuugcuuucuuucuuuuuuuuacuuuuccagguuggaucgcuuuccuccccucccccaccuuuuuuauuuuuauuuuauuuuauuuuauuuuuuuggaaauagggucuugcugagugcagugccacaaucacagcucacuacagccucaaccuccuaggcuccagcgauccucccaccucacccucccagguagcugggacuauaggcaugcaccaccaugccuggcuuauuuauuguagaaacaaggucucauuauguugcccaagcuggucucaaacuccugggcucaagugauccgcugaccucagucucccaaagugcugggauuacaggcaugcaccacugugccuggcccagauagcuugucuuuuuucuuuaaccugacuugccugcccucccucccucccuuccucccuuccucccuuccucccuucccuccuuccuucuuucuuuuccuucuuuuccuuccuuccuuccuuccuuccuuccuuccuuccuuccuucccuucuucccuuccuucccuucccucccuucccuccuuuccuucccuuccuucucuucccuuccuucuguucccuucccucccucucuuccuuccuucccuuccuucccuuccuuucuuuccuuucuuuuuuuuuuuuuuuuuuugacagagucuugcucuguugccugagcuggagugcaguggcaccaucuuggcucacuacagccuccaccucccucccggguucaagcaauucucccaccucagccuccugaguagcugggacuacaggcacgcaccaccaugcucagcuaauuuuuguauuuuuugguagagacaagguuuccauguugccuaggcuguaucgaacuccugaccucaagugacccgcccaccucagcaucucaaagugcugggauuacaagugugagccaccgcaccuggcccuuucauuuguuuuuguaagauccuuggacuuuugcuuugugaagugagaccuaauuuuucuuucaucuuuuuuuuuuuuuuuuuuuuuuuuuagugaauuaccaucuauaccagaaaagugaggccuuuuaaguaaauaauauguuuuuacuuuuuucugccauaaagccaguuaauaauauaauuuuuuucaguaacuugcccaauuaauaugacuucuuuagaucauuaccuagaucaaaaaucuuucuauaaugcuaggaagauaaguauuauuacauauucuuuuuuuuuuuuuuuuugagccagugucucccuccgucgcccaggcuggagugcaguggcacaaucucggcucacugcaagcucugccuccuggguucgcgacauucuccugccucagccucccgaguagcugagacuacaggcgucugccaccgcgcccggcuaauuuuuuguauuuuuuuuuuuaguagagacaggguuucaccguguuagccaggauggucucgaucuccugaccucgugauccgcccgccucggccucccaaagugcugggauuacaggcgugagccaccgugcccggccuauuacauauucuugccucuauuuagacuaaaaagucuuacaaauccuuugauacuaaugauaauaugaaaguaaaaauugugacugucauuuagguuuauaucaucaguauuugauggggcaggagaaggaaaaucacuuauucgagaaaugaggauaaacuauugaaaauguauauuuugccucaaguuuaaaaugcaaacaauuaauauguauuuugguauguuuugucuuguuuuuuuuggauucuacccagauacacgcacagaauacacaugcaaacauacugagaccuuccccuauuuacccuuucaguucacaggagugauggaggauggagaaaggcacuuuuuccuuauaauucucuuguggguauuauuucuguucuaaauacccauuucuaauucugcucaauuuuaguguuuuguuuucauugucauaguuucuccucagagguccacuaacacacaacaugcaaugaucccucaaacuaaaaagauaauauacuuugagaaaauuuugcuuaggauuuucuucauguaggugucaguauugacauugucaaucuuuaaaaugaaggcaggagcuggaagugguggcucaugccuguaauccuaaugcuuugggaggccaaggcaggaggaccaggaguucgagguuccagugaaucaugaucaugccacugcacuccagccugggcaacagaacaaggccuugucucuaaaaauaaauuaauaaauaaagauggccaggcgugguggcucacaccuauaaucaaucccagcacauugggagacugaggccgacggaucacuugaggucaggaguucaagaccaggcuggccaacauggagaaaccccgucucuacacaaaauacaaaaauuagccaggcgugauggcaugcgccuguauucccagcuacuuaggaucccaaagugcuggaauuguaggugugagccaccgagcucagucuaguuuuccucuuuuaaauauugucauugcuuaauuuaaaaauaugucagaagauuaccuuuagauuuuaagugcuaaacaauaaauauccugauuauuaauuuugucauucuagucaggcauuuuaugucauuaagggccauuguuuuggaauguuuggguagcuauuuagaaaaacaauauuaaaggccgggcacgguggcucacaccuguaaucucagcacuuugggaggcugaggcgggcagaucacaaggccaggagauaaagaccauccugacuaacacggugaaaccccgucucuacuaaaaauacaaaaaauuagccaggugugguggcgggcgccuguagucccagcuacucaggaggcugagcaggagaauggcaugaacccgggaggcagagguugcagugagcugaaauugcgccacugcacuccagccugggcgacagagugagacuccgucucaaaaaaaaaaaaaagaaaagagaauauuaaagcuuagauuacuuucauuacgccaaaauaaaauucagagagaugaaggauuaacauuuaaaaauaaauaaaagcaguaagauaaaacuuggaugaauauuuuaauuuugugauggagaaggcuugaguaaacauuuuccaaaaucuaaguaccauagaauuuagaaaacauggcuaaauuugaucacauuaaaauguuaaacauuuuaugauucaaaauguaaacacacauacacauacugaaccaagucacgaaacaaaugacaaacagaggugggcaggaauauuugaaacagaugugacagaagguuucuauaacauguaaaacaacuaguaaccaacagaaaaaacaucuguaaccaaauaaagcaauagaucagccaggaacggugcucacacuuguaaucucagcacuuugggaggucgaggcaggaggaucacuugauuccaggaguuugcgaccagccugagcaacacagggacccugucucugcaaaaaaauuaaaaaauuagcugggcaugguggcccgugccuguagucccagcuacucaggaggcugaggcaugaggauugcuugagcccaggaggucgaugcugcagugagcccuaauuaugccacugcacuguaggcugggcgauggaaugagacccugucucagagaaagaaaaaaauuaauacgggugaaagacaagaggcaacacaggcugaaaaauacaaauucccaaacaugaaaagaugcuuagcugcagugguauuuaaagaagugugaauuaaaaucaguggagacuuacaguuuaauagacauacucuguucuguuccuuuuuuuuuuuuuuuuuucuuugagacagucucauucugucacccaggcuggaaugcaguggugcgaucucggcucacugcaaccucugcccucuagggccaagcaauucuccuaccucagccucccgaguaacugggauuacaggcgcccuccacuacgcccggcuaauuuuuuuuuuuuuuuuuugagacggagucuugcucugucacucaggcuggagugcaguggugcgaucucggcuuacugcaagcucugccuccuggguucccgccauucuccugccucagccucccgaguagcugggacuacacgcgcccgccaccacgcccggcuaauuuuuuguauuuuuaguagagacgggguuucaccauguuagcgaggauggucuccaucuccugaccucgugauccgcccaccucggccucccaaagugcugggauuacaggcgugagccacugcgcccagcccaaugccuggcuaauuuuuguguuuuuaguggaggugggguuucaccauguuggccaggcuagucucgaacuccugaccucaagugauccacccgccucagccucccaaagugcugggauuacaggcaugagccaucguacccagccucacucuguucuuuucuauauauucuugcuauucacuuaauaugcuuugguuguuuccaugcauacuugcuuccuuguuucuaauuucuacauaauauuucauuaguggaugcaaugcauauacauuauauuacugauaaacacuuuuugucuuuugcauuuuuguaucauuugucuacaguuacuaaaaauuagcugggcaugguggcucaugccuguaaucccagaacuuugggaagccaaggugaaaggguugcuugagcccaggaguucgaaaccaggguaggcaauauagugagacccuauuuuaaaaauuguuuuaaaaaaggaaaaaaaaauccacaaaauuagaguaacaaaauaggacugguuuuuuuaaaauaauuuguaucaccuuuaauaaaagagauuuuaaaaggaguuuuaaaauuuuucagauauuuccuaaauuucaaaugccuugugaacuguucuuuagggaguaaguggaaugguaacaguguuaacucgugcaagaugagcccaauucuugucugagggacaucaacauuaaaauuuuucuguggacaaauuuauuugcauuuuuuucaggugaaugcuugagaugcauguucuggaauaaccuugguugcauccauuuugccaugagcaagcacaauuugggaauauucuacuuuaaaaaggcucugcaagagaaugacaaugucugugcacagcucagugcagguagcacugauccagguaagcccaguacugggggacaguuuguauuuacuacuucagaaaagcaugauuuaaaaagcaugaaugugguuaaaauacccaccauguagacuuacauauaguuaacucugaucuuacccaacaaguuuggcucuggggauuuuuaguagauauugcuacuuugaagagcaauaacaagguguuaagaguaauuuugaauuauccagaaauuuaaguugcauuccauuuuucauugauuugaaaaugaguaauucccugugguaauguuauauaccagaauguuugauuagucacaacaugacugugccaaacuagguuuauuauaguuuuguuuuguuuuguuuuguuuuguuuuguuuugagacagagucuagcucuaucacccaggcuggagugcaauggugugauuucagcucauuucaacuucugccuccugggcucaagugacccucccacuucagccuccugaguagcuggaacuacagacacaugccacuguaccuggcuaauuuuuguguuuuuuguaaagauaggguuucaccauguugcccaggcuggucuggaacuccuggcuuaagugauccucccaccucagucuuccaaggugcuggaauuacaagcauaagccacugugcccggcuuguuauagauucuuugcagaguuuuacaugugauacuacuggcagcaucugacggucuuuaagcaaauuccugacauuuauccuuuaauauucauuaucauauggauccuugaucugaaaugccuaaaaucaaacaauuauuuagcuuuuaaaaauaauaaccuauuuaggccaggggcgguggcucacgccuguaaucccagcacuuagggaggccgaggugggcagaucacgaggucaggagaucgagaccauccuggcuagcacagugaaacccugucucuacuaaaaauacaaaaaaaauuagccgagcaugguggcaggcgccuguagccccagcuacuugggagacagaagcaggauaauggcguguacccaggaggcggagcuugccgugagccgagaucaugccacugcacuccagccugggugacagagcgagacucuguccauaauaauaauaauaauaauaauaauaauaauaauaaccuauuuaauugauggcaaauguauuauaaaucaagguagaccgaaacauugaauagguuuuauugucaugaacacaugacaauaaaaugguuaaccaagaugaauuuuuuuuuuuuuuuuuuuuuuuuuccugagacgaagucucacccuguugcccaagcuggagugcaguggcgugaucuuggcucacugcauccuccacgucccagguucaagcaauuuuccugccucagccucccgaguagcugggacuacaggcacaugccaccaugcccggcuaauuuuuguauuuuuaguagagaugggguuucacuauuuuggccagucugguuuugaacuccugacuucgugaucugcccgccuuggccucccaaagugcugggauuacaggcgugagccacugugcccagcugaaaauuuuaaaaaguggaaacuuuauauagacucuaaaaauguuggcuaggaaagauggcucaugccuguaaucccaacauuuaggggaggccaagguggaucacuugaguccaggaguucaagaccagccugggcaacauagugagacccccccaucucuacaaaaauaaaaauaaaaaauaaaagagaauaaaguaaaaauguagaaaaguaguauaaggugcaaaggagugagagcgggucccaucacuuaucuuugccuuccuggaacguuguugccugaggagcuggcaaaugagaagagacaucucuggcucugcuagcauagacaacuaagaugacucuggagaauauuugugggguugagaauggagaccaccauuggcgagagcuauuaaaacucagaucaggauuauugguguuaaacaugguagugucuaaguacuuaauggaguaaauguuuucaagguuacuauuacuguaaaucuaaugauguauucuuaucuaauuuuuaucacuagguaaaaaauuuucaggaagacccauguguacguuacuaaccaauaagagauaugaguugcuguauaacuguggaauucagcuucuucacauuggaaggccucuugcugccuucgaaugucugauugaagcuguucagguuuaucaugcaaauccucgccucuggcuacggcuggcugaaugcugcauugcugccaauaagggggugagugcuacuuggguaucuuuuuaaacccugucuucuccccacuuacuacauggaaugguuaaaaaaaaaaaaaaaaccuuggaaacauacauaagacauuucucuuuuuauuuauuuauuuauuuauuuauuuauuuuuugagacggaguuucucucuuauugcccaggcuggagugcaauguuacgaucucggcucacugcaaccuccaccucccggguucaagcgauucuucugccucagccucccaaauagcugggaccacaugcacaugccaccacgcccagcuaauuuuguauuuuuaguagagacgagguuucaccauguugcccaggcuggucuugaacucccgaccuuaugugaucuagccaccucagccucccgaagugcugggauuacaggcgugaaauguauagucuucucuucuuaaccacugggggaaauuaguuucaaaaagucauuuguuggccgugcgcaauggcucacgccuguaauccaagcacuuuaggaggcugaggcggguggaucacuugagcucaggaguccaagaccagucuggacaacauagugagaccuccaucucuacaaaaaauuacuggguguggcagugagcgccuguagucccagcuauucaagaggcugaagcgggaagaucguuugagccugggagguggagguuggagugagaccagauagagccacugcacuccaccuuaggcaacagagcgagacccugucucaaaaaaaauaaaaauaaaaauuuaaaaagucauuuguuaacauucucauucuugguaaguaaguauggcaacauuaaagaguugaagccagugagaaagucauguauguuggaacaguggucugcuagcugcuccaggggucaggauacaugcaucugcuggcguaagaauaguguguagccuggugauuagaaaaggucugauaacagccaggugcgguggucacgccuguaaucccagcacuuugggaggccgaggcggguggaucacgaggucaggagaucgagaccauccuggcuaacacagugaaacccccgucucuacuaaaaaugcgaaaaauuagccgggcguugugggccuguagucccagcuacucgggagggugaggcaggagaaugacgugaacccaggaggcggagcuugcagcuagccaagaucgcgccacugcacuccagccugggugacagagagacucugucucaaaaaaaaguucugauaacauaauguggaaagagcugcauuaagcuggauuuccaucaaugccugaggguuuuacuuugguuucaguaaaugauacagaguuuauggauuaccaggcuguuucucucugacacaugauugcccaugguagcuaugggaauaggccaguuuacauugauuuccaugcuuagauaaucucuaaauggcaauugguggaagccuuuugaauuucaauuugggagggaucaguaggagauaggggaaagacggguugugucagaauuaccagauaugugugucuuccauuugcuaccccaugcccugcccuugcugugcuuuuuggguguguauagacauugggaagguaugguaccuggagguuuuaccuugcaugccuaccauaggugauauaagauguugaggcucuccucccgcugaacagcaguuucugagaaguacaagaacuaaggggauuaaagaaguguguuugcuaguuuucauacaugguacuuagguaguuugugauuugaguauaccaacagaggaagagaugagugauuugucuuugaaagacuuuaaugauuuaauuauacuuugcuuuuuaaaagacaacuuucuuauugguuaauucuuaacugauaaacaguucuaggcagaauuuauacuucuuuuuuuuuuuuuuuuuuuuuuuuuugagacggagucucgcccugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggcccagaauuuauacuucuuaaagauaaaagaagcaaauagaaauugcuuauucucuuuaaucuguuuauaaauuuaaguguugggcgccuuucuuugguauuuacuggaaaccagggaguuaccuuuuucugggacuagggaaagauuguaaaguuuaauauuuucuuuuuaaauuaacugguuuuagaaauaguacuuuuaggauuguguucuacagaagccauuaagcuuacaaggucuccuccccucccccuagaggagaaggagcgggaggggaggauaaguauuuuccauauuaauaugcugccaguccuguuuuuuuuucuagaaaaguuguaaauuuguaauuuuuaaaaaaugguaaagaugacuuucgguugccauaacuucaugaacacacacaauuugugcugcuaauaggaaacuugccaccaguaauaucuuugugcuuuuccuccuccuaaaaaaaaacuuuaggguaaccuaaaaaacaguaaaaacaagcccaaaacacuaauaaaaucagaggacaaaucccaauacgaguaauuguaaacuccaaauaaaauuccauaaaauuuguuuuauuuagucaggacaggagguaugcugaacaaaguaguuuguaccuucagaaauaaauucauuuuggauuuaaaaaaauuaacuuguuuaugcuaaggaggacauuuuguccugaauaucugguacauauuauuucagacuuggcagaggcaaggcuuauauuuaccugggcaguguauaaauaugggaaaagaucugcuaaacaaaaauagucccaauauuuuaauuauguaugauccuuuuaccuuaaaacuuaucuggcacacuuucuggcuaucggugcuugaagguauggauuauuauucuacguuuuuuaguuccauuccaucgugggccaguuuguuuucaucuguugcaucuucguaucuagccauuuggaucaguuuucauggccuuagcaauaagaaaagagaagagaauauggaugaauccauguaaauugauuaccacaacuaggaaaagaagucagaacggaaguccucacaauaaugguuuaaaauauccacuuuuucauuaauauugcauggccuucucuauacacaauuaguuuugaucagagaaguuuuauuguauuuuuuagcacuguguaguauguucuuuauuaaaagucauauauggaagugcaacuauaauaaguuacauucaggagcaauaaguaacaguacagaaacauuuguguuuagagaaaagacuuuuugcagggcagagauuaguuuugcaaauucauauugauugacuccgguuuguucugguaugugagaauuuggaugucauuauaagauaacuacuugggauuccaccugcagguaaauuagagacuuguuuuauuuuauuuuauuuuugagacagagucucacucuucacucaggcuugagugcaguggcgugaucauggcucacugcagucucgaccucccuggugucaagcgaucuucccuccucagcuucccuaguagcugggacuauaggcaugcaugaccgcacuuggcuaauuuuuguauuucuuuguagagguggaguuucaccacauugcccacacuggucucaaguuccugggcucuagcgauccacccgccucagccucccaaaguucuaggauuacaggugugagccaccuugcccagcuuaguuuuauuuuuuagauuuggccuagagcagugguucaugccuguauucccagcacuucgggaggcugaggcggguggaucagaaggucaggagaucaagaccauccuggcuaacauggugaaacuccaucucuacuaaaaauacaaaaaauuagccagguuguuguggcacccaccuguagucccagcuacucaggaggcugaggcaggagaauugcuugaaccugggaggcggagguugcagugagccgagauugugccacugcacuccugccugggugacagagugauacuccaucucaaaaaaauaaauaaauaaaagauuuuuucuggcugggcgcgguagcucacaccuguaaucucaguacuuugggaggccgaggcgggcggaucacuugaggucaggaguuugagacuagccuggccaauguggugaaaccccaucucuacuaaaauacaaaaauuagccagguguggugacaggcgccuguaauccuagcuacucgggaggcugaggcaagagaaucacuggaacucaggaggugaagguugcagugagccgagacaacaccgcugcacccaagccuaaagaaaaauuuuccagccucagcaacuuggcaaaacccugucucuaaaaaaaauaaauagaaaaauuagccagucaugguggcacacaccuguaccuguagucccagcuacuugggaggcugaagcaggaggaucacuugagcccaggaggccgaaguugcagugagccgagaucaugccacuguacuccauccugggcaacagagccagaccuugucuuaaaaaagaaaaaaaagaaaggaaaaaaaaaaagguagauacaggggggucucacuauguugcccaggcuggucucacacuccugguuucaagugauccuccugccuuagcuucccaaagggcugggauuacgggcaugaaccacugcacccaaccaaauuagagacuuagaaugaagggggaucauuaaucaaauuaucacugugagcucuguagugagauaauacaucuuaaucaaauauccuaaaguacuauguauguguaaguagcuuuuauuauuuucaguuuaauguuuauucauuugguuuggggauuuuaauuuccuagaaggcaaguauuguguccauguaaauuuuuaccacguacagcuuauuaaaguuuauauauuguugacaauguaauuaauacuuugaauuaagaaggaaaugaucuguguuuaggaaguggagcgacuuccuuuuucuuuuacacuauuuugggcucucuuauuuuccuuacucugaugucaaaguaccuguaacauguagcaugguacuggaggucuagaauauucuaaguaaaugauucuaaauaaauuauugggacauaauugaauuggauuuuguucguagaauuuucuccaaucucauguaaacaaaauguagcacauaucccagauuuucagccuuauauacuuuuuccacuaauaccaaacauguuuccauuaucaccaaaaaaaguccucauugacuuuaagaacuuucuuaaauuuagaguaauugugagagauauucccucauuuuuuauaccacaucuuacaauucccuuaaauuuauuggaaauuauuuguauuuuguagacuucugaacaagaaacuaaaggccuucccagcaaaaaaggaauuguacagucuauuguuggucaaggcuaucaucguaaaauaguuuuggcaucacagucuauacagaauacuguuuauaaguaaguauuuugcaaagaaaaaguguauauauauuuaauacuaguuuacauaauguuacuuauauauaaaaguaugauuaggauuuaucauugcauaggaggaaccacuuuguaacuagauuuuauugcuauuucaacaaacagacccucauguauagguccauagugaauguuaucuaacaugauuuugguuuauuacauccaugggugcugcaauuauugauggccuaggaaacccuagucuguucagugccauuauuaagaauguccagaagagggcaucuugguauuuccuuuuuauguacuuuugguuaucauugauacuuuucauuuggguauuuucuuauagucccuaggacugaaaauacaugaaagggaauucuuacuauucagagaaaaaagguguauuaaaacauaaagcaaccaaagcaguauagaagcugucacauguauaaucuucauuugacaauuuggaauugccauuauuuguaaaguggcaaacuuugcaaauaauuagcugccuuaauuuguuuuugucaaagaagaaaauuguucucuaccauuuaaaaguuuuuccacaguuuaaaaaauaucugauacacaauaauuuagucuuaauuuaguuaaacuauaaugcaagaauauuuuuuaaaacuauuaugauaaagcauuucaaaguuuuaaagcaauuucaaaguuguuacuacuuuucaaaauuuuauuuuucucuaguaaagauucucuuuggguauaucaaaccaacagaaaguuguauaaaaugucaaugaaauuauaagacaaaaaguaauguugguguuucaaaguguauagaggcauuuuugaaagcaaggaucaaccaaaguaaggcucaaacgugaaaaucuguuuucuucccuuucgucccauucuuaguauaccucuccuugcccucauuacaguugcccuugucugcaguuucucuaguauguuaacauuaacauugugauauacaucaaauuaucucuucuccuuggucucauuccuagagacacaguguauguaauuuauauacuugcaauccauuauuuauacuauuuacaaccuauacuuaggauuuggguucuuuagcaugcuuuuauaacugcuuauauuaaaauuucuaccuaucaaaaggcauagcuuucauuuauaaucaauugguuuuauuccucauaauaaaagagccuuauuuuaaaauauuuuauccacuuagcuaauuugguuuuguucuuuuaagugaugggcagucuucggccauuccuguagccaguauggaguuugcagccauaugucucagaaaugccuuguugcugcuaccugaagaacagcaagauccaaagcaggaaaauggggcuaaaaauaguaaucaauuaggugggaacacagagagcagcgaaagcagugaaacuugcagguauucuaauccuugugaccuccuuuggcaaaauccuuucaggacuucuuuaguaaacccuuuguucuuuaaguaaauuccuaaaaucuucaaccugaauuucugaaauucuguuuugcguaacaagaaaggaaaguauuuauguuucugagucuuucuggaagagagaaauaaggugaaggcuaaguuaggagagauccuugaaaaagaaaaguagaaaguagcagcuuuggccggacgcaguggcucaugccugccuguaaaaggcugaggcaagaaaauugcuugaacccaggaggcagagguugcagcgagccgagauugugccacugcacuccagcuuuggcgacagagugagacuucaucucaaaaaagaaaguagcagcuuuucauugacaagagggauauuuguaagaaguccuguugucagacagcuuuaaaaaaaauuuggccaggugugggggcucacgccuguaaucccagcacuuugggaggccaagauggguagaucacuugagguuaggaguucaagaccagcuggccaacauggugaaaccccgucucuacuaaaaauacaaaaauuagcugggcgugguggugggcaccuauaauccccacuacugggaaagcugaggcaagagaauuacuugaacccgggaggcagagguugcagugagccacgaucaugccacugcacuccauccagccuggugacagaaugagacuccaucucaaaaaaacagaaaauuuauuaaaauaaacacuugacuccuaaagcugcuuauuucuuauuauccucugucuauccucuuaauauacuauaaucacuaaccuccagaauauuuuuguauauuucugguuuucuaguauaaauucaaaauuaugcaaaucuaggcagggugcuggaggaggccaagaguucaagucuagucugggcagcauagcaagaccccaucucuucaaaaaaauuaaaaauaaguaaauaaaaauuaugugacuauagaaauugggagaacuuuugguaaggacaaaacacauaccauuauauauagggaauucagcuuuuuucuuucuuucuuuucuuuuguuuucuuuuuguuuuguuuuuuguuuguuuguuuguuuuugagacagagucucccucugucacccaggcuggaaagcaguggcacgaucucaacucacugcaaccuccaccucacaggcucaagcgauucuccugccucaacccccuaaauagcugggauuauaggcccagcgccacuaugcccggcuaauuuuuguauuuuuaguagagauaggguuuugccauguuguccaggauggucuugaacuccuuaccucaagugauccucccuccucggccucccagagugcugagauugcaggcaugagccacuacacccagcuggaaauucugcuuuuuauacauggcaucguuaaacuuacaucucccaucccagcauuuuuucuugauuauaauagcaaucaauacauauuuacuauagaaaauuugggccaggcaugguggcucacaccuguaaucccagugcuaagggagaccaaggcugaaggauugcuugaagcuaggaguucgaagcuagccuguccaacauaaugagaccccaucucuacaagaaauaaaaaaauuaguugaguguggugccaggcaccauuaguaccagcuacuugggaggcugguguaggaggaucgccugagcccaggaguuugaagcugcagugagcuaugaucaugccacacugcacuccagccugggcaacagucucaaaaacccagucucaagaaaaggcagggguugaggggucaggguaauuagaauaaugagaaaugcgcgaaaauauucaguuauuucccuuuuguaguaaagauacuguuuucaguuagagauuuuuuaaagcaguauuggaggggugggggcagugggggaagaaacuaauauacaauauagcuuuaacauguuaguguuaccaaauuacuaaguauuuccauuguuuaacucuuuuacacuuuuguuguaaaaaguuacaugggaggccgggcgaggugagacaccucuguaaauccuagcacuuugggaggccaaggcagguggaucaccugaggucgggaguucgagaccagccuugcuaacauggugaaaccccguuucuacuaaaaauacaaaaaauuagcugggcgugguggugugcgccuguaaucccagcuacuugggaggcugaggcgggagaaucacucaaaccugggaggcagagguugcagugaguugagaucgugcaauugcacuccauccugagcgacgagcaaaacucugucucaaaaaaaaaguugggaguaaggacagggaaacaaaauuuuacguuuaauuauuuauuuguugcucuucauaauuaagacucuuaccucuauuuuagcaguaaaagccaugauggagauaaauucauuccagcuccaccuucuucuccauugagaaaacaggaauuagaaaacuuaaagugaguaucuaaacaaaauuagcauugcaucuauugaaaugaacauauucauggcugggcacaguggcucauaccucuaaucccagcacuuugggaggccgaggcugguggaucacuaggucaggaguucgagaccagccuggccaagauagugaaacccugucuguacuaaaaauacaaaaauuaaccgggcgugguggcaggcgccuguaaucccaguuacuugggaggcugaggcaggagaauugcuugaacccgggaggcggagguugcagugagugugccacugcacucuagccugagcaacucugucucaaaaaaaaaaagaacacauucuuuuuuaucuuguugauacuguuaauaugaugaauuacacugaucaaauguuaaaccaaucuuucaaucuugugauaaacccuacuuggucagaauguauuuucuuuuguauaaauuuuuagauuugauuuguuaauacuuuguugggaauaagugcuucuauauccgugaggaagauugguccauacuuuucuuuccuagaaaugauuuugucagauuugguuucaggauuaugcugaccauauaaaugaguugagaagugcuucaucuuccucuguuuucugcaagagucuguguaagauagguauuacucauggacacaaagaggggaacaacgggcgcuaaggccuccuggaggguggagggugguagaggaucagaaaaaauaacuauuggguacuaggcuuaguaccugggugacaaaauaaucuguacaacaaacccccaugacacaaguuuaccauauaacaaaccugcacauguagcccugaacuaauaaaaaggacagguauuacuucuuccuuaaguauuugauagaaugcaccagugaaaccaucuagccuaggauuuucuuugcaggaagauuuuugauaaugaauucaacuuguucaacaacacuuuuuucagauuuuauauuucuuuuuuuuuuuuuuugagauggauucucgcucugucucccaggcuggagugcaguggcgcgaucucggcucacugcaagcuccgccuccuggguucacaccauucuccugccucaaccucccgaguagcugggacuacaggcgccugccaccacacagggcuaauuuuuuguauuuuuaguagagacaggguuucaccguguuagccaggauggucucgaucuccugacgucgugauccacccaccucggccucccaaagugcuggguuuacaggcgugagccacagcauccggccuguauuucaucuuaucucaguuugguuaaguuuuauuuuucaaggaauuuucuaaguugucaaauuuauuggcauaacauuguucauaauauuuuuuuuaccuuuuuaaugucuguagaaucugcaguuauaccucuauuuucuuucuuuuuuuuuuuuuugaguuggaguuuuacucucugucccaggguggagugcagugguaugaucucggcucacugcaaccucugccuaccaguuucaggcgauucuccugccucagcuuccuaagaagcugggauuacaggugccugcuagcacgccuggcuaaauuuuuguguuuuuaguagagacgggguuuuaccauguuagccaggcuggucucgaacuccugaccucaggugauccacccgccucagccucccaaaguuuugggauuacaggcaugagccacugcgcccggccaguuuucauuugugauauuugugggaucucuugcuuucucuccuuucuucccuaagcaauccugcuagcaauuuacauauuggauugauguuuucagagaauagacuucuacuucauuuucuguuuucuauuucguuucugcucuuuauuuuauucuucuacuaacucugguuuauuuugcucuuuuuuuaacuucuuaugcuggucacugauuuuuagauaaagguccuuuucuacacaguucccuuuaagccugcugugacuuccuuccacaaacaguuauguuuuauuuguuuauuucacuccauagugucuuuuuuuucaaaauuaaacuucauuuagagacgauuguagauucacauaauagucuaaaaaguaauacagauaccugggcaacauggugagacccugucucuaaaaaaaucaaaaaauuaggccaggugcaguggcucaugccugugaucccagcacauuggugggcugcagaggcaggcagaucagcugaggucaggaguucgagaucagccuagccaacauggugaaaccccaucucuccuaaaaauacaaaaguuggccaggugugguggcgggugccuguaauuccagcuacuugggaggcugaggcuggagaaucacuugagcccaggaggcagaaguugcaguaagccaagaccgcgccguugcacuccagccugggcaacaagagugaaacuccgucucgaaagaaaaaaagaaaaaaaauuaucugggcgugauguugcaugccugugguuccagguagcuggcaggcugaggugggaggaucacuuuaagcccuggaggucauggcugcaguaagcugugauuguaccaucaaacuccagcaaggaugacagaucgaggcucugucucuaaaaauaaaaaauaauacagagaccucaucuacccucuacccaguuuucucaaaggcaacuucuuacagaacuuuaguacaugcugggugcgguggcucaugccuguaaucccagcccuuugggaggccgaggugggcggaucacgaggucaggaguucaagacuagccugaccaauauggugaaaccccaucucuacuaaaaauacaaaaauuagcugagugugguggcgugugccuguagucccagcuauucgagaggcugaagcaggggaaucgcuucaaccggggaggcggagggagguugcagugagccaagaucgugcuauugccuagacaacagacucugucucaaaacaaaaaaagaacuuuaguacaauaucacagucaagauauugacauugauacaguaaagauacagaacuuuuuuuguuuuacaauauuuucauuacauucaauuucuuaaaauuuuuuuaaaauuuuguggcugggcgcgguggcucaugccugcaaucccagcacuuugggaggccgaggcggguggaucacaaggucaggagaucgagaccauccuagcuaacacggugaaacccugucucuauuaaaaauacaaaaaauuagccgggcgugguggcgggcgccuguagucccagcuacgcgggaggcugagccaggagaauggcgugaaccugggagacggagcuugcaauaagccgagaucgcaccacugcacuccagccuggacgacagagcgagacuccgucuuaaaaaaaaaaaaaaaaaaaauuuguguagguguggggucuugauguccugcccaagcugaucucaaacuucuggccucaagcaauccucccaccuuggccucccaaagcacugggauuauaguugugagccaccgugccuaacccagaacauuuuuauuacuacgaaagaucccucauauugcccucuuauagccauacccacuuccacuccugcuccugccccuuauuuaacccuugguuacgacuaaucucuuuuuaauuucuauaauuuugucuuucaaaaauguuauauaaauggaaucauacagcauguaaccuuuugggauugauuuuuuucauucaguauaauucuuggaaaauucauuuaaguuugcugaguaaaucaauuguuguuccuuuuuauuggugaguauuauuccaugguaugauuguaccucaguuuaaucauucaccuuuuguaggacaucuagcuuuauuccauuccaguuuggggcuguuacaaauaaagcugcuagaaauauucacagguauuuaugugcacauaaaucuuugucucucaggaugaacguccaacagugcugcauaguaggggaguuacaugucuaauauuuuaagaaacugccaaggccaggcgugguggcucacgucuguaaucccagcacuuagggcggccgaggcgagcggaucacgaggucaggaguucaagaccagccuggccaacauagugaaacccugucuauacuaaaaauacaaaaaauuagccaggcaugguggcgugcaccuguagucccagcuacucuggaggcugaggcaggagaaucguuugaacccaggaggcagagguuguggugagccgaaaucgugccacugccccccagccugggcgacagagcgagacuccgucucaaaaaaaaaaaaaaacagaagaaaagaaacugccaaacucuuuuaacagagugacuauaccauuuuacauucccaccagugauguaugagugauccaguuucuuuaccacaauauuucuuauuuucuuuuuuaaaaaaauuuauuuuuucaucacauacuuguuuugauauuuguguguguuguagguuuuuauuuuauuuuuuauuuuauuuuauuuuauuuuuuugccaggcuggagugcaauggcaugaccucggcucacugcaaccuccgccuccuggguucaagcaguucuccugccucagccucccgaguagcuaggacuacagauguguaccaccacguccagcuaauuuuuguauuuuuaguagagacgggguuucaccauguuggccaggauagucucuugaccucgugauccaccgaccccggccucccaaagugcugggauuacaggcaucccagcaccuggccuguuauaggcacuuuuuacuuuacucauucuaauagggaaguaagauguguagugcuaucucauugugauuuuuauuugcauuucucuaaugaacuucuuuucaugugguauagcuuuuuguuuuguuuugguguguugucauuguugccguuguucugagacagucuugcuguguugcccaggcuggagugcaauggaaggaacucagcucacugcaaccuccgccucccaggugcaagcgacucucaugccucagccuccugaguagcugagauuacaggcaugugccaccacacccggcuaauuuuuguauuuuugguagagauggggugucaccauguuggucaggccggucucaaacuccugagcucaagugaucugcccgccucagccucccacagugcugagaucauaggcgugagccaccgcaucuguccuuuaccaguaauuuuguagucuguaaacugcucuguaccuuacuuuguucccauaucagcacaaaccuuuguuucacucuuucucaugggugccuagaguugcauuuuguggauaugaucuaauuuaucuaacauugcuuuuuauugagcuguuuauaauguuuucagcuuuugcuguuacaaauaaugcugcagugaauaugguuauacacauuuaaagggaauccuuaaugaagaagacauuugaaacaguuuuucaaacuugauuuaaguuuuacaaguuuacuugaaugaauacuaaucuuuuuuuuuuuuuuuuuuugagauagauuuuugcccuuguuccccaggcuggagugcaauggugugucuuggcucacugcaacauccgccuccugaguucaagcaguucuccugccucagccucccaaguagcuggaauuacaggcauacgccaccaugcccagcuaauuuuuuauauuuuuaguagaggugggguuucaccauguuggucaggcuagucucgaacuccugaccgcaggugauccauccgccuuagcuucccaaagugcuggcauuacaggcaugagccacccacccagcuuaaugaguacuaaucuuaggauugcucuauuuuugugugcaauuuaagaaguauauuguuucugccaggugugguggcucacgccuguaaucccagcacuuugggaggccaaggcaggcaaaucgccugaggucaagaguucgagaucagccuggccaccauggugaaaaccugucucuacuaaaaauacaaaaaaaaauuagcugggcaugguggcacacaccugcagucccagcuacacgggaggcugaggcaggagaauugcuugaacccagaaggcagagguugcagugagccgagaucgugccacuauacuccagccugggagacagacugagacucugucucacauacacacacgcacaaaaaguaguauauugucuuacggugguuaaacaucugcagaguuguguaauuuaacuuuaccuucugagaaugucauuaaagagaaguguacauacaggaugggauuccucucagaguuuuguaccuuucguggguacagcuguuugcuuuccauaugucauaguaggaggauugaugauuuucaaagaaaauaauauuacuuccauuuuuuuugugugugaaaaggagcauagggcuuccauagggaaugccgucaucauaaagugaggcaaggguggauucuguaguauauauauauuuuuuucuucuggagcagaugggagggagaaaggaaacaguacaagauggaaggagccuuaggguagauuuauaaaaaggacugcuaugccagacaguagcaaugguaauguggacacaaauggugaaggggaggagucguaaaagaauugugucguaauuuucaaagccauaaagcucacaaugcaguuggguguguuaaagggcaauucuguggcaggagccagcugucuucuaucuaaggagccugagcacuguguuuuaagauugugaaauucuuugagauuucaucuauuucugaccugaacucuuuuagauuauugaaaaugugacuaguauauaguuuagcuuuuauggacuaucauauuugaccccuuguguucaauaauacccaagacaccaaugcaaagccccauuuucuguuuccagcauaacuaauaugcaguaaauuaucaugacuuuuccaauggccacuuuuuaugauacggguuuauagccccuugaguauuuucgguuuuuuucauuuguacauaaauuaagguaaguccaaaaaauuucauucuaaccaauuuaccaaguauauuuuuagaaggcagauaauaauuaaagaaguugugagauuguauauuaaaucaagguaguuuucagaaaaauauucucacaauugaaauuaaaauguggccccaaauuaggaaaacgucucagaaaucaacuaacuaguuuaacuguuaagguuuggaugaacuuagagauacuaauauaauggaucaagaaaguuauauagucauccuuugguauccuugagggauugguucuagggcccccaacagauaccacaauccucagauauaaaauuccuuacauaaaaugguguaguaauugcagauaaccugugcacauccucucauauacuuuacuuauuuuuauuuuauuuuauuuauuuuuuugagacauaguuuugcucuugucacccgggcuggagugcaguggcucaaucuuggcucacugcaaccuccgccuccuggguucaagugauucuccugcuucugccuuccaaguagcugggauuacaggcgugugccacaaugccuggcuaauuuuuguauuauuaguagagacgggguuucaccauguuggccaggcugguauugaacuccuggccucaagcgauccgcccaucuuggccucccaaagugcugggauuacaggcaugagccacugcauccagccuucucucauauacuuuaagucaucuuuagaguacuuauaauaccuagugcacuauauaugcuauauaaacaguugucauacuguauugguuuuuaauuuuuaaaaaauuauuguaguuuuuuuuauuauuauauuuuagaauauuuucuauuuauaguugguugaaucuacagauuuggaaccuguggauuccaagcaccaacuguacacauaaugacacuuuuagaaauuugcuucaguuucugaaccacucaaugcuguaugaagccauaaguuuuauucaauuaaggauugaauaaacauucugugcccuggaauuaaauaaaugcuaugacuuugaaauuuuaaggugauuguguuccuagauguuuaccaaagagaaacagaaacuuguccauaaaagaauuuuauagcagcuuuacuccugguagacaaaaccuagacauagcccagguauucaucaguagaagaauggauaacuaaguuguauuacacuuguauuuuggaauacuagucagcuauaaggaagaaccagugaggucgggcacaguggcucaugccuguaaucccgacgcuuugggagguccaggcaggcaaauugcuugaguccaggaauuugagacgagugugggcaacauggugaaacccugucuguacaaaaaauuggccaggcauggugcugcacaccuguagcuccagcugcucgggaggcugaggugggaggaucaccugagcccuguagguuugaggcugcagugagcugagguugcaccaaugcacuccaaccugggugacaaagugagacccugucucaaaccaaaaccaauuacuaaugcacaaguuaacauggaugaaucucaaaacauuuuccuguuuuuucuuuuccuucgcauaagguaucuacugugugauuccauuuauaccauuuauaugacaaacaaaacuuuaugaauagacaaaacuaauuuauguugcuagaaaucagaacagugguugcgggaauugacuggaaagaaauauaaacgcaucaauuuaagcagcagaccccagccuuuuuggcaccagggaccaggaucaugguagacuauuuuucuguggacaggguugcaggggaggugguuucaggaugauucaaaaacauuacauuuauugugcacuguauuucuauuauuauuacauuguaauauauaaugaaauaguuauacaacucaccauaauguagaaucagugggagcccugagcuuguuuuccuacaacuagauggucccaugugggggugaugggagacagugacagaucaucaggcauuagauucucauacggagcacacaaccuaaauuccuugcaggcgcaguucacgauaagauaugcacuccugccgggugcaguggcucucgccuguaaucccagcacuuugggaggccgaggugggcagaucaugaggucaggagauugagaccauccuggcuaacauggugaaaccccgucucuacuaaaaauacaaaaaaauuagccaggcgugguggcaggcgccuguagucccagcuacucgggaggcugaggcaggagaaugguguguacccaggaggcggagcuugcagugagccaagauugcaccacugcacuccagccugggcgacagagcgagacuccgucucaaaaaaaaaaaaaaaaaaaaagauaugcacuccuaugagaaucuaaugcugcugcugaucugacaggaggcagagcucaggcaguaaugcaagucaugggagcagcuguaaauauagaugaauauagcuguaaauauaggugugguggcaggcaccuguaaucccagcuacacggggggcugaggcaggagaaucacuugaacccgggaggcggagguuguggugagccgagauugugccacugcacucuagccugggcgacagagcaagacucugucucaaaaaaaucaauauaauaggcuuggcagguggcucacaccuguaaucccagcacuuugggaggccaaggcagguggaucaccugaggucaagaguucgagaucagccuggccaccauggugaaacucugucucuacuaaaaaugcaaaaaaauuaagcggguguacuggcgcaugccuguaaucccagcuauuaggaggcugaagcaggagaaucgcuugaacccaggagguggagguggagguugcagugagcccagauggugccauugcacuccagccugggcaacaagagugaaacuccgucucaauaaauaaauaaauaaauaaauaaaauaaaaauaauuuuacguguuucuuuuaauguuauuuuuuaaacgugucuguuagaaaaauuuaaauuacauuuauggcuucaauuauauuucuuccuuuuuuuuuugucuuuuacaaaaaaaucuguaccacaaacuuucacuacaccacacacaaacuucuggccucaagcaauucucccacgucagccuccuggauaacuaagaccacaggcaugggcugggcucgguggcucacgccuguaaucccagcacuuugggaggccgagacgggcagaucacgaggucaagagauggagaccauccuggccaacauggugaaaccccgucucuacuaaaaauacaaaaauuagcugggcguaguggcgcgcccauguagucccagcuccucgggaggcugaggcgggagaauugcuugagugcaggaggcagggguugcagugaaccgagauugugccacugcacuccagcccagcgacagagcaagacuccgucccaacgcuccccccaccuccaaaaaaaaagacugcaggcauguaccgccaugcccagcuacuuuuuuauuuuuuguagagccagggucccacuguguuaaccaaucuaguccuaacacuccugggcugaagugaaacuccuaggcugaagcagucuucccaccuuggccccccaaagcaucgaaauuacaggugugagccacugcaguuggcuauggcucuaauuauauuucucuugaacagagcugcucuaagguuuuaagacaaguguguucgaauguuuguaugcuauaacaugauuuuuacgugugugaauguuguuacuaugucacaguuuuuuguaccacaaauuuuaacugaauuauuucucuuuagaaaauuuuuuuuuguuaaaaggccuaauacccaaaggaaucuuagaacacaguuucuugggcaggauugauauuuuggcuauauucuuugauuuagaugugaauguuugcugcauacauuugggagacgauagguuuuugaaauaacaaugauugaucgcaauagaauaauguauuuuucuucugauauguuuuuugauauuuauuuauuuagagauggagucucacucuguggcccaggcuggagugcaguagcgcagucuuggcucacugcaaccccugccuuccggguucaaauuauucuccugccucagccucccgaguagcugggauuacagcugcccaccacacccgacuaauuuuuguauuuuuuguagagacgguguuucaccauuuuggccaggcugaucucaaaaacacgugaccucaagugaccugcccaccucugccuuccgaagugcugggauuacaggugugagccaccaugcccggccuguuuuuguuuuugugguuuuuuuguuuuuguuuuuugagagggagucuugcucugccgcccaggcuggagugcaguggcacagucuuugcucacccaccuccggguucaagcaauucuccugucucagccucccgaguagcugggauuacagacaugcauaaccacacccagcuaauuuuuguauuuuuaguagagaugggguuucaccaucuuggccaggcucgucucgaacuccugaccucaggugauccaccugccucggccucccaaagugcugggauuacaggcaugagccaacgcauccggccaagaguucuuuauauguccuagauacaacuaucagauauaugacuuguaguuauuuucucacauucugaggguugucuuuucacuuuuuugaaggugcccuuugaagcauaaacguuuuucauuuugaugaaaguuaauucuuauuuuuguuguugcuugugcuuuucaugccauuucuaagacuucuucacuaaauccaagaucaugaggauuuaccaugucuuccuauaagaauucuaaguuuuagcacuuacauuuaggucuuugauccauguugaguuaauuuuuuuuuuuuuuuuuuuuugagacugaguuuugcucuuauugcccaggccagagugcaguggcaugaucucggcucaccucaaccuccaccucuuggguucaagugauucuccugccucaagccucccaaguagcuaggauuauaggaaugugccaccacaccuggcuaauuuuguauuuuuaguagagacaggauuuccccauguuggucaugcuggucucgaacacccaacuuucggugaucugccugccucggccucccaaagugcugggauuacaggcaugagccacugcggccugccuuauuuugaguugauuuuuauagaugaggaaagauaaggcucaacuucauuuuuuuuugcauacuacgaucuuguuaauaguagagaaauaucgggugaugggugcaccaaaauuucacacaucaccacuaaagaacuuguguaaccaaauaccuguucccccacauaccuauggaaauaaaaugaaggaaggaaggaaaggagggaaggaggaagaaaggaaauaacugggugugguggcucaugcuugugaucccagcacuuugagaggcuaaagugggaggaucccuugaguccaggaguucaagaucagccuggccuacauagugagaccuugucucuacaaaaaauuuagucuggucaugauagcgcgugccuguauuccuagcuacuugggagacugaggugggaggaucgcuugggcccagaagauagaggcugcagugagccgagaucacaccagccuggaugacaagagcuagacacugugucaaaaaaguaaggccugggcacagugacucaugccuguaaucccagcacugugggaggccaagguggguggaucaccugaggucaggaguucgagaccaaucugaccaauauggugaaaccccaucucuacuaaaaauauaaaaauuagccaggugcgguguugugugccuauagucucagcuacucaggaggcuaagacagaauugcuugaaccccggaggccgaaguugcagugagccaagaucgcaccacugcacuccacccugagcgacagagcaagacuccaucucaaaaacaaaaaagaguaaagaaguaauuucauagauuuagucauauaacaauauuucuuuuuucuuuuucuuuuuuuuugagacagagucucacucuguugcccaggcuggagugcacuggcgcaaucuuggcuccuccaaccuccgccuccuggguucaagcgauucuccugucucagccuccugaguagcugggauuauaggcaugcaccaccaggcccggcuaauuuuuguauuuuuagcagagacuggguuucaccauguuggucaggcuggucucgaacuccugaccucgugaucugccuaccucagccucccagagugcugggauuacaggcgugagccaccgggcccagcuauauaacaauauuucauuguugcauagugguuuaauaacugucauggguaugaacugacucuuacauguugcuuauuauagaacaucuuuguuauucguucugagauugugauauuagcugaacuuaauggaggcuauucaagagucugauaaagaguguaacagaacugaaaaagguaggaaauaauguuggagccaacaugggagaugucuguacaagaaauuaaaaucaaagcauacaaaauuucaaugaaaaaaaaauuuuuuuugagacagggucuugcucugucgcccaggcuagagugcaguggcacaaucuuggcucauugcagccucuacuucccagguucaagcagcccucccaccucugcgucccaaguagcugggacuacagaugugcaccaccaugcucugcuaauuuuuaauuuuuuuuuuuuguagagacagagucucacuguaucgcccaggcuggucucaaacugcugagcucaagcaauucucccacaucagccucccaaugugcugagauuauaagcgugagcuacagcaccuggccugaaaaugaaauuuuaauuuaauuggucauuucuaaaaugggaggccacaaaagggauaaaaggaaauguuuggagcaaauuuaauuaagcccaguuauuccacaaguguaaauuauaaagcuuaauuaguucuuucagacucuaaugugacagucagugaauuauuuuccauucaguuaaaagggaccuccugugguccagugucuauaaaagaagaugaaucaaacaaaugguugauaacauaaauauuauagacaguuuuagugugcuuaagaaaccauauuucuucuuuuguuagcccaguggugauauuguagcccauaagacauaacuaaaagaggauuauggcuaauaaucuuuugaaucuuauauugcuuuugcuagagauccagccccauuucagucuuacgacugagugugguccuccugaaacuuguucaucuaacgaacucuaccguagaaggauccuaccugugugacauuuccuucacacuaucagcaauuuguguucacguuggcaugauucacaucugccuccaaggaucucauuuagaugaacuggugaucagauugaucacaaaccaggguuaaaauaauucuucaggccagguggaauggcucacuguaaucccagcacuucggaaguucgaggcagguggaucaccugagguugggauuucgggaccagccugaccaacauagagaaaccccaucucuacuaaaaauacaaaauuagccaggagugguggugcaugccauuaaucccagcuagucaagaaggcugaggcaggagcaucuuuugaacccaggaggcagagauuguggugagccgagaucacgccauuguacuccagccugggcaacaagagcgaaacuccgucucaaaaaaaaaaaaaauucuucaguggucugccacucuguggaaaccccacagggccacuaauguggauaaaucauuuaaccccugugggcugccuuuuccuuuucuaucaaauaaagcaauugguuuaggugaucuuaagaucccguccauguguaaaaugcuaagucucugugacuuuauauuuuauuugcugcccaggauaagacuggguucuuugggaugccagauuugauaaagauaaaacuucuuuagcuuuuuguguuguacuucuauuucuguuggauuuggacuauguuugucaauaagauucuuuuugcacagaacuguuauuagcaaaauguuuacagaagauaaaauuaaaaacuaauugaacaacuaaacuucaacuuuaacaguugaaaguuggcugagugugguggcucaugccuguaaucccagcacuuugggaggccgaggugggcggaucaccugaggucgggaguuggagaccagccugaccaacauggagaaaccccuucucuacuaaaaauacaaaaauugagaaguuucccccuugggcaguggcggaggugguaacuacgacaguagcagcuccggcggcagcagcagugacuacgaggauggcggaagcugcagcaggaccugcaacuucccagagguuuuuccagagcuucuuggauacucuaaucgacgaggacccccaggcggcauuagaggagcugacuaaggcuuuggaacagaaaccaaaugaugcauaauauuagugucaaagagcuuauugucacauucuuguaauuacuguguugcuguugcugaugcaaagaagucucucgaauucaauccaaauaauuccaccacuauguugagaaaaggaacaugugaauacuaugaaaaaaacuaugcugcugcccuagaaauuuuuacagaaggacaaaaauuagauagugcagaugcuaauuucagugucuggauuaaaagaugucaagaagcucagaauggcccagaaucugauguguggacucaucagucaaaaaucagguaugacugguaucaaacagaaucgcaaguagucauuacacuuacgaucaagaauguucaaagaaugauguaaauguggaauuuucagaaaaggaauugucugcuuugguuaaacuuccuucuggagaggauuacaauuugaaacuggaacuucauccuauaauaccagaacagagcacauuuaaaguaguuucaaccaagauugaaauuaaacugaaaaagccagaggcugugagaugggaaaagcuagaggagcaaggagaugugccuacaccaaaacaauucauagcagguguaaagcaccuacauccaucaucaucuccuuauacaagaaauugggauaaauuaguggguaaaaucaaagaagaagaaaauaaugaaaaguuggagggagaugcagcuuuaaacagauuauuucagcagaucuauucagaugguucugaugaagugaaaugugccaugaacagauccuuuaugggagucugaugguacaguuuugaguaccagcuggucugauguagguaaaaggaaaguugaaaucaauccugaugauauggaauggaaaaaguacuaaauaaauuaauuugcucucacacacacacacacacaaaauauaaaaauuagcugggcauggaggugcaugcuuguaaucccaguuacugggaaggccaccaaggcaggagaauugcuugaacccaggaggcggagguugcagugagccaagaucaugccauugcacuccagccugggcaacaagagcaaaaaacucugucucaaaaaaaaguugaagguugacaaguuuaacauuuuuuggauuauuguagacaaauuggcauuaauauuuuuuucuuuagaaauuuuauuuauuggccaggugcaguggcucacgccuguaaucccagcacuuugggaggcugaggugggaggaucaugaggucaggagaucgaggccauccuggcuaacauggugaaaccccaucucuacuaaaaauacaaaaaauuagcugggcaugguggcgggcaccuguagucccagcuacucgggaggcugaggcaggagaauggcaugaaccugggaggcggagcuugcagugagccaagaucgugccacugcacuccagccugggcgacagagcaagacuccgucucaaaaaaaaaaaaaauacauauauauauauauauuuauuuuacuuuuuuuuuuuuuuuuuuugagacggagucuugcucuguuuuccacgcuggagugcaguggugugaucucugcucacugcaaccucugccucccggguucaagcaauucuucugccucgaccuccugaguagcugggacuacaggggcaugcgcuaccacgcccagcuaauuuuuguauuuuugguagagacgggguuucgccauguuagucaggcuggucucaaacuccuaaucucaggugaucagccugccucggccucccauaguucugggauuacaggcaugagccaccgugccuggccucuuuugaaauuuaaaaaucucagcuacucugggcauacugccugugggguagcccuguucuccaaggaccauuacaaaaaaaaaaaaaauagauauuuaguguguacuuucccauauucaguuuguugaaagaaauuacauuaaccgggcaugguggcucacgacuguaaucccagcacuuugggaguccaaggcaggcggaucaccuguggucaggaguucgagaccagccuggccaauauggugaaaccucaucucuacuaaaaauacaaaauuaggugggugugguggugcacgccuguagucccagcuacucgggaggcugagacaggagaaucacuugcaaccgggaaguggagguuguggugagcagagaucaugccauugcacucuagccugggugacaagagcgaaacuccauaucaaaaaaaaaagaaagaaaagaaauuacauuauuagauuuuuuauuuuuauuuucuuuuuucuuuuucuuuuucuuuuuuuuuuuuuuuugagacagaguuucgcucuuguugcccaggcuggagugcaauggcaugaucucagcucacugcaaccuuugccucccagguucaagcaauucuccugccucagccucccaaguagcuuggaucacaggcaugugccaccacgccuguguaacuuuuuguaucauuauuggauuuuuuaagccaauuuuucaaauguuugcugugaggcuacuuuguaaauuuauuuuccuuugacaaauggugacugacuggauuuauccucauuuuagccuuuuuuaauaaggguuaaacuauuucagauauuugguuuagauuucuuuaacucacaggaucuauggcuugacaaauuuuaaugccuagucuugcauagcuuguuguaacuuggugcuugaagaaaauguuuacuccuuucuuuuccuuuccuuuuuuuuuuuuuucuucuuuuuuuaucuucuuuuccaaggaugggcauucuggggaccuagagcuaguuccuucagcaugugaaggggagagugggguuuugucagauccuccacaggggggaaaagcuagugucucuucccuugagguauaguucuuccagucugaugaacugucagauccacugagugauugguaaagcagauuggacagugacucgaggaaguggggguggggacaauauuuuaaguaguaacuaucaaaaguaaagugauucucugggggcucaguagagccaugugugcuucuagcguuagcagucugcaggaauugugcagagugcgguguuuucuaagaggaaaaggaggaugagugugagagugaugagaggugaguugggauggauuguaaugcaccaagagaagggagcauaaauguugguuugaguuucgggcaaugaaacuugcuuaauccugauggcucuuaaucagaaugucagcccuaaaguuucauauucacaguugagaacuuuuaauugaaugauuauuuuuuauagucuuuuacccuguuuugauuuagaauuugaagaaagcagauuuuuauauucuacguaauuauaguuugggcuuccugggaaacagaauccugcugcaaaucuuacaugacugauuucuggacccaaaguggguuugacagugggcuggagcaguaauagcccaccuacugucgggagaggccagggcaggcauuucccagcaagccugccugaagugggucuuguccuagacucuaggaccuagaucaugcaggaaaagucccauuugugggagcuggaaaagaguuggcuucauuagcaaagugaccuaccaacaggaaaggugggggucuggagaagcagauuuaaaauguugaaagcuguguuucuuuaacaaauacuuauuaagcaccuacugccuaugugagauauugcucuagucuguguaggaaaccacagaugugugcuucugcuuuuaagaagcuuauguuuuacacugaccuuuggcagagucacauaugaaaauggauaucgggccgggugcaguggcucacgccuauaaucccagcacuuugggaggccgaggcgggcagaucacaaggucaggaguuuccagccuggccaacauagugaaaccccaucucuauaaaaaaauacaaaaaaauuagcugggcaugguggcgggcaccuguaaucccagcuacuugggaggcugaggcaggagaauagcuugaaccgaggaggcagagguugcagucagccgagauugcaccacugcacuccagcccaggcaacagagcaagacuccgucucaaaagaaaaaaaaaaaaaaaagauacuaaauuuuguaacugucauucacauaggcccugaacuaauuuuuuuuuuuuuuuuuuuuuuuuuugugacggaguuucacucuuguugcccaggcuggagcgcaauggcgugaucucagcuuaccgcaaccuccaccuuccagguucaagcgauucuccugccucagccucccaaguagcugggauuacaggcaugcgccaccacacccagccaauuuuguauuuuuaguagagaugggguuucuccauguuggucaagcuggucucgaacucccaaccucaggugaucagccugucucagccucccaaagugcugggauuacaggcaugagccaccgcacccagccacuaauggucuucuugagccuccggagaccggaccuuuaauagucuuuuuuuguucauaaguaguacauaucugauauguuguaguuacucaguauacuucuugaaugaaugaaugucauugccauuuuaaaauuaaaaauacaaauaagccaaaaggagaaauuaagucaccagucuugccacacagaccuaacuacuaacauucuucugaagaugagagauaacuagccuccugccucuggucccugagucuuccuucauggggaggguucauuguagggacuguggccaugggacaaccuugcugguaaagccagcuguugaagagccagaaauauugauaguaggcuugccaggaaaauuccuuugaaaguggcacuacuugcuggcucucaaauuacuauccucuguaauaagggucagauuuaaaauuacauacucagggacaaaauauaaacuuauguuuggauuaaacuuuuucuaccuguuuaaaaagacaaguuagaauaccuauguuguguaugccuagaacuuagaaaauuauaauguacaagaaucuuuucuguuguguuuuuuguaaguggucuugugaguuaauaaagaagcaaugugauuggaugggaagaacagcggauugggagucuacaaugucaaauauuagaccuaacuaaucacacacuaagcuaaagauuauguuuacucacuuugagucucuguuuccacaucaguuaaacaaggaaccacacuagacagucuuucagcccucccaugguaguauaaggcauaaaccucaauuucguuaugcuucucaaggaccacucuacuuuucuguguuguuaagaguugaggggcugccuuucuaagauucuaggaaccaaauucuaggguaguuuucuaagauucuaggaaccaaaaguuagcaagugaagaggaaacagaauacuuuugaauuugcccagcugugcuuuuuauaggaagagccauuucuagucagaggauuucagaacauuucaaaacucuguggugauauacugguuacauucuuccuuagacuaaaauuacaaccugaaugcacuuaaugauacauauguguauuguaauuuguaaacauaacucaaaacccuguaucugagugaggucauuugugguuagccauucagacuucauuucuauuugacaaggguuuauuuuaagauugcuuuguggagcaguuguuuaacauucaagugaucuauuaguauuaagucuuuaaccagacuuguuuuaaaugagcugucugugaaguagaaaaccaaauauuauagaaacuuagauuuccaauccaacuuagcgaaaucaauguaacuuaaacguugucuucacauauguuuguuuaaccuguuuuuuuuccuucaguauuccuuuagaagaauaguaacugugugaauaaaacuuuuuaguuacucuugauacuaugguuuagcaagaacuguagacuuaauugguugagaaaagaacauuuaaaguaaaugaaugcuuuaguaaguuaauuauuucuuagcauaucacaaauauauguagaaagaauaagaucucauucuauagcuuuauuccuagguuauuaaaagcaaacuucuauggaaguuaguucucauuaggcuauauauauauaguguguguguguguguguguguguauuuaucuauacauauauacauacauacauacauacaggcuauguauuguaauccauugguuauuuuguuggggaugugggucaauuggaugaaagcuaaagaugacuuauguaaauagccaaacuguguuucagaauuguuuuauacaucaaucuaauucuuaccauuaguaccguggcuuccucuccucuuuccugguguccagauugucacagcuaaagggcauuucuuccuauuuagcaaauauaaccauuaucaauguuuaaaaugagauuuucggccccuucccuuuuguguuauaggugcuccauacuugcuugcagugccuacguggcucuggcuuugggugauaaccucauggcuuugaaucaugcagauaaacuucuucagcagcccaagcugucaggaucucuuaaguaagugugacuugcccugugugucccugguuucuuuaguuuugagguuucuccuugguuugugguuuauguugcuucuuuugacuccuccaguggaauauauauuuguaaggaaagcaacuguuuaaaagaacguuuuuuaacccaugccucggcagugaaaauguuuucacuugugcuguacugagcguuaggagacaaaaacuucggacucuaguguccacuucuaggcuucacugcagcacuuuaauucuccaaauaagucaaguccucagagagaagaccuacaaaaaaaggaguguggucaaugugauaaaucuacuuugagggaccaggcacgguggcucacgccuguaaucccagcacuuugggaggccgaggcaggcaaaucacgaggucaggaguucaagaccagccuggccaacauggugaaacccugccucuacuaaaaauacaaaaaauuagcugggcguaguggcgggcaccuguaaucccagcuacucaggaggcugaggcaggagaaucgcuugaacccaggagucagagguugcagugagaucucugcaccacugcacuccagucuaggcuacagagcaagacucugucucaaaaaaaaaaaaaauagacaagaauuugaaaaaucuuuccaagcuacuguaucauuccagaaucagcuaguuuuagucaaacugcaaauacuucuucauuaauaucauugucauucuaaaauuuuccaaagcacauuaucuuuucuuuuaccaaaauugaguaaaauacaggccaggugugguggcucaugccuguaaucccagcacuuugggaggcugagguaggcagaucauuugaggucgggagucugagaccagcccagccaacgugguaaaaccccaucucuacuaaaaauacaaaaauuagccaggcaugguggcaggcauccauaauuccagcuacucgggaaguugaaacaggagaaucacuugagccuggggggcggacguugcggugagccacgguugcaccauugcacuccaggcggagugacacagcaagacucccucucaaaaaauaaaaauaaaauacagcuugaauuuuuguauggugcugauccuggaaauuuuaucaaaagccacgaguauucugcacaacauuagaacaguucuuucauucaucguauagguguauacuuacaaaugccaaaauauaacuacuuacucuuuggcuuuuuagugauccccaaacauaccuaguguuuuuguuuuuuuuuuaaguaauuaaggccaggcgcuguggcucacaccuguaaucccagcacuuugggaggccuaccugggcaaaucauuugaggucaggaguuggagaccagcccugccaauauggugaaaccccaucucuacugaaaauaugaaaauuagccgggcaugggggcacacuccuguaaucccagcuacucgggaggcugaggcacgagaauugcuugagccugggaggcagaagcugcagugagccaagauuguaccacugcauuccaaacugggugacagagugagacuccaucucaaaaaaaaguaauaaaucauucaacuauauaagagacuuugucacaauucaaauauaagggagcuccugcucuucugcaagaaaaucuuguccaauauucaggccuggagauggggaagauccuaauuuucaguucaaggcauuuggguugccucuaaaguaccuuccguccuuaucauugcccaacucaaaaugccaauguugggaauugcagcugaugcugguguucagauugugguguauacggccauuaugagagaacuggacuuuguguguuugugugugacugagucugucugggucacccacacuagagugcaguagcacaaucucaacucacugcaaccuccacugucuggguucaggcgauucuccugccucagccucccgaguagcugggauuacaggagcccaccaccacacccggcuaauuuuuuuucuuuuucugagacaguuucacucuguugcccaggcuggagugcaguggcaugaucucagcucacugcaaccucugccuccccaguucaagggauucuccugccucagccuccugcguagcugggauuacaggugcacgccacuaugcccuacuaauuucuuuuuuuuuuuuuuuucuuuuuuugaaacggaguuucacaggcaugagccaccgcaccuggcuacuuuuuguauuugcucuuauugcccaggcuggagugcaauggcgugaucucggcucaucacagcuuccaucucccggguucaagcgauucuccugccucagccucccaaguagcugggauuacaggcaugcaccaccacgcccggcuaauuuuguauuuuuaguagagaugggguuucuccauguuggucaggcuggucucgaacucccgaccucaggugaucugccaucuuggccucccaaagugcugggauuacaggcaugagccaccaugcucaaccuggagaguuuuaaaacuauaaaaguuuaguuuguggugguguuguucuuguguagaaagucauuaagauuuugagcagaucaaaagguccccaguuaaaaaaaaaaaaaaaagcugggcaugguggcucacgccuguaauaccaacacuuugggaggccaagacgggcggaucacgagaucaggagaucgaucuuaauuuuuauuuuuauuuuuuuugagauggcgucucacucugucauucaggcugaggugcaguggcaugaucacugcucacugcagccucagucucccaugcuuaagugauucucccaccucagccuccugaguagcugagacuacagguguaugccaccacgcccagcuaauuuuuguauuuuuuuuguagagacaggguuuugccauguugcccacgcuguucucaaacuccuggacucagcaguccacccaccuaggcuucuugaaguguugagauuaaaggcaugagccacuacacccaggcaguugauucguuuuaccuaaauaaauuuagauuucaauuuaaggacaugaaauaugagaccuauauccaauguauaauaacauaauauacccagcauuauuuuacauuggguauuuuugugacguuguacuuuucaguuuggaaucuguuuuuucauuuuagguuuuugggacauuuauaugcugcagaagcccucaucucucucgacagaauaucugaugccauuacucacuugaacccggagaaugucacugaugucuccuuagggaucucuucaaaugagcaggaccaagguuaaugaggacaucuuugaucagaacuggucacuguuuccauuucccuccugucauaauucaggauguguggaaauuuaggcauggugguaaugagaagaaaguuuuagguuggcuuuccacauuuuugucuguacuuacuuuguagcaguuguuugcuaaguagaccugagaguuaaugaucacaucaucuaaauucucacuuuugaaaggcugguacuguuagaaugguuaauuuugguucugauacuauuuauuuguuuuccuuuggagugauucuaaaauccauaggggaguaaaaauauugcauucaagagucaguuuuaguccaggcgugguggcucacgccuguaaucccagcacuuugggaggcuguagcaggagggucacuugagcccaagaguucaagaccagccugggcaaccuggugagacccugucucuauuuuaaaaauaaggaaagaaaaaaaaguuuguuuuaagucauugcuaaauuucuaaauaauugucgggugcgguggcucacaccuguaaucccaacacuuugggaggccgaggcagguggaucaccugaggucaggaguucaagaccagccuggccaacauagugaaaccccgucucuaccaaaaauacaaaauuaguagggcgugguggugcaagccuguaaucucaccuacucaggaggcugagacaggagaaucgcuugcaccugagagguggagguugcagugagccaagaucacgccacugcacuccagccugggugacagagcaagacucugucugaagaaaaaaaaaaaauuaaauaauuaaagcuaugugacauucauuuuacucaagacuagugcucagguuugagaugguggugggugguagcauucuggcauuuuuuaauggaaucuccacuacaugaaaaguaaauaaauugcuuuauauuaaauuuccauuucauaaagaaaguuagguuuuuagaaaauaugcucucagcuggccacaguggcucacaccuguaaucccagcacuuugggaggcugugguggguggaucaccuaaggucaggaguucaagaccagccugaccaacauggugaaacccugucucuacuaaaaauacaaaauuagccaggcauggugguaugccccuguaaucccagcuacucaggaggcugaggccagagaaucacuugaacucaagaggcggagguugcagugagucgugccauugcacuccagccugggcggcaacaagagcaaaacuccaucuccaaaaaaaaaaccagccugaccaacauggugaaaccccgucucuacuaaaaauacaaaaacuagccagggaugguggcacaugccuguaaucccagcuacucaggaggcugaggcaggagaaucgcuugaauccaggaggcggagguugcagugagccgagaucaugccccugcacuccagccugggcaacagagcgaggcuccaucucaaaaaaaaaaaaaagaaaagaaaagaaaauaugcccucuaccuucugagcccgaggagaaaagaaagaaaauaugcucuguuguucugccccucagauuuauuuucguguuuuuguaggaucagacaaaggugaaaaugaagcaauggaauccuguaaguaagaaguuuugugauacuuaaguagccuggccugcaucccaaaaauuuagauucuaaaucuucuguguucguuuuucugccugaggaauacugcugugccaaguggcuccucaaggcgauagauuggguugcuuccuugcuguuggcacggccucuucaccagugucuacacucuuuuuccccagcugguaagcgggccccucagugcuaccccaguuccgucaacucugccaggacugugaugcuguucaaccuuggcagcgcuuacugccugaggagcgaauaugacaaagcccgaaagugucuccaccaggugaguccagagugggaggaacugaaccuuguaaagcagccaacacaaguuugagguuuauauuuuuuguuacuuuguuugaagcaucugaucaguuuguuaaauauuggaauaucacuuucccagauauaaaaauauucuugcaagguaaacaacuaaucagcauuguaaaugaaccuagacacuuaaaggaaaguucuucuugaugauuuuauuuuaaaaaaaauuuuuuuuugccaggcacaguggcucaugccucccagcacuuugggaggccgaggcaggcggaucaugaggucaggaguuugagaccagccuggccaauauggugaaaccccaucucuacuaaaaauacaaaaauuagccagguugguggcacgcaccuguagucccagcuacucgggaggcugaagcaggagaaucgcuugaauccgggaggcggagguugcagugagccaagauugugccacuguacuccagccugggcaacagagcgagacuccgucucaaaaaaaaaaaaagauguuuaaauuucaaaucagcagaauaaaaagcaacuuggggccgggcacaguggcucacaucuguaaucccacacucugggaggcugagacaggcagaucacuugaguccagggguuugagaccagccugggcaacauaaugagacccugucucuacuaaaaauaccaaaaauuagccaggcaugguggugcauuccuguagucccagauacuuaggagacagagguaggaggauuaccugagccugggagguugaggcuguagucagccaagaucaugccacugcacuccagccugggcaacuggagugagacccuguccccccaaaaaaaaaagacaaaagaaguaaguugacaguuuuaauuauuaaaauuccaaaagauggaaaacugucuaaaagaucacuuauauaaauaauagugcaucuguacaguugaagacaaugcagcuauaaacucuagguacuaaaauggaaagauguccaagacauacuaaaugaaaacagcaaggugugaaacaguuucuguauaacccuguauacaugcauaaaagaucucugaaaggacacaccaagaaacugcaaacauuaguuguugggguggcaggacgaauacuacauggcuggagcaguagaaugggagacuuuucacuguauacuguuaugcuuuuaauuuuuuuuuuuuuuuuuuugagacggaguuucgcucuuguugcccagacuggagugcaauggcgcaaucucggcucacugcaaccuccgccucccggguucaaacacuucuccugcgucagccucccaaguagcugggauuacaggcauguaccaccacgcccggcuaauuuuguauuuuuaauagagacgggguuucuccauguugaggcuggucucgaacuccuggccucaggugauccacccgccucagccucccaaagugcugggauuacaggugugagccaccgugcccaggugcuuuuaaauuuugaauuguguaaaucuuuuuucaaaaugugaauuauaggccaggcacgguggcucaugccuguaaucccagcacuuugggaggccgaggugggcggaucaugaggucaggagaucaagaccauccuggcuaacacggugaaacccugucucuacuaaaaauacaaaaaaauuagccaggcgugguggcaugugccuguagucccagcuacucgggcggcugaggcaggagaauggcaugaacccgggagguggagcuugcagugagccaagaucgcgccacugcacuccagcccgggcaacagagcgggacucugucucaaaaaaaaaaaaaaaaagugaauuauaaauccaccuuucagaaagccaauacuagagaaacuccauacacacuaaagaaagcuacuggcaauauauaacuaaaauaaaccucugaauucuaccacugaaauggugcaucaugaagcuucaaggaagauuuugauuggaucucuuuaguaggucaccugccaaucccuggaccaaucaugggcauugagccauaccuguaguaggggacuggguaccaccauuggcagccccagaggaaucucacaaaauuagaaauaguuccucaaaaggacauucauccagcagauaucuguugagcacuuacuucugagcuaagccaugggaauaagacugcacauaagcagacauacuacaaucuugcccuugcuuguagaccuuugcaguuaggagacaccuuccuaaaaagggaauugcauggucagaggauaugcaggauuuuaagacuucugauauagaaaguuuguaucaaaugguacauucuccagcagcagaugagaaggcccacauccccacaugcuugccacagcaacuaaaguugauauuaaaccucuucucaggagauaggguggcuuucagccgggcgcaguggcucacaccuguaaucccaacacuuugggaggccgaggcaggcagaucaccugaggucaggaguucgagaccagccuuaccaacauggagaaauccuaucucuacuaaaaaugcaaaaaguagcugggcgugguagcacaugccuguaaccccagauacucgggaggcugaggcaggauaauugcuugaacgcaggagguggagguuguggugagccgagaucgcgccauugcacuacagccugggcaacaagagcgaaacucugucucaaaaaaaaaaaaaaaaaagccuauguggcuuucacauagguuccugcuuaugugagcagccuuguugugccuagaagugaugaugcuuuaccaugugaaaaauaacuacaaauucuauuuagucaacuuaguggcaucuggucagcauuucugaucccagaucagaaaaguuaagugacaggcuguccaggguaacauguuugauauuaucuaggcauugaguguaugaguuaaaccaguaagaguuaaaauguuucacucuucucaguaacaaggcuaggguguugagcagccccucucaaagugcccccagaccucagucacugcagcaaacagagcuuuugaucuaaaguuacaguguguacaguccagcugagguucucguacagcagguggccauggcugcugccacgcugggagagacagauggggucaggccugguuuggggucugaaggggguuuuguuuuggucccuugguuuuuagguuaauccaauggcuggaccuuuguuaauugggaggcccacccugccugggagggaagaacagugaugugaagaguuggaaagggcuccgaguagauguuuccaagguugccugcccaccacuaaccauucugaacagccaguaagcaaaaugccauuaaguaucauaaagauguugccuugaauucuuguauuuuaaaaaaagcuucagacuguggucauugaaaaaaacaguaaauaaaauguguuacuagccacuuggauggaaaacagagauuuuacuauccacaaaaugggccgggcacaguggcucacaucuguaaucccagcacuuugggaggccaaggcggguggaucaucugaggugaggaguucaagacuagccuggacaacaugaugaaaccccgucuauacuaaaaauacaagaaauuagcugggcgugguggcaggagccuguaaucccagcuacuugggaggcugaggcagaagaaucgcuugaacccaggaggcggagguugcagugagccuagaucgugcaauugcacuccagccugggcaacaagagcaaaacuccgucucaaaaaaaaaaaauccacaaaaugguauaaagacgaucuugccuauacagcuugccuagaaagcuaggcuuagauauauaaaaucucauuuucugaaaagaguuguuauaccucaguguuguggcgagaggaauaaaagccuccccaccucauucaugaggaacuucuuagaagcacaugcucugggcaacaugccccgcuagucugagauuucuccuaaugcugccagaaaccaaccuaguacacguuucuggucuuccccaacaucucccacguucaagcugcuaccuucaguaccauuucuccccauuuucuaccugugagauaucuacccugcaaggacuaaagcaggccucccuuaccccaaagcucuguuugaaagaaacuucuuccuuucucuccauauucacagcacauucacugccuuucucccuggcauuuacguaacuguguuuggauuauuguuaguuauuugcaugcuuguuuguuaucaggggaagucccugucuuaucuccauacccaccucuguucaauaaguauuuguagaagucuauuaucugauuagauuaagagaagaggcagagcugucuggaagcaaugagcaacuaaaacuagauggggaaguacaaguugauaauaaggugaggaauauuuuggcuguagcucaaagaggcccagacugaggaaauaaaccuguaauuucagcacuucuguccagagcaguccaggcuuccuucuucaggacuggaucagagagaaacugcuggccgaugcuauggcucuuacucagaucuaagggcagcauguugccuaaacuaguaaauuauuuuauuggacuaaauugaaguguguuucaguccuuaagaauggagaccucaaacaugcuacgugguacguuuuuucuguauuacuauaaguuugaauuauuauuccugacauugacaacuuacaguuuguaauacugaaguguuacuuaggaaaacaaaugggcaugcagauuuugauguaauugcaacuguaugugucuguugugaaagccaccagcagaauuggaugguugacuguaguaucgggguguccagucacccaucucaaaacccagaguauuacaugucuagcuuaauuguuagguuuuaagacaaaaggaacugaggcucaucagagcagaacaacagguagucccuaggaagucacgugggaaugagcuugaauaaguuuguuaccuuguugguuggcagauguacuuggaguguguaucuuaagcuuuuguuuuuucacgggcaucuuucuguuuugagcaaaggcggcuucaaugauccauccuaaagaggugcccccugaggccaucuugcuggcagucuaccuugaacugcagaauggugaguaauucucucuguuuaggacuuuaucccuugaaagagccugagauuuuuugguugggagacagggucucacuguguugcccaggcuggagugcagugguaccaucagagcucacugcagccuccaaacuccuaggcucaagcagccuucccaccucagccuuccagguagcugggacuacaggugcacgccacugagcccaacuaauuuuuuaaauuuuuuuuagagauguggucucgcuuuguugcccaggcugcucucaaacucaugggcucaagcaguccucccaucuuacccucccuaguagcugggaugacaagcauaagccaccaugcucagccaaggcugagauuuuuuuuuuuuuuuuuuuuuuuuuugagacagagucuugcucuguagcccaggcuggagugcaguggcgcgaucucggcucacugcaaguuccgccucccggguucaugccauucuccugccucagccuccugaguagcuaggacuacaggcgcccgccaccacgcccaccuaauuuuguguauuuuuaguagagacaggguuucaccguguuggccacgauggucucgaucuccugaccucaugaucugcccaccucggccucccaaagugcuuggauuacaggcgugagccaccgcacccggcaaggcugagauuuuuaaugucuguuuuuucucuucagagucagaaauuugccuuccuugaagauaggugacccaucaaauucuuuuuuuuuuuucuuuuuugagauggagucucgcucugucacccaggcuggagugcaguggcacuaucucagcucacugcaaccuccgccucccggguucaagguucaagagauucuccugucucagccucucaaguagcugggauuacaggcacccaccaacaugccugguuaauuuuuguauuuuuaguagagaccggguucaccacguuggccaagcuggucuugaacuucugaccucaggugaucugccugccucggccucuuaaagugcugggauuauaggcgugagccagagcgacgacccaucaaauucuucuacauaaaaauauaguuaggagcugggcgcaguggcacaugccuauaaucccagcacuuugggaggcugaggugggcugaucaccagaguucaggaguucaagaccagccugggcaacauggcaaaaccccaucucuacaaaaaauacaaaaauuagcugggugugguggugugcgccuguaguuccagcuacugggaaggcugagauuggaggaucacuugagcccuggagguugaggcugcagugaacugagaucaugccagaauaagaccuugucuaaaaaaauaauaauaggccgggcacaguggcucacgccuauaaucccagcacuuugggaggccgacacggguggaucauuugaggucaggaguucgaaaccagccuagccaacaugguaaaaccccaucuuuacugaaaauacaaaaauuagccaggcgugguggcgcaugccuguaauccagguacuuaggaggcugaagcaggagaaucgcuugagccugggaggugggagguugcagugagccgagacacaccacugcacuccaaucugggcgacagagugaaacccugucucaaauaauaauaauaauaaauaccuauaucuaucuagauagauagauagauaaauagauaaauugauagauauaguuagggaguuuuugguauccuacaaauacuccuuacaaguuaagcuuaucuccuuuuaucugagaaaauacagaaucauaacuucagacacuuaauuauaauuaaucacuauuaauuaaccuuucuccuaggcagcuaaaugacugagaacaugaguuagaaugcaguugcuuugaguuauacaccauaguauuuugaacacauauuaacaaguuuuacaguaagccaguucuugcugagaauuauuuauucaaacauaaauucaggucaugccucuagggcauauacgaucuccaagauguaucucacuagaagaaaggcuguuggcucuaaauaugagauagcaugaaguagaaaagagacaugaaugagagagauuagaagggacagaaauaggccaggugcgguggcucaugcauguaaucccaacacuuugggaggccgaggcgggcagaucaugaggucaggagaucgagaccauccuggcuaacauggugaaacccugucucuacuaaaaauacacaaaauuagcugggcguguuggcauacaguuguaguuccagcuacucagcaggcugaggcaggagaauugcuugaauccggaggcggagguugcacugagccgagaucgugccacugcacuccagucugaacgacagagcgagacuccgucucaaaaaaaaaaagggacauaaaugaagucacagccaagcauggaguccuagcuacucuggaggcugaggcgggaggauugcuuaaggccaagaguucaaggcuauagugugcaguauugcuccugugaacagucacugcacuccagccugggcaauauagugagacccugucucuuuuuuaaaaaauaaaaaauuuuaaaaaggcugggcacaguagcucaugcccguaaucccagcuacucuggaggcugaggcaggagaauugcuugaaucugggagauggagguugcagugagccguaaucgccccacugcacucuagccugggccacagaacaagacucugucucaaaaaaaacccaauguucuaaggcauaacuccuuguugaccuugggaacucuuacaaggcucccuuuuuuuuaauagcugaagaaggggucuuuagugccuggcacccagcgggccuuagccuccuuaaagaugugauuaggguuagugcauugcccuagauuguuucauuguuuuuuguuugucuugagacagggucucacuuugucacccaggcuggaauguaguggcgugaucuuggcucacugcagccuugaccucccagguucaagcagcccuccugccucagccccccaaguagcugggacuacaggcaugcaccaccaugcccagcuaauuuuuguauuuuuuuguagagacgggguuucaccaugguacccaagcuggucucgaacuccugagcucaggcgaucugcccaccuuggccucccaaaguacuaggguuacaggcaugaaccaacccucccagaugauuguuucuuuuauacagcccaccuauaacaaguucucuaccugggcuauaccuuagaaucacugggaagcuuuuuaaaauuccauugccugggccaugcccuacaucgcuuaaaucagaauuucuggggauaagauggaggcuuuaugggauuccaguauacagccaaggcugcagaugacagcucuucuagaucaucuuuuaccuccccagcaggauuuucaugucuugcuuuguguguggcaguauuguucugugcuuuguuuuuuaacgggaaguguuuuuauagguaauacucagcuggccuuacagaucaucaaaaggaaucagcugcucccugcagugaaaacacacucugaagugagaaagaagccaguguuucagccuguccacccgauccagcccauccaaaugccggcuuucaccacugugcagagaaagugauacuucacuuuuggaaaacuguuaccugagacccaggggagaauuuacuggccauuuuaguuguaucacagcagaaugaauaaaagauggugaaggcuguuaauuuugagucaauucuaccccugacauuuggccaaaagcuuacuuaaaauuaaggauuuacuaagucaucaucagcuguuuuucuuaauuucagccagacuauuaauuuugagccauuauguaauauaugccauaggcaauuaaaacau

SEQ ID NO: 192106 - RNA, 321026 nt, Homo sapiens
cccugagcugugacuuugcuccgccggugauaauuuccagguuacuguguaggagcgucuggcgcagcaucgugugcggaagaccgagagagggagugugcgugugagccugucaggccgggcggguccauauccggguggaccggguggguggggcugccccucccuccaggucccgagguggauaagggguggggagugacgugcagagauucccuuucgccccuucggauccaagagaggguggcagaaggaaugcgugggugacuuggcguggauuuagggcgugcccacccugcagaucggccuccuagagugucccgagggccugagaggccgcagggacacgaaggaagagaaggaggaacccgaagagggcucgccuagccggccacccgcuccgaacuugcccgggaaacuagugcggagggaggggccgggcccuggccgcggcgggaggaggggcggccgcagcugcauccagccccguuggcuuccuucccagcucuccuucgccuccuccuccucuuccuccuguaugagucaggcauuucccggggauuuggagcaggcacgcgcggcccgggcguccggagcuguagcagcagcagcagccgccgugccggggccgccaccgcggcgggcacccgcgucccgggcgcccacggaccauggagagggcaguccagggcacagacggcggcggggguagcaacagcagcagccgcagcagcagccgugcuaccucggcgggcuccucgcccuccugcucucuggcgggccggggggucuccagccggucggcggcggccgggcucggcggcgggggaagccgcagcagcccgggcucuguggccgcuagcccguccgggggaggcggccgcaggagggagccggcgcucgagggcgugcucagcaaauacaccaaccuccuccagggcuggcagaacagguaacgcgccagccgcccgcgccaccgcgcgccgcugugugugugugugugugugugcgugcguguguguaugugugucuguguaugugugugcgcgcgcgauugugccuucagcgaacccagugaugccucccaacggugcccuuccugcgucccugcuccccuccaggugggguucucaggauggggcgcgccguggcuccaccccgggaccgcaccgcaguggcggggagggaggcgagagcccugguuuucuucuaugcuggcaccugcagagacuggagugguggcaggaggaucgugcugguccccgugcucugcuuguccgcgguuucccgcacgccugaagaaugacugggaaagggaggcagaaggggcgugcuuugugccggggugaaaaagcguuagcacguccgcuccgauuacaguaauucucuaaguaacaguucauuuuaaaguuugguguuucagaacaccaccaccaucaacaaaaaaccugccacuugucauccugggcgacugugcauacuccugccccaguuugugccuugcagccuccgauguuuguaauggaaguuuuguuuaaaaacagaaagaggccgggcgcgguggcucaccucuguaaucccaguacuuugggaggccgaggcgggcagaucacgaagucaggaguucgagaccagccucgccaacauggugaaaacccgucucuacuaaaaacaaaaaaaauuagccgggcguggcggcgcgccuguaauuccagcuacuccggaggcugaggcaggagaaucgcuugaaccccggaggcagagguugcagugagccgagaucgcgccauugcaaucuagccggggcgacagugcgagacuccgacucaaaaaaaauaaauaaauaaaauaaaauaaaauaaaauaauaaaaagaaagaaaaaauacccucccccuuuuaauauuaguagcaauuuacauuauuaucauuauuuccucuucaggucccauuugaaguuuccugcucacuucccccuugcaguugagaagccuaguuauggacacguggaaggauggggcugucgaggaaaggggcucaggaggcacuuggaauggugguagugugugugaucugccaucgugaggaagacaagaacagauguggcacuacuguuuacuuuuuguuuuuguuuuuuuuuucaauuuguuuuccaaaaacaagccagagggaaauacaagugucagugcgaggagaacaaugcuuuuuggagaggugguuggugggauauuuuguccugccuauuuaacagucuccagaucuuaauagacuuggggcucuuaaggauguuugugagauuugaauuauacccuggaaaguugcuuaucucugcugcauggacuauauuacuugguuaucucuuccuguagauuguuuggaaauguucagauuugcuuccaucugaaacauaucagccaguuaucugcacgaaacucaacuuggaggaagaggucuuuugaaguauggaaacugaguuguuucuauauugauauucuacauauaggacuuucugagucaccugggcuuccugggagauguguuacuauguuaguggaaguugcacuuaacuuuugaauccuuuuauuucucaaaauaguccuagugucugcuguugccucucccuuccccuuucaauucgugaaagcugaaaaagaauagguagaaugcguagguagagggagauaugagaugacuaaaucugauuucaguucuugguaauuaugucucguuaauggcaacucaaggugccuugucaguaacagcauuuuguugguguguugagcaaucacuuaaugcuuuuucuucaaguagauuaugaggccagcaaagcuuuuacccuggauuacaguuauuuuauuauuuacuugcuggggaacaauauuuuaccuugcagucuguauuaaaggauuuguuauuuggaguggauuuaggaggcauuggaguaacauucuuuugcauuauuuuaaacccauugugguguuuagauuggaggcaagguugagaagaagcacauuuaaugccaauaauaauaccuacgugauagcaggcuaccuaggugaaaugugguauuaaguacacuccugagcaugcuuaagugaugucucaucuuuauugaguuuguuuacugcaauuuauagcugucugccuauguuuguucuuaccacaguagacucaccguuuuccaagucuaccacugacuccauaagcaucgucuguaauuguuaacaucucagugucaggguuucuauuucccacauuuuguucuuugaacgauggcugaggguccauuagugguuuggagaagauuacgaugacucugugcuugcaaaauucucccuucucuaggggucuuaugaagggacagauggauuagugaaaaggaagagagaagaggauaaaaauagaaacuuugaaaauguauucauuuguucaauuaucuauucacagacuguuuuauugagcaccuacuauguggcaggaacuguucuaggagcuggagcuaccacccuucccugguccagggaaaugccuuaguacaaauaguuagccaacugauuccugcugccuuucuuucugggccucauagcaucuuccuuuggcaguucuuuucaaagugcccacaguuaaugacaaaucuauagcaaccaaguucuugguucauccucucaggcugcugugcaauuguagugcucuucaccagcucccaggacuuaauaccaaucacccacuaacaguuuguacccugguguccucuugcauguucucaaguugcuguaaaacuuauauuuuaacacuuggcaucauauucugccuuuauuuguagccucauccucaugcccuuaggaaggcaguuugggccagaacacaaaauaaacgacauaaagagaggucacagagaagaacacuguaugaugggaacgugcucaacucaggagaguaaguucaggacauuuggcucacacucacuggaugagaaugugaaauacuuagaguauggggaaaacaugcauuaagggcuuucugucauucauuauuauagauauuuaaagaaaauauuucaggcauaauaacauuguauagauuuacaggauggcacugaagaguaaauacauugauacaaaugaacaacaauaaaaaauccagaaaguggcaagugcuaugaagguuaaaaaaaggugaugagauaaagcaaguauuugcaggaauaauuuuaagugugagucuaguguuuuuacugcuauucacauugucacuuagaguacucucuuauuacccaucuuaucacucauacagagugaaccauggggagaguaaaccucgagaacuugaggaggcagaugaccuagcaccuaguuggccaggauuagaauuucagacuggguucugguggcccagaaggauuuuaggaagggaagugacacuuauuaggucacuuuggcugcuguguagagaugagauuuucaaggggccaaagcaugaagcagggagaccaguuaggagcccaucugagugguccaggaaagagaugcuggcggccugggcuggggguuggcagagaacuggagagaagggauagaucugguguggagaggauggaaaucgcugaugaauuugauguggaggugagagaggggcaagaauaacucuugauuugugggccugagaggcugggagguugagacguccuuuguggagaugaggaucacaggaggggaauguguuuguggggagggugaggcuuggccaagaguucuguuuggacuguguucaguuugaggugcuuaccccuaguaagaaacuggcuguaugaacuuucauuugcccuaagucaaacuuuacucucaaacuaaaauggagcuauuuuggaguugcucauaauaucaaguauuugaggaaauaauuucuaauuggaucuagaaauuguuauuuaaauaucuaaggguugccauugccauucacuuuuucuuauuuggagaaaagaagacacugcgaacguggaaccaaccuucaauucuuuuuuuggugauuggcaggguuguaagaacucaauaaaaugcugaaugacaacaaaucuugacuaggauuaaggaagacaaggcugggugcauuggcucacaucuguaaucccagcacuuugggaggccgaggugggaggauugcuugagcccaggaguuccagaccagcgugggaaccauggugaaacccugucuccacaaaauaaaaauauaaaaauuagccaguggugguggcuuaggccuguagucacugcugcucaggggucugaguugggaggauugcuugagcacaagaggucaaggcugcagugagcuaugaucacaccacuggacuccagccugagcaacagagcaagacucugucucuaaaguagacauuuauuuggggaggaagaguagugugaacuuuggauucaaaucuugacaccaacacuuagcacacaugugaccgugggcuagcucuuuaauugcacugggcuucuguuuuucucuucugcuaaaugugggaaaugauguuacucuuuucauuaguucaaugugaagauuaaaugagauuauugguguauaagggacugagaauaguacauagcaagauaccaagaagugguagcuauuauuagaucuucaauuugucuguuuuuaaguaggcacuuucugguccauaaaauucuugguuuuuauucugagugcugugguuacccugggaccacauuaacauaauuaucauagaguucuuuggggagaagaugauuacuucauuuugaagggauccuuuuaaaacuuggcaccaaacauuuacagcuccccuucccagccucuaaauccuaucuuccuuuccuauuuuauuucucuccauauaccuugcuauuaucugacaugcuuuauauuuuacuuuuuuuggucucuccacacuagaguauaagcucccugaggacagauaauuuuguuugucuuuguugcugcuguuaucuccaguguugagaacagggucugguauacaguaaggguagaguaaguauugucaaauggauaaaaaaaugaauaaaugucagagagggaaaccagggcuuaguucuauuugagccaguguuagcuauuauuaguaucagaagucuugguucuguaccugcuuguaaccuuguccuuguguugcuguguuuaucaucuguccugcucucugcaaacagucuuugguucuggaucagggaguaugacucuuccugugacgugcccacccugauuuagggcccaccacaacucacccauugggggccauuagugaccaaauauccagggcuugcuuuugacucuaucuggauuaacaacauacguugaguguuuaguguuuagcccccagcauuuuggugccacuuaucccaaauuaaagcaucacugggguauauaugaauuuuuaaagccaccuugaaggaaaauaaguguuuuuuugaguaucccaauaauuuuagagggaauuggugauaccaggguugaaaaucacugcucuggguuuuguauucuuguccgcguguacauaggaaauaucugcauaucuuccuguguagucugccagaguguuuugaggccgugugcuaaaauccuuuagggacacuaacuaguuucauugaugguaauaauaaaagggaugguugccuagguuacaaaacacuguauaauauuguuuauucacuuaugguucaaaauacguauugagcaccugcuucguauuaacuacucccugcagaaucugcccucccccuccuuugaaaguguguguauauuugaggagauucacaccaaaaugguuuucuuugguuggugggauuaugggugauuuccauuaucuucucuugucuguuuucccaaggugaaugugugucuguuuugcaguuugaaaaaguuguugaggcaaagaaaagcugcucaugccuuuucacgucaucugucuaacugaguuuugcgaguaaauuucaagucuaaucuacauucagaaaaguacacaaaucauauacauacacaguucaaugaauuuucuuaaauggaacacacccagauuaagaaacagcugccaaaacauucccugucccccacagccccuuuccucauaguaucuccccgcauacgguaacugcuauucugaccucaacaccacugaguuguuuggucuccuuuugaacuguguauuguguaauaugugaucugugugucuggcuucuuucucuuaacguuauguuugggaggcuuacgcauguuucuguguauaguuguggucuguuuauuuucauugcuauuugguauuccgugguaugaauauacugaacacauuugucuauuguagguugguauuugaguucuuuucaguuuuugacccuauucauagggucacaaugcugugaacauucuaguaccuguguuuggagaacauagguaugcauuucuguggauauacaccuaggaguguuugcucauguccagcuuauuagauacuagcagagaguuuuccacagugguuguaugcauuaauacuuccaccaaaaguguguagagagaguucuguguguaccacauucucauccacacuugauauugucucuuguuuucaugucauccaauuuuaauuugccuuucccugaugacuacugaggcugaacauguuuucacguauuaaucggccauugggaugucauguuuugcaagcugcucuuuaaguccucugcccauuuaucuguugggugucugccuuuuucuucuugacuuuuacgagauguuuauauauucuggguaugcgcccuuugcuggaugccuguauacaggugccugggcacugcauauauagagacacgguguauuaugcaggcauuauguccuguggauauaccacaguuuguuuauccauuaccuguaggacaacauuugggcuguuuccaguuuuugacuauuacagauaaagcugcuauuuguguguaagucuuuguguggucacaugcuuuuauuucuuuuggguaaauaccuagcauuagaauugcucguguauccauccuauguagaaagugcuaaccuguuuuccaaaguggcugaaccauuucacacugccaccagcagugcauaagugaauagauggcuccccauccuggccaucuucauguugcuaccuggagagcuuuuggaaaacaggacugccacuuccucaugugcauggcauugcuucugagaggggcagucuagggagaagcuguguaguccuucuuaccuuuccagcuuugucuccuuuuggccaaaugaccuugggcaaguuauuuaacucuuugggccuuggucucuccaucuguaaaaugauaugaaccucgcaguguugugaggccaccacaggcaccaguccugugcuuggugcacaguagguccucagcagaaguuugugagugagagucuuguauuuuagauagacuagugacuagcuuucuggaaccuagggguugcauugguggucacuuaagccccagccuuggcaaaucugcaggugucuuagcccugccucucauuacaugaggacccaguugacuuaagccauuugauuugcccaguggcugucugcguuuggugugcuuccucagaggcugcuuguggacaguugucugaggacucugggaagaaagaagccacauggaugggccuuuguguccugaaagaaggguugaaaugauugugccggaaacgugggaggcuuuuugcaguucugccuggcucccacugaugcgauuuggggccaggccaagacagaauuaaaaagaaaaccauccagaauuugaauuuugauaaccuagacuggacugaauauggucacagcccagaaaaugcuuuauuugugccucaugcaaugauaucaauaauaaugauaaaauuaggaaacauuauauauggucuuuuguugcaagucuguuccuugaaggucagagaaggcauuugcaccaugaauaaucuuuucuuuuuguguuguaguuuuuaggggacuauuuauguuuuugugugguuuagucccuuucuauaaauauauugaugaaaauacaaagaguugaaaggcaaccaauaucaguuuuuagucacucuuuuccaggauguuuuaaguauuuaucugcacggccagccuuguggccugugcaggcugccaugagugguugggugggauuggacguuuuuuggaaaguggugggguucagguucuccuuauguguggguagaacugggggcucuguucuggccuuguguucagggcaaucgaguagauuaggugacugaugcaaaugauccucacucagccgucucugcagugcucacuccgucagagcugugugggcugcuaacaaugcaaugaaaaccaccgcugcagcugaucugggcuuuuugguuguuaaguagagucugggcagagucgggaaacuuucuuuuuucuuuuugagacagagucucgcugugucacccaggcuggagugcaguggcgugaucuccacucacugcaacuuccaccuccuggguucaagcgauucuucugccacagcuuccugaguagcuggaauuacaggcguccgccaccacacccagcuaauuuuuguauuuuuaguagagacgggguuucaucauguuggccaggcuggucuugaucuccugaccucaggugauccgcccgccuuggccucccgaagugcugggauuacaggcgugagccacugugcccggcccagaguugggaaacuuucuaagcccugagugagguggcagcaccaucccccaaacauacuccucuuugcuugaaauuaugccugguggaauuuuuauaccccaaauauuuuugagcgcuuuuuauguauaugucaaaugccaugugagaagcaggagacaggaggaagaagcacaggcccuaccuuaaggagcugacaguccauaacagaggggagcagacuuuucuguaaagggccagauaguaaguagguuagacuuugugggcuauacagucuucauggcaacuaccgagugcuccuuuguaaauaaguggauguaucuguguucuauaaaacuuuauuuauaaaagcuggcggugggcugauauagccugugagauguaguuugaucauccuuucccuauaauuacacuuagauuucuuaugcaaguaguugaggcagcccaguguuggggcuaagaguguaguuucugagguccaguagccuguuuuuaaaucccagcucuacucuuugccuuggacaagcuauuugaccuuuaugucgcaguuucuuuaucuguaaaauggggauaauauggugucugugucauagaguuuuggggaucaacugagaagcuguguauaaaggguuuaggacaauggguggcacauagaaagcacucauuagggccaggugcaguggcucaugccuguaaucccagcacacugggaggccgagguggguggaucaccugaggucaggaguucgagaccagccuggccaacauggcgaaacccugucucuacuaaaaaugcaacaauuagcgggcaugguggcaugcgcccguaaucccagcuacuugggaggcugagacaggagaaucgcuugaacccagaaggcagagguugcagugagccaagauugugccacugcacuccagccugggcgacagagcaagacuccagcucaaaaaaaaaaaaaaaaaaagaaaaaagaaaaaaaaacagaaaaaaaaaaccaacucauuagaugcagcaguacagguggugagugcuacugcagaggaagcaccugggagugggagcagcugcuccacuugggaauaaagggcagaagucgcagguggaggaagaccuucuagaauguugaagagaagaguucaucaugcagacaaaggcuucagcagggcgucccugguagaaggcucugugaguacaaauguuuggaggcaugaaaggagauagguuuaguauggcuggaaugcagguuguauguggaguguggccagagaugagacuguaaaagacagacuaggcuaaaaaaaggcuacuuucugaagaagcucuuaagccgcugagaccacagaucacaaaaugucuguguuaccacaaggggaacgcuggcccuguguauuuguggguccacgaagcaucagacacuuuacguauauuauccaauuuaaucuuuaaaaugagauggagguggguguugcaaagcuauccauucuccccuuuuccuguagcuauagaccccaguuuuuagcuggaugcauggcugucaaaaauaaaacuguauuuucaucccucccccuccuugcaacuaggauggugaugagauuauaaucuggauguaagcgcagaguugucacauaguaauuuccuggaaccuucuuuguacucuucuuaccuuuuccuuuccuguuggaauauagacaugcuggccaaaacuagaauauggaaaugauggcuggaauuucagcagccgucuugaaccucgaggugacugggaugaaggccauggagacagaagaaaucuggccucagaggacuuuguggaucaaagccaccucauaaauccuagcugcaaccucuggaauuuuccuuguggggagggggaggaauaugcuucuuuugcaagccccgagucucagucagaucuaacccuaauugaugcagguagaaucgcaguuuuacaggugaagauguugaggccuagagugacauagacugcacaguuaauaaauuguggagcacggaauuuucggacuucaaaguguguuuucuuuuucucuggaaagaacuuggucuccuaccccuucauuuuauagaugagauuacugagggcuuuggcuuaggguaaacuaggaccagcuaauuccacugcaagauaaucauuuccugccccgcgccccccacccccgcauacucuuucucuccauggccuuuccaaagaagaggccucguguuuuuuuuuuuucuuuuuuuguuuuuuugagacggagucucgcuuugucgcccaggcuggagugcaguggugcgaucucggcucaaugcaaccuccgccucccagguucaagcuauucuccugccuuagccuccggaguagcugggauuacaggugccugccaccaugccugacuaauuuuuuguauuuuuaguagagacgagguuuccaccauguuggccagguugaccuggccucaaguaaucaaguaaucuggccucaaguaauccgaccucauuacgugaacaccugaccucaacuaauccacccaccucagccucccaaaguagugcuaggauuacaggcgugagccaccgugcccagcgaagccccguguuuuaacgagugauguuguagcccuccuuugggcagaauaucuuucugugcauggguuguguucggugguuuuuccucuuccaaaacccuaacuguuccagagcuguaaguguagagcuuucucuuuagacaaccuugccaacucuugccaccucugggcugguccuuaggaaugacuuuccuugccuggccuguccuuucucugccugaguguuuaggggauggaugagggguuccuuggcccugugauuauuuguaagugcugacagaugucuugauuuaugcagaggccucccaauucauuaaccucagaguguggacuuuggcugaaauaggaucaugcguuugcggaauguacuuugcuuuugggauucuugugugucugaguuccacccuauuacuaauaccuuaacaaugggcuucuugauccccuuggcuaaccacacagcacagaacuuuuuuguguguguacugcagcagacucauuuaguggccucgucucuaaaaaguuuaacagaacaaaaacccauuugugcuaguacgugccguugagagagcauuugucguacauucauuauauagcauuucauauugauuccucucuuugcuccagcaaauuucuuugugguaauuuuuauuagcuuggcuaaugagugccuuuuucuuuuuaugagaagucugcagcugauaccuuggcccaaaguacaucauaacacuauuauaguuguuuaguuaauuuggaauuuccuguaacuggaauuuuuaugucaaagaucaguuuacaugauugcuucgaagucagcuaaaauucaggaagauggucuuaaaagccagaauggcauguuuucuuucucauguugauuaauaggauaggccauuuuuauggguugaacguaaagguaugcuucagaaaaucuuuguaucaaagaaaguagaccaaacuuguaucugggaaaucaaguuuaagucuggguaaaguguuuuuuuuuuuuuuuuccccuucaaaauagaagcaaagcaugaccuaacuuggaugaaacuaaauugcagugauucaugucauggaauggucugaauuucuguuuaucugaaggcuugcuuccuuuuccuuuccagcauuguaguguuauugguauuuuugauauuuuuguuuuguuuccuuuuuuguuuuugcuuccuuucuuaguuuaagacuuugaauucuuuuguguaacaacugcauguaacuugugauccgauuuuuuuuucuauaaaugacaugauugacaacauuuguauaaagucuacagauuugauaauaguacuguauccaugucaaguauuuauuuuaacauuuacgcacugaaguauuuaaggguaaaggggcauuauguuggcuauuuacagaaagaaauacacacagaaagaaaaaauaauaaagcaacugugguaaaauguuaauaguucuuuaauaguaaauacuuauuuguauuauuuguguaacuucucuguaaauuugaaauuauauugaaagauuaacaaaaauucacuugaccuauucaaaacaaaaaccuuggggugugcacuauauacuuaaucaccgaauagagcauauaucuaauaaacauuauccaauuugccuuaauucuagucuucuaauguggccacugaagcauccauucuugaagcuucauccagacugguuuagaagaugcccaggugugauaaaaaugauuguuaggcaauuccagagauuaacuacaaugaaauugccugagugugugagugccugugagcaaauagguaaagccagcauauuugcagcuuaugaaaggaccauuaaaccaaagguuugggagauuuguuuuuauccuuucacuguuuuuauccuuucccuauuaaguuguuucaucguaauauaaaugucaacugucucuuucauuuauaaaugagaugaagugggaaacauugcuuguuuccucauuacuccaacauaggaaaauuauaaugaauuaccauuuauaagcaacuuuuuuuuuucauuuuuuugagacaggguguugcucuguuguccacgcuggagugcaguggugcaaucacagcucauuguagccucaaccuccuggguucaagcgauccuccugccucagccucccaaguggcuggggcuacuacaggccagggcaggaggaucgcuugaggccaagaguuugagaccagcccuggcaauggcaagcucccugcaacggugagacucuacaaaaaauuacaaacagaaaacaaucaaacaaaaaaccuggaguggcaugagcucucugcauuccuguccagagcuggaaagaugucucagugagggaaugggauuuuuuuuuuccugaccuugguuuugaugugcaagauugauuugguuugucuugcauuaucucauggaacauguuauuuaugcucagaaguaacagcuuaaaucuuuguuauuuguguaguaaaauguguuuuaaccauuuauuaaaaaaaaaaaauccccucagagauuguccaugaacuugcucauacucacaugaaaguuccaguuccacauccuugucagcgcuugguauuaugauauuuuuaauuuuaggcauuuuaguaaaugugugucaugguuuucauuuguaauuggcugauagcuaaugacacugaacagcuuuucaugugcuuauuucccauccagauaucguguuuaguaagguuagcuuuagcuaagucuuuugcccauuuuuaaauuggauuucaaucagguuguuuguuuucuuaugguugugagaguuuucuucugagagugguucaugcuuuuuaaagaagugauccauuuuuuauaaguuguugaauuuagguauguagaguugcuucuaguauucccuuauuaucuuuuuaauguucaugaggccccuuuuucuucucccugauauugguaacuuguucguguuucuuuuuguuuuuaucaguuuugcuagaggucagucaauuuauugaucuuuucuaagaaucaacuuuuuguuucauuuaugaucuuuauucuuucucuguuuucaauuuaauugauuucuauucuaauauuuuuuauuuuuucacuuuauauauaguuuuuuaguuuccuaaggcagaugcuuaaauuauuaaauuaucauuucuuuucuaauguaaacauuuagugcuauaaauuucccucuaaccauugcuuuaguugcacucacacauuuugauauguuguauuucuauuuuaguucagcuuaaccauuuuguaauuuaucuugagacuuuauuuucgucccaugaauuauuuagaagugugaauacacacacacacacacacacacacacacacacacacacacauaauuuuguuguuguuguuguaguagagauggggucuugcuauguuguucaggcuggucucaaacuccugaccucaagcaauccucccaccuuggccucccaaagugcugggauuacaggcaugagcgacugagccuggccuauauauauauauauuauauuuuauauaauauauauuaucuauuuuauauaauauauaauauauauuaucuauuuuauauaauauauauuauauauuaucuauuuuauauaauauauaauauauguuaucuauuuuauauaauauguauuauauauuaucuuuuuauauaauauauauuauauauuuauauaauauauauuauauaaauagauaauauaucuuaucuauuuauauaauauauauuaucuuuuaauauaauauauauuauauaaauagauaauauauauuauauuauauauuuuauauaauauauuauauauuuuauauaauauauauuauauaaaauauauaauauauaauauauaauuuauauaauauauuauauaauauauaauuuauauaauauauuauauaauauauaauuuauauaauauauuauauaauauauaauuuauauaauauauaauauauaauuuauauaauauaauaguuuauauauuaucuauuuuauauauuauauaaaauagauaauauauaauauauauuauauaaauuauauauuauauaauauauauuauauauuaucuauuauauauaauauauauuuuauauuauauauuauacauaauauauauauuuuuugagauggagucuugcucugucacccaggcuggagugcaguagugcgaucucagcucccugcaagcucugccuccuggguucacgccauucuccugccuuagcuucccgaguagcugggacuacaggugcccaccaccacgcccggcuaauuuuuuuguauuuuuaguagagacgggauuucaccauguuagccaggauggucacaaucuccugaccucgugauccgcccaccuuggccucccaaagugcgccccggccgccuggccuacauuuuuuaaggguuguuuuaugacauugaauauguucuaucuugaugauuguuccauguauacuugaaagaauauguauuugguugucauuggaugaauugugcuauaaaugucaguuugauucaguugauaauguucaguucuauaucaugacugacuuuaaaaauuuuuauuugauaauuuuggagcuguggucuggaaagaaaguacacccucugcucauaagccauucauauucagauuuuccccugaauuuguguguucuuuuacagacuaacuuacuuuuacauuuaauuuuccugaguauugcuacaugaagucaguuaaaugaugagccaugagaacuugauguuuguucauuguuugaaagcacacaaguauuucaggccaggguguuguuuauuucauuuuaugaggcacaccuaucauuauuuuagguaaauaccuaaaaaucagcuucaggacuacuuggagaugcuuuuucagacaauuuaauugacuccaacucagacuuaauguaaagauguuauuuaccucgucaagugaagauugaucuaaggaaauacauauugguucuaaugaguggauggaugcugaugaaagagguucugagaccacugcuuacccauuaagagugcuggguagggcaggugccauggcugacgccuguaaucccaucacuaugggaggccgaggcgggcagaucacuugaggccaggaguuugagacuaaucugggcaaccuggcuaaacccugucuguaccauaaguacaaaaauuagccaggugugguggugcacaccuguagucccaguuagucgggagccugaggcaggagaauugcuugaacuugggaggcagagguugcagugagucuagauuaaggcacuguacuccagccuaggugacagugugagacccuguaucaaacaaugaacaacaaaaaaagagugcuggguagauggaaucauuggagaaacaucugacagcuauauugaaggaaucauuagacaacccagguucauccaccuccaucucaauagggagauuuaccugugucucccaagacauucccucuugguuuggaugugcuuuggaaauauugcuuugaauggaagaugcugagcaggagggcuacugagauuagaacaauuucuaauuggggccagguguggucaugcaugucauuagucccagcuacucgggaggcugaggugggaggauggcuugagcccaggaccuugagauuaaaaaaaaaaaaucuaauugggaggguguggaaggugaugcugcugaauuuuguuacaagaaagcauuuuuauccagagauuucaugacuauggaacaaaauuagauaggacuaagucauaucuuggagaaaucagguuaaaugugauuuguuccaguuagggagcuucauuaaguaauaagggaaggaauuuuaaugagaauuuucuucugccuggaguccucuacgaaauguccuauggauagcaagggagcaagccaggcgccucuuugggugggugugucucuacagguugucucuuuaguccauuugguguuugaagagugagccuucaaaucauuguuuuagaaucugugcaucacuccugcugucaucauuugaagaacuggcagcauuuaaguauuaaguaauaguauuuaaucaguguuaaacugugagaacuugaucaucauaugguucuauaagaaaauguccuuguucuuggaaaauacauaaauacauaaauaugaaauauuuaagaauaaagggagaugucuacaacucauucucagaugguugaggaaacacuuuauauaaggagaaggggaugggaaagggagggagauggauggauguggguggaggggaggaaaggaaggaaggacggggaagggagagaagggaggggagagauggcuagagagcaugauaaagcagauguacgcaaacaucaauaauuuuugaaucugugugaagggagauagaggaguucuuugucauauucuugcaacucuuugguaaguuugagucauuucaaaguacacauuuaaaaaaacagaaaacaaggaaacacauggcuccuuugagaaacaggagucacaccacuuccuguaauauuauuugaaauugccacaaaagugaagucuuuugauugaaagcaagucauuguauugcaagauccaggagaucaggcauuagaccuaaguucuggcacagugccuggcgcauaguagguacucaauauuuguuuagugaaugcuaucaaagcagcagugauuuuggcauuggcuuuucccauuugugcauuuaccuugcacccaagugauuuggauuugcuccccuagacaagacuuuaugugcuccuguggucuuugugaaaacagccaaauggaaaaguuuugucucagggagcuugcguuacaacuuaguguaaugggagcgauugaaacccuaacuguacauuucuugcggguaaaagcccccuggaaucaggcagaguauuuauggcacuucuccugugcugguucccauuuaaagauggugaaaucucaaaaaaaaaaauaguguuucauuacuuuuauaauauguagaacauauaguuuaccauuuuaaccauuuguaaguguacaguuugguggcauaaguauauucauacuguugugaaaccaauaccacuuuucauguccgguacuuuuuuaucaucccaaauugaaacuauacccaugaaauaacuuuauuguuguuauuugcuuagaaaaucauuuauucaacagaauuauaguuguuaucuguguuaauaguaggcuacaggaccucgaauccaaaauuggugaugccggccaggcgcgguggcucccaccuguaaucccagcauuuugggaggccaaggugggcagaucaccugaggucaggaguucaagaccagccuggccaacgugaugaaaccccaucucuacuaaaaauacaaaaaaauuagcugggcgugguggugggcaucuguaaucccagcuacccaggaggcugaggcaggugaauugcuugagccuaggaggcagagguugcagugagcugagaucacaccacugcacuccagccugggcgacagagcgagacuccgucucaaaaaauaaaaauaaaaaaaagcaacccuccccucugccaaaaaaaacucuuaaaaaaaaaaaaaccaaaacaaaacuggugaugccaaaauuagagaacuuauuuaaauguaauuaauagcaauuaucuugaaagggaaccuuuagaaauauaacaggaacaucugcugguguacauuaauuaauuucuguaaagauuauaauuauacacuagaauauaugccauuuaaaaugaaauuuaauacucaggaggcugagaugggaggauggcuugagcccaggaguucaaggcugcagugagcuaugauugcaccacugcacuccagccuaggaaauagagugagacccugucucuaaaaaauaaauaaauaaaauacaaaugucaaaagacaccaauaauuagcccagcccccucccagcauuauuagcauuauuaacauuauuaacacacacacucucuaaauagagcaguuuuaggcucccagcaaaauuggaaauauagaguucccaugucuccccuacuccaacacaugcacagccuuuuuaaugauacuuuacauuuuaaaaauaguaucugucuacuaaaauaaaaucagagacgcuagcuuuccgagcccugggagcucacuuuucuccugaagccuucccuggcuuccugggcacugcagaucccucaaauuuagguucuaccaccacauucuuguuuggugacucgugaucuagccucacccacaaggacaguacagggcucguguuugcuuagguggugcuccauauuugauuguugagccaaagaguggguuuggagagcuucagaacuugauuuguuauagaauagcuucauucuuuauggaguggguugcacaugaagaauauuugauguagaauggcucuggcaaguuaaaaaaaaaaaaaaaaaaaaaaaggcuguagcuucuugguuaaacauugacagaaggaggucccuuggggaauuugugagcugcuaggugguuuacaccauuuuuugggcagcuuugagguucaagcaguuugguuuuaacccuuuguaggucagguuuuuagaccuuguaaucuauuuucccuuuuaaaggaggaauaaggauuaaagaggauaaagaggaugguuuuucuguaagagagagugcugguaauucucuccugguggugagcauuuguagggugggguaggggcacagauggcacauggcugauggccuugagggagaaguggguugcacagucucuugcaacaguuuccagaguggggaagguucagagaugcucuucugguuucugagcuugugaagagagagacguagaggagaaaggguuaacuuccauuuuuacuuggaaauggauaguuuaagcuggggagggccuguguuauguaaacuagcuugcaaccuucugguguccauuuuagccuugcuuucucauuuaggucaauuggaucugaauaaggaauuuggccagacaacaaaauauuuaaacugguuccccuauugcaucucauuuccacagucuguuuauaauccuaauugaugcaaaugcccuuguuauugugaaugugaauacccugaaugcaggguucugguuuguuucauuucacauuguauuacugaacguggugagggaagcugagggucugagugacaagcggaguguggcuggauccagccuuauuuugaaggauuccuuuggcacccaggggcccagggaugaggugcuguuuugggaggcugguaaaaguucagaagcgaucucugagacucccuaucugccagauucccagacugugagcugcuucaagaucagggaaguuuuucgguacguaauuucuuaagcacucagcaaagugcuaagauagucuucccugccucagggaguuuggaaggacauuuuuccauggaguacaucagaccuaagagggagaguuuuguuuuucuucacugauaggcaacuuucauuuucugcauuugagagaaccugauuuuaaguagcacaguggccacgucacaauccaggaauaauuuuggcauuuuuccuguauccuuuuucugcaaguguuuuucacaauaaaccaaaauaaccuagucaaggggagagggaggcuaacauuuucuuucauggagcauuauucugaggcuugaaggugcucaggugaacuugcccaaguucuguuuuacaggugaggaaacugccucaaauagaugacauuuaauucaaaguuacacacggaguuugucgcugaguuagaacaagaaacagaauaugcuucucagucaguuuuggaaaaacuccagaaaggugaugcuaaaaauggucuuuuugccuuguguuuuguuauauagcaaagaauacccgcuggcuucucauuaucuagcugaugcccugagacucaucugauguucuggcuuauguauuagcugcuuugagugauggcgaaaacuucaaaaugugcagagagcucuuccuugaacccagugauccugggguauuaacagauuguguuugggauaucuuaucucugagucucaugcuaauuuccucugauauauagcaaaaagacuggguuuaacaguaguuuucaguagacaaaguugcuuuuauuuuauuuuccagguuaugaauacagaacuggccuuuaggacugcuucugaucuaucaguagauaguacacuguuuauagugcugcaaaaagagaagguggacuuguaaauucaggaagggaccuggcuaaauuugauuagacugcauuaaaaauuugagacuuuucucugugagccgauaucucguagcauuucuuuaggacagagcacucuuuaauugagaguuguucuugccuggaccuuggcuuguuggcaaaugcagcaugugugauuccauugcgugcgucuccacucuugaacugcuacuuuggaucacaauuacuggaagugucuucuagggcccugacccuuuagagaugacauuugaccuuugggagucucuuccauggugcauuaaugaguuucccaugugcuggagugcuuacucuuugguuuaguacagggguuagaaagguuuuuuuguaaagagucagauaguaaauaauucaacucugccauggcagcauaaaagcagcccuaggcaauauguaaacaaauagacauggcucuguuccaauaaaaccuuauuugcuaaaauaaguggugggcuggauuuggcucaaaggccuguucucuaguuuagaggcuuuuggaacacaaagccgaaacacccuuggcucuugugugagagagagaagaauccaguauucagaacauaaacaucucaguugaaauguagcauccauggugagaaagaugcuuuguguuauugaaaaguugacauaacaaauauaaagacuuuuuuugggaaaaaaaugggcccuuguccucccauccuaauacaacuguuacugauuuuugugcauuucuuuugagucuuguccuccugcauauguaccucugugaaguccugaugugcgcaauaccaguugauauuauuaaaaagcauaacacaccauauaucugacaguuguuacuacauuggaucuagugaggccuaaaacauacaaacuagauuugucagagaagauauuuuuaaggacuaauuugugagguguacugucauuuugugcauuuuuaacuuuuuucaauugcaagaguaauacuucacucauuauuuacuucagcccuaaauauuaguagaaaucaggccagagcuaaaguaaaucagguaauuggcuauucaggggcugaaagauguuuaguggcaaagucacgcuuuagcucuaaguuaacauuguggucacaaggguauucugguggcccgagaguuacugcaccccuccuugcaaauggcuacaaaggcuaagacauagcacacguuuaauuuuuuucuuccuucuuagcuggugcacacacaauaaaccaagaaacaaaugaccauacuucagugucacucuauacaaugugacuuuaaagaugcauuuuuaaaaacaggaaucuggccgggugcgguggcucacgccuguaauccuagcacuuugggaggcugaggugggcagaucacgaggucagggguuuaagaucagccuggccaacauggugaaacccccccucuacuaaaaauacaaaaauuagucaggcgugguggcaugugccuguaaucccagcuauuuaggaggcugaggcaggagaauugcuugaaccccggagacggagguugcagugagccgagauugcaccacugcacuccagccagggcgacagagcaagacuccucaaaaaacaaacaaaccaaaacaaacaaacaaaaacaaaccaauaacaacaaaaaaccccaggaaucuccaaguacauaucuccacgaauggcaagguucuuuuucacaacagugcugccauugcucaaaauauuucaaggcuccuuuucuggaauugccuucagaauaaguuauaagccacaguagaguagaggucugccugcuucauagucuuuucucauuuuugacuaaaaaugguguucgccagugcaguucccuugccucagcugccacuguggcucuggguugcuuucagcuguuuccagaucucauaacugugcucaggggagauggauuuaucguaacugagucaaagguuguggguaaugacaauaagucaggagucucugugguuauuucuuuggaaagaacaaaaauauuuaugugucaguugugauaguuaaaaaaacaaaaaguucugccuuuguacaucccuggaucaccaugccaacaugauuuuauuuauuuuuauuuauuuuuuauuuuuugagacagggccucacucugucgcccaggcuggagugcaguggcacagucuuggcccacugcacccucugccucccgggcucaggugauccucccacuucaguuuccugaauagcugggaccacagguguguaccaccacauccagauaacuuuuuuguauuuuuuauagagaugggguuucaccauguugcccaggcuggucuugaacuucuggacucaagcaaucugcccaccucaggcucccaaaguacugagauuacaggcuugagccaccacacccggcccaauguggcuuuugaaugagaucauuccuucaccaagcagcauccaagauugacaugcuguaucccaaauccuacucuagggagcaaggccaggguccaugaaaggcccccuuuuuuuuuuugagacggaguuucgcucuugucgcccagguuggagugcaauggcgcaaucucggcucagugcaaccuccaccucccagguucaggugauucuccugccucagucuccugaguggcugggaauacaggugcccgccaccaagcccagcuaauuuuuuuuuguuuuguauuuuuaguagagacaggguuucgccauguuggccaggcuggucuugaauuccugaccucaggugauccagcugccucggccucccaaaaugcugggauuacaggggugagccaccaugcccggccaaaaggccaucauuuuuaugugcucuguugucccucuuaccuggaacauuuggaaagcuuugcucaguuugcuuuucugggagacccugcacauacugauauuaauagaaccugauggacuguaggauguccccucaacucuccuuguccuccuuugcccucccucuaauguggaaagugggacucuccuguacuaaagaguuuuacucucuagcaggcauuuauauaggcucaaaaugugggaggcaggaucagagccauuuagaaggguugcuguuuaggauauuaguuacaaacaguagauuccuucuaagcagucuaaguagccagggauuuauuagaggguuuugcaguguuucugggagaaccaagaucaaugcuacauguuuaggaacaacacagccugucucuaaccaauucccaucuauagcauggauauaacccacuucugccuuagggcuggugacacuagaggccaaacuucauaacaucugcuauaacugcuccaaggaaucaaauacacuugucaccaucugaccagaaguucugaccuucugguuuguggcuacugccuccuguuguuccccucucacucucagaucuugcaugagugugucugcuuagaagaaucuagcugcaagggagucagugaaauguagcuuauaguuuucuagcuucuguagacuagaagcugggcuggaaagcugcuagauggcacugaaugagcugcuuugcauuauuuguuauuaagagcaugugcauggagaugauggcuaaaucccugguggguaaauucuccuuguggcaaaaagaaaagagggaagaggauugaguguaggagaccccacagggcuuuugggagaaugaagcgacagggagucagugcaagugccaaugcuguuaccaagaggguggcuuccuacugcaugauagguggcauugcuggguagcuguggcugcagugccaugccugagccuuuggcacaguccugaccuuugcaagagggaagcaguguugggcucauaugguucuuuuucuauugagguugguagagcugguuucaaauucuagccucggauaaguuccugcaccauucugaguuucaguuugcuuaucuauaaaaugaugauaugccuaccuugcagggaaguugugaugguaagaccagauggcauaugagugucuagcauauaccucugguguauaguagugguucaacaaauuauuacuguauuacuguuaucuucaauuuugucaucuuuccuuuuuucuuuugucugagcagcucacgcugcauuaaaccccaguggaugccuggaugccaguagcuucuaugauuuuuucuuagcaauuagcuuaccuuauccacccaucuaccuucuauguggcuaacugcccccucccucauuuuauuaugaaaaauuucaaauauacagaaauguugaaagaauuguacaguaaacacacaaguaucuaccaccuggauucuacaacugacauuuuauuauaccuaguuuuuuacaugucuguccaucugucucauccauagauccauuuuauuucuuuauacauuucagagcaaacugcugacauuaguauagucauaaauauuuuagcaugcaugucauuaacacauaucauuaacaauauuuguuuucaauuauuucucuugauguaaaauuucacaaugaaaugcacaaauccuaaguguacauugcuaaguuuugacaacugcaugcauuuuuacccaaccucugucaaggcauagaacauuaccaucuccccagaagcuucuguugugucucuugcuccuccccacuccaggcaaccaccauccuucccccugcccccaauauagauugguuuuugccuacucuagcauuucauauaaauggaaucacacaauauauacuuacugugucuggcuuccucuagucagcauaacauuuugggauucauuuaugucguugugucuuaucagucguggauuccuuuuuauugcugagacggcuagcuuuaaaauuaugccugauugcugcaaguagaaagaaccagaagcccuccucauggaacuugggauuguugcuucuuuuuccuuuccagccuaguguuagcaaugcacaaaggcucuuuguagaggauuagaguugaggggcuuagaggccauuuaauucaguaccuccuccaggccuguggcaucuuggccaggcagccaucuuucugaccccuuuuucuucccucuugggacugguguuaaugggaauucaugugcagaaggagcaaaugggccaaugcacgggcaccucacacauuuaauuguucuaggguuaaaggaugaacccagacuucucuuaaugauuuuuguuguugaggauuuugacaugcuuugugcaugcuagaaauuauaggaccagucagcugcaacaacuggagcuggaaacaaguuccuauuuagcuuugauguuaaggaaucaaccacagcacugaagcugcugaacucucugauggaaaaaggcgucauucuguugccucuugccccaguuccuucucuccuccucuuucauuucucugucucugucucucugucacacacacuccucacauacacauagagcuuuugaacaucuucacguauggugacuugucugaaaguuuagcugucucuuuuuugaagaaaauugacaugauugagagggagaaggaaaaggguuaaugaagaauggccauuguggccaggugugguggcucacacuugucauuccagcacuuugggagacugaggcuggcagauugcuugagcccaggagcuugagaucagccugggaaacaugguaaaaccgucuuuacaaaaaauacaaaaauuagccaggugugguggcaugcaucuguagucccaguuacuuaggaggcugaggugggaggauugcuugagcccaggaggcugaggcugcagugagcugugaucaagccacugcacuccagucuagacccuguccucaacagcaacaacaacaacaacagaaucacuucugcuugguaagggggaagcagugcccacucuuuguguguguggggguauuaaauaauauaauguguggcaacugaguguuggacacagcaaggcucugcagauguuauuuccugccuugcuucugucccguggagagguucugaaaccuuucugcauauuaaaaguaucugaggaccgggcgcgcuggcucacgccuguaaucucagcacuuugggagguugagguggauggaucacgaggucaggaguucaagaccagccuggccaagauggugagacccccgucucuacuaaaaauacaaaaaaauuagccaggcaugguggugggcgccuguaaucccagcuacucaggaggcugaggcggagcauugcuugaacccuggaggcggagguugcagugagccgagauugcaccauugcacuccagccugggcuacagaaugagacuccgucucaaaaaaaaaaaaaaaaaaaaaguaggaagauuuuacaaaaauuucaucaccagaucccauccuggaccaguugaaccagaauauaggacccuuccccgacagccacaguuuaaagucacugauuaguaccugagagaaucaucuucacacauauuaucaccacuaauucuaauaaccacacaaggcgggcagguuuuaguaauauuuaauauuuaguaauaucagagccaacugauguuggggggacauucuaacacaggucagucugauuccaagugccacauccuuccuacuauucuguguucccucugauccuuucgugugaauggauuuuacauaguaguaugaucaucccuucauucaguuguugauuccuucucauugcuccccaugcugugccugaagguacaguggggacuauuguagauggguuccugccccaaguugcuggugggcuaggaagaagaugcacagcagugguugaacugcagcaugcaaagugcucucacggagcgugacgagggauacgccuggauguaggguggggaacucuuuuggaggaagugccaccugguuaagaucuagggugagagaggaaacaugacucuugaagggaagugaaagaagcucagaaggugaaaacaagaaaagaaccuggacaaacagaugaauuuaucacuugaauaguuuugccucacugaagaaaacauauuucuuaauccaccuaauguguacuaaggcauggcuuuccacuuugcaccaggauucuuuauuugcauuugcaaaauaaaacaaaaugcuuuaucguagguuuucuauaaauuccaaauuucauugaauuuaagagucuuuuguuuaauaugacuauauguuaacauguaaauaaguuugucuuuagagcuaacaaauccuaauaaacaauacucauuucccaccacucauggaaggcacagauuauaguaggaguucuguaagaguugcacacuaauggaguuuuaggcagggauucuugaaucuugugaauuauaucuaauuuuuuucuucgcugguggaaaucuuaagaguauagcacgguguuaaagcauggguuuuaaaguuaaugaaaagcuuaguuugucacuuucacuuaacuggauguguaaaguuauccuaccuuuuuaacucucaguuucuucaucaguaaaaugggaauaauaauaaauacuccauauaauuuaaauauauaauuauauaguuuaaauuaacauuuauauauuaguuucuauuuuuauaauuguauacaaucauagaauaaaugaucuaaauagcuuuuuucuaauauuugaaaaauauaauugauuuauauuaaagaauauaugcaaucauauauguaacagagcauaagaaaaugaacaggcaugagcucaccauucacucuaggaaggauaauauaaccacuaguagcucaucugcccaaguauucuucuucaacucaauccuuuccuccccucuuuuagguaaccacuaacucuugaguuucaaguucaucauuccuucaccuuuguauaauauaaaguauuuuuauaauagauauuuuacaaaaauaauguguguuaucucucuguauuauuuaguuuuguuucucaguuuuauauuuuuaaaaggauguuguauauaguuuucugcaagucuuuuuuuuuucccguuuuguuuccaaaauugauucccguuauugugucuaacuucagugcauuucuuuucaaugcuguauaacauucuuugugugacuaugucacaaauuuuuuauccuggugauggguauuuagguuguucaccauuucuuccucugugaacgguguuacugcuguguguaaguuaguauguaucucccaguacacacacgcaagaauuuccuugugauguugauguagaaguugaauuguugguguguuaguccguuuugcauugcuauaaaggaauaucugagacuggguaauuuauaaagaaaagagguuuauuuggcucaugguugugaagacuguacaggcauggcaccagcaucuuggcuucuggugaggcuucagggaacuuuuacucaagauggaaaguggagggagcaggcaugucacauggcgagagggagcaagagagagaggaggagaugcuaggcuccuuuaaacaaccagcucuaacagagcuaacugguaaacuaacagaacuaacagagugagaacucacuuauuaccauagggagggcaccaagccauuugugagggaucugcccccaugacccaagugccuccccuuaggcuccaccuccaacauuggggaucacauuucagccugagauuuggagaggucagauauccaaacuauauccacugggcuucaggguauuuggauguuccauuuuauaagaugauguuaaguuguuuucuaaaguggaugugccaguuuaaugccauccaguaggguauaagcauuugcauuguucugcaccuuuucuaguuuuugauauaguaagaauucuuaauuuugccaagccaguagguauacaugauaucucauugguaucuuaauuuguguaucucugauuaucagaaagacagcagcucuucaugugcuuaagggucauucuuucuuccucuuuuaugaaauuccagcuugggucuuuugcucaguuauuuauuagguugucuuuuuugcauugguuuguaggagugcuuuauauauucugcauacuuauccuuuguuggaucuauguugcaaauaucuccuuuuaguucauagcuuggcuuuuuacuuuauuugugaugcuuuugaaaaacaaguucuuacuucuuuuccauauucucuuaauuaugcugcccacugcucaguuuacuggcagaaacagucaucccuccugacaggcccuuuucggauacccuggaagcuaauacaagccuacauaaguaggauuuccaccgagaccuacuuuaaaaaauuuuugccaacucucagauugcuacuucaacccacugcauaacugacaacuaaaauuuuucauugagagcagcuucuagcucugauccaaaccaagucaguccauaggugggaccucaggucaggagguucuuaaugugguagaauaugaguauuuucuuuucuaguuaacuaaagagauauucucuuauauuuucugcugaaaguuucagaaguuaccucucucaauuaaggcuuuaaucugucuggacuugugucuguucugugagguaggaacccaguauccuuuuuuuuuuuuuuuuuuuuuuuuuuuuuuuuugagacagagucuugcucuguugcccaggcuggagugcagugaggugaucucagcucacugcaagcuccaccucccggguucacgugauucuccugccucagccucccaaguagcugggacuacaggugccugccaccaagcccagcuaauuuuuuguauuuuuaguagagaccgaguuucaccguguuagccaggauggucuugaucuccugaccucgugaucugcccgccucagccucccaaagugcugggauuacaggcgugagccaccgugcccagccggaacccaguauccuuuuauauuucuuguacugcacaauuguuccaugagaauggagaaggauguaugcauccaacuacuugcacaguuuuaggcacauggaagguacucugaaaagguuagcuguugcuauuuuaacuugucuccuguuuuuucaguugauugguucaauccuuccugaaauaauaugugugugcguuuuaggaaugacaauugaggcagauuugcauugggcuaagaaaccaaccuaaaacuccucuuuccccaacuuccccuuaguauuguuagaagcuugaucuguaaguuuaaucacagaguaaauaauaaauaaugaguuaauugauuugaccauuuauuuccuuuggacuuggcugguaauuaaggaauuucucuggcaccuuaccaaacaccugcucccuuuucucugaauaaucaaauagucuuuuauuacaaaguuaauuucgcuacucuggaauuuacuuauuuggcccugcauuaccauagagguacucucuaacuccaucauggauggugggggcuccagccaugauucugaaguucuccuuaagucaauuccuucuugaaugucuugguccagauuguacacacuguacagaaaacuugauuugggggccuuuuccaauuucuuagcuaugcuuuaguggaaaggaaaggcaaagaaauacuucuuggaaaauuaaaacugcuuagcaacacuccuggggugcauugaaugcacacgaugaaaucuggaaaguaaaacgugaaacuuuauaaagucagcauaaaaagcaccauaaaaauuggaggaaaguuguuaguuauaugacggaggaugacugcccguuuauugcucgaguguggucguggagauucacucugaggcuaaagugcucuuaggcagaagguagguggaacugcaggcugcugcuugcaauagggaacaauaaacccaguuacuugggagguaagccuucagucuggguuguaaaauuauacuccaugcucaaggcuuuucagaggugcucaaccaccuuguacagaugaguuuuuuaacuuccuggaugguuuccagagagauggaaagaugaaaagacucauaaugaugaauggcccuucccucuuucccugcauguauauuguucugcuggacuucuagaauggacucuguccauuguggauguugcuggugcccugcacagauccccuuuacugggucagggcacccagcccuugacuaauugagggaguuagcugcuaauacuucaugccuguaccuuucacuggaagauucugcccugcaggggaggaacccucuagccuggaggugacugggagguaaccugcauccuccacucuggugugaccuuguacccagugacugacaucacuuagugaagucaacgauugggaguaucaaacccaauccccugcuuccuggcagcacaaacuuuguacaguuuacuucagagcuuuuugugggaucagacggaggcugggcuuaucucaacuccuaugcaguuucccucaccuucuuccaguuucuccggauccugagagcacuuccucaagcacucauuugcauaggagucgccacaucaggcucugccuccagggaauaugaccuaacacagauucuuuaucuauuuuucuccuccagccugucauacugugcucagcguguggaguguuuccacaggagucuuccgugaucuguuagguucuuuugagggcuuguuucauguguuggucaucuuuagacuuccaccaaaccucccaaccccaugcccugccugaguaccuucucagugcugucgcaggaauuguggaguaggggaagguggcauaugcagaggccaagaggagcugguaggggacuucugauguugguguaagaucugccauugguaauuuggacacucgcuauaggcaggcagaggacaaagcaugcuuccgccuuugugaggaggauagcauuccaauuuuucagccuuagugaugcugugggaacugcuguucagcugaguuggguggaggaauuggcaccuccagcuuuggugaugugcugugugcuuagggacagccugggccgaggguugaccuuguucgugccuagauccagagcugcuacacuucugcagaugggauccuggucucuaugucuccccuacucacccuuaccuuccaguaacugcuccccauccuuuauuuuuuguguuggcccaguguuucugauguccacugaguugucagagccugaaauuuagugaaucauucugauuacugcugugucucguucucuaguaucuaaccagccacugaggcauagcugccuuucuggucugcucccuccugccuuugucucuucugauaacugcucgucucauuugucaguaucuaacagccacugagccguagcugccucucuggucugcuccuccugcccuugucuuuguuucgaugcuccuugcaucuggucuggacucccacgaucaucuucuuaaggccucccugagcccaagcuccucuucuucuaggcaccucaacaccaucuccaugguaacuuuucuaaagcaugcaacacuaaaaacucuugggugacuuccugugaccuccaaaggaagucucagcucugcuagaaugggaccaaagcccagcuccaccuugaacuugugucauagccuugcuucuuguucccucuccuuagccgggcagaugccuuguccuuugauaaaggcuuccugucaccuccugagggcucuugugcuuuucgcagguggaugccauuaccuuuaccgcugugccucccgcaauugcucuguucacacgcuguccgccaucugccugcaagggcccaggcagggucuuacucaucauuaugucauugcuucaauagaagccuaauauuuuguacauaguagucaggaaggaaacgacuuaaaaaauucuuaauuuuucuuaauacaaggguuuuuuuuuuuuuugauaaaaaacaacuuaauaaaauucuuaauuuuucuuaaauucuuaauugauuucuaauuuuuuuguuauuauugaaaaaguaaaaaacuugaguucccccuuuucauuaaaaaacuuaguaguggcugggugcaguggcucacgccuauaauuuuagcacuuggggaggcugagggggguggaucaccugagaucagggguucgagaccagcuggccaacguggugaaacccugucucuacuaaaaauacaaaaauuagccgggcaugguggcacgugccuguaaucccagcuacucaggaggcugaggcaggagaaucacuugaaccugggaggcggagguugcaguaagccgagaucaugccauugcacuccagccugggcaacaagagugaaacccaucucagaaaaaaaaaagcauaaaccaaaacuuaguagugucuguugauucaggcaaucccuaauggcaagagguucucugaauugaguaaugccuuaaguaguuuggauuuuuuuagucauaauaggaucugcagauguuuggccaguaacccuauuuguaugcaugauacguuauucguaccagaccaggggucacaggcucaaauauucuccaggucucaggcugugucacagaaacaagggugucagaaaagcaguauaaaccccucuggucaagggcugcugaccucugcuuuggcauccugagcgucuggagaaggugggagcauggagaccugagagugcaucacaucugacagggcagcugcuucucagcuauggccuaugguugccguguagugaauggaccccauguugagauccuuggauauugcaagagaaacuagagauguagauuugugugagaagcugucuuaauuuuuaaagauugucaacugauucaaaacaauuuuuaaagccaaaaauaaaaacaaugaacaaaccaaagccugauucuggucaaagcaagugggcuugagggcuggaucguaugucacugacugacuuuuguuuugaggcuuccgguccagauagugucccuagagcauauuuguggugacuuugggagccccaugucacugguguugacuuuggggacuguaacuuuggaccagaguccuaguggcaggaauuugacgccuuguuugcugaugagggagggaauuuuagguaauuuucuccucccaaaaugacccuggcaccccuuuuguuagcauggcuuguuccuuccuguuuuuuuuuuuuuuuuuuuuugagacggagucuugcucugucgccaggcucgaguguaguggugcaaucuugguucacugcaaccucugccucccagguucaagugauucuccugccguggccucccgaguagcugggacuacacaugugugccaccacgcccagcuaauuuuuguauuuuuaguagagacgggguuucacuauguuggccaggauggucucaaucucuugaccucaggaucugcccgccucagccucccaaaauguugggauuacaggcauaagccacugugccuggccuuuuuuuuuuuuuuuuuuuuuuuuuuuuuuuuuuuuuaaagagagggggucuugcucuguugcccaguuuggaauguaguggugcaaucauagcucacugcaaccuuaacuccuguacccacucuuuucaugugaagcaaccagauuggcugauggaugugcugggaagaaggugucuccaaggagaugagucagugccacagcacuguauuauaggcauuauguauuauaggcauuagaguuguccuuagucuauucaggcuuguauaaaaaggacaaagggaaaauuuagggauggggacagcuaucaggaagguggugguuuuacauaaaucuuucucuccacauguccauauguaaauauauccaugcuuuagcaggccuguuaguuuaaaauauggauugccauuugaaaacuugacauuuuccuagaugucuugaaccuuaguucaucuagccuggccacaucauuuaauagaaaagauaauugcuaacacaugguuuaccaguuuggaagcuguucuuuuauauuuuaugauuauauaauuaauuuauuuuuacauuuaaaaaagcugcuuauuuuugcugguagaaauauagauugguaugacuuuuauggaagacaaauagguaaucuuuaucaacagccuuagcaaugguuauauuguuugaugcagugauucuacuuguuguaagauaugcuaaaauaguaaucaaagaagugcagaagaaauaauucaugaaaauguucauugcuguguuauuuaugaccacagaaaauaugcaacagccuaaauuggggaauaguuaauaaaguuaugcuuuaucuaucugaugaaauauuauucauauauuaaguguuguuucuaaagaacuuuuuuuuuuuuuuuuuuuuuuuuuuuugagacggagucuuccucuguugcccaggauggagugcuguggugcagucucagcucacucgaaccuccgcuuccuggguucaagugauucugcugcuucagccuccugaguagcugggacuacaggugcgugccaccaugccuggcuaguuuuuuuguauuuuuaguagagacgggguuucacccuauuggccaggcuggucucgaacuccugaccucgugauccaccugucuuggccucccaaagugcugggauuacaggcaugagccacugugcccggccucugaagaacauuuaaugacaguggaguuaaugcucuugauacaaugauaaguggaaauaacccaguuuuaguuaaaauauccauguaugucugucucuguguauguguauaacuagacaguaagauuuuaagggaauauucugaaauauuaacagcgacuuucucugggugguguaauuauuuuccagauuuccuacaaugaacauguguugcuuuuuaaucaggaaaaaaguccaaguuuuuuuuaaaacuauugaauguacuugauuaaaaaaaauacuguguauuauaugaccuagcaauucuacuccuagguauauacccaaaauaauugaaagcagugacucaaauagauacuuguauggcaagguucauuguagcauuauucacaagauucaaaaauggaaacaacccaagugugcaucaguagaugaauggacaaacaaaaugugguuuauaugcacaauggaauauuauuuagucaugaaaaggaauguagcucugauacauguggcaacauggaggaaccuugaaaacauuaugcuaagaagucaaauaagccaguuacaaaaggacaaauauuguaugcuucccauuguaugaaauaucaauacuagccagauucauagaggaagaaaguagacuagaagauaccaagggcugaggaaagauuggaauggggaguuauugauugauaguuacagaauuucucucuggggugaugaaaaagguuuggaaauagauaguagugaugguugcauaacaauugugaauacaacuaaugucacugaauuguacaccuaaacaugacuaaauggcaaauuuuguuauguguauguuaugauuuaaaaaauuugacauaauuuuuuuugucaaaacuguguuagcuaauuguguguuugcuauuuuacauaugguguuuacuuucaaugacaguggcuaucacuuuuugguucauuuaucucaauuuuugcuuuucacuuuuaccccuacagacaugccugugcuuuaaauggguuuguuguuuugaagguuucagaugccaggcucagaugcugacaauggagccaggcagguaaugaggcaucugggaggauuuaaaaaaaauguauaagaggaaaugugucacuuuuuuuuuuuuuuuuuuuuugagauggagucucacccugucgcccaggcuggagugcaaugaugcgaucuuggcucacugcaacuuccaacuccuggguucaaaggauucuccucucucagccucuuguagcugggauuacaggugcccgccacccagcuaauuuuuguauuuuuaguagagacaggguuucaccauguugaccaggcuggucucaaacuccugauccgcccgccuuggccucccaaagugccgggauuacagacgugagccacugcgcucagcccgcuuuuuauauugagccauacauugcauucuuguggcgccaucucggcucacugcaagcuccgccucccagguucacgccauuguucuaccucagccucccgaguaguugggacuacaggugccugccgucacgcccagcuaauuuuuuuguauuuuuaguagagacgggguuucaccguguuagccaggauggucucaaucuccugaccucgugauccacccgccucggcuucccaaagugcugggauuacaggcgugagccaccgugcccugccauacauugcauucucgacugggagaagaaggaagaaagagaagcccugcugguaaccagcagccagccgauaauaguucuggaauggugaaaaguauucuggcaaaucagauagcacuugaagaaauacagcuagcacuuuuuugcuuugaagauugauuuggcagcuagaagugcuagaggaagaucuuuacuuauauucucugcuuccugauauuuaaggaauuuauuucacuugcaauuuaacacuaguccauuuucuuucccuuucaaaggaaagaugggccccucugagaugugaaagauggcagguggcugaggcugcuucucuuaaagcuaccucuuagcaauccaucuaaaaaugauuauggaauacaagaaauuggggucagcagggaucuuggcaguaggcaggcagccagaucccucucaggggaguuugaggugucuagacuugaugcuuuugagcucuugguacguuuccaaaucauuguuuggcuccuagcugcuucuguuggaauuuacacagcucagagagauuuguugggcuaacucuugccucugcuuaaaucaacugaaaaagugaccacuuucguauccaucaaagagucuucccuuugcucaggaugcccucccugagauucauuuauuuacccaauaagacuuucauuuuccuuuuaucuuggcuuuuagaguaagaguuagcagagucuguuugucuugcuuuucuuuuuuguuugcaccggaucuugauauaauacagucuccuguguauauaugguuacugaaguauuaaauauaaaauacugaccuuuuauucuuucaaaguuauuuccuuaaauauugauauugcaacuguucauccuucuguguuuagcuugaggagaaagcaauuuuugaauguuucauucaccugucggacaaacguugaguacauuuaccauucucaacaccuggcacacccucagcaaauaacuuggagacccugugcucagggaauucacauucuggggagggaaaugguuaagcacaagccuuuuuuaagaugagagaguuggccaggugugguggcucaugccuguaaucccagcacuuugggaagccaagguggguggaucacgaggucaggaguuugagaccaaccuggccaauauggugaaaccccgucucuacuaaaaauacaaaucuaguuuggggauugggaagacuuccuggcaguaguaacaucuacgcugagucucaaaagacaguaggagguggccaugccaaagcugugggguuguucaagcagagaggccaggggugaaggagaacaucaucuauuugggaaaagauaagaacuucaguaugagagcaggguagccugugaaggaaggugacgaagaaggaguacagagaaucauacagguaugaaaucccaaaggccuuugccaugagauuguggcacucucagaaaauacuuaaaaaagggaaaugagguggcaauuuuauacauucauauuaucaacacaucaaaccagauauaggacaucuccaccagcccagaaaauuccccagugcccauuuccagucagucacccaccccaccucucuacagcugcuuucugacuuuuaucaccaguuaugucuuucucagauuucaugaaaaugauguuacguaguagguguucugccaugucuggcucucuuaagucaacauaauacuuuggagcucagccacauuguugagugcaucagucguagcuccuuuucauugcugaguaguguuccauuguauggguucacccaguuugcuuauacauucuguugauggacauuuggguuguuucuaguuuuuggcuuugaugaauaaaguuguugugaacauuucuuguguaagucuuuuuuguggacauauauuucuauuucucuugguuaaauacuuaaucaugggauugcuaggucuggcugucuauuaaagaauauauggagugggcuggguauaguggcuuaugccuauagucccagugcuuugggaggccgagguaggaggauugcuugaggccaggaguuugauaccagccugaacaacauggugagaccucgucccucuauuagccaggugugguagcaugcaccuguagucccagcuacaggaggcugaggcaggaggaucgcuuaagcccaggauuuugagacuuagguucaagacuggcaguuugaaaaacagugaaguaaaaggcagacagagggaaaagauuggcuagcaagauagaaagaaacccaggagugugugcaugaauugagggcucagggaagauguuccagagaagccaggucaaguguggucugaauguguuuguggaguuuggucacuauggccaugcuggugugcugcugacuguagcuaggggaguuucacuggagggguggggaaggaagccagauucacugggagagaaguugggagagauaaaucuagaagcuugacugugaagaagaggucauaguuggagcaggcguuaggucugaggggaauuuuuuuguuuuuuuuuuuuaagaugaaagaguuggccagguguggugacucaugccuguaaucccagcacuuugggaagcuagggcggguaggucacaaggucaggaguuugagaccaaccuggccaauauagugaaacccugucucuacuugaaauacaaaaauuagcugggugugguggcaugcgcccguagucccagcuacucgggaggcugaggcaggagaaucguuugaaccugggagguggagguugcagugagccaagauugugccacugcacuccagccugggcgacagagugaaacucugucucaaaaaaaaaaaaaaaaaaggaugagagagucuuggcacauuaaacugaaaagagagggaagugugagagcauaagagagcauuaauguaguagagcaaaugccugggaagucuaguguggauagaguucugagcugggaugcauguugaucugaagcaggaggaaggacauuuauccacugaaugggaaggaagacauugauggauacagaugaaggugaguuugagggugggcaggaaguugaaggcguucuugcuuuacucucuguaaaguaggaggugagguuaucgucugagaguggaguuagaggaaggguugaugguggacccugaggcuugggcaaagucgaggagguuugaaaaagccucuggccaggcauguuggcucacaccuguagucucagcacuuuaggaggcugagacagaggaucacuugagccuaggaguucgagaccagccugggcagcauagugaaaccccauuucuacuuaccugggugaguuggcgugugccuguagucccagcuacgugguaggcugaggugggaggaucacuugaguccaggaggucaaggcugcagugagccaugaucgcaccacugcacuccagccugggcgacaaagugggcucuaucuaaacaaacaaacaaacaaaaaaccccacaaaaacuucugaggggaauggaaagagagcucaacagguuugcuggacagcucugaggguguccagaauggagccccugaaucuguuaugccaucugcuguuaaugguugugugguuuucuccuugguguugaguauccugaggagaggaacagagaaggugauagguagaaggaucugggguugggauuugguugagugaguguuuaagagagugugagggaguugagaucauugguuagugggcaguugauguaggauggaggagaaaggagauguagacagaagaggccugucagagaagaagaaaauagaggugcuagcaaauuggagcaucagaagagauggaagaguugguguggugggagagguggcaugagagaucucagggaaggaguucguagggucaaaaggaaaugcagugagauguuuggcagguacugucagaguuggagccauucugaguagugaugggaaagccacgcuaggucuuugggaggaagacaguaacaccaagaaggagguuacagaaugaggucaaggaacuaauugggcagugugcuugguggauucuaaggucauuuggaaugacugcuggacuuggugacucagggaggacugaaccaggggaaaaggucuucagcgaaugagauagaaugauugagagacauggagguaaauuuuacccaagaguggaggagucuuauauuggaaacagcuuugggcaauaaggagaagcuacaaugugcuuccaucaagaguuccagguuucaaccaagauaagaagagagguugggggaaggguggucccaagagguucaguacaaagguguaggaggguggggauccaagggaaguuuuggacugugggugugauauugugggaaagggucgggggucugggggcaggaaggggcuugaacuuuggacaggacugaaaggcaugaugggggugaguggcuguauuguucuucuagcuccccugcuggcuaggaggagccagucuucucuuuggaagcaauuugagaagugcucugcuggaccuaaauugaugcuguccaaauuucugccuugaggcaaguuggcuaugccuucucggaugaguaauuucagccccuaaagaguauagcaaauccauauaaccaagaguuggcaagaaaaggcucuuuaugacauuugaguguuucauguuccucugacuuucuuucuuuuuuuuuuuuuuugagccugagugucucuugcccaggcugggugcaguggcgcaaucucggaucacugcaaccucugccucccagguucaagugauucuucugccucagccuccugaguagcugggacuacaggcacaugccaccaugcccagcuaauuuuuguacuuuuuaguagagacaggguuucaccauguugcccaggauggucuugaucucuugaccuugugaucugccugccucaaccucccaaaguguugggauuacaggcauaagccacugcacccagccauuccucugacuuucuagaggccuguuuacuggaagagugaauaaucucaacugcuucuuuuuuuuuccugguaucuagaaagcagaaagauaagaagacuccuugggguuucaguuccauucagugccuugguuacacggugugauaagucaugucugguucuugaaagucagcagugaauaagccuuucccaguguagagcauaggguuccuuuggggaauuuaaacacauuuuucuuuaauggcugaaaugaaguguggcucuuuucauggaaguuuuauguauuugaccuauuuaauuuuuuuuucuucaggaaauaaaaaaugccacuuucuuacuucccuuccaaaacagacaaccacugacuuuucuuggcaaggagauaccugugugugucauggaaauggaugguguuuggaaaugugaaaaauguaauuuacuuuuucuuuucaccauugaaguggauuaaaagaagugaauauuuuaauggaacuggauaugauaaaugucuuucuugugaaagcuuuagaaucagaaugaaaaauuauguuuugauuuuucccuauaaauaugcacauuuauucuuggaaguaauacuagagucuguuuguuacagcauuuagcuaacaugagguuucaaaggacagucauuuuguacagauugaauacaaaauaugcagaagggacugccucaguaaauaaaugcuaagcccuagguuguuuugguaguauuuuaagaaaauaagaguugcugguguaccuuaaagaauguaagagagaauaaaaagaaaacaaaaaugaaaauaggagaaagaaaaauuauuaaagcaugagaggcugaagcaaagaaugagugaaaccuuagagaagcucaggaauggacauuuaaagaccaguggggaauguuagaacagaggggaguuacauaaggaaaugacaguucaggaguugagaagggauggugaagaggagaaggggguauggcccaaccuguaaaagcauaaaguggaaagauaaaggauuuuucucacuagaauggugacuuuacauaaaaaguaaaaacauaucagauccugcuuguagaauuuuguuaucacuucagcaauuuuauuuccagaaccccuugcuuaaacgcaaccuauuuccuuucccuuucuacauaugaaaaccaauuauuuuggccgggugcgguggcucaugccuguaaucccaggacuuugcgaggcugagguggguggaucacaaggucaggaguuccagaccagccugaccaacauggugaaaccccgucucuacuaaaaauacaaaaauuagccgggcguggugggggucaccuguaaucccagcuacuugggaggcugaggcaggagaaucgcuugaacccaggagacagagguugcagugagccaagaucauaccacugcacuccagccugggcgaaaagagugagacucugucucaagaaaaaaaagaaaaaaaaaaaaaaucuauuucauaggaguagauuuuuuuuucuucuuuuaguucccaaagcagcauuucccaggaugaauugcaccaaaugcuguuucaacaggcuguucaaaggaaauaaagaauuuuauguucaaauaacuuugagaaauacuguauaaaaaaaaaguuuaacauguuuauuuacugcacaguucucagaucccuuaacaucaaauauguauuuugaauuucuaagauaaauggucucucuuaucuaauggaauucugguuuugcucuggguggcaaaaauuauaguuaaaaauucucaucuccccagacuccccuguugccaaaggugacacaguagcagccagugaaauauaaguagaagugguugcagggcagaggcuuccaggagagcuucgguuucuugauaaacaggaucugugaggcuggcacacaacuuucccauuucccuucccaccuuccuguaugaaggggauguagcaaucuugucccaggaaggccaagcgcuaagaguugcaaaucagaaagauugaagggguucuugauggcuucuugcaacuacucuaccagccuuggaguuucuaucuuuggacugguugcuuuaguagaaaaauagagccccgauuguuuaaacuacuauggguaaguuucuaugacaugcagcugaaugcaauuguaacucauaccagggugauauauaguaagcaguaauugugcuuauguuaaccguggauauccaauuuuuuuuccuuuaaacuauuuagaagagucuuugggaaaugcuacguuuaugaauagaaauguaguaauauagucagccuuuuuuuuucuauaaaaaugaauuuucucuugggaggccgaggcggguggaucaccugaggucaggaguuugagaccagcuugggaaacauggugaaaccccaucuuuacuaaaauacaaaaaauuagcugggugugguggcaggcaccuguaaucccagcuucaggaggcugaggcaggagaaucccuugaaccugggaggcggagguugcagugagccgagauugugccauugcacuccagccugggcgccagagcgagacuuugucuccaaaaaaaaaaaaaaagaaugaauuuucugauggucuuugacuaugaaauuuggguuuaaaauuuugggcuuuuccuuugccuuuuccccacacagaugaaguuuuugcuuccuuuuuuuuuguuguuguuguuuuuuaaaugggccaggcugaucuugaauuccuaggcucaagccauccucccccgcucagccuccugaguagcuguuaccacagacaggcaucaccaugccuggcuuccuuuuuuguaaaaacaacaaacagaccaaaaaagccuuuguaauuaguuuaugccucuuaccaaagcacuuuauauaugccagguuuuuuuuuuuguuuuuuuuuuuuuaaacagaggugguuuucauuagccuauucaugccuucuuuacaguacaauuguucugaaaauuuguaggggaauugacucagauguacauuuauuuucgucauacuaucagagauguuuaauuuccuuugaaugauuuuauucuuaacuguagcacuuaacacuuuuuucugucuucuuuccucucaaaauuaaugucuguaaacuaauguuuaaguggccuagagagucucuuaauguaaaagcuuguuguaaaguuggaaaucuuuuguaauuugaauaccccuugauugcuguccuucagugcauuggauuguccuaggguguucuaauaguauuucucaauuagcugauaaaagaauuuuagaggcugggugcccuggcucaauccuguaaucccggcacuuugggaggcugaggugggaagauugcuugagcucaggaguugaagaccaaccuagacaacauagugagagcccaccgucucugccaaaaaauguaaaaacucaggggaauguggugguguguaccuguagucacuacugcucgggagggugagguagaaggauugcuugagcccaggagaucgaggcugcagugagcuaugauagcaccacugcauuccagccugggcaacagcaagagacccugucuccuaaaaaaaaaaaaaauuuauuguuucccccuuaaaggacauuuaaaguauacuucaaaucucuagaauauaaaaucagaauguuaaaguugaaguggcccuuagcaaaugagucuaaccuccucauucugcagcugaagggaucgagaacuuaccgaaggccucauuacugagccaaaaggauggcaggacuggugcucuauucaugagucugcucacucuggugauggccugacaauaacagugugggaaguuacacaacucauuucagugaucaguuucuccaugcguaaaacuggaguaacuucucauuugcucaaccugcaguaaaaucuuuaaacucuucugaguugcuuggaauugaauccuuauucuaguauacuguauuuguuggaaaggagaaauauuugauuuuagaaaacuuuauuuuuaaauaaauuugaguuuauugcaguauauaaaauugaaccuuuucaaguguacaguucaaugaguuuugacaaauguaugucuuaugaaacugccaccauaaauaagaauauucuaccaucuuaaaagguuagaauuuguuuugcuuugauuaaugagagaauacuuucauuuucuguaauaagaauauggauaaaauguuacaacuauuaaaauauugacauacuucauuguuuucaugaaagcuguuaaauuuuugauucucuugcugacaccaagaagaaggagggggaggagaaggagcagacaucauuaaaaugauguuaaauagccucuuugugacauggggaguguguaauggacuuuaauauuauucagguagaaaaaaugauagguaaggauauaguagacuuauuuuuauuauacgcaauguaaaacuuuacagauuuuccuguggguuuguggagacaagguguucguuaaauuuaaaucauagggaaaccauuaccaaugaaauaaauuguauaucuucuuacauuguuauuuauuuauuuauuauauuguuagaacaagcagcaucaagguacuuaagccauuuguaucccauuugaaaggcaggaagcgaaaucacuuagggcauugaauuugaggcaguguugucuuggagguaaggaaaguuuuaagcuaagcaaagaaacugggagaugcggguggaggugaggagaccguguucggaguuggaaacucuagugaaauggauuauuuuagcauaaacuuaucauuggcaaauaacaguguuugguuuucuuaaacuuuuuuuucuucaaguuucuugaaugagagaccauguuuuucauuuucauuuuuauuuuucgguauaauauaaucagauauauaaauucuguaaauuuuuuuuucuucauuuaaaaagauuauuuauuuguuuauuuuugagacagagucucgcuguauugcccaggcuggagugcaguggcaugaucuuggcucacugcaaccucugccuccuggguucaagugauccucucacuucagccuccggauuagcugggaccauaggcacacaccaccuugucuggcuguguugccuaggcuggucucgaacucugggacucaagagauccacccaccucaggcucccaaagugauaggauuaugggcaugagccaccaugcccagccuaaauucuguaaauuacaucacuauuuauuauuuauucauuuauucaaauaacauuucuugaguacuuacuaugugcaagacaccauucuaagaguuuugagaauaaaaagauggauuugauaaugaguguucuguaagaagcuucuaguguaauuggaauuaaaaacauaagcacagacaacagaacuguaaagguggcuuggauuugaaugccaagacaaggagcguggcauucuguaagcagucagcuuccacugauguauagaggaaggacuucaucaggucuaggccaaggucaucuccuuaaagggaguugaaucuggugguggaguauaggugcauucuuaauggguagaggggaguauggagaccagcuaggggacccuugauaauugucuaaggacuuggaguguguccacagaauuggaaaggaaauagguuaagcaagagauguuuuagagagaaucaucagaauuuaauaagugguugggggcuggggguggagaguggggaguguuucaaaugcuacuaagauuuuuuaaaaauuuaauuugaauucauuuuuuaguagguauuacguucacaugguuuucaauccaaaagagaaugccaugaauuguuucccccuuccuucugucucucggucucccucuccaaagauaaucaccaguguuauugguuucuucuauaugcucccagagauauugaaugccuauguaagcagauaggugugagcacucuuuuuuacuaucuuuuuuuuuuuuuuuuuuuuuuuuuuugagaccgagucuugcucugucgcccaggcuggagugcagugggggggaucucggcucacugcaagcuccgccuccuggguucacgccauucuccugccucagccucccgaguagcugggacuacaggugccugccaccacgcccagcuaauuuuuuguauuuuuaguagaggcgggguuucaccauguuagccaggauggucucgaucuccugaccucgugaucuacccgccucggccucccaaagugcugggauuauaggugugagccaccgcacccagccuacuaucuuuuuauucuacccaguagcaauuuauuuuucacuuacacuguuuuuuaaagaucauuccauagaaggagauaaaaggcuuccuaacucuuuucuuaugacuacauaguguaccuuguauggauuuacugugauucauucaucauucugcuauggaugcucauguagguagguuccaguuuuugcuguuacaagcaaucuacauugcaauaccuguacauacauacuuucucgcaugugcaccuauuucugugggguaaauguugagaauagaaauagcuaaguguaaagguauguacauuuuuaaauuuugauauauguugccuaauugccccuuauaaagguuguacacuuccauuagcaaaauagaaagugccuaucaauaggaugugguuuugaacuguugaaaaucugagagguaaaaaugauuucucaggucaguuuuaauuugcauuuacccuuuugugaaugaaguugaacauguuuucauacaucaaggggccauauauguauauguauauauauccuuaucugugaacuguuuuuuaauuaaaaaaaaauuuuuuuuuuuugagaucugaggucuugcuguguugacccagcuggucucaaucucagacgccuggucucaagugcucaagugauccccugccuuggcuucucaaaguucugguauuacaggcguaggccaccacaccuguuuuuuuuuuuuuuuuuuuuuuugguuggugacagggucucacuugaucacccaggcuggagggcaguggugcagucauugcugacagcagccuugaacuccuggguuuaagccaucuucuugcuucacuguccuguguagcugggauuacaggcaugagucgccaugcccagccugugaacuauggcuguaucuguugaccauguaucuguucgguuauugggcuuucuuuucuuacuuaguaagagcuuuauuuuuauuuccuuuuuuuuuuuuuuugagacagagucuugcccugucgcccaggcuggaguccaguggcgcuaucucggcucacugcaagcuccgccucccggguucacgccauucuccugccucagccucccaaguagcugggacuacaggcggcugccaccacgcccagcuaauuuuuuuguauuuuuaguagagaugggguuucacuguguuagccaggauggucucgaucuccugaccuugugauccaccugccucggccucccaaagugcugguauuacaggcgugagccaccgcgcccggccgauauuuuacuuuuuguaaccaucaugaaugaaguauuuucuuugauuauacuuuauaacugguuauuuuuugucuguauuaaagccacauauuuuacauguuaauuuuguauuaguaaauuuuuuucuugucuaauuauguugacgggaaucuccagauccauguuaaaaaaugcugguucuuauuuuguuccugaguagaauuucuuguuaaacaucaugcugacuuuuauccugagauauauuuuaugauguuggaaaagcauccaucucuaucuuuuuuuucuucuaagaauggauguugaauauuaucagaugugaauggauguugaguauuaccaggugccuuuagagugccuauggcaaugauguaugaccuaccaucuaaaagauuuauuuuuaauccuagcuggauguuuccuuuuuaauucuagcuggugugaaggagaugcaggcuugggaaugagguaguugagaguuggaugucucugcgaugcuauugugcaagucagcucuuuuaucaaaugcuaucaauauuuaauaaaccuagaccuaauaauagauugacuuuggauugugauuuuuauauuucugucuuucccugucaacaccuuuugguagcuucaaguuaaacuucuaguccaguugggguuuaaaggguauaaauauacauucugggcauucuuuuuuuuuuuuuuuuuuuggagacaagucucacugucgcccagacuggagugcaguggcggcaaccucugucucccagguucaaaugauucuccugucucagccuccugaguagcuaggacuacagacaggcaugcaccaccaugcccggcugauuuuuauauuuuuaguagagacaggguuuucagcauguuggccagacuggucuugaacaccugaccucaaguaacccgccugccucggccucccaaagugcugggauuacaggcaggagccgcucugcgcccggccauucuuggcauuguuaauugugcaagucugagguagaugguagggucuguguccuccgaaucaagaguaggauacuuggggguagcacacacaauaauuacuguuuuggagcaugcagauaaacuuuuaaaagucaccuugauguaugagucauucuugaaacugucaauuaguggauuguuuuuuuccaggcagguuaagguagaugccaaauggacaggauguuuugguuauguguugccauuuuuuaaaaagaucaauaccuccgaauuaaaguuguauagggaccuaagugcucauuuucuguagaguuuuaaauaccauccgcaaaucuccauuauuuuucuuaaagguauuuguccuuuaggaguagaaaguaauuguuguaaauguaacuaaccugaacuucacccucgggaguuuaaugaccuuauuuuuacuggucgugguucacacugaauuuucucucacuucuuguuccucauucucuccaugcaaccuauccuuuucgggccuuuuuuauuucuuacuccuuaccuguauggcagccucccuguucccgacuacaagggcuaguagguggggguggagaagaagagcuccauaguguuaacauacaaagaugugaagauucacgggcuacagacucugugccugguagaaccccacaauuauucacucagccucuuuacgcauguuuuagauaagguguuccugguuauuauacuagauuucuggaaaagccaaaugagaaggagcuggcaugaaggccagcgguagauauacugauugcaacaaggaauaauagcugcuguuuauugggugacccugaaaauuauaucaggaccuuuaaaaccaaggccacuuagggccauuuagugaagggacaagccucuguuccuuuuauaucaguauaguacaauuuaaaaaauaguuaagaugacucugggcauccagaaaagauaaaucugacauagguuguucaguuuacgaagacagagaagugugugauccguuuuugagucaguuaucuggaaaauuuaccaagcaaggguugaagaguggagauuucuuguacuagggaagcuagcuuaaaagauguguucuaauggaaacaguuaaauaguugaugacucaguuuuucuuuagcaauuacuuuuaugauaugaugugguugaaaauaaccuccaaauauuccagaguuucuuuuacauauaauagugacgcuuguuuuucaugguaauugaaaauguuucagauucaacuuuuguaaugaauaguuuuaauuuauuucagauuugaaaugucagugacuugggaaggguccagaguguguagcuuuuacuuuaccuuugacuuuuuguuguuguuguuguuguugagauggagucucacucugucacccaggcuggagugcagugacacgaucuuggcucacugcaaccucuaccucuuggguucaagcuauucuccugccucagucucccgaguagcugggauuacaggcaugugccaccauacccagcuaauuuuuuauauuuuuaguagagacaggguuucgccauguuggucaggcuggucucgaacuccugacuucaagugauccaccugccucagccucucaaaggguugggauuacaggcaugagccaccaugcccggccuacuuucccuuugauuuuguagguggcugaggaagugcaacuguguuacuacuucugcugcauaggugcugugucauucauaugucaaaguaauaaccucugcaugagaauaacauucaaagcacccuguguagcccuguguaccuacacagcuuuucagaccaguucaggcguccacagcaagccugugccauuuuuacuugucuuauguuacaccaacuccugaagugugguggcuuucugaauaugcuuauggcauaugugcugcaaauuuuugugauuuccugucuccauauuccagaauuuauaguaaucucaugaggaagcgaggugaaguuuuugguuuauuccacggcuucucaaccccagcacuauuggcauuuggggcuagauaauucuuuguugugggagaacuagccuguauauuguagacugcucagcagcaucccugaccucuccccaguagaugguaauggcaucuucucugguuauaacaauaaaaaaucuuuccagacauugcagcuauccucugggggggcaaaaucacccaugguugagaaccaccgguuuaugcuuuauaaagagugauuuugagggcgaauugacuguuuauguuauuauaagaaaaugaauaaacauuuguugagcacaauugauaagccaacuccagugcaaaaccaaguauacagaggaaacaucccuguccucaaaggaaacguacauguguacuagaacuagaaauacaauacuuuauacuaugugacaaagccuauaauagauauaaagauaagagagugguuacuuuuacuauaaagauaucagccaaagaacaggaaaggaaggaauacuugaccugggucucgauggaucaguaggaauucaccagagugaacugcaguggccuucauaacagaaaagucauugugaauuaaggcuaaaggacucuacauuaugguuugcuuugggauauucuucuugucccggcauaauuauuuuuauuuuuaucuuuuuuuuugaaacagagucuugcucuauugcccaggcuggagugcaguggcacaaucucggcucacugcaaccuccgucucccagguucaugcacuucuccugcuucagccucccaaguagcugggauuacaggagcccacaaccacgccuggcuaauuuuuguaccuuuaguagagacggggguucaccacauuggccaggcuggucuugaacuccugaccucaagugaucuccccacguuggccucccaaaguacugggauuacaggcgugagccacugcgcccggccccagcauaauuauuaauagcacuccuuucacucaaaaaaaaaaaaaaaugcuuugcaugaugaauuuaacagucacucugguaguccuggggagucaaaaguuugugggcaagugauguguuuaaggugcagugaguugucuuauauugucagaguacuuuagggagugggaagggauguggaggauggcuggagauaagguuaggaccuauuguggagggucguggagggucuuguaugccauaugaugaaaguggaacuuguccuggacagccuaggagccaacuaaaaccucccgggcaagggaguguguuaggaagagagagacagagaaaaugggcuuuucuggcccuugagaaguuccagucuguucuauauguugaaugcugcucccaaguacuacuacuuagaggaaauagguccccaggaguuucuccuuggcugaguuuuuuuggugacagccaggugcuguucacaacuguguuacuuucaacugaguuucuuugugaaaugcauaaaggagacuucuauucauuuucacuuuguucuugacuugugaaugagugagauuuugcucuguuacugaaauuugaaugaauggcuacuauuuuaguugaaaagaaaagaugaaauuaucucaggacuuggcaaaggauauucugugggcgaaaucuagccucuagucugcugcuuguuuuuguaaauaaaguuuuauuggaacacagccacaguuauucaucuauguauuguguauagcugccuuagugguacaacagcagagcuggauaguucugacaaauaccauauggcuugugaugccuaaaaugacugucugggccuuuguagaaaaaguuugccaaucccucauccaacugaauucaauauucaagucaagucacucaaguauuuuucauaucuuuacuccgauuaagauaguuucaggaauggaccaaauuaugcugauuuuagugcaucuauuuguuccaaauugggcuuguguuuucaauuuuacgggagagauuuuguuauccaggauuuuaccugagagggauaaagcucuagaacuuggcuuuucugucuuccaggaagucuugaaucuacucucuggauuugauaccucacaaggaaggugcugcccggagaggcuggguggcuggacccgggcucugugguggggcucucuccccucuagauggccauggaccacguacucuuuuccacuccagagucccuuuccuuuuccacuccagagucaaugccguaagagacaaauauauuucuuuuuuucuuuucuuucuuucuuuuuuuuuuuuagaugaagucuugcacugucaccugggcuggagugcaguggcaugaucucagcucacugcaaccuccaccucccagguucaagcaauucuccuugccucagccucccaaguagcugggauuccaggcgccugccacuaugcccacuaauuuucuuguauuuuuaguaaagacaggguuucacuauguuggccaggcuggucuugaacucccgaccuucugauccacccaccucagccuccuaaagugcugggauuacaggcuugaaccaccacacauggccuugacaaauauauuccaauuucaagcauuuucagaaaaguaagcuauuauaaauaacaugaauuuguguacuuaagaauauuuuuggcuuuuaaaaauacaaguagaucauacuggucuuuuucuuuuacuuacuccucacugucuuuuagagacaggaucucgcucugucauugaggcuggagugcaauggcacaaucauaacucacuguagucucaaccuccugggcucaagugauccuucugccucagccuccugaguagguaggacuacaggugugcaccaaaucagcuauuuuuaaaaauuauuuguagagauggggucuuguuauauuuccaagucuggucucgaacuuuugggcucaagugauccucccaccuuggcuucccaaagugcugggauuacagggaugagccacugcuccuggcucauacuggucuuuaagaaaacaaacaaaaaguacaggaagaaaaagaggcaguuuuuugguuggucugaugcauuuauuuccucguuacgauccucuggugccuucucauuuaaugaccauguuuguuuacucccuuucaaacugacaacuuucacucugauuagcaucaagcuguaccugguauuuggguggggacuggaccuuuggagagagaaccagggacaacagccauauguuaaccagggacaauguuaauuaaccaaauuggugguuuagcuccccaccccuuuccuccaccagucuggauagcucagcuuuuuguaggauuuggcuacuugccuucagagacucuucaauaagaggagagugguuacccugggaaaccaguucacauaaaugaagaaugcuguuuggucauuuaugguccuggaccuugccccuuguucuuucuuugugaaguguucagaugagcguuuucuuucaucuuuuaguugcuccuuuaaagcuccaagugauuuuuuuaaacacugugaagcccucacaaucaauugcuuaaaauguuucuagaaauuccugguaucacuuaaaaauagcuuccguuuugugcucuagaagguuauuguugcugagugccagcagcuacauuuuagaauuaaggcagguuuggccagauuggugugcaguguggagaugaagaaucccaccccugcaagacggagccacauaagaagccagccgggggaacagaucacuguagccaucucugaaaagugacagcgcuaaauccuuguccugccuuucuucucuuuccuuccaguuuuuuaaaaaaaauuaauagacuuuauuauuguuuuuagaacaauuucagauuuauagaaguuuuuuuuuuagauggaguuuugcucuuguugcccaggcuggagugcaauggugcgauccaggcuaacugcaaccuccgccucccggguucaagcgauucucuugccucagucucucgaguaacugggauuacaagcacgcuccaccacacccagcuaacuuuguauuuuuaguagagaugggauuucaccauguugguuaggcuggucucgaacuccugaccucaggugaucugcccgccauggccucccaaagugcugggauuacaggcgugagccacugcucccggccagguuuauagaagaacugauuggauaauagagaguucucacauacuccccccaacucccacaguuucucuauuauuaacauuuuacguuuaugugguuacauuaccauuaauaaccgauauuacaccucauuauuaacugaaguguauaguuuaccuagauuucuuuacuuuuuauccaauguuccuuuucuguucuaggaucccuuccaggauaccguauuacauuuaguugucauuucugccccuuaggcuccucuugacugcgaugacaguuucucacaauuccguuguuuuugaugaccuugacaguuuugaggacuacuagucagguguauuguaggauaguccuuauuggaauuugucugauguuuuucucuugaugagaugaggguuauguguuuucagaggaagaucacagagggaaaguggcauuuuuaucacaucauaucaaggguacauacuaucaacaugauuuguaauuguugcuguugaccuuaaucaccuggcuagaaguaguauauuucagguuuuuccccugugaaguuucucuccucuccuguccuuuucauacugugcuccgcaaaagaaagucccuaugcucaaccuaguguuuaaagaguagggaguuaaacuccuccuucuugagggaaugguuuuacaucauuuauuugcaguucugaugccugggagauuugucucuucuccauuuauugaguaacuuaaucauuauucauaucaguauggaaucaugcauauuuauuuuuuacucuggauuauagacccauguuacuuuauuuuguugcucaaauguuuccauuuuuguuggccaucggaggcucuuucacuuggcuccugcaucacuuugacauacccccaucauuguggguuugagcacuuccuuacuuccugguacuacaagaugcucuagacccaucuuguguuauuuccugccccagucuuagaaucagccauuuuuccaaggaaccugacuccuuuuauuggagaaugguauuacaaaccaagaugugggcacuagguauacuuguugccaugggguuaucauuuuuuuagguccucuuagcugacauaaaaaaaguacauguguguacuaagguguauauauacacauauuuuaaaauauuucuauguguaaccauguguaucuauauuaaguuuaucaugaguuugacuuauguuuaacauguugauaucugaacccuagccuauuagcacauggauuaaucuagauuccuccucuaguuuaucguucacccccacuucaauagugagaaacuuggaguauuaguccauuuguguugcuauaauggaauaccugagacuggguaauuuauuuuaaauaauagaguuuuauuuggcucaugguucugcaggcuacacauaaaacauagugccgguaucugcuucugguguuggcuucaggaagcuuccaaucaugguggaaggugaagggggagcuaguggaucacauggugagagagggaacaagagagaagccaggcuucuuuaagcaaccaacucuuggugugaacuaauaaauagagugaaaacucacucaucaccaagaaaauggucccaagccauucaugagggaucugccucccucccacgacccaggcaccucccaccaggccccacuuccaacauuuuggaucacauuccaacaugagauuuggaagggacugauauccaaaccauaucacuuggccucuaccaucuaccauccaucuacuuaauuguuuaguuccaguacacauguguagcaguagcagcauugguaaccugcauccccaugggaagcaacuuuaucagcuagaguacaauucuuaugugcuguuccuuuugccuuuacucuuacagaugccacucacuugcaaagucacuuagguuacucuuucuccuaccuccuucaguaagguuguuuccuacauuuguaauacaauuagauucuuuugucacaggcuggguucuuuccuaggauccccugacuuccuaaaugauucuucuuuucaaauuugcauauauccagguucacucuuuguguuggacaguucuaugaauuuugacaaaugcaugucacauauccaccaauacaguaucauacagaauauuuucaccauccuaaaaauucccaaugcuucaccugcuuauuccucccuuccuccccuaaaccacuagcaaccccugaucuuuauaaugucuuuauaguuuuaccuuuuccaucuucugcauuuuaaauucuuuacacuugaaucucuugagcacccacugacaauggcuggccagucagaacucauagucauuauucuauuauucugcuccucuggagggcacagaaaguuggacuucucuuuggaauaaaguagaagauaguuaugaaagcuaaaaugcauuaucuuaacaacacguccauguuucacagucugcacuauuagugccauuauccucuaauaaaaaagugcuuucauucuagucuuccuguaaagccugauuugguggauagauuugcagugccuguguuguacuuccuguuuuccucagcccaggauagugauugcuauuuacucagcaaacaguuuuggaggcacauucuggaagccauuccuccugcucugugaacugccucccuggaccuuugguaaugauguuuauuaacucuggugauaugauugggugaaagagacaaaucagauccucacuuagaaauuugaauugaugagauagccgguugggaugagcacauuccuggaauucuagaaggugucaucuugggaacugaaaccacuauguucauuucuggaaaaacagagauuggaaccagagggagaaaacacuuccucucuguugguuggauuuccagucuuugcuccagcccuuccuaagaccuggccaccuuccuuggcuccugugagaugccuugagccucauucaguaagucaccccgauguauccucaagcaaccaaauuaguuucuguuacuugcaauaaauaagucauagggaauuuaucuauguuuuaaauuuggucuuuuccucugcggagugcuguucuaaguggauuugauaugucagacuuauuuacauuaauacuaaagcauuauaaaggucaugauagaaaucuguguaagaggcaaagaaaggagugguugagucuaccugagggcaggaggacacaguccaugaaagaggcgaucuuuccagguggucugggcagggcauucuggguagaagguacaguaugagcaaaagcccagcauuuggaaucaucuucaggaguugcaggauguuugacauagggugugacugggggcaguugguaggcaggugagauccaggcugugagugccucaugcugugaaguuugacuuuaucuuguagaucgaaaccacaaaugggcuuuggaugggcuauuuguggccugcauauguguuuuguuuugcuugugcaaauguuuuccaucacuaguugccaugauuuaaaaaucaaaugcuuucccuuaaacaucugaauauguacaaauuaccacugucugaaauuuuuuggaagauuuauuaauagauggucuagcaguagugggccugcauuccacauggcacaggaaaugggguaugugggccccuguugccauggucucaccuggucuaccccauacacugacuuugcuuuccuauccuuauaggcuugggcuggagguaguggggccagugacuugcuuacuuucauuuguuuccuguuuggucagcaguggucccagugaugaccgccuuacuaucucauuaacccuuuuccuuucugaggugauuuuccauuccaaacucuuuagacacaaaacugcucuggagccaggcaugguagcucacuccucaggaggcugaggcaggaggaucguuugagcccaggaguucgaggcuacagugagcuaugaucauaccacuguacucuggccugggcaacagaaugagacccugucucuuuaaaaaaaaaaaaaagaaaagaaaaaacaacuccagugugugucuucuagauguuuuuguuucacuuucagggacuugucuugcugucuuuuaacuuugucauuauuacuauuuuuuaaagcaaaagagaaaguuuaaaauacuggcauaaagguuaagugaauugucauuguguuuuuaauaacugaggagggcuuuuguuuggaaugauauuuauaguaaguuguucuuuuucaauuauuaguuuauuaaaauaguaaauuuuaaaaccuaguauuucuugaacuuuaagcucaacuuguagauaaauuuuuauuuauaaaguaguaauuuucaugucaaaaaugguuucacuuauucauugauuaaccucacuuaguuucuaaauuuaacaaauuaaaguuauuaaggcuguuagcaccacuuaaagauuuaaucagagucccuugauguuuuaaacuguaaucacacauuuuaaguaucuguuucucucaaacaccuuaacuaaggcugauaacaaaaccgaggagcaaagucagccucauacuucagcagcucuugggaauuagugcaguaauccuacuggaagccaagaggaaaaaagagugcguuaguccagucaagguuacauguuuugagguauugauugauugauugucagcauacuagaucaguuuguaccuuccaaggugcuccuuccuaucucaacagcuaguuucuuuucucuuuuuguguuuuaaaucaggcagccuccagaaccagaauagguucagagagacucucaaaagcugguugcuugauaaaaacaaagcauacuugugaguaggagguuugggugucuguagucuuucagcuggggguuaccuauuugcauagguugcacuugucugcagccaggugugcuaaacuacccaucauguaaauuaacagaggcucuugaauguacuuuuuuucucuagucaagcaguaaggauuuauucuuuucauuuuucacaacauagcaaaagacaccucguuaauagcuuuucacuauaaagacuguaaagauugaauuacuuucucauuugguugggacuccuaguggaguuggacacugaaauuccuuugccaaggcccuuggccccaccucacaugaacgcuguaacugucguguaauuucuuguguggggccuagugugggcaccggugggaugcugaaccccggcugugacaccgacuuugucuugucuuauucuccaguguccuauugaccuccuccuggaaucucauuauugaugugcacaagggaaguaaaguaaugcaaggaggcacagccucacauuauuuagaagaaaugcuuuuggagaggcuugaaaucgauuuuuugaaaucuaaauauuagaacaaaagagauauauuuagucugcauaucuuaauaggagucccggcuuacaauaaaaacauuuauuaaacaguuaaagauggaaagcagagauaagcaaccauuuucaggagagggccagguggaugaaucaacacaauuggucuuuuuggcaagaauguuaaaaccuguugguuuugauuuuguuaauuggaaacagcgagggagauuaacaggugccugagaaguaauuaaucagggauuuagagagcuuuuauguuaucagggaaaggugauuuugaaaguguccacuccaauauuuaagaguacugaguggaacaaacauuuacauuuuuacuguauugauuagcuuacucauuggugagccauggacuguggaaaaugaucauuugugggggugggugauaaaagacuaagagucaauuuagagugagguuuggugcaugaaaaaaggugucagauauuuuacuucugacugcucaugagaacaaaggcaucauaaugcuuauaaccaaccuguuguuacacuugacuccucuguuuuuagaggcagugggguggccacucacucuacacuugccaaaucacccaauuaggaagacaaaccaagaaggaacauuuuacgugacuuuagaauuggggaaauaggugaguaggaagcuguacaaaauaugcacauugauuucugcauguuaacuuauuuuggguucuagaauguagaagccaguaucagugcauccauguuugugugcuauagccuuuuggauagaauuugaucaguaucaaaauaaauacaugcauacuuauuguacauuaauuauuucccuccuggagacagugcuggauucuuuuuuuuuuuuuuuuuuugagacggaguuucacucuugucacccaggcuggagugcaauggugcgaucuuggcucacugcaaccuccaccucccggguucaagcgauucucuugccucagccucccgaguagcugggauuacaggcucccaccaccacaccuggcuaauuuuuuauauuuuuuaguagagacgggguuucgccguauuggucaggcuggucuugaacuccugaccucaggugaucugcccaccucguccucccaaagugcugggauuacaggcgugagcuaccacucccggccuggauuucucuuaaaggguguugcgugguugguuacagauaauuuuuuuucaacuuuuauuuuagauuuggagguacacgggcagguuuguuaccuggguguacugagugaugcucacguuugagguaugaaugauccugucaccuaggcacugagcaugguaugcgauaguuuuucaacccuugcucccucuccuucccuacuuuagucgccccaaguuuuuauuguugccaccauuauguccauuaguacccaauguuuagcuuacacauauaagugagaauaugcggcauuugguuuucuguuccugcauuaauucgcuugggauaauggccuccagcuguauccauguugcuacaaaggaaaugauuauuuuuuuauggcuggguaguauuccaugauauauguguaccacauuuuauauauccaguccaccauugacaggcacuuaaguugauuccaugucuuugcuauugugaauagugcugugaugaacaccugaaggucaccagagaauuugaggacaggaguugggaggcgaaguggaagggaacaacuccaggaaaccaccaauaagaggaaauuuuauucaugguaaugguuuuuuuuccccccuguuaccauucaauggcuauuuauuaaaaaaaaaaauguguucaaagcagugcacuggaugcagaugaggauacgauagaagacaacaggcaugguagugguucacaccuguaauaccugugcuuugaggccaggaguucaagguuacagugagcucugauugugccacugcacuccagcacggagcuugggcgacagagugagacucugucucaaagggaaaaaacaaaaccaaacaaaacaaaacacaauagacacauccccguaaacacagggagcuuauacucuaguguaaugcuguucaauggaaccuucagcagugauggcaaugauauauagguauguuguccaauaugguagccaguagccacauguggcuauugagugcuugaaaugugaucagcaugacugagggauugaauuuuuuauuuuauuuaauuuuauaaucauuuuaaguuaaauaguugcacauggcuaaugacuaguugggcauuuguagugggucaagugaguucuaguucuagucuucauauuuagaacaccucauuugcgguaacuaggaaaauuugauacuaaaauccagagucucgggcucaaauaauuccauauacugggaaaucagagucccaucuuggauauauuuuugcugugacauuucccaaaguggguuccauggaaugcuagucacaugagauauacugacaaaaagagugcugugguuaguaagguugggaaacacugccugcugccauauccuucuggagcugcauaaugaauacaagcauauuuacagacucugauaagucacacaguaaagaaauugauacuugguagagauguauuuuggcucaguuucccaaacuuaguuggcgauagcacucuuuuauucaccaauaccucugaacacuuuucgggaaaugcuauucuagggagauaacugaucuugguuaggaccgucuuaaaaaugaaaggaagaggcugggugcaguggcucaugccuguaaucccagcacuuugggaggccgagguggguggaucacuugaggucaggaguucgagaccagccuggcuaacauggagaaacccugucucuacuaaaaauacaaaaauuagccuggugugguggcgggugccuauaaucccaacacuugggagcugacacaggagaaucacuugaacccaggaggcagagguuucagugagcugagauugugccacugcacuccagcuugggcaacagagcaagacuccgucucaaaaacaaacaugcaaacaaacaaucaaaaaauaaagaaggaagaaauggugguuauagccucugguuaguucuugguucuccgagaauaugagaguucucccauucuccuagauuuugguggguuagagauaugacagaaucggggcauagaauugcauauugcacauuugggcacugaaaaaacgcuucuugucaguaacaauaucuuuauuucagaguuuuauauacauauauuuuguuguguucaccuugguuagucaguuuucuaauuguuucugaguuagccuguggucuacaguagucuaagguagccugaauuaauacaugcacaaagagguugaauaguuugauuuugcuuuucuccuauuuagguuuauaaaacuaguacuugggccgggcgugguggcucacgccuguaaucccagcacuuugggaggcugaggcagguggaucacgaguucaggagaucgagaccauccuggcuaacacgguggaaccccaucucuacuaaaaauacaaaaaauuagccaggugugguguugugcgccuguagucccagcuacucgggaggcugaggcaggagaaucgcuugaaccugggagguggagguuguagugagcugagaucgugccacuguacuccagccugggcgacagagagagacuccaucuuaaagaaaaaaaaaacaaaaaacaaaauaaaaaaaaaaaccuaguacuucuguguccauuuacacuuucugacucccuuuacaaaagccuacagggucuccaggggugguauuauaguccccucauuuacuugguauaaauuaaaagcacagagucuauuauauaucaaccccaaauggcauuuuagaaauuccaguuagauuguauuauaaaucaguucuuaugcuguuauauaugcggguguguggguauauguguguguguauguacaaacacaaauaagaucucuaagcuugcuaaugccuuacuuaacaauacaacuaggcuggacucaagguuauucauauaauaaugccacccuugcucaccuucugcaguacuuucuugagcagcagagaaggaaauggauugagcaggccaugggaguggauccugcugcauccaucaugcuugugagcuccauccaucaugccugcuguggcaggaaaaggcucagagcugcuggguaguguaucuuccaaggucccuuucagugccgaaauucuaucacucuacgacagcuuuauugaggguuuccauuguagugaaggcgcauuguagucuagcugaaacucuagcaucaaaggagagacaugcucaaaauacuucaaggcuucaagaggaaauguugaugaugaaguugauuuuuggccuuauaagagggcgagagcuucuugggugccuuaacuuaccauuucauucuaagaguuuagaaaacacugcuuguuucugccauuuggaacuucucaauaaccaguacuuccucaacuuuacuaauguccgccccccgaccccgugacuaucacuauuuugccuuaauuuuuuuuuuuuuccgagacagagucucgcccugucgcccaggcuggagugcaguggcgcaaaucucggcucacugcaaccucugccuccuguguucaaaugauucuccugccucagccucccgaguagcugggauuacaggcauccaccaccacgcccagcuaauuuuuguauuuuuaauagagacggaguuucaccguguuagccaggcuggucucaaacuccugaccucaugaucugccugccucggccccccaaaguucugggauuacaggcgugagccacugcgcccagccaauuuuuuuuuuugauuuaaacauuguuuuauuaugguaaaauauacauaacaaaauuuaucauuuuaacuguuuuuuucggcauacuguaccguggcauuaaguacauucacauuguuuugcaaccaucaaaauuaccauuuuuaaucaaugcuugucugcauggaggauuaggggaaauuuccuguuggggccugaccuuccagcaccugccuguacuaguuaguugagacuguuauucauaagcaagacuugccaacccaaguugaccucuuucauaauauagcuagacuuauggaaggagaaugacuaacuuuugcauguucccugcuugaggccacuuuccuuccgaaaggaggugaaagaaaguuguagugugagcuuguccagccuucagcuugugcucugccuguggcccaggacagcuuugaaugcagcccaaaacaaauuuguaaacuuuucuuaaaacaugaguuuuuuuuuuuuugagauuuuuuuuuaaaguccaucagcuauuguuaguguuaguauauuuuauguguggcccaagacaauucuucuucuuccaaugugguccagggaaguaaaaagauuggacaccccuguuguagagggaauguugaagguauuaccccaagcuuagugguguuucgccauuccccugaggguaucuggagauuucugagaaagggacaaaaugcucagaaccaccagcggccacuucccauuccacuccuccacccccaugagaguagcuuuaagauuaaccaucccacuguuuucuuuauacauaaaguuucguugggacacagucaugcccauuuguuuacucuggucuguggcuacuuuugugugguaucagcagaguugaaguugaguaguuggaacagagacugcaauggccuacugaagcuaaaauauugacuuuuuccccuuuuccagaaaaaguuuggcaacucuguaggcccugagcaccccuggcccugugucuucuuuaaguucccccucaaacagggucugaagcaggauggacuuaucugaguacucugugggugucgcauuuaauauggaacccugcccugguguccugaaaggcugggcuguggagaugaaaagaaucaaagcaacagcccagguguggcagaagacaauguucuuuuauucuggaccaugcuugagaagacagccugcuggguuacauaaugauuugaguaaaggaaguaggggguccuuuaauucaugaaguaguuuauuaggaaauuaauuuaaguaugcuauaaauauuuguaaguuugggagacucauggauuugguuaaaggaagcggcgccauuuguuaaauuuuacucuggaagcuugaggguaugucaguacagccuuugauuugucauacauuccauuugccaagaaguccaacugaggagacucucuggcuucccagacucugaauucuuuuauuuuuauuuuuauuuuuuuuuugagcuagagucucacucugucccccagacuggagugcaguggcaugaucuuggcucacugcaaccuccaccucccagguucaagcgauucuuccaccucaggcucccaaguagcugggauuacaggcgcgugccaccaagccuggcuaauaacuuuguauuuucguagagacaggguuucaccauguuggccaggcuggucuugaacuccugaucucagguaaucugccugccucagcuucccgaaguucugggauuacaggcgugagccaccgcgcccggcccccugacucugaauucugccaauagguuguccuuuacugaaccccaugucccuccuguuuaaaggccaggagauggcuaggugcacuggcucacaccuguaaucccagcacuuugggaggcugaggcgggcagaucacaagguaaagagaucgagaccauccuggccaacauggugaaacccugucucuacuaaaaauacaaaauuaguugggcaugguggcguguuccugcagucccagauacucaggaggcugaggcagaagaaucgcuugaacccaggagguggagauugcagugagccgagauugugccacugcacuccagccuggugacagagcaagguuccaucuaaaaaaaaaaaaaaaaaaaggccaggagacaaggaugcaaaaugauugucuuacacagcgccaguguagccagccucuuggugcuccaggauuuaggcaucuuaaugucuuuaauuucuuaaauguguauguguuuaacauuuuuaaaaaaaugguguuaggggguuuguuucaaagcugcuacucagagugggggccauucuaguagauucauguggguuccuaaaggcaaagucgcauguguuucccaugggaugugaagaacggcccuggaaagaaaagcugauguggucgcugaggguuaugucagucacagugcacucgcuugaucugaaauggagggaagugaaaucguugggguguccaaguggccguacugacuuggugaguuacuguggaaauguucauuugcacuuuuuugcuaaugaaaucauuugcugagagauggcaauuuagugagaaguuccuucucucccccuuucuuucuuuuuuuuuuuaaacguugagcccuaccagcaauagcuuucauuagccacaagagucauggaguuaauggaaucuuucauuuuccguuaugccagcucccuuucccaaaacuaaucuucaggugccuuaagagacagccucagagaaugaaaggcagaagaccagaaaccaaaucauauugguauucugguugaaugcuaauauauuuugguggaggucauuauuuagaaacuauaggucuuggugauaaaauuaccgauggccuuaacaguuccaguagaaaggagaguguuacagaaauauagcuuugagagaccacuggagggccaaggccagccaucugaaagguaaugucagcucucaaguucuuuacuuugcucauuaaccucuagguaguuuucccuuagcucaggcuauggauaaaguaaaaagacuuaacacagucauuaagaauucugacgaaugcuagcuauguuuuagcauuuuauucuaagacacuucuuagcuaaaugauacuucucuccagugaccuaaaguuaaugguuucagaaggcccuugaccuggcucugcuuccuguagaaaugauuucaagguuuccaauugguuacuaaucacuaguuaagugaaagccaaauaaaacaaugcuacuugcaguuccccagggggagccgcucaucuccucuuuccaucucauugccugaaagugcugccaucaucuguaggagaucaauaucuccagguacuuaaaaaauauccuggccuauggaaauggacuguuauaucagggaauuggccgacacaacccagggaaucacagaauguuuaaaggcaagcaaacauccugaaguaauaggaaaccaaagucaaugauguuuuuuccuguccaguaguuuccuuaaccucauccucacuagugaacuacauccgacacaauuagggcauuuacguggcaaaaaacaccuggcaccauuguccugggcuggccaucuugccucuagaucagcugguagagcaacaaguuaucaggcugcaggugcaagagaaggggguggcucuuccaguuguguuggaaaaaauuaaaagguaaacuuuuccaugugaccaaucugcacagguucugugcucacauaaaucucugccuagacaauuauacuaagcucuuaguggaucccccuuucuccacccacccaagcaucauucuagagugagcugcuagugucaugucuuugcucagagcccuccuggggucucccuuuauaucuggaaucaaccccccagucccuaucaugccugcaagguucugugugaucuggcucugguucccuucaucucccaucacuucccccuuguucacuccacccguguugcacuggcuguuucuccagcacaccaagccugcucccaccucagagucuguauuuauugccugaaacacaguuauuuuuaccgccaccaugcuuuacccucuuccuuccagucuuugcucagagucaccuuacagacaggccuucccugacccagugaaguuagaacugcuccuccaccgcagccuuuucccagccuccaacacuguagccuguuuuauuuuucucuaagccacuuauggacacuuacuauguuuguguauauguuuauaauuuauuucccaccccuagaauaucaguuccacaagggcaggaaugcuuaucuguuucacggauuguucuauucccaacaucuagaggagucuuuggcagugaauaucaacaaguauugaauagggaaccucauaauuuaauaaaauaaacuauagaccaaaaauucaaguaucugguccugguccuuauaugaacuaguuaugagacaauggagagaucacuuaaauuuuuuuuuuuuuuuuuuuuuuuuuuuuuuuugagauggaggucucacccaggcuggagugcaguggugugaucuuggcucacugcaaccucugccucuuggguucaagugauucuccugccuuagcuucccaaguagcugggaugauagaugcccgccaccaugccuggcuacuuuuuguauuuuuaguggagacgggauuucaccauguuggccaggcugaucuugaacugcugaccucaagugaucugcccaccucggccuuccaguguugggauuacaggcgugagucaccgugcccagcuagaggucacuuaaauuuaccagucuuacuuuucuuacaaguaaaaugcaauaaagaauaccugcccuauuuuuaagacgacaaaauaagauaaucagaugaguaugcuggaagcucuguguguugguccgaccuagaguucuuuuuuggucugauaccauggggccuuugcauauagcagauccucaaaagccauuggcuugcuauugcuuuuacucccuggucacagaccuugugaugggucugugcaucuguguaucugugcaucauugcaucuggggugugaccuaugaccuaagggagaccuuucaauaaauuaugacaucaauaauucagaggcagacuguguaauuucacugcucccgaaggcuggagaaaugaucugcuuucuagagccauaaaaguucucuuaacauaaaaccuucuacagaaauggguuucacaggcaggcugucuucagugacuucagugacaguuuuucaaaaucaaguuuuacuucagucaguuuucuguuagccauggaugaucuaaaaacauaguuguuaucaccagguacaaccucuuuuaucuugaaauuugaauccaauccacuagugguccaccaugcuuggcagauuugguucucaccuuuucuuccugcucagaggagaggaguagccagugugggaggaggauuagagggucaggauggccugaagauuaauucaucaacauggaccuaauucaucaaauccugauugauugggaauuggucauuuugcuagcuguauauauucauaaaguacccaaaaugucccugguuauggagaguaguuuuggcuuuaaagagcuuuaugugcugguagugauaauagauagggaggaugauaaugaaaggauacauuucuauuuaaugaucuuuugcccuggaucuguuagggcaaacuuccuccauaugcacaacacuaugccaagcccagagcuauguuuaaucgagugauauaaugucaaaggaauuucuaguuuaauuggcagagauacucauaauauuauugauaauaacaguaggaggccaaaggauuucccaguuuuuuuuggcucuagucugcuugugggagaguugaaguggguuauauauacuuugugaaaaauaauuuaagagguaguugugggguuggugaagaacaaagugaaaagggguuaguuuuuugguucccugaucgugaaauagauugcuuuguuuguucuugcuuggcaaauugaaauggcagcagagccaacugaagugauggacacugacuaugguguuguuuguggaaucgaagaaacuuagcaggagacacuccccaaacucauauuccuucuacaggagaguagauuaauaagguugaauguggugacuguugcucaaaauucaggcuggaucugaauauauauuuguucaucugaggagaacacacuuuuuuuuuuuuuccuucuuugaggugaugggaauagaauaauuaaucaagugauagguuuuuuuuugucagggaauguuuuauugucuugcuaagaagucuuauauuuuuuuuucuagagugguaugauggauauuucaagacagauuugaauaauaucauagucaaugcuuagaauucagugauguuuauuaaucuuuguccuccucucucacuaggccuuaaucuugucuauugugaugagaauucacuagguucuggcugggcacaguggcucacuccuguaaucccagcacuuugggaggcugaggcagguggaucacuugaggucaggaguucgagagcagccuggccaacauggcgaaaccaugucucuacuaaaaauacaaaaauuagcugggugugguagcgcaugucuguaaucucagcuacucaggaggcugaggcauacgaaucacuugaacccgggagacggagguugcagugagccaagauugugccacuacacuccagccugggugacagaacgggaguccgucuaaaaaaaaaaaaaaaaaaaaaaaucaccagguuccuugacauagagcucuuuguggaaugccaugugcucuuugacauauugacaaguuugauaucaucgugugacuugaggacuaggaaaucacagcucauauguauuuaugcagaaugugaucacaaacucaugccccugaaaaauuaagcuuucuauguaggcaagacagugauuuuguucagaguaauugguauuuccuucauuuauguuauuaauauuugacagacauauuauacuuccugugugccagauacuauuuuaagcauuuuacaaauaacuuacuucacccucauugaaguccugugagguagauacuucuauuacucgauuccuuuguugcuuauacuuuuguuuuauauuccgguggcagccuauaggcagaugcuuguagcugccuccaguuuaagaaaaauuccuuggagaaaaccucagcucugccucauaacugaugcucuccucucccagaaaguugggaaaguuccaccuugauuugaacucgcuggccaaacaccagcuaucucuguagacacagauuuugacagguucagacccagauuggaaaugauuuugauucagguugccuuugagucuguggagagucagaguuuauggcaauuucagcccgcucuauccucuguuugggauuauguguucccagagaguaaacuguguggccccagagucacccuaggaggaucugagugacccuggguuuuguguuuuuacucuguggauguuguggucacgcuggaucauguuguguggaggcuugggagcauguguuggaggaacaguugagauuuuaauuuuauuuuugguggcuuuuuugguacauccaacccuuucagguuaauuaaaugccagguagagcuagcccacaaguggauuuuguuuugaaaaugugccuguuuuccaggagcccuuuguggcagccuggucugguugcccagauaucauuuuggcuucuuggugccuuagugccugggaugaauuggccugccugcugcagucucuucuccucagcccugauauccgccaacuggguggcuuugaugccucugcugagggcucugguuuccugccagucugggaggcgugggaucucaugcgugggaaagguaaucaagcaauaaaacuaagccugggugugagagguggauuaaagugggcaaggaagaagcaggggagagggagggagccagcuguccagaguggccggaagaggcagaaugugggcuccauccuggcugggaccugucagcccuugugagaacuuuuagggcgguaguauuauaguuuggauuuuccccauucaucuucucuccuuccccucuccuagguuuuagcugcccacagaauccuuugaggaggugauuccuggaaaccuguguucacuggauuuaguagaaauccaccuugacuuccuguugaauauuugacauguccugacaaguguuucccucccauccccgcaaccccgucacccugcuuuaacaaaaagcuucaaaguugagacccuuugcucugagguagaagauuuuauauacucuuauuuuucagaaaagggcagaauaaugcaguaguuaggaacacagcucuggggacagauugccugggcuccuauugccucugcugcugauuggcuguuugacucugaugagagaucucugugucucgguuuccucaucuuuaaaaagggcuaauagcugagcaugcuggcucaugccuauaaucccagcacuuugggaggcugaggugggaggauuguuugaguccaggaguuugagaccagccuggguaacauaguggaacccugucucuacaaaagaguuuuuaaagauuagcuggguggugugguauggccuguggucccagcuacucagaagucugagguggaagguuugcuugggccuagggggucaaggcugcacaagccuugguguugugccacuguacuccaauccgggcaacauagugagaccuugucuaaaaaaaaaaaaaaaaccuaaaaagcaaaacaaaacaagggauuauaauaaugccuccaucauaagguuagggaaauauuagcaauuauuaguuucucugccuucucuauucucuauaaaggguccuugaggugaaggcaugaauuuuuguuauguuuucccacuguuguauuccuggcaccuagaauagugcuugguacuuagugcuuaguauaucuuuugaaugaauaaauguaagaaagacugugcaaaugcuauuugcuguggccucuuguuuauccugugucuuuuggacuauagcagggaugaaggaggaaggaagggcaugggacuggcaaugucagaaaagugcaagaaugaauaaauccucugucuuucuccaugcuuucagcuuucugcauuguugagcuggcuguucuuccucacugcucucuuuggaaucagacuccauagaagggugagcagggugaaacaggugccugcuggccacugacuuaggggcuacauuaagacuagcagguuugggaggccaaggcggguggaucacgaggucaggagaucgagaccauccugacuaacacggugaaacuuggucucuacugaaaauacaaaaaaaauuagccaggcgugguggcgggugccuguagucccagcuacucaggaggcugaggcaggagaauggcgugaaccugggagguggagcuugcagugagccgagauugcgccacugcacuccagccugggcgacagagcaagacucugucucaaaaaacacuggcaggaaggcugggcgcaguggcucaugccuguaaucccagcacuuugagaggcugaggcagguggauugccugaggucaggaguucaagaccagccuggacaacauggugaaaccccgucucuacuaaaaauauaaaaauuagcugggugugguggcagccaccuguaaucccagcuauucggaaggcugaggcaggagaaucgcuugaaccagggaggcagagguugcaguaagccgagauggugccacugcgcuucagccugggcgacagagugggacuccgucuccaaaaaaaaaaaaaaaaaaaaauacugacaagaagcagccucuuaguacuguauaugugccagguccaucuuuaaggugcuauaugugcauuagcuuguuuaaaccuuagcacagcucugugaagugagaucuucuuagccccauuuuacagaccggaaacaggcacugagagguuaagugaccugugcaaaaucaugcaguauuauaaauacuuauuaaaugcccuuuuuuguuuggugcuuuuguuuuuuggagacagagccucacuguugcccaggcuggagugcaguggugcaaucuuggcucacuacaaccucugccuccuagguuaaaguaguucuccugucucagccuuccaaguagcugggaccacaggugcgcggcaccauaccuagcugauuuuuacuagagaugggguuuugccguauugcccaggcugaucuugaacuccugagcucaggcaguccgcccgccuuggcuucccaaagugcugggauuacaggugcgauuggccuaaaugcccuuuuuguaccaggcauuugugcuagauaccgagcagccagcagugaagaauccugaugugguuccgcccugaaggacaugcagucuagugaauguguggauguuaacaaauaaucccacaaauaaggacacagugaugacuugugagaaaugcgagggaggcagugugcuauggggcagagugacagggaaucugguaugagaaagggaagacuuugcucaagggcaggccuuuuucagcugggaucugaaagcacaaguaagaaguagccagaccaagaguagggaagagacuuccagacagugggaucaggauaggugaguguucugaggcaggaaagugggggcauugggaagauggccacuguggccagagcaggcggaaugagcagacugcagaggugagcugagcuacaucauguaagaccuguaggcacacuuaaggauuuuggauuuugucuugaaugcaauggaagccauugaaggauuuuaauuaggagugcaaggggaucucauuuacauuuguuugaaaaaccuuuaugucgaguagagggagaugauuagaagugagugagaauggauguggggagaucagcaagaaaaguuuaugcuuugacuacaggauuuaaaauguguauccaaaauucauauggucucuucaauagaugcugaaaagacauuacauaaaagucaacaucuauuuucguuuaaugucuuguuuugaaauauuuuuagauuuacaguagaguugcagagauagaguguucucacagcauuuucccagcuucccuuaaucaaauuuauuuuucauuaacacuuuaauaaauuagaaauggauuuuuccuuauuauaaugaagacuaucugaaaccaacagcuaacaucauacuuaaugguaaaaauacuuagaaauguuuccauguaagacaagaguaauacaaaguuuccugcucacucauuucagaacauucugugcuuugcaguaaggcaggaaaaggaaaucagaaacagaaaaagugauccuccucaauaccuauaacauccaaagaguuaauugaauugaaaaucuaacauugaugcaaucaguggaauggcaaaaguacaaaauaaauaucuaaaacucccuucuagaauaaagacaaaguaauugcuguuacaacaacugacugcagugccuuuggccccuaaaucauguaauuuuccucuuguaggacaagccugagaaggggagaaaugugaagagaggucuuggggaacaaugggucuugucugaggagaggccagggguuuaauaggagacaaauagugagaaauuagucauagugggcacagccaagggaccaaggguuggagcuuuuaucaggaacagggcugcagaacaagaaggggcaaugauaugguaaaugguuuguuuuuuaaaaguuucauucucggcugggugcgguggcagcacuuugggaggccaaggugaguggaucucuugagcugaggaguucgagaccagccugggcaacauguugaaaccccaucucuacaaaugaaaaacaaaaaaacaaaacccacaaaaauuagccuggcaugguggcgugugccuguagucccagcuacuggggaaguugaggugaggaucacuugagccugggaagucaaggcugcagugagccuugaucucaccacugcaccccagccugggugacagagccagacccugucuuaaaaaaaaaaaaaaaaaaguuuuauuuucuaaccauguuuguaaauaaauaugcaguuuuaaaaacagcuuaaucuucugcaaaguugguuucauaaaaguaaaaacagcuuaauccaguauauuacuaaggugcuuuuaauuguaguuauuuucuguagaauauuuucuaugcugggaccacaggugugugccaucauacucagcuaauuaaaaaaauuuuuuuuguagagguggggucucacucuguugcccaagcuggucuuaaacuccugacuuuaagcaauucuccugccucagccuuucaaagugcugggauuauuggcaugaaccacugcaccuggcugaauuuuucuuucuuucuuuucucuuuauuuuuuaaagagauaggcucuccuauuugcccaggcuggucucaagcuccuggguuccagugguucucucaccucggccucucaaagugcugagauuacaugcaugguguucagauuuuuuaaaacaucuguuuaauuugcaguaucuguuguuuaacuggcaaguuuaauucauuuauaucauuugugauuaauacguuuggacauguuugugccauuguaaccacugauuuuuaucuguccagcuuuuucuauguuucuucuuuccaccccaccccaucuuguauuuuuggaggauauauugcauuuuuauucuuuuguuuauauucuauuuuuuucuucuuacucuuuuggaauuuaugcacuauauuuucuauugguuucccuugaaacuuuaccauccauauuaagcuuuaaaagguuugaaguuggcugaugugguggcuuacgccuguaauccuagcacuuugggaggccgagaugggcggauugccugagcucaggaguucgagagcagccugggcaacacggugaaaccccgucucuacuaaaauacaaaaauuagcugggcauggugggugcgccuauagucccagcuacuugauaggcugaggcagggaggcagagguugcagugagccaagaucaugccacugcacugcagccugggugacagaccgagacucugucucaaaaaaaaaaaaaaaaaaaaaaaaaaaagguuuaaaguuaacugucuuaaacuuucucccaaacccaguugaauauuuuaauuuuaaugauacccuccuaugucaaacuuuaguucuguccuuaaaaagaauccauaaguuaaacaucuuuauuauuuuauguagacuuauauuguuuagauuugccuuuguuuaccauuuuauuuauucaucauuucuuuuugcaaacaagacuucuuugugggauuauuuuuauuaucccaaagaaccuuaaaagcuccuuaaaugcaggucccuuagugguaaauuauguuuccguauaucuguauaucuguuuuguauauuuguaaagauauuuauuucauucuuauucuuuuuuuuuagauuuuuuuuuuuuuuaagagacagggucuugcuauguugcccaggcuggucucgaacuccugggcucaaaugauccuccugccuuggccucccaaagugcugggauuacaggcaugagccaccauguguggccagcaguuucuaaugcuuacccauccugagaguguuuuuaaaaaauauuuucaauggacaaaucacaguuguauacauuuauaggguguaaugugauguuuugauacauguauacaauguggagugguuaaaucaagcuaauuaacauaucucucaccucacuuaucuuuuuuuguggugaggcauuugaaauuuacuccuagcuauuuuaaaauauauaauggauuauuacuaacuauagucacccugcuaugcgauagaucucaaaaacuuauuccuccugucuaacuaaaacuuuguaucuguugaccaauguaucuauauuuccuacacacuuaaaaugucaacaagaucuucccagacuaaagauuccaauauuuuuuccuuuacauuuugaaaauaucauuccuuucucuucuucuucuguuuuuuuuuuuuuuuuuuuuuuuuuuuuuuugacagaguucucgcugugucacccaagcuggggugcaguggcaugaucucggcucacugcaaccuccuccuaccagguucaagcaauucuccugccucagccucccuaguagcugggacuacaggcgccugccaccacgcccagcuaauuuuuguauuuuuaguagagaugggguuucaccauauuggccaggcuggucucgaacuccugaccuugugaucugcccaccucagccucccaaagugcugggauuacaggcgugagccacugugccuggccucguuucucuucuuauacauccagugcugauauuaaaaacucuaaugucaaccugauguuuguuucucuaaagguuuucugccuuuuuucucugguagcuuuuagauuuuucuuucuuugauuuuaaauuuuacuauaaugaaucuacauguggcuuuuucucaucuaaccuguuuggcacuaagugagaucuuucaaucugaaaugucguaucuuucuuuaauuguggugaauacuugguccuuguuucuuuagauauuuucgcuucuuuucauuccuuguucguucuguggaaccgcuguggaaggauguuaacacuucuguuuuaucacauuuucuuuucauuuuaaaaauccaguccugaugccuucugagagagugccuugauuaaucuuccagcucaccaguucguuuuuccaccacacucugcucuucuaccaguccugugagugcccuuagcaaagcucuucuuuuucaaaccccauauuuucaaucagugguuucuaacugcucguuucuacuugcauuuccaguagccuccgcugguuugcugaggcuaacuaugguauuuguuuuguuuuaaguuuuaguucuuuguuuucuauuaggucugcuucuucugucuaagucauuccauucuuuuuucuuccuuuuauaguguagauguuucucugauuucugguucuuucugccucuggcauggaccuuuuagugcuuugugaugcuuagcugucuugccuaaguuuucuaccagggggugaaugacaguagcucaggcacuaccuguccucccuagaugagaugacguggcgagagaaggugcccuuuggacugaaguguaaccagggacccuuaacucccugccuuuccuccccucccuccaaggacuggcccuaggcuuugcuaacucugccuccuguggccuguggaaaggugcugaguagggaagaggcauaggcaggagcuggcuggcccaccauucuucuucccagaggugacccccucuaaggcaggcacugcccugauuucacagcagcccuuccagcuggugcuucugcuuaucugcccaugacaaugauguggauggcccagcuagaggagccuccuugaaucugccucugcucuguggcccuuaauguccgauuguccuggacugucccugcaaucgggaaccacuucugcucugcacggcucucugcucuucagcucccuuuauuuuguguggcgucuccacaacuggauuccaaggagggagcuggagaugggcacguucuccacauuguccagaguuggaagcagugauccaaaauucauagauuugucaagaaacuguaccauccuuugcagaaaauaaaugucauuuuuuauuugauuagauucuguggaauauggaucuaagcaccuggaacauuugaucccccuaagggauauaaucuuacacagucuuuugaggaguaauuauuguuuuucugugaagucugaaaagugaugcaauaacucuuuccucuacaaagugugaugguuuuagugugauggcaacacgugaauuucugaaggauucuguauuuugaaagcuuuauuaucaauggugaauguuucauucauacaacugucauacaauucuuggaguugaguuucuuggaauuaauguggcauuguuuuuaauuaucauaaauuaagacauguagaauauacuaggcauaauuucuaguacuguguguguguauaggugugugcauugaggauauagcagcaguguugaacuauucucagcaauuacugagugcauugcugaaacagggaauuagauuucaccuuccuuuaauauggugauguauuucccauccuugcuauuucuccuggguuuugauuaugcuucccacaaauaacuguagaauuuauauaguuuguugcucuugcccauucauguaaauuuuuagacaacauaucuguacguuucuugaaggcaggaacacugagucacuuaccaguguauccucaguuacuaaauauuugugggagcaguaagcauuauaauccccuguuuuaaagauguucacauuggcacaggaagagucaaacagcuuggauuaucaguuaggaauuguguucagcugugaguaauggaguuacauaaaguuggaguccaucacagauucuccacguugacugcaauuguaaccaccugaggagcuuuaaaaaacuaccacugccugaguuucauccccagagauucugaguuaauugguccaaguguaugugggggauugggauuguuuaaaaaaagucugggcugggugcgguggcucaugucuguaaucccagcacuuugggaggcugaggcgggcagaucaugaggucaggagaucaagaccauccuggcuaacauggugaaacccccaucucuacuaaaaauacaaaaaaaaaaauuagccgggcguggugacgggugccuguaaucccagcuacucgggaggcugagguaggagaauggcgucaacccgggagacagcuagcagugaaccgagaucacaccacugcacuccagccugggcgacagagugagacuccgucuaaaaaaaaaaaaaaaaaaggccgcagagaauucuaauaugcagcauuuauguucugucacauaaaagcaguuuggagguagcuuuuccggguugguuuggggauuccacagaaaucagagacccaugcuccuuccagcuuucugcuucaccaucccuagaguguggcauggaauuucagccauugcauucaucuucuaaaaagcaaguggaggagggagggaagguaauacgacagcauuuuuccucauuaguuagaacuuagucaauugaucacaucuaagugaaaggaaggcugggaaagauauuccggcauagcauguuguguccgacuaaaaacuagcguucucuugagagagaagggaaauagguauuuaguggguaguagucugucucugccacaccugguuucagaccgcuaaucaaucaguggcagagcugaaauucagauccuggcuucaacccaauaauguuuccacuccucccaguaaaaauggaaugaggauguuggaaaauagcugguggauuuaggcaauacguguuuggaagagaaguucuuuuccuuucucuugggcuugcugcaucaacaacaacaaaacaaaaacggauuugcuugacaauaaauuagggccaugggaauccaugaaucuagaaauaaacagaugaguguauggucacaaauaggauguuucaguucuuacugacacuuugucagcauuugacauggucacucuguccuuucugugcuucugguuuuccucucugccuuguuuucucuguucuuuucccuguuuaauguuagaauuccucaagucuuggucccaggcccguuccuuccugccuccccuuguccuccuuguuccucuuucugggcaaucucaucuaugccuguggccucaauuucuacuuauuugcagaugauuugcaaauucacaucuccaacuccgaccgcuccugggcuccagauucauccauccaacggcuaagugacauuucuuggaguaagguauuucaaaugcagcauucccaaaacugaauuccugccucaucaaaucuugucaacugaaacucugccaucaccaccuuggucuaggcuauugccaggaucacuguagauaucacuuguauuaagguauaauuuaaacauuauaaaauucacucauuguaaguauacaauugaguuacuuuuaguaaauuuauauaguuuuguaacuaucaccacaauucaguuugagaauauuucuaacaccaacauuuuuuuaaaaaaauaaaauaaucccuguaagcaguuugcagcuaauccugcucccacccuuagccccagacaaccacuuaucuuuuugucucucuguuucccuuugcuggacguuuuauauaaauagaaugauacaauuuguaguguuuuucaucuggcuccuuuagcauaauguuuuugagguucauccauguuguacuuuuauugcugaauaguaugccaugggauggauaugccacauuuucuuuauccauucaccaguuaacauuuaaauuauuuccaguuucuggcuacuaugaauaauacugcuuuaacauucgcauguaagucuuugguguagacauuuguuuuaauuucuguuuaguagauucuuaggagugaaacugauguguuguagguuaaguuuauuuucacaagcagauguucuauuucacauuccuaccaagaguguggaaagguuccaguuucuccauauccuuaccauuugucauugucuuuuuaauuauagcuguucuagugggugugaacuggaaucucauugugguuuuaauuugcauuuuucuaaagacuaaucaugugcaucuuuucauguauuuauuaaccauucauguaucuucuuuggugaaaugucuucuuuggugaaaugaaauauuuugcauuucuugaauggguugcuucucuuaguuuugagguguaaggguucuuuguauauuuugcauguauauacuugguauuuagucaaagauuggccagagauugugcuuuagccagaaaggcuuugacucugccccucuaucugcuuguuaggagggagcacauuaacauuucaggcuguuuccguguccuuccuggcucuuacuuuuuaucgcucuucccugugccugagcauaggcucuguugaccaaggauguaugggugccgugggccugcucuggucucugcugcaguugugcucaaccaccgguuaacagauacaugaaaaguuuagccccaugguuuucucaccuccugaaauucccaauuaaaucccuggcuagucugcugguccguggcuugcuccaaacugggcagcaaccucaggccaguggagccccuggucuucccacugcaucugccugcaauugccacuuuaccugaugaugauccgaaucaugugagcaauugcccucacccucgcccucucccucucccucaggcagcagaacccugcugccccagucgaacuaccggucagcauugcuaggaggaggcuggggacagcccaggcaugauccccaagcucugcuuguucuuaucaaaguuuggucaguuucuacuguucugaaaugguugcuuuugacaguuuuguccaguuuuauaguugacuuuuuuggggagagaauguguuagucuccccagucgucacguugagagaaagcgagucucugcagccgccuuucugcucccucugcucccaccuggcuucuuuccuggccuuucccuacuuuggagcuagaauucucuuucuacaaaguaguucugguucugucccugccgcugguugauguuaggauaaagucccgccacgccuuguaggcgcagcaugguuugcauugccuacgucuuuagccccaucugauaacacacauucuuuccuucucuuugcuccaaacacacugguuuuucuccauucccucuccccacuccguccucagggccauacacgugcuccuuccucugcuuggaacucucuccucuccucuuccccgaguccauuucuucacaccucagaucucaguuccuccgucuccagacaggcccuaguaagucaaauucuacuaauugacucacuucuauuacaacacacaaucacagccagaguuuggcacucauuuuagugaauauuuuauucucugcuucccucccccguuagaauaggggcuuugucacccauaccacauguauccuuagcacaauaccuggcucauagcagauaguaaaaauuuuuccgaaaacaaaugagugaauucuuacaaauaaaacuuaguuuggggacuuggagcuacccucuucaaaacauuguugagcuuuuauauggauucucuucucuuuaaccauuaccugaauaaacuuauccagagugcuuuauucauaucacagaaccuauguacaguugaccacacugacagcugagugugagccccugccaaauaauauuuccguggcacuggcaccccccaaaaauggcaaacacaagcucucaaguucugucuuguuggcauuguaguaaacugcugauacaaugcaauaugagcaucagcaucagaucugauuuacugucugcauuuaggaaugugauaugaacauuuggaaauucuuguuuuauaagcaggcagaccuuugggcacagagacggugggauggacugcaagagcgaauuagccagcuuuuuguuuuugcaaauguggaaaucaagucuuagaguggauaaagaacuugcccgaggucacaaaaaugaaaacaagugguucccaaagugugguccuaccagcagcaucagcaucaccugggaacuuguuagaaaucaaauucuccugcuccacccagaccuccugaaucauaagcucugggggaggggcccaggaagcuguguuuuaaccaacuuccaggugauucugaugugggcaaagucugaaaaccccuggccuagggcauaauuaggucucugacugccgaaucacacuaccuuccucuaugcuuuguugccccuagagaaaaaguaaaggacacuuugaauucagggacgguggaauuuagagacuuaguugauguuuagggaaaaagcugagccauggggcuuguugaugauuggguuugcuucuccuggccuccacaggacagcucccaucucucuugcucuugguggguacuaaacugggguugcucacccacuuuuaccccagggcuuuagcuaguaucagaauuuuuucagcgugacuuucaggauggguguguuauaguacaaagcagagacgugaaucaggacuuagcucauuuccagguaaguuccaacaucgucaguaucaagaauaagauauaauuugugagcauuaagacgcagauugguaucgaaauuuucaccuaaagacaccagaaacucaagaguuaauaguucagagggaaaugaggcaauauugugaaagccuauauuaauucucauaagacaggucucaguucuuucgggcuuaaaucaacuagucuuuaaaagcagaucgagucucaucauagaucaaauccaagcucagugcaucaaaucuugaguuaaaaguucacuuugacuuauucuggugcuuuaugaggucuccaaagcagcagccucucaggcugguggcucuuaaucuugaggugcuucacucagccuggccccuggagccccucugcucaagugagcaccuucauaaugccaggugaugaucccauuaugcaggaacucgaugccaggugauuucaaacaaugucuuuaaaccuuucucaaaaacacuuccagagugacaaaaccaagaaauccacugucugggcugcugugauuuaggaaagcugggguuuggcuguuuuugacuaagacaaaaugagguuggcuaaugcuuaaauaacauucaucuugguuauaugggugugugggugcucagguguuugaaugaaugauugagagaaaugcuuggcauaccagauggaaaacagggugaugaauaacggaagguuuuauuuugacucugauuuugcacuguuuuuuguacuugagggugcuucugaaucacuuggaaaacuucuugaaauucacauuuccgacuuccugaccuucacaaagauccucuagguguagguugagagucagaauccacauuuucaacaagcuuuucaacugauugagaagcagagagcaacuggaccaaacuuuaagaaacauuauuuuuauuaaguuuuaaauugacacauaauuguacauauuuaugggcuacauagugauguuuugagacauacaacauaccaugaucauaucaggguaauuagcauauccaucaucucaaacauuuaucauuucuuugugcugggaacaugcaauauccuccuccgagcuauuugaagcuauauauuauucauuagcaucauuguauugugcuauagaaugcuagaaauccucccgucuagcuauaaguuuguauccuuuaacaaaucuccuucuaucccucccuucccccaacccuucccagccccuaguauccucuauucuacuuuuuauuucuaggaggucaauuuuuuuuuuuuaaguuuccauacaugagugagagaauauguggugguuaaauuucuguuccuugcuuauuucacuuaacauaguguccuucaguuccaucuguguugcugagaaugacaggguuucauucuuuuuuaaggcugaauaauguuucauuguguauauagaccacauuuucuuuauccguucaucuguuguuggacacccagcuugauuccacaucuuggcuauugugaauagugcugcacuaaacgugggggugcagaugucucuucaauacacugauuuccuuuccuuugcauaaaucccaguaguggauugcuggaucauaugguagcuguaccuguaguucuuugaagaguauucauacuguuuuccauaauugcuauacugguuuacguucccaccaauaguguauaagaguucccuuuucuuuguaucuucaccagcauuuguuauuuuuugucuuuuugauaauagccaugcgagcugggguuagaugauuccucauugugauuuugauuugcauuuuccuaaugauuagugauguugagcauuuuuucauauauuuguuggacauuuguauauccuuugagaaauaucuucagaucauuuuuaaaugaugaauuuaaaaucagauuauuuuuaaagcagauuauuauuauuauuauuauuuuuuccugagauggagucucacucugucacccaggcuggagugcagugacgugaucucggcucacugcaaccuccaccucucagguucgagugauucuccugccucagcuucccaaguagcugggauuauaggcaugcaccaccaggccuggcuaauuuuuuuuauauuuuuaguagagaugggguuucaccauguuggccaggcuggucuugaacuccugaccucaggugaucugcccaccucagccucccaaagugcugggauuacgggcgugagccacugugcccagcccauuauuugugguuuuuuuucgcuguuguuugaguuucuuguauauacuggauauuaaucucuuguuagaugaauaguuugcaaauauuuucccccauucuguagauugucuuuucacucuguuguuuccuuuguugcacagaagcuuuuauagcuugaugugaucacauuuguuuauuuuugcuuuggcuuccugugcuuuugaggucucacuaauuuauaaaaucuuuucccagaccaagguccugcagcauuucccuuuuguuuucuucuaguaguuuuguaguuuucaggucuuacauuuaggucuuucauucauuuugaguugauuuuuguauaggauaagagaugucucuuucuucugcauauggauauccaguuguccccgcaccauuuacugaagagacugagcuuuccucgauguauguuuuuggugccuuugucaaaaaucaguuggcuguagauacaggaauuaauuucugaguucucuauucuguuccauugguuuaugugucucuuuuuugugccaguaccaugcuguuuuggauacuacagcuuuguaguaucuuuugaagucugguaguguguucuaauauaauucuuauguaauagacuauauuuguuccuggcuuggugaugagccugaggacccucugacaauuuaguaccaccugggguguguuggaaucucuacaucuuggugguuugggaggauggugaugguggcaguggugggacucuggucacagacaaguagcugagagauguaagaagaccacugcauuucucuagucauugccacaaauuccaagaguuaagaagauuccagauuuuaaaguuugguugggauugaguuugccugcaggugcugugccuuggaaccuguuguaagguuuuggcuguaggauccagugucuuacuuccaggaaguuugguuaucaugagagaaauucuagaaaacuuacuauuuucuucuaaaccucuuaagguuuuugaguauaaacucuucuaagaugacaagacuacuauagggaaggaagaaaguuucuuuucuuucuacccucuagguugagcauauuuugggguuauauauuaugcuuucuuuccuucaccgcaaugauuaaggcauuacagccccaccuggagauguguagauaccuccuaugugacacugguagcuccaaggaggaaacuuuuugcugacuuuagucuguugaucucuggagaugagaaggguucaacaaaugauuaccagaugauauuaauuuuaaaaacauaugggacacucgggaaaaugcauccauaguuuggccccccacuucacauacugagugugcuuuauuuugcugacuuuuccugaguuuuucuguaaguaguagauuggaaguuuuauaaacaagguacuuguugaucucagagauggugaagcuuuagauguuugugcacaggagggaccuggaaggcuacugaaaccucaagaaucaguguguacauugcuggaaagaacugcuccuuccagcuuggaccuuguaccaggcaaaucuuuuagugggaaccauguggggguggggagaugcugaggguagggagggucucagucucugccauuaguguguucgugggggugucuguugacugcaacucuggaagagucagguaguaacuaucccacauggagaaggguuuucuuuuuuuuuuuugagauggagucucacucugucacccaggcuggagugcaguggcaugaccucggcucacugcagcccugccuccuggguuccagcgauucuucugccucagccucccgaguagcugggaguacaggugcaugccaccaugcccagcuaauuuuuguauuuuuaguagagacgagguuucaccauauuggccaggcuggucucgaacuccugaccucgugauccgcccgccucagccucccaaagugcugggauuacaggcgugauccaccgcauccggccaggagaagggucuuaagcugaagaacauggcauaguugccauuggucaggacgagacagggugcagaagucuguucacaggccccguucaugcaguccagcaguuuggagcagaugcgucucagaagauagaggccugaggaaggcgaggcagaucucagcagggagguccacccucuccaugaagcugcggucagcuaggagcuuggugcucauuccucuuucacguggcagaaggugggccuggguagguaaggggccuucauggcccuggacuugaccaucuuguguggcagugagggacugauccucaccaggacuaagaggagccugagccccucuugguaauagcaguaauguggcuauguaagguaugcugcucagucauuaaagagagggccauaaccuccccuucuugggcccuuuaugcuuguuguuuuaauuuucacuuuuaaauuuagaugaaaugauuuugcuuuuuguuagaaccagccugucuagcagagugcuucaaagaaagauuuuuuucaugcauguuuguaauucucuuguaguuuggcucuaacuucuggcugucagcaugagugagcuguuucccacugcagccccccaccccccaucuccuucuccuuucuuucuuucuuucuuuuuuuuuuuuuuuuuuugagauggaguuucgcucuuguuucccaggcuggagugcaauggugugaccuuggcuuacugcaaccuccgcauccuggguucaagcgauucuccugccucagccucucaaguagcuaggauuacaggcaccugccaccaugccaggcuaauuuuuuuuuuuuuuuuuguauuuuuaguagagaugggguuucaccauguuggccaggcugaucuugaacuccugaccucaggugaugcacccaucucagacucccaaagugcugggauuauaggcaugagccacugcaccuggccucuccuuucuauuucucuucuugccugggguuuggcuaaggguuguuggugaaauccuaggcccaguuccuuccccgacaaaggaaacauguaugcuuuugucagcuuuuagauccuaaaguugaaccuuaaugaaacuaugucggguagauggggguguagaggcagcaaugaaauggguaccugugcagacagaugaugucucagagaugcaagacuggcaaggcacagugaguggguaagggcagugcagugugugggugugaacgagugagaacaugugcaggugagugugaauaugcaaaugcaccuucaagggugagugcaugggugguuaugaaugugugagugugucacacucuuggugccuccaguugugcaagugugcaugaguuugugaguaugugagugugaacauguguaagcaugaaugcaaguaccugugugaguguguuuauauguauagugugugugagaugcauguauguuugugggcaucagugugagugugucacauauauaaguguauaugaggguauauaugugugcauuugugcuucuuuuggaaacaauggauauaucugaaggauguuaguaggcaauggcuuguccucagcccuucccaggaaggggccuacacuugcccuaucucccagcuuugggauugagcaaggguuucaccaagaagcuagccuggugagaauuaagauggcuuuccucauggguuuguucgcuuucuucccucauuuucccuuucucccugcagcacaugcuuugauuuuuuuuuccucuuuuauugauguuauuuuuaacauagcaaagaaaguauguucucucuggguacaauuaaguucaccaacacagcagucaaguugcacacuguagcuucaagaaguuaauuaauaaaccccagaacguaggaauuagauuugccuuauucuguucucuagaagggaagaucuuuaagaauguuucaggauuuuaucugacaauuucacuugguuuaaugaagcccgauccagaaauacgguuuacuuuuccauuuagaaugaaagcugugacuuugagauauagcugcgugcuccuaacagcaguaccugacaaagccaugacccugugggaaaccaaauuuaauuucuuuccuaccagggaaugugacccacaggaauucuuaaugcuauauggacagugcuuauccauauaugacacaagcugacuuaacugucagaggccaugcugaaagaacacuuguugagucuguugcaauuuuuuucuagucuguuggaauuuuuaaucagauagugucccaucagucccuuccaaauauaaaaauuuuaacugucuuuagaagaggaguaaauuauugauaacucuccuuaguacacaugauucaaaccugugcauuugcauugaaacuauuuuagaaagcaguggaaacauguucuuuuuuuucaucugaggcagaaaguuaaagaugucaguuugaaauaguuaaugugaaaaaucauuaaugugucccuauauucuauauaaugugacaucaguugguuauucugucauacuuacugaaaaaauaaaacagcguucaauucauuucuuuauaccagcuccuaaauaauguccucuucaauuauauaguuauuuguuugaacaggaugcauuugggaagcugccucuaggagagagaaaagcuggcaagcuggcagguucucuguggauaaguugguaggagcgguaaggagagaaaaguuaagccuuugcuucauuccagucaauggcauagaguagauggggaaacugaggacauguuacuuugccuuuucauugaaaguuuauccccuuccuuuucuacuuaccuuuguguaagaguggcauguggccaggcacgguggcucaugccuguaauuccagcacguggggaggccgaggcggguggaucaccugaagucaggaccugccuggccaacauggcgaaacccugucucuacugaaaaugcaaaaauuagcugggcauaguggcaagcgccuguaaucucagcuacucgggaggcugaggcaggagaaucacuugaacccgggagguggagguugcaguaagccaagaucacaccauugcaguccugccuaacagagcaagacucaucucaaaaaaaaaaaacaacaaaaaaaaaacaggcucaugccuguaaucccagcacuaugggaggcugaggugggcagaucaccugaggucaggaguuugagacuagacuggccaacauggggaaaccccaucucuacuaaaaauacaaaaaaaauuagcugggcgugguggugucuguaaucccagcuacuuggggaggcugaggcaggaaaaucacuugaaccugggaaguggagguugcagugagcugagaucgugccauugcacucuagccugggcaaagaagcgagacuccaucucaaaaaaaaaaaaaagaguggcaugcuugucaaaggggaugcugcagugcugugucugcagguguguguaggggggcacacauggcacaacgugcuguagugugagccuaccuagucuccuuccucagcuugaaaggaugauuguucauguucuaacuugccaugagcauugucugcacagccgcagucagaaugacauuaaauauaggucaaguggaagacacuccucaaggcagucagcacuuaaauaauuugaccauuugcugcucagaaguuacccugguucuucucucauugagggaguuugguuuuugccccacauuaaagaauaggggcaaauuucaaguagaaggaucugaaaauacaaauaaaaaggguuuuuuaugucuuuguuaauguaaggcuagcagcugcuauaacagauacugauccccguggccuaguuaaaguuucuuucuuauuaauauaguggucugauguggguguugcucagcaggugaugcucuuccaggugguguuucagggacccaggcucucccaaguugugcuguagguugucuccauuccagugcgugugugugugugugugcgugugugcacacuucugcucacauucuauuggcuaaagcucaaaaagccacacccuaagugcugggaaggcugagaaauguguucuggauguggcuucucuggaagaggaggaaagggauuuguugaugguaguuuacgccagugauuuucacacuucaccugcagcagauuaccuggaagcuuguuaaaacaguuucugauucagcagggcuuggguggggcccaagauuuuccauuucuaacaagaucccaggcaauguuguuacugccggcuuggggaucacacuuugaauagcccugguucugacacauuuuugcgucuucguuuauccacgcuguucaugagaaccagaaauaccguuauuagaaugacuugagagaugagagggaagaagaguaaaauagauaguagucuuggccagaccaucugaaauauuaaaaauaauucaaaguggacgauuucuuagaggaauuggagcuuuggaggacugccacccgggcagucaugugcuaaugagauggcugcgacuugcucccuugccggggccauaaguagggaccucuacugccaggcaaaggagcuuucagcuucauuaucucuguuggaacagggagauuuggagaaugaaguauguaaauagguccuggagaagugauauggagaaguuacaaggaaggacuugagugagaaucaaggaguuucaguuugcuggaguggacccgagccugaacuuuggacacagaagaguugaacuuggauuuuaaauuccuucaagucucaggauacguauaauguggggauaacaucuauucuguuggguuauugugagaauaauuuagagguuugugaacuuugcugguuguuggugcuucuagguuaaaauaaguaucuaacagauucauuuuuuaagugguuaguuccaaacaaccucauacauauuuaugucuaaacaacucaguagcuauuugaaaaaauaauaucaauugaaagaaaaauauuuuaguuucuuaaauaaccacaauuacuuauuaaugggauguguguaccuguggguacugcacagcuucucaaaccuuggaaucauacuggacauugcuguucucuuuuccuguucuacguugauguuuuuuuuuaaaucguagcaccugcugaaacucuuugcaaaaauaugauggcaucaaaaggaguguagugcaauauaauguuaaaacugugaaaagucccugaguugguaguacagacgguauguugagucucgccauguaucccucaaaaaauguaaaauauguugcauugccucuaucaguucacuguaugacccgggugcuuugaugcauggauggagaaacgugggauuuaguagguuuuuuucuuuauucauuccuugcacaagugcuaacugaguagcaaugaacuaucaggcacacugcugggcgcuguggggaggaaaacacuuuccacuuccgcagaguguagucuaguggggaaaccagucauugaaucagauaaucacacaaauguagacuucaaauggggccaguaccaugagggagcauuucaaagugcugcaagaaagaauauuugacccggucaggagaacuugacacggcaagaagggguaggaaccauauuccaggcagggggaguagcauucugggcaaguguuuuucaaacuaucuauggugaaggaccugcuucacuccaucugccaauugcacugucauugguucaugacuaguauguagcuuguguggaccacguguguuugacaacuucugaacuguugagacuuguccaacugaucuaugcauuuggauauugaaacaaagccaaaugcaggaaauguuucaaaagggugugguggacugguaacaguuuguagaccgucaaaauuugcagaccacacuuugaguaacugcuccagacagcaagaacagcaugugcaaagguccuguggcaggaggcaacuuggugacuaugaaggaagagagaaaagacuagugucaguggaagaugaagugagaagguagaaaagucagcaggggcgggccucaaggccacaguaagaaucugaggcucaggugaagacauuucccuccugguggagaaggggaaauugucuugacuacuuccuagguaauagcuugagaaaauuaacaggccagauauuuggcuacaaagauucauugugugauuuaagcaaauuggaguucuucuucuuuuaccauggauguagaguucaguggcauuucaacgucccagagcagggggauuccuugccuucgugugaaugggccugcuagagcguguccagaugguugcagaagcaccuccaguucccugacagaugcugccaggugcucaggcuccuuaugguacccaugccacuggcaggaaguuggagaccaagcuugcugcugcucucugggugugaaacuaccucuccuggaggccuugugaauuucaacuguuccugugaauucauguggagcauguugcaagaggcuguguugcaaugcuucugccagucucugucauucugagguuuaaugugguauccauggguacugggugaagugugggcauggcaccaaauccugagugguccuggcccuugcccacaagugccccauuaugagcgccacucugauuuaagaauccagugcucucucccuacucaggcuaacuucuaugggcaucugggagggacuuuugguuuccagcuucauggauguggagucuugauguugacuucuggaucacuuugcuuuuuucugcuuugcugugcagaauaggguaggagagaaaaaugauguacugugguuucucugugcagguacuucguacuggauuucgaggcuggcauccugcaguauuuugugaaugagcaaagcaaacaccagaagccucgaggaguccugucuuuaucuggagccauagugucccugagcgaugaagcuccccacaugcuggugguguacucugcuaauggagagauguuuaaacugagaggugcguucuucucccaguaacuuuucagacaggccucuaguugcuauggugauggcucucuuguuuuuugauuuuuuguuuuuuuaaauugccuuugacaguuugcuguguuuggaggacucuguggugacacacauugccucucuuaucccugggguggggagauggagcugacauuaggaauuacuuguccuaauuaacugaggaauuaaggacaaaggaaaggugagugauucccaaagcagcgcgccuuaggacuucgaagaucuuaaguguuagcucaguauauucucuuugacguaauaguaugaaucuucacuacagugcccugugagggcugugcuauaagggcaaaaaaagaccuuuaaggguccuaguguuuuccccccaaaguuucucuagaaccguuucuuaguaaagugccccuuugaguuuuguucaauccacugucguagagccuggugagaagccaacuggaauggaguuaaugucccuuuguaugcuuucuucccuucucuuugcuucuugaaaauggauaucuuugcuuuaauaaagaaaaaaaagaaaauggauaccugcccagcaucccggaaaugaggaugacuuuccagggaguccaguauucacccucaagacacauccaucgcacagaaaugucagacuuguaauaaaauugcaguguaauuugauugcuagaucauucuaccaggaucugucaugguugcauugcugugauucuucugccacuuuucuucuaauaaaauaaugaaaugaaacaacaaaucuaaaugcccacaagugcaugcacacacacacacacacacacacacacacacacauggacacgcagagucuauauuauuuaucaaguccugaggaaaaguaguauguauuaaguauugagaggugguugaaaauucugccuuuuuuaauguaacauuuucuuuugacuaagagcuaaguaugaagaaacggcugcuugcuaucuguucgugaccaugaucaguugccucugcaaagucagacugagggacuacauuccucaccucucagcccaguuuucaccauucuucugccaagcuucacuacccaagagauggaauaagcuaauguuuauuaucuauauacaagucauauuucagaaucuauaaaacaauccaaaaaccucggaaguaaaaaugucuauaguugauaaaaaacuuucaggaaugugauaagauucauguucucuugagauucaugcagugugcauuccagcuggcuagauuuauaugguccuuggcuucgcuuugccauuuauugcuuaauaaauugucagugcagaaacaauagcagacgaaaaacguaauggcacuuuccacccugccugugguuuauaaaaugauacaaacccauacaaaagaaauauccaacuaauuugacaauugagccaucuuguuuugccauugaaucauuaauauccuuuggauuauuaagcccuagguuuuuuuuagagggcaauuuuaauagcaaauauagagguuuuaugaucugcauggaauaaucacaauugcuaaauuuagcuaaagcguaacuauaaaaaaaagucaggauaaauuucugcauguuuauggcuuguccuuagcccgucccacaagcaacuggcuguuggugucucauuucacaucuuaccugcacauaguaggaguuggaucaugguaucaugagacgcacagcuuuugggaguauuuuugaugcaaagccuuuggauaguauugccacaaacuggcaauucuucaaguuuacuaaggaaaaaggcccuaauuucugcaaaguccuuugucuuuggaaguucauuacaccugguacacacuguaaaucagacuuguguaacaggccuuuugacagacaaaucauuugggauuuguaggggccaucuucaugccuuaaauaggacuaagcaacgaauuucccauuugguaacucuagauuucuucuccugaaaguucaagcugaagucagguuuuauggacaaaugacacuuaggcccaguuuuguaaacagauauaauuuccagggaaucguuguuuuuuuuuuucauagucaacauuuaugcagcuaguauuauuauauuuaugcaguuauuuaugugauuaaauugaugauuuagauuucauuagaaccuguugugugcccaugauauuugagaauaacuucauauauauuauuugagagauagguuauagauggaaggacauaacuauacaacaugacuacuugcacuuuaauaucucuuugggggaaauuugaggcucucuaaggcagcauuugguaucuugcucuuugcaaucguaugaaucuuugagagcauacuaaaaugguaauucaacugaaugcuuauuuuguaaauguuaauaacaccacaauacagcccugguagauagcaaaaggcccugaaaaacugcccuuugaggccgggugcaguggcucagccuguaauaccaucacuuugguagaccaaggcggguggaucaugaggucaggagauugagaccauccuggcuaacacagugaaaccccaucucuacuaaaaaauacaaaaaaaauagccgggcaugguagcgggugccuguagucccagcuacggaggaggcugaggcagaagaaugguaugaacccaggaggcagagugugcagugagcugaguuggcgccacugcacaucagccugggcgacagagcgagacuccgucucaaaaaaaaaaaaaaaaaagugccauuugauacucauauuagcuacacaagguuagaggcauuugaaaauaagcaugugguuccuugccugcuuucuuuuuaaauaaguauuauagaaaugacuuuuuucagaggaggcuaaaaaauggcaaaauuauucuuauaacggguauuucagaauccauuuuucauauggcucaagagaggauuuuccgugggauucagugcagucucuguuuugguguaaguacaggccgcuugagaacguugugaucugugcuugcuuccccaccuucuugcuaccucucacuccccaggcuccccacccccuuagguggguguagaaauaaguuggauguguuuuggaacaaucucugcaaucauuucuuucucuguuuucucuauuuuagcugcugaugcaaaagagaaacaauucugggugacucagcuucgagcuugugccaaauaccacauggaaaugaauucuaagguaagucaccgugagaaaggaaggaggcauucgaauaaccagccuggcuuucagccccauuauuuguuucuucggggaagguguuuuucauguuauuuuuuaaguugcccacugcaguggaauuccuacuuguccugcugcacauaaauuuaaagccaggagaaauguaguaagauuuucuuguagguagaauacgcaggcacgcagacacuaugggaaccgaaucuggaaagacacuuuugcauucuguugucaauuuaggcagcuguuaauuggucuauugagaagcucuaguggaugauuucauuguggagauggaguugucagauuuacaguucguaaaucuaguagccaucaccgauccuuaaauaaaaccuagacccugaauugcuuauguacuuugcaaggagcuucugcauuccuaguguaucaaaauguucucggguaauuuggcauccaaguaugauuuauucucuccuggggaccuugugagaucuuguguuaggugugcaggagguaggaggugggcauuuucauggauuauuguggaggauuuacauucauuaaaauacaggaaacaauuucaaaaugcauuuaucuagggcaauaaauauuuguuaaaauuaauguuccaagggcuacuccuuucuaucauuaguucaaauauaguuaguguauccaacugcuaucuuuuucuguauuccaugcauccuguagaaagauccauucuucaaacuucugaugauuccaucugcuaaaaccugccugcuuucugggucagggccaugugaaaugucuuacuuagauacaccuggcuguucugccuccaaauacaaacuaaaauaauuucuucauaaugcuuuuuuuuuuuuuuuuuaaagaaacauccccuuuuccuuaacuugcuuaggauaguggcacuuaccuguaaugccucgcuuaacuugcccuaagccgaaucuucaggaacuguagguacagcccucauucuaaagcauuuucccccaauuggccuucuuuauuuuccaagaauuauaguaggaguucucaacacuuaauugguacuuuauauacaucuaggaagugcaguuuguuuuugucuuuuuauaugugucuuuacuuuuuauaaaccagaacagaagaggauaagaguagaaggacuuauccccaccuauugcccuaugugcucauuagagauaguuguucuuaacaguucuugaauaucuuucuaguaaauuuaguauaucuugguauguguauguauauauaacuguaucuacguaaauacauguuuuuauacaaauggggaucacaugcauacuguuuucuccuuuuuuuuuuuuuuuuuuuacuuaauauauuuuggagaucuuuuuguauuaggcacauggauuuacuugcacuccuuuuugguuggccagaugguguuuuugggaauggaugucagugcuuuauuuaagucuucuacuaauggaaauuuagaguuguuuccuuauuguuguugucacauauaaugcuguaaugugugacgucuuugugcauauauauucuuauaccucuaggugucuaucuguaggaugaauuuauaccaguggaauugcuagaucuuagaauaugucuuugaaauuuucauagacguugcuaaauugucuucuacaacgguugccguuauuuguacucccaccaguucuguaagaguuuguuucccccucucauuaacgggcguuacuaacauucagguuucuucauucucacagaucaaaauuggauaccucauuauuuuuauuuucaugucuaaaaucaugacuggggccaaguaugucuucaaauguuuauuggccauucuuaaaaauaaugcaaacugccaauuuauauccuucacuuguuuuucuauuaagcucauuuuuuccucuugauuugcaguagcucuuuguguacaaaggauuuuuuuuggccugucauuuguacuguugauauuuucuccuaguagacaauuuguauuuugaguuugaauaaaauuuuugcuuuguagaauauuuaaguuuuugcagucaaguuuaugaguauuuuuauuuuuggcuuuugguuuuguaucauauuuagaaagggcaucucugguccaaaauuaugaaaauauucuucacuguuuucaaggaguuuauagguuaauuauuauauuuaaaucacugauucaucuggaauuuauuuugggagugggaauugagguaggggaaccaacuuuaaguacauuaauauuuugaugaaucauuguagagaagaaaaauuaaagccuuccuaaugguaguuaaaaaaaaaaaaagaauuugaagauucuuggaagcagaguuugauuuccugauauauucucugguuagcuucaggaauacugacuaaucuauuaauauuagaaucaaaauaaauaauaauuuagaaguuuaggccuggaggauuucuuauuugagaaauggagaugaaagugcuauuaccacucauuuauauccuagcuagcaugaucaacuagggaauaauaauuuuaacacugugaacagaccuuauuauucagugacagcauuaccaaauucaaggcugcuuaagcagaaguuaaauagugaaaacaaggaugggcucaaagugaauauaaacuugauaucuaguuaacuauaguacugcugcuuaauuugcaucaugguuauuaggaauauaugccaagccuccucuucaccguguuucuucuuuauucucagcagaucagaucccuuuacaguagacuauagagaauacuuucccuacagcugcuuggaauuuugccuuuuaaaaacucuuacguaaaaucguguucagggugggaaaaaaauaacauuguguucccuggaacaaauauuagguaaaauggugcuauaauucaaacucauuuuaguaagaacuacaggauagccagaugcauagaacuguagagcugaaaaaggcuuuaaggaugacccagccugugguuucaaaacccagaccugccuuagucacuaccugaugaaguuuuuccccaguccagagugaaaugagaaaaacaaggagggaauuauucccaaagacaacuuuauuuaaaauaaacgacuacucuuuuuuucaaaaauuauguugcuuugcuuuuggaugguuaaaauauucuuccuuuuuaucguagaauaugguagaauauugauugcauuuuuuuuaaauugagguuuauuagaguauaauuugcauacaauaaaauuuaacuccuuuuaaguguaaaguucacugaguuuugacaaauauauagagucgaguaaccaccacuguacucacaauuccgcccugccagcagguucccucguuacccccuuuaugaucaaucuccucgcugaccccucugcaacuggcaacugcugauugguuuccuauuuauaguucugcuuuuucuagaauguucuauagguagaauuauauggccuuucacaacagacuucuguuacuuacaaaaaaguuuuugaggcuggaugugguggcucacgccuguaaucccagcacuuugggaggcugaggcaggcagauugcucgagucugggaguucgagaccagccugggcaacauggcgaaacccugucuccaaaaaaauaugaaaaaaauuagcugggcaugguggugcacaccuguagucucagcuucucaggagacugaggugggaggauugcuugagcccaggagacagagguuacaucaaacugagauugcaccacuguacuccagccugggugacagagugagaucaugucucaaaaaaaaaaaaaaaaagcuuuugaauuucauccaugcuguuguguguaucaguaguugauucugucuuuacauuuuagcuauuuuaguggaauuaugguacuuuuuguucuuaauauucuuacuuggaaaaauugaaagugugaauaacccuaaaucaauucccagacuuaaaaaaaaaaaaaaaacaacaacaaaaacaaaacacguauuggcuuuugaaauccagaggucuggcuaucucgcccagccuccauugguuuguacacaaagaagccccaaccaggaggcuguggugcuaagacuggaaccugggucuccugcuuucuuguccuugcucugacaucuagccucacagaugucagcuagggccaccaugugcuucccucugugggugguggggucccuucuaggaaaguuucugauucugcauggacagaaacugacaaacagacaaaaucucccuuuucuccaugucacauagguucauccugugguuuccgguguuacuugagguggagucaccgggguaugggauuggucugccaggaagaauagaacacagacuuccccugaaaacacaaacaacaaaagaaaacauucggccuuuagugcauuauaaaaauuaaagcagcauugauggagaaaguguugagagagagucauaaagccauucuuaugagaaucuacuuguguaugacuuugaaggucuuaaaugcaagaaaugcaagagugaauuucuugcaugugugugcgugugcauguguguguguguguuuugagacagggucucauucuguugcucaagcuggcaugcaguggugcaaucagugcuacagccuugaccucccaggcucucaauccauccucccaccuuagccuccugagcagcuggggccacaggcacacaccaucauccccggcuaauuuuuuguagaaacaggguuucuccacauagcccaggcuguucuccaacucaugggcucaagcgauccuccugccuugcccucccaaagugcugggauuauaggcaugagccacugagccuggcuucuuguaguuuuuaucaaguggguggucuuaggaaacuucuaggauaggaaaagugguguuacaguguguccggaauugguggguucuuggucucacugacuucaagaaugaagccguggacccuugcggugaguguuacagcuuuuaagguggccugucuggaguuuuuuccuucugauguuuggauguguucggaguuucuuccuucugguggguucauagucucgcuggcucaggagggaagcugcaguccuucguagugaguguuacagcucuuaaggcggcgcaucuggaguuguuccuuccucccggugggcucauggucucgcuggcuucaggagugaagcugcagaucuuaggggugaguguuacagcucauaaaagcaguguggacccaaagagugagcaguagcaagauuuauugcaaagagcgaaagaacaaaccuucuacagugcagaaggggacgggaacggguugccacugcugguuugggcagccugcuuuuauucucuuaucuggccccacccacguccugcugauugguagagcugaguggucuguuuugacagggcgcugauuggugcguuuacaaucccugagcuagacacaaagguucuccaccuccccaucagauuaguuagauacagaguauagacacacagguucuccaaggccucaccagagcagcuagauacagagugucgauugguguacucacaaacccugagcuagacacagggugcugauugguguguuuacaaaccuugagcuagauacagagugcugauugguguauuuacaaucccugagcuagacauaaagguucuccaaggccccaccagagcagcuagaauacagaguguggauuggugcacucacaaacccugagguagacacagggugcugauugguguguuuacaaaccuugaacgagauacagagugccaauugguguauuuacaaucccugcgcuagacauaaagguucuccaaggccccaccagacucagaagcccagcuggcuucacccaguggaucccgcaccggggcugcagguggagcugccugccaguccugcgccaugcauucgcacuccucagcccuugggugguugauaggacugggugcuauggaguagggggcggcgcucgucggggaggcucgggccgcacaggagcccauggaggggugggaggcucaggcauggcgggcugcagguccggagcccugccccgcgggaaagcuaaggcccagugagaaaucgagggcagcgccagugggccgggacugcugggggacccaguacacccuccgcagccacuggcccaggugcuaagccccucacugcccgggccgggaggcccgccggcugcucggagugcggggcccuccaagcccacgcccaccuggaacuccagcuggcccgcaagcgcagugcgcagccccgguucccccuugcgccugucccuccacaccucccugcaagcugagggagccggcucuggccuuggccagcccagaaaggggcucccacagugcagcggugggcugaagggcuccucaagugccaccaaagugggagcccaggcagaggaggugccgagagcaggcgagggcucugaggacugccagcaugcugucaccucucaauaggaauucaguaagcacugaggaugaaucaggaacuggccuguuggcagaaguaaugauaauuaauacuuuauacuagugugagcuucauccaugauuguguuacucuucacagagguccugugagguaggugguauuacuuccauuuuuauaaauuagaaaauggaggccaacugaaccuaaaugacaggcugaaaguuacacaacuguuaagugacuaagcugggacaaaagcccaaauugcuuagcaugcucccucuucuuuccaucucccauccuaguuuauuggcauaauuugaauagaaagguucacccccauccccuugagccccauauuuucauauauugcagaggaaacagcucuggaauaggaugucugcaaucuuuauguaaucaaaggaauccuuccucaaucuucuaaauugauucugauucuacaguuuuuaaagugauauugcuuaaaauuacaucagccuuuugcacucauuuuugggggauguaagcuuauuauacaaggugagcauuuuggcggggugggggguucccguaaacuuugaaugaaaagugucuucugauuaauuggauauauccaucuuucaauucaugacauucugguuuagaaaugauauugugggguucagagugagaagaccuguuuaaaucccugcucugccaaugauguauugagcauaccugcuuagaccauuuuuuuguacuuucugaaccucugucuccucaucuuugaaaugaugauaucugucucauaaggucauauagcucaagcaagagagugaagugaaagccauuugcugaagugaagcacuccucggaguuggaggcuuaguagcaggugcugauuuucaguaaggcugcugcuuggaaguucagacuccugaccaccuuuggugcuuugacaaaucccucaaggaaaacaacuuugcuuuuuaauccauucguggcuaugugucuguuuagcagucuguuuuuagauaggccuuauuauuuucaagugaccacaucaaagaauguaggaucauucaaaaucaacaaaagucaauauuugggaguggauucgggaguuggagaaauuuaugaauagugcuguuuucaaguuacuuuugaccuuugugaaaaguaggguaaaaagaacaaaagucaagugauuagggaacauuuaaaagacauucauacaagaaaauuuuaguuucauuggcuuuaauucugacugagaaaaauuuuaagggucaaacuugauggaaacuuacaauauuuucaauaguuuuuggauuuuuuuuuucuggacauggaaaguggauucauuuguggagaugacuuguacacgaaguguaauaauagcuuaugagucugcugugaugcuaguugggcuuuaguaucuucucccuugauguuucaucccuaaaggauaaaugugugacagacagugaugcuuaucacuuccucaaguagcgcuuggcagccaccuagacaauggcgggggagguggaauguggugcuucaaaacccgauggagcucggggauugccuuuuugguucagguggcuguuuucugacuggcauuccccauccucacugcaaauguauucuuagugccaauucaucucuaacagcuugcaaaggccuuuuuuucuauaauggaaguagcauuauuuuucaagauuaugaauauuaccuauaugccauauaaaacauucagaagauagaaaaguauuucaaaaggucaccccagaccccacccccagacauaaucugaugcuaccauuugggugugcaucccuccaggcacuuuuuaauguggaaaaaugcagagagacacaugacuccauuuggagguccguccugcccgucuuuuuuuuuuuucuuguacguucauaugcacggaacuuguacacguuuuguuuucaugggcaguuuacaucucugugaggagggacuaggaagaccaggcuuuggccauagaccuauucuauguuugggcuguuuuauuuuuaaagugacugugagaguguucaguuggggaccuguuucuuagaacauuucugggaucucucuuguguuuuaucuuccuuccagucagcuacuugcccuucugucugggucauuucugaccccuuguucugucugucuguuucccucccucccucccucccucccuuccuuccucccuuccuuucucuuucuucuugucuuacucugcgcccaggcuggagugcagugcccugaucuuggcucacugcaaccuccgccucccagguucaagcaauucucuugccucagccuccugaguagcugggauuacaggugcacaccacuaugccuggcuaauguuuuguauuuuuaguagagacaggguuucaccauguuggccaggcuagucucaaacuuccgaccucaagugauccacccuccuugggcucccaaagugcugggauuacaggugagagccaccgugucccgccuguguccuguucuugauuagcuccaagugggaaauugagaaaauaaagggaaguguuuccugguauuuuauacaucuaacaguauggaaagcacagcaacuuuuuuuuuccaucuauggauaaaaaagcaagaaaauguagauauauguagauguauuugaaguaguuuaugauacucaucgcauuagaaaucuuuucucugggcuucuaggaccccaggccugacucucuccuggcgcuuacuaaugaccugguuucccaucuccuccacuugacccugugcucacugagagcaaacagugguggcuacacugaggauggcaguaggucccugugaaucuucaucuguguaaagagugugaagacacugugguuagauuggcauaugguuagggcuuauuuuccuugcuagguaauucuaaauuaaaauacaaauuuuaggauaaagucuuaugcaaauuuggucauggaggaauaugauuggcuaauacaggacuuuaaauucauuauaagucauagggggucuugaaugaacagcaaaaguuacugaguuuugaggaguguauauauuaauguucaugcuggaagcugcccaaauuacaggucuuuuggauuuuuucuuuuuccccauccccuuagaaugauaauugcacauuaauucacuuguggccuugugguaguaagagcccugucuuacccccguccacuggggucuggacagccccaagaguaggugaggcagcucuuccucaccccuucuagcugugagggaccugccuguguuuacaaaacuuccaaugauagcugacaccagugauauacccuaacucuccucccccgccuuugucauggcgucuauacuccccaagcauguaggggcuuuagucagggcauguuagagcauuggacagugagaaaggaggccguagagaaaugggcuggcuuggcacccuggcugacacugguugguuccacauccacucugacuaaggagagcaugcucugugggugucuucucuuccugaaggcuguguguccugaagccacuguucccacuugugugguugagugcacaggaguguguggauagguugagagaccaacugauagaccucgccccugcuugccaggugcagacaccaccccuguuuggggacauugagaaacuuuacuuggggaggccuaggggauguguggacugcuuccggggaauuaaaggguuuguuuguuggggugggaaggaggagacaggaguggggaauucuauccauagcaaaaugugaagggugaggugauuugaagcuguuuaauuguuccucccgccaaucuagguuucugauggugaaagacuacaacuuucuugacuuuuucccgcccuggggugugagccagagggcuuuggagaggugcuuugauauuuugguuaggaugcaacacaacgggaagcaagauuaacccagugacaucuguagacucugaaaccaugugguuaccagggauuucagaagucauccagcccaacauccuggucuauccaacuacuuggaaagaaaaaugcacaccaaaguguuuacgcuuauacuaaauaaagauugauucuacucaaaacaacacccaauuuuauucuuuuagagaggguacugcugguaacucauuggcugaauucucagaauuuugguggcaaucugacaaaugacacugaauaccucuuuuauaugauuaagcaauuuuagggucucucagaacaauuugaaauaauucagaaguaacagaaugauuaaaauguugugucuuagucuguuugggcuucuguaacaagcuaccauagacuggauacuuuuaaacaacaugagcucuuucaugaccuaaucaccucccaaaggcccaccuccuaaugcuaucaacuuggggguuaggaucucaacaaaugaauuuuagggaagacacaagccuucagaccauagcagauugaaagggauuccaaacucccuuuguugcauuugucuaagaaacaguagaugaaaagggauaagaaaauacagguuuuaaaacuaugcugugcaauauggagaccucuagccacaugagacuacuuaaauuucauugaaauaagauuuaaaaaucaguucuucaguggcacacauuucaagugcucaguagccacaucuggcugauggcugcguauuggacagcacagauauagagcauuuccauuaucacagaaaguucuguuggauagagcugguaaagcuuccacuauuacuuaaugguuucuaagaagggaauuuaccaauaucuaguuuugucucuugcacaaugaacaguucuuuuaaucuacagagguuuaauggggcucccucaccccuucugucccucccucccuucuuuucuucucccuuucuguugggaguccuggucuucuuuaggaccucggcauuaaaugcuugaucacuuucacuuguccacuugccucaccugugcaacaggaacauaggccuuacugaucugaaggcaggagcuaauguucucugugguccgggucagcuacuuguucacgccacuggagccauuuauggagcagacaucucacacgcggcuuuagugaaggacaaaagagcaaaggagacugcuaguuaugccugucccuagcucgaacaaucguuaguggcaccaaacuuccuaaggcaaguccaaaacuuuaucuuggcauuaaaugcccacucauuucggguccaguuccuuccccucuaucucuacccaucauucagucaguguucuagacaaacagcuccccaagcacccugcacaccuccaugcuuccuugccuuugucacugcuguuuccuuugcugggaaugccuuucccucccccucccucuugugguuuuuaaagcucauauacuuuauaugguuaaguauauggucgggugcgguggcucacuccuguaauccuagcacuuugggaggcugaggcagguggaucaugugaggucaggaauucgagaccagccugggcaacauggcgaaacccugucuaccaaaaauacaaaaaugugcugggugugguggcgugugucugucauaccagcuacucaggaggcugaggcaggagaauugcuugaacccaggaggcggagguugcagugagccagauugcaccacugcauuccaacuccagccugggcaacagagugagacuccaucucaaaaaacaagaaacagaaagagaaagccccuuauacuucugugaugccuuccugaccccccaggcagcauggucuucucucugugcucccauauauaccaguacucacugacauuauagcacaucuuauugugcccucauggcccaccguguguccucggaggccugggacuguggggaaaucauacugcauccucugcaucuggcacugucaugacacauggggguggacauaaaccaguuagugcauguucaauacucagcaaauaucaacgcugcuucuuccuucuucuucuccuuuaccuguuaguaguaguauuaguaucaguauuaguaacaguaguaguauuaguaguagugguguuggauuuggguuccucaggaaacuagauccaagauaccacauuuuauuuuucuaaauauuauuguuuuguauuugaucaaguauaacaauuuuuuuuuauagagagagaacuauuaaccaguagcugaaaaucagucaugaguaacaagcaaaauguuucugaauuuuuaguuuuuuaaagagagaggaaacuaauagucauaaggaacacauuuuugggaaaaggaaauaauaguaaauggcaucuuggaacacauugcuuuguggcagauacuaugcuaaguacuuuucuuggauuaucuuguguauuucucacaacaacccuguaaggcaggcacugcuaugaccacauuuucuaggugaggacacugaggcacagaguagauuugugauaagcccaagguggcauagcuaacaaguggcucuuaucguuucuuaaaauuuaagauauaauucacauaccauaaaguuuacuuuuuuaaaguauguaauucagugguuuuuaguauguuuucaaaauuguacaaccacuaccacuaucucauuccaggauauuuuaucguuccuaaaaaaauccccuguuucccuguuuccaugaacugucagucaccccccauuucuauccacccugucuucccagccccuggcaaccacuaaccacugucucuauggauuugccucuuuuggauauuucauuuaaauggauuguaugcaauauugugucucuuugugucuggcuuuuuuucacuuagcauaguguuuucaagguucauccauguuguagcauaaaucaguacuucauuccuuuuuuaugacuaauaucccguuguauggacauggcauaauuuuuaaucccuucaucgcuugaugcauauuuggguugcuuuugcuuuuuggcuauugugaauaaugcugcugugaacauuuguaugccaguuuuugugugaguuuguuuuaaauucuuuuggguguauauuuaaaaguggaaugacugggccauaugguaauucuauguuuagcuuuuuaaggaacaaccagacugguuuccaaagcagcugcaccauuuuacaucccuaucagcaauguauaggguuccaauuuuuccauauccuugccaacauuuguuaguauagcagccauacuagugggugugaagugauaccuccuuguaauuuugauuugcauuucccuaaugaaugauguuaagucucuuuuuauaugcuuauuggccauucauauauacucuucggagaaauacauauaaaaauccuuugucuuuuuuuauucauuuauauuuuauugagucauaugaguuauuuauauagucuugauaguuagaccuuuaucagauacauaauuugcaaguauuagcucccauucuuuuuguuuuuagaaaauaaaaaaaaagcauuacauuuuacuguugcauuuguucaugauaguuaaaguucuaggguggaacgcagacaucuuuuauuucaacacugucuuaaugcaggauauguuuauuuugguaauuuauuauuguuagaauuaaaccaggcuucggucuuuccaaguuugauuugagcuuauacuuugcaugucuaugugugguccuuuggucucaggcuggggcacauuaaagauagccacagauucuuugaagcuuuccugucagcauucccaucaaaaggcaggugcuauuuuuuucuuuaaaaaaauuaaaaaaaaauuuuuuuguggguacauaguguauguauuuaugagguacgugagauauuuugauagaggcaugcaaugcaugaaggggcuauuucugagccuggcauguggcagcuuugaccaaaagucaaaguaccgcugacaguuccaggcaugggcuguaagaaaacuggccccuuccacuuggcucagagcccugagccacucuguaaauauuuacuacccuacuggagagaccccauugcgaggcuguaagaauacaugaagggacacagcaaaauccaggcuuccagcugccccucucaaggcaccaggaugugcacgaggcuuucgugaccccuccagacaagucuagcuacuggccaaguaccacugagucacccgaggugaugccacccagaauagaaagaaucaccccaggaagaccggccugaguuccugacacauguugagauaaaauaaaauaguagucacuuuuaaccucuuguuuugggguaguuaggcaguaauagauaaccagugcaaacuugccaagggaaugguuagugucaccaaagaggccaauaauauuaaugguauuaaucaauuuuugaacaaugauacaagcuaaaauuuaaauucugaguuucuaguucuauagacaaucagucaucuguaucuguggguucugccuauguggauucaaccaacucuggaucacaaauauucuaaaaaaaauugcaucuguuuugaacauggaucgacuuuuaaucuugucauuauuuuguaaacaauacaaauaacuguuuacauagcauuuacauugcauuagacauuauaaguaauuuagaggugauuuacaggggaauauauaugcauagguuauaugcaaauaaaaugccauuugauaucagggacuugggcaucugugaauuuugcugucuuagaagggucauggaacuaaucccccauggacaccaaggggaugacuguauaugccuucacaauuuccuaaugacccccaaacugacccaaugaaaaucaaaaauaaacacauugauuaaaaacaugacuuauucuaaaucugugauuucuaaacuaauaauuuauguuauuggcuuaauuuucaauuuuuauccauaguguagguuagagcaauguauauuuaauaaccuguagacuuaagaacuaagguauuuuugcccaugugugguucacaacuguaaucccagcacuuugggaggcugaggugggcggaucacuugaggucaggauuuuaagaccagccuggccaacaugaugaaaccccgugucuacuaaaaauacaaaaaaaaaaacccaaaaaaaaaaaccccaaaaaaccccacaaaaauuagccaggcaugguggugggcaccuguagcuacucaggaggcugaggcaggagaauugcuugaacccaggagacggaggcugcagugagccgauauugugccacugcacuccugccugggugacagagugaaacuccaucuaaaaacaacaacaacaacaaaaaacagaaagagaacuaagguauuuuuaacaguguuuugaguagaagaaacuaaaaagaacauacaugaacuuuuuuaauguggugggucaggucaucagauaagaugugguggcaacgguggagaauguggcucauaacccuagccuccuuggucguucaguccccucuuaucacuuccuugucucuuuauugccuuggggcuuucugccuggagccccucauucuucucccauaguaaauccuucuaaugcaguuucaugacuugguuaaggucacucacucagugacauguuccuuuggaccauccaauaacaagaugcuuaauucuuuccuuuuuuacaucuccauagaccugggggcaaguaaaauacaacucuggaugugcuucuucauguagagaguuggcccaucauaggucuggugacuggugacugugcuucgugcagugaaugaugcagagguugccgaggugcaggcuucuucaaaaucuuaaacgcuuucauuuucaaauacaaggccuuuuagggcacagggaaagaaaaggcuuuucauugacucagacuucauguaagggagcaggaagggcugguuccaaugugcgcaggagggagaggauuaccagguauaugugagcaauguccaccacaccauucuuaagauacucuccaugcccaaauggaacuguuauuggaguaaguccuacauggcaaucuccaaguccauuggaaaauuucacucacucuuaggccucaagggccagucugauuacaugugggaaugccaccuacuuugcugggcucuuggccuuccuaagcagaaaugugauuauacuacaagguaagggugcuguaaugaauuguguauuccucaaggauucuggaaccaaagcccuuuccaaugucucagcacaagcaguugcugcacagaaaaauaaacuuaaggagccugggagagguucauuuugggaugaugaugacguuagugauguucccuugauggaaguccaagauugagggaccagcaucuggugaggaccuucuugcuguggcaucccauggcagaaagugaaagggcaaaagaaaaccauuucaccaagauggagauuggguccaucaugaacuuacugaucaucuccaggauuucgugaggcagcguggcacugaugagaacaaccugcauggcuggaggccauguacacauuguaaaucugcccuuugaaacuuauguuuaccaguuuauuauaaaggauguugcaaaggauacagaugaagagauauguagggugagguauaagggaaggggcguggaacuucuacgcccucccugggcggucacccuccuagagccuccuguauucagcuauccggaagcuccagcucccauuucaugguuugucucuuuacuuuucccauuuuuuuugacauagacaaaauuuuuuagaacaaauggaggaucuggugugauagacaauguagggaauuagguaaaaacaacaacaaaaaaaaaaaccugguuucuggcugugccugggccacucacaggcuacuaccuagcuuuguaaucucaaguaacucaguaaacgaguaaugucucuuagccucaguuuucacuucuguaaauugggcaaaauaauggcaucaacccuacagggcaguuguuaggauuaaguaauauuaagcaugucacaauauucuuuuuauaacacagauucacccaauucugcuacaacauuucuguugauggauaacuugguuguuaagccaaguucuaccugaagaugaucaugaaggaguggcuaagaagcaucucuaaaaccugauuguuaugacuuucccccuaaaaguuuugauagacugcccaaauguuuauauuccccaugcaucagaaagcuccaguauaauccagacucagccaggcuggccuuguucacauugugcaucugguuuugaguggcucccaucucacuuucugugaugcugcaggauuaaaggcaagugcucuaggcucucugggggcaguacccgguucagaacuagcccuauagugccaccuggggcaaguuauuccuugaaaugaggacaguaauuuuugaugugaggauugaauuguaugcuguggugaggauuaaugagaucaugucuguugugcucuuaguacagagccagacacugaaugaguuuccgugagggguacugugcuuucaggacccagcuaaguugggcccugcgaaacaagcaguaccugacugcccaagacuggaaaggcacagcuugugaaaugaaaugggguauuucugauaaaaaacugagcuucugcaauaaaagagaaauuuaauuuauuaaaguugaugaaaagguuaaaaaacauagggggcugggcacaguggcucacaccuguaaucccagcacuuuggaaggcugacaugggaggauugcuugagcccaggaguuugagaucagccugggcaacauagggaaacccugucuuacagaaauauaaaaaaauuagccuggugugguggcgugcuccuguaguuccagcuagauacucgggaggcugagauggcaggauugcuuaagcccagggaggucaaggcugcagugagccaugauuacgccccugcacuccagucugggcaauagaacgagaccuugucucaaaaaaaaaaaaaacacaggcuguggggaagauauaccaugauaggaacaaccaaccagucaaacaaaaacgggagagacacacacauacuuacuuuuucuguaucucucucucucuuucucucucucucccccccuuucccucucccucucccuccuucuuucccucccucuuucccucucccucucccucucccuuucucucucucucccuuucugucucucccccccaccccccugccaaucuuuggaaggacacacgagaggcuaguaguagugguugccaggggugcuguuaggggaacaagagauuuaugguugaaaguauauagggauuuagguguaccuuuugauauuauucaaaauuuucaucuuuugcauuggucaguuguauauuaaaaauguaguuacucaagugguuaaaauuugaauuauuaaaaauguauuuuaaaaccuggagccgaggcucuuuugcugagugcuguguucucgugggucacuauugaguuggucguuuuaucuucagggagaugcucuccaucaggcagucacugaugaaccugcuucucauuauauucuucacuugaaagucuuaacaucuaauguccuugaagauguucaguaauuccaaauuccugccaguucagauuaggcuccucuucuugcuacucugaauugcuuucacuugaaauaauuugaaguguuuaaaguuuaaugcucuuugaggggagcugcuacaucucuccccuuuauuugaauuaaauagugauuaauagucucuguugaguggccucuuccuugacaaaacccuccggugcuggggugguuggcugauuagcagagcuagcuccugucuuggguucuguaagcagagcuucuccaucugcagagggcaggggguaugaaugccacuggagguugaagaggguuaguacugcccacaugaaaacuucuuuuucaaggcagggucucacucuguugcccaggcuggagugcaguggugugauccuugaacccuccaccgcccagguucaggcgauucacccacguagcugggaauacaggugcccgccaccaugcccagcuaauuuuuguauuuuuaguagagacgggguuucaccaugcuggccaggcuggucuugaucuccuggccucaagugauccucccaccuuggccucccaaagcacugggauuacaggcaugagccacugugucuggccuacaugaaaacauuuucaagaagcccuagguguaucuuacauucaacucguacaucuuacugaacaauacacuagccugauaaaauauuuuaaagcuguuuuauuuucuuucccaaaucauugggugaaaaguaagauaugcugcaucuccuguugagacugaagguauaaagugcuccagguugaaaagcagaguaugaggauaauauguuuuccgaaguagcaagucuuugggggaauagauuccgaugaguuuaggcuggauaaacucccuuaguaaaguuggacaagcucaucuaaggauugacucuucccuuggcucugucuucuuauuucugcuauuggguaauuuugcuuucauguuuuauuaagcucagugccauuuuucuucuagaauuuuucacagauaauuacuuuuuggguacuuaaaacuaaguguaaaacaucacccuccuaaacauaccaucaaauuaaguaaauaaaacacaauuuaagaacagcuuuuauuaaaacaauaaaguuuggggauuuuuuuaauugucuuaauaaagugcaacaauuuugcauaccuucuccagcauaaucuuaacauuuggcugcccgccuugccugaaaggaaaguccuaacauuacccaggaagaucauuuuaggucaagaaggccuuuagauuaaaacguguguguguguguguguguguguguguguguguguguguguguguguaauauaaacauaaauguauauaacauauauuauacauauauaaauauauauauuuuuaggaaaaaacaaaaugguacaguuuugauucaguugaacuaguuuauugcaccauacaucuguacuuaaauagggcuuuuuucuacaauacuugaguugcuguuuuuuugccuagaaccuuguggggugauuuuccaucgcuagcccucugugagaaguucugacuugaggguagacagcucuuagucugaggacauuuccugcacugaacugcauccacugugagugauaaaguuggggucaguuguucagagugggggugucuggucccuguuuugcuaacauuggaggaaaggcuuagaagaacgaaugaaugcuuggaguagcauucaacaaacacugcaaguagaugaaugcuugggaguagcauucaacaaacacugcaugucuguguaccauaauguucuaggcacuaggauauaguacuggacccuggaaagugacuacguguagcuuguacuugugugagggagacauccaacagacaaauauguacugugccagguggugacagguucuaugaagaaaaguaaaacaaggcuggaggcuagagaacaacaguaaauauuuuaagguauuccuacuuaaaaauauauccuacauggacuguauucuucaaaaaugucaguauaaaagaccaagaaggguauggaaguguuccagauuaaaugaggcuaaagauacaugacaacucaccgagcauggcggcucaaacuguaaucccagcauuuugggagaccugguguaugaauugcuuuagcccaggaguuugagaccagcucaggcaacauagcaagaccuugugugcacaaaaaaacuuaaaaauuagccaggguggcacaugcuuuagucccagcuacuuaggaggccgagguggaaggauaccuugaguccgagaguuggagguuauagugagcuaaucaugcagcaugcaccccaggcuggggacacagcaagaucccugucucuggcaaaacaaaaacaaaaacaaaacaaaacaaaacaaaaccaugacaaccaaaugcgauaccuacccuaaacuagaucugauuuuacacugacauggaauuaauuggaauacagacaguagauaggauaaaggcauuugauaacuguccugugguuauacagagaauauccuuguuuuuagaaagacacacugaagcaguuagagguauuuaaggggaaaaggccuuacccuuaaauuaggaaaaaguuucauucauuuauucguauaauaauuauguguguuuauguguuuauuuuaaaguggggaaggagagaacagagggaacaaaugauaaaacaaaugggguaaaauguuaguaauugguaaaaccgaguaaaggauacgugguggguuuucuuuucaacuuucuauaaguuugaaauuauuucuuugucaacuuuuaaaaauuauauauuguauguguguuauauaaaacuguaaaauuauauauagucuaacacuuuuaaaaacauucuuuuuuaaaaaguauauauucuuugggagaaguuaccuauuaaucauuuccauguuaauaauaugaauuuuaagaaaaguaauuuauucauuugcuauugucuuagcugagacuaaccacaaaggaacugaguggcuaagaaaaugugggaaaggaggcauuaugggccaauggcagccaggcugaugcagagaacugguuagaacacuugggcuuggagagugaggcgcacaguguauuguggaagaugacguuuaaaaggaagaucagagcaggccuuugauaaaaccaccacuggggucaguuuggccuuuacaguuaggcaaucucucuagaccauucuguaugcuaucuuugggauaaaguuauccuuaaaaaaaaaaaaaaacuuuacugagauauaauguauauaucaugaaagaagguugugagugaccuugaccaauauuuuauacagauagaugaacauuguuaugccagcaucuaucaaacuugaucaaaaugccaggcgcaguguuaaguacuuuaauagauauuauuuaguuuaauccuuacaauauccuuauaagauaugucuugcuuuuuaaauaggcaaugaggauaaaacccugaaacguuauaaauaacugccuuagguugcauaucugauaaggggcugcauuuuggagccaggccuugcugcuccagcaccacuggacugggcugcugccucaugugugugaucccugauguguggguggugcagccaggugagagcagaggcucugucucaaguuagaacagaacgugcaggugcuuccugaaauguggcagaagugagcugacgugucucagcccaagaagagaagaaaaacugugugaauaauaauaaguaggaaaaugaagaugccuggggaguuaauugagcauuuugggguuaauauuuaaguagagucaguucugggcugggcaaacuauagcaucgauccuuucuuccuuccauucauccaaucuguauuccaagguggcuaaccuugauuugcauuuuucuuucugcccagcauugaccuucccuaccacucuugccugugguacaaauuagaugauccuguuucucuaccauagacuuuaccuccaucaucuuguauucuuagcugcuuuuccagcccuucacagaccccuugaugcugacccucaguaaccuagacagguuaucaggaacuacacugaggguuaggauacagggucauuugaaguggaacuccauguuuuguuaauuaguuggcaccugccuucacaaucuuucuucccucugaauccucuuuaggccaggucaggaacuagaaaagguugcugaugccugacuaccuguauuaggauauuuauuuuucauucaucuacuuggcagcuuaucuuaauggcaucuuccgucccuccuaagccuuguugcuuggcagaucugcauaccucuuuggacuaaaaaacucuuuuucaugugaaaaaaaccuuaugaacuccagugcauugcauugggcaguaggcauuuauaaacugccuacuauguggggcacauugcccuugguacucuuucuuuacaacuuauagcauagaaccuuuaaauuccuagauucucaucauguauucauguguuaaaacaaacaaaacaggaauagccaggcgugguggcucacaccuguaaucccagcccuuagggaggcugaggcaggcggaucacuugaggucaggaguucaagaccagccuggccaauauggugaaaccccgucgcuacuaaaauuagaaaaauuagccaggcaugguggcgugugccuguagucucacuuacuugggaggcugaggcaggaggauugcuugagccugggaguuggagguuguagugagucgagagcaugccacugcacuccagccugggugacgggagcgaaacccugucucaaaacaaacaaacaaacaaaaaaaggaaaaaacuuccgugccacaggaguagcuugcucaaaugucacaaaaauguguuuuucuccuguaauaauuguaguaaauagugcacugucguucauagguuucuuucacgugcaucaccucaucccaggguuuucccaccuugguacuauugacauuuuuggcuggauaauaguuguugugaagcgguugucaugagcauuguaggauguucagcacaucccuguacucuuuaccuccugauaguguaccuccuuccccccgacccccugcccccgacugccgguugacagacuuugcugaaugcuuugggggaggggaaggagcacagucacccucauugagaaaucccugccucagauaaugcucacaacaaucuugcggguaggucuuaucuccauuucugcagaugaggaaacugaggcccagggagauuaaauggccacauggcuagggcauggcagaagugaggcuugaggucauccccauauguucaguucuucacuugagguccuuuuucacccugcagcugcugggaaugguguuucaguguauaagagagaagcaaggccagcggggugguucugcaguugagcuuuuacucuugggaagggccuuguucucuuugccagaugcaagacagccuauccaucaugucuuugagacuccugggcaucucccccagaaagggaugcagagugagagauguuuuagcagcaaagcuagaaugccuucugaguccugcucugccugguuccagggaucaccggacucagucacgggauggaggggguucugaacuuugcagucugagacccccuuugccaggauacugcacaaaucagaggagagcugcaugacacuucuggcacauguugcugaagaagcaaaucacaucuuucggaaauuuuauuccccugugcucuguguugcacugacagaguggagaagagauugaggagaauguucucuugagccugaaguuugacagcucgugugagucgugcuggucuggguaggacuggcagagccuuggcccuggugccuucuggcccuccucaugggcugcagccacucugccaugguguggaccgacagcggcgccuccucccucaucccgcugugggcagaugcggggagaggcucuugccgguuuccucuccauugcucaucaaagguagaugauggaggggccagggcugaacuggggagugggauuggaggggagcauuuacucuucagcucuccuucacgucucuggcugagaaaagaaguacaucucucuuaggacuucucgacacagacuuccagggcaucggggauuucuguacaguaugaaacuauaaauauuuucuucccccagugggaugcauaguacagacugguuaaacuugaggaaguguuuuuuuagaaucugauuuuugaaauacaaaagaauguuacuagagcguuccuuggcauuugaaaugagaaaaagacaucuaucuuuucucuugugaaauuuuuuuugcaacuuaaauacugaccuuggauaacugcuuugauuuucugguuuugaagccagugucauguuguucaugcuuuccucauuacuucuuaauaaccaaauuauaugcagacacaccacauuaauggaggcaguucaggaauggaagaaacucgaguauucuucucaauaguucuaucauuggccuugaccuugagcuguuuccuucuuuuuuguacuuguuucuuauuccguaaaguagauggagcauuuccuucuuguguuuuauagcgacauugcaaggcaaguaaaucaauacuuuuggagaggcuuaaucaaagacagguucaguagcuauuaauaucgugauuauaaugauggcaugaugacgaauaguauaauugccagcuuuaugugcagaguggggguugugagaguuaccugggagugcucugccacugaccucugcucauuucuauggagagugaaauuuuucucacauuuguuuuaaugaaguagaauuuugguuuccuuuuuuacacguuggaagcuuuuugcugccccuuugcucuuugccccuccacucuauucuccaaaguaaccauucugggcauguaaaugugaauauuguuuucaacaaagggggaaguggggucauauuuuauauuuucuuuccugguuuauuguuuuuguuuuuuguuuguauuuuucacuuacuagcucuuggaauuuuuuucuuucuuuuucuuuuugagauggagucuugcucuguaaccugggcuggagugcagugguaugaucguagcucacugcagccucaaacuccugggcuuaagagauccuucugccucagucuccugaguagcuaggacuacaggugugugugaccauauccagcuaguuuuuaauuuuuuucuuuuugagacagaguuucacugugucacccaggcuggagugcaguggcgugaccucggcucacugcaaccuccaccuccuggguucaaauuacucuccugccucagccucccgaguagcugggauuacaggaaugcaccaccacacccagcuaauuuguuaauuuuuaguagagaugggguuucacuguguuggccaggcugguguccaacucccaaccucaggugauccgcuuacuucggucucccaaagugcugggauuacaggugugagccggcaugccuggcuaaauuuuuguagagaaggagacucacuauguugcccaggcuggucucgaacuccuggcuucaggcaauccuucugccuuggccucccaaagugcugggauuauaggugugagccaccauacccagcccagucuuggaaauuuuuucaugccaguguuuguguauauguauguauauggaucugucauuuaaaauggcugcaugauauuuaguggaaugcauaugucauaagucuuauccaaucucuuguauaacaacguuauagcaaucucuugguggguauuuuuuugguuauauaguagacccuugagccuaggaaaggccuuguuaugguaugaagugguaaggcuagugagaccuaggauucuagaccuagaauuaucucuaaaacacacaggcaggaccaggaggaaucuucuaguccugucuuugugugcguuagagauaauugcucuguuuuucugggcuucaguuuucucgcuaaaaaggaggauuggacuagaagauauacucagauccuauucuacuuuaaauguuauaaauguauccucaaauugcccauacugucuauauugcuuuguaacaaacuucccaaaacuuaaugccuuaaaacuauaauccuuuauuuagcuccuagcuaugcuggacauuucuucuuaucugggcaggcucauuugaucaguggacaagugggucagggggccuuuuauuccuggauggccucauucacaugucuggugauggcugguucuguucacaugugacuuggcagaauuucaaaaguagcaggagcagaagaugaaaggcaucuugaagccuaggcuuggaacugacacagugucacuuugaucacagucucuuggucagagcaaaugacacagccagccagauucagguggaaagagccaccaaaguggaccugagaccacccaacucugaacuuuuugcuaaguaaugaaagggauccugaaguuuaggccacugucagucaguuuucuguuacuugcaacagagcggguuccuaacugacauaugucacuauuaaggaugugauuaaauaaagaagagaaacaagguguaccuuuccuucuguuucauuuuaauguaucagacaauauuuuagaccauuggccaugcuuuuagauggccuuggacucucagcuuuuggccagaaaugcuuuuucagcuguucuguguuaauccuuaaaccugagcaggaggucagagcagggaacaggcaugugggaggcagucauugcucccauuuauucuggggcagaaaugcaauuaaaagguugaagcagcagcucaggccuaggaacauauuauucuuuaaccugguuacuuuucguuuuaaaugcaauagggcauuugagaguaguagagcaugaguuuuaaaaagaacugacgaaaaaagucacuggguggaacuggaaccagauaauggaauucauguucuucauguuugagaugagacucacaaaacauuuuccaccgugaccuugaacuugccguaugucuguauuugaacuaacuggggggggcuuguagugggaaagagagaugugaaauucuucuaggacaagcagagaguaacagcagaagagaagguaaaacgugugccugagucaaggaaggcaguucaccaagagguaaacuuaagaccacaagggguugugccggaguauauagaauccuaucacaccaugcccagaaccaaaggaacaacaaagcuucagggcagguguccccugaagucaagccugauucugcaucaucuuguauagcacaaacuggcgacaccugugacuuugccuuucccagggucccugcucuccgcuccagguaggcucagccugagggaggugcuggcaggagccucggaggcaggaggggcuggcgugcuucacuccuucagcuugucuugggagagcugugggcugcaucccccuggcuccucgucccacaggcagccccgcugugugucuggucuugcagguuggcugcagcuucugggcccugcuuccagccccucuucccaugauccuccagccuuggaagguguaauaguuucccauguugcugaucuuuaguuugccucccucuccuuggcuguucuuucugcuguuccauccucugugcaaccaauuuuccauauuaaauucccucacugagacacuucugacuuccugacuggacaaaaucuuguugacucaaaauguauucucucucucaguguugagugugaaggggucuaugucuuaaccacucauuuggaagacuuauugggagucaacacagauauggauugggguaaugccggugaauaguuuaaggaaaggacagcucugaggagggcaagagaagguuugcuaccacagugagagaaguaauaggcugggcgugguggcucacaccuguaaucccagcacuuugggaggccaagguggguggaucaccugaggucaggaguuugagaccagccugaccaacauggugaaaccccgucaaaguacaaaaaucagccagguguggugggcacgccuguacucccagcuucuuaggaggccgaggcacgagaauugcuugaaccugggagaccgaggcugcagugagccgagauugugccacuguacucuagccugggcuaccaaaugaaauucugucuuuuuaaaaaaaaaaaaaaaaaggaauggggagaauugcagaugacuugugaguggaggcugagauggggaaccaccugguggauaaaugauguaaugagaaaggggagaaugagacauuggguugggggauccuugaagugacagcccuuuauggauaauuggaaaucugaguuauuuugaggacugagaguggacauuugugauucuucugagaagaggugacaauugaagacacacaaaaaguucuuuguagagaaaaguccguacaaacaacagaaggcuggaucuugggguucacucauaguugggggauagaggaauauagaggacauugaugagcuaaaggauguacacucagauacaggaggaaaauucgcaugguuuuucaucccagcuuugaaaggugggcaugcucaggagcaccagaagcugcagagaaagagaggggcauuugggauaagaccuuuggauuugcccaaaggguagucaagagagugguauauguuuauauguggccacuagcacuagauuaauuguucccaauaggauuuauuuauuuauuuauuuauuuauuuauuuauugagauggaguuuugcucuuguugcccaggcuggagugcaauggcgugaucuuggcucacugcaaccuccgccucccagguucaagcgauuccucagccucagccucagccucccaaguagcugggauuauaggcgcccaccaccaggcccggcuaauuuuuuuguauuuuuaguagagacgggguuuuaccauguuggccagacugaucucgaacuccugaccucaggugauauacucaccuuggccucccaaagugcugggauuacaggcaugagucaccucgcccggccccaguaggauuuuuuaaauugccauuucuggucagaugcaauggcugaugccuauaaucucagcacuuuggggaggccaaggcggaggaucgcuggagcccaggagcuugagaccaaccugggcaauauagugagaucuugucucuacaaaaaauuaaaaaauuagcguaguguggugggacaugccuguuguccccgccacgcgggaggcugaggcaggaggauugcuugagccugggaggcagagguugcagugagcagagauggugccgcugcacuucauccugggugacagagugagacccugucucaaaagaaacauaaacuuuaaaaauagcuauuuuaaaauuuugucaugguucaguuauuucaaauuugccuuuugcaaagcacaugucucaucuucuccaugucuugaccacaguugugcgggauuccucuugaagucaaauaaguaaugcacagguaagccaaagaaaccugaaaugguagcaauccauucauggaaaagagccugcccugcuguaaaugacagguuuugggagucucugaaaagcaucgguuugcccauguugcccugucucugggucaugcagagcaguagagaauuucaaaucuggacuugguggagugacugcuuuuugccuuuuuucucuuuauaaugugugcugucuggggcucaugcuuagcauuuccucuuggugaagucugacacagaaccgcuucuuacuggauucugcucuguguguaauaaacagucaauguuaucaggaaguugaggaauaauagaauucauuaguuuaacuuuuuucuuacuauaaaagcacuauaauugcacauaauaaaauguggaaaauagaggaaagaagauccuggucucaucucucuacaacaagcacuuuaacaauuuggaaucucuucuguugguggacucacuuccuacuuuaauaaguaauuuugagucauugcuuccaguaucucucaguuuuuguccaguuacccuggguauacaguucugccuacacgaagaagaaauaagagcagccuuauuauaaaauauucuguauguuccacauaccuuguggcauaaagagaaacccuuucaggaugagcaggagaagauggaggcaggcaggcagaaaguguuagaauugccgguggaggguugcuggauccuuaggguguucauuuuuauuuucauuaaaaaaaaauugauaugaaagucauugacauaaaauacauacaaugguuaauuuuauugagacagggucuugcucugucacccaggcuggagugcaguggcacaaacacggcuuacugcagcuuugaccuccugggcucaagugauccuccugccucagccucccaaauaacugggguugcaggugugcacaaccuugacuagcuaguuuuuuuaaaaaacauuguuuuguagagauggggucuugcuauguugcccaggcuggucuugaacucauagccacuagugauccuccugccuuggccucccaaagugcugggauuauaggcgugagccacugugccugguccaaauuagccauuuuuaaagaggacaauuaaaugauguuuaguacauucguuauguuguauagccaccacuucuauguaguuccaaaacaauuuuugcuaccacaaaauaaaacccugugcccauuugcaguuacuccccauuucucuucccugagcccuugacaacaaccagucugcuuucuguuucuauggauuuacuauucugauuauuuccuaugaaugaaaucauaugugacuuuuugugucugacaucuuauucuuuaucauaauguuuuugaguuucaacaacaauguugcauguaucaauacuucauuccuuuuuauggaugaauauuccauuguauggauuugucacauuuaucaauuuaucaguugaugaaaauuugaguuauuucugccuuuugacuauugugcauauagggcugcuauaaacauuuguguauauguauuugagucuguuuuuaauucuuuuguauaaggcauuaaucuuauuccucagucuuugggucauaaaauauacaggcugagccagcuuacuugaaucauggcaguucacgguuggaaccaacacauuuugcuugcugcuaagcaauucucugcauuauaaugauuuaagucacaaucccaaagauaauacauggguccccuuuugccugacuggugcuuuguuacaggaauccuaguucagcaucuuguaccuacgguguaaaauguuagaaucucagccaucuuaucauaauugcucauggggaaaaacaaucuuuguacuacucugcucaucagcagaucuuaguuauguauccccagacccuagcaucccugucccuugccucaucugcccucucucugcucagagcaucuggacucauggcugcugccuguguuugauuuagaacuaaugguccagggccaccagugacuguggagcuguuaacaugugacucccugagcacgggguauaugucuuggagauacccaaucgugaacuuauuauuagauaugcucuauuugcagugucuagauugguccuuugucuggaaaugcgucucuguauuccucaauguagcucuugauagacuugaggaggaaaggaacuuugcuguuaugccaacuggaacuuuaaccuauagagagaauaaauuggggcagcaaaggaaggagggccaacaaugaucagagaugucagauuaaagcaagcauaccauuuugccacugucuagcacucugaaacaauggguauuuauuguuuuagauggguucucccagaaggcagagccucagggaugaaggcuugggugcaggaaugucaucccggaagaguagaauaaggagagcaagaggaacaaaauauggaaagagaggaggaaccccaggaggugugcuuuugugcugauuacagcugugggcaauuuaagccaaaucccacuggcuacccuuguaggaaccacacagaaugugcuucagaauucucuaccccagacacagguaaugggauuaucaucuccuggcacccaucucccauugaucaagggcugccccaaggugggagguaggugggguuaacucucucuugcaugccuagauuugcacuuguauguggcugaacaguugcuguggacuuuccaaacaggcuucuguagaagagucccaggucagaagguaggagguaaauagcacagccaaggccucaugcugucuguguaccaauaguuggcucagcagccaggaguuaaaauguggauugagagguguaaggcaggacacacaauguguccagcacguguaauuuccacauuuuuucaucucucuguuugucgcugcuuauagccaccuccuguaucuaaaccuaaaucaaaguuuuaggaauauccccaaaugauagcguucuauuauggaacguauucucagccuggcucugggugaaggucauguuuuuguccccaacuccauaacuucucuuuugcucuucccguaucaguuuugauggaauuaggccaguugauccguuagacuuaaagucacuaagucuguuaaagcuguaggaauccaauuagauuuuaacacaagaugaaacucuuaaaaaaugaauaauuuggacucuucagcagguaguagagucucuggggacaggaagaaaugagaaaaaaacucucauguacuaccaugcaaggagugauaagaguuuaauuuucuucuucaugugcucuaacgucuguuaugacagugacaugcugggucagaagccauaguaggagcuuuuguguuuuauguaaagcccaacaacuuuucuuuugcauuuccuguaaggaucacccugucuuccucccuguauuaacacagagccaacuugcucagguauugacaccuguuagccaaugccacuucuguaauaagcccagaagcucuuugcugagccaguauuugcacuggugaauugauggaaacugcauucuuagagcucacacauuagggauacuccaggguucuaugaucauagggcugagauacuucaagagaaguccuaagucuuagcuaaggugauauggagacaucauuccuuaaucaaaacagcgaaaucauccaccauuauguauacagaccuuaagugugugugucauuuuaacuuugaaucuuuacccaccagucuuuagcucuaaaguuccaaggcccauucaucaagcguaggcuugcugcucgaguuucugcaucaucucccugauguaaagcauaucuauuauguauuaccuguaauuuccuguuuugauuuguuuaaagaagagggcagccugauuacagaacgcuucuagguuuuuagagauaguuuuuacucuuuuuuaguugucaugccuguaccuaauucaauggcuguuuuuagcagcucacuuuuauugauauuuuucaaauuauacagcuuaguuucauaaagacaauuauuuucauacuuuuauugguuucuuuguuauuuaaauuguguaauuaaaauaauaaguacagcagcacaaauacaguagggacuaaauaccguuggcuguuaguaaauacccagcucagcuggugggggcagagugugcaggcauaacuagagaaaggcuuugagucagcacuagaaugcaucagucaguagguuuuggaagaaauguggugggacauccaauuaguugguuaaauugaggauauugaaagcaucuacuacagcuuuucuaacucugcuaccugaaauccugagauggggcaacacaaauaucuucucauuuaaaauagccuaagccucgccuggguuguuucuaauggcuccauccacacacuuucugcagauuucagugacuggaaugacagcagccuagugccuaaaccacaaauacugcuaaagauccccugucuugaauucauugguaaaaauggagagaucugagagugagucaggcgcuuuccuuugugcuucagaaauuaguagaaaaauaaguaaauaaaaauaaguaaaugaaucuuguuggcucuguuuacucaaguccugugucuggauucaggauucuuaaaaguccaagacaggaucuaaacauauuuguguuuuaaaaauaagccuaggccaggugcgguggcucaugccuauaaucccaacacuuugggaggccgaggcgguggaucacccgaggucgggaguuugagaccagccugaccaacauggagaaaccccgucucuacuaaaaauacaaaauuagcugggcgugguggcacaugccuguaaucccagcuacaggggaggcugaggcaagaaaaucgcuugaaccuaggaggcggagguuguggugagccgagaucacgccauugcacuccagccugggcuacaagagcgaaacuccgucucaaaaacaacaaaacaacaacaacaacaacaacaagaagccuaacuuaguguuagcauaagccugugagccuacaguuuauuucugcuuuggcaaaagugccuuacugggaauuagggagggguuaaaucuagguauauaagacaccuguguauguguuccauacuuauaaaaagcacaggagaaaagaagaagccaaauaucaagagcuucuaagguccuggccaaauacaguguuuuuaggaaaauugccucauggacgcacgacuuauaagguuucuguagccuccuguggcuaucacuguagguggguuaguaaggugcuaucuagccagacuuccuguguuauuagcaaaucuugcauuuuuaucuuaacuucaucagcaauaccaagcuuggaauaguaauuagugggauuuauuccacagcuccuguaggagucugcacgccgcuugggcauguugaugaugucgugauuuaauuuuuuuagcaugaaacauuuggaaacacaaguaggcgugcccuuuugagcuuggcauuuuugugccugagcauuugggaaggagauaaugaucucuuaguagacaggagugcucugucagagauuaguuauugauuuuaagaaaaaucaaauuugcuucuugaaauguucucagaaugacauuggacuucccaucccauggcugguuugacccacugguaggagacagauguuuaaauauaaaauaggagcccuuguccccauguuccagagugaucauuuauagaauuccucagcacgcacucgccuuuuguucuaugauucauuacuggcauaaaguaucuucugggucgauuacaaugagacgugagaagaaauagagcauagaauaaaucaugaaaagcccaucuucagggcaguaguaauauaauuuuaugaugaaaauuauccaguugaaaugauccauuccauguagaccuaaguaaauuguaugcaaauaacaauuuaauaccugacuaugacccugaggagaaagcuuauugaaacccauucuucuaauuugcuugucauucucugugucugcaugagccuuaggugguaccaggcaucuggcuugccuggcuguugucuguaauuucuaauucaggaacuagucucucccaucccuaaccuguugaccucaacuccauauugcucuaugcuuugcucacuuccaccucugccacacuguccaucuugcucaaacacaccaagugaacucucaccccagggccuuugugcucuguugagauucuauguagaaugcucuuacccagauagccuggcucacuccuuuacuucguugacaucuuuaaucaaauguuaccuucucaugaagcguucucuggccaccuaccuaaaauuggaaagccuccucaaguuuuuuuucuuuuuuucuaucccugcuucauauuucaccuauuugucuuuuuagggggugguggguggggaggaacucuuucucucaccaggaugccauuucugugaggacaggaauauuuguuuugcuuauuguuguacuuuguuccugagagcagugccuggcacauaguaaauguuuauuaaauacuugcugaaucucugaauaaugugagucaguugauguugugccagguugcuuuuuggacauuucauguuuguguaugauaaguguggugguauguaugucuuuuccagacucuucugccuguuuggaaaaggagaagagauaauaaugaaucaguguugauauuuuuaaaauuagguuuucagggaagaggcagugguuuaaccggugauaaaaauugagguuggggggauuuauugcucuuuauuuacugcauucauagcuuuugcaaggugaggccauguaucaaauucaacagaauacaccauggcugguuagauaccaucucuggccugagaaaggccauccuugaggggaagcaguaagcuguggagacagaugauuccugaguaaugcacauuaaaugcuaugcgggguguagucuacauuuuguuuuugacaucuguauacauacugcccaucaaacauuacuccuguuauuaggaauaguuaauuaaaaaccauauaaacaauuuaaaguauuagcuccaugugguuuagcucuaaugagcuuauuguuuaaguaucugagaauuaguaugcuauauuggccuuugauauuaaaaaguaauuuuuuucgaagaugcuaacucagcucccaguuaugguguuccauagagaguuguggugacuuuuuuggaccucaguugaagagagcugagugacuuaccucaagugaggcugugaauccucauguccucaucaccuuccaaggcccuaccaccuaauagcaucacuuugggguuaggauuucaauauaugagguuuuuuuuuuuuuuuuuuuuuuuuuuuuugacagagucuugcucugucgcccaggcuggagugccgucucgugaucucggcucacugcaggcuccgccucccggguucacgccauucuccuguuucagucucccaaguagcugggacuacaggcugccgccaccacgcccggcuaauuuuuuuguauucuuaguaaagacgggguuucaccguguuagccaggauggucucgaucuccugaccucaugauccgcccaccucagccucccaaagugcugggauuacaggcuugagccacagugcccggccacaauauaugagcuuuuuuagcggggaggggacacaaauauuuagaccguaauaugcacauauauguauguguuuguaugugugcguauuuccauugugguuuuguuaauauuuguaucugguuggaugaguucuucccuuuugcucacauuuucaaaauuaacuugaucuuucaugaagcuuuauucuucuauuuacguauuagaauaaauuuguugaguugcucaaaaaauccugccggaauuuuuauuacaauaauuauaaagcuaauuagagagaacugacaucuuuacaacauuaaguugucucauccauuuaccugauauguguauuuccauuuucucaauucugcauugauuucuuuucauggauuaaauuuuuuuuuuuccucuauaaaggucucauauacucccuauuggguuaauacuuguacaucauaguuuuuauuacuauugugaaugauaucuuauuuucuauuuucugauugguuaucguugauaugaaggaaugcuauugguuuuucuaaauucaucauauaucuggcaacauugugagacccauugauuuuuuuuuuuuuuugaaauaaaacagucacaucuacagugauuguuuucuaguccuauuuuguuggcuagugcuuccaggaaacagugguaguggaauucuuguuucuaauauuaaaaggaaugaagcuaauuuguuaaaacuuaaauaugacuuaaauaugaugguuacuguaauuuuuugcuuuguaaccuaauuaagaaaauuucuuuuuauuccuuguuuucagauuuuuucucuauuaaaauggcaauucagcauuuaaaggucucuguguuauguuacuuacuauauauauauauauauauauauauauauauauauauauauauauauauauauaauuuggggaucuguaauucuaggaauauagcacacaguugcccuacuuucagagguguguuguguguuuaugaugauaggugguuaaauugaaguuuuggguaagaagaaagauaaaaauguguaacaguuaucagcuuuccuccuuucuaucaacuauuuuaaagugugcccuguguuaauacuauuuuggaugaugaggucuuuauuuaauugugaaggcccagcugaaggggcugaaucucuaaucagguguuuucugaguugagucuugaaugagauuuauaauuugggccugaguuuugaaugauucauuuaccuuuugggagcuguagacuuuagaucuauaaaaggaaaggacuagccuagacuuaugucuugagauuccaucuagcucuaaaauugcauaguuccaaagcaugagaaaugcagugaauugagcuuugucagcagaaagacaauuuuucauguuuucaaaauaaagcauccaaaaggagucuugguacuuggaauugcaaggccccaagcaaaugguguggauggaggaugcaaaguggagaagguggaagguuuugaagucacacuugacacuucuggguggaucuguggaaaguggagaaaaaaggguggugugcgauaagggggucagaugcccaaggacagugcuuucaguugacuugggaccuucagguuugcccuggagacuggcuagggauuccagagcaguugaauuaacuguuaaggaagagucagcaggauuuauuggcagggggguagaggagggggguuagaugauugguggaugggaggaguugaaaaugaugggggaaaaaagcgcagaaaaugucaaguuuuguuucccacuauuugcaggaaaugaaauauaugcauuugcuugugacaauuuuucagaaaucuggcauuugcgugcauacucauagauucaggacaguguguuuagaagcaggcuagagacuucgucucuggaagaaccacgauuuuucauuugcacacacauuugcaugcauuuauauugccauuugagaggguauugguauaaaguuagugaaaaauguuuaagauauauuaaagauuugaagauggcaauggaagaaauuuucuaugccugguuacuuaauguugaaacucguauuucuggaugaaaacaggaauuuggaaaaguagagagagcuggaacaaauuugaaaagcuaaucauggaaaugaacuuggaaaauuucccaguuuuaagaaucuuacuucuacuuuaggucuguuuaagcuugaaagaauagacaacuaaaaaacaaaaagcaaugcaaaugaggaggucaauaugaagcaauuaagcaaaauacuggaauagauucauuuaaaaagcaguucacauuuuauucggagguugacuaucaggaaagugaaauuccagcuaauuuuaaggcccucaauauacuguuuuaaaaauuguuacgcuuuuucuuuuuguugauuuugaaguauauuuacuuuuagaggaaaaggauuuuuauccuuagcuuucacauauuuagauauggcacaauuuuuuuagaggaagagaagaaauauaaucaaaugauuuuaguugguuaaauuuguuuuucaaaauacauuaccagacuuguuugauuuuuuucuguuugccuugggcuauuuuuuucugaaauauaguaucuuuuuuuccuccuugcugugaaggaauucaaggaagugaggaaaauauguuccaaaguaaaugucauuugaauguuguuacaauuaguggacgcucagaaauuuuucacaucagaaaaauuuucuacaguagaagugguugugucaaaugucuauuugaaaucuuaaacccccuucccucccuugccuccuuuuaauucuagcucaacaauuacaaacuuuugauacaugucuuaagagguuuugaggaccagcugaucuuuucuauuuggaacuuuguuuaucgcaaguauuaagggaaacuuuccauuaguuuaaauacuaauuauuuuuuuggguaacccauguagauuggauuaauuuauagggaacuuugcuuucucuaacagguggguuucugaaaaugugaaaucauauuuuaagagcauuuuuuuucuccgaagcaagugguuuuuuaguaauuaggaugacugucuuuuaaaguuaaggaagccuuaagacugugacuacuuaagauaccaaggaccaaaauggccauauaguucauucaggaaccacuuaacaaccauuccccuauaaugaggcuugaagaccucauuuuauuaauuuauuaaugauaguauucauugcauacuuuaugacacaugcuuuaugugucuuuucucauaucauucuccaacaacccaaugaaguagguaauauuaaacuuuagaauggaagacaccuacauuuucuagguuacacagcuugcaaguguuggagcccagauuugaacucaggcaguugacuugagaaggugugcucuuaaucacuccccacacuguccauaguacuggguggguacagggccuguggaugguccagugcuuguugcccuaagcuuucucacacuaggcuucuaucucccaggcuuguuacccgauuaccuugauuggacagauucuuucuagugauuccucuccuuuuccaagcaccccuuucccaaauggcaguuuuggccaguagauucaaagcauauguguguuuugucuucucuuugcaaccuugggaaauuuaggaaucauucaaugagaauguagggaaagaccaagaggccugugugauuaugugcagaugccuggacaggcucugagcaucagcacuuggucucaccugcucccacacucuuuuuugcugucccgcaucaucagccaggugcuuacgaagcaaggggacauaaggaguagccagaugaacacugauggcugugugagggacgauucuccuaagcaaaggaugaagaaacuugcucucgacuccgaauuuuccacagauggcacacuugguguuucuaguugcccccauugaaguaaauauuuggaacaaaaaccugccauguuguuucucagacucuguuaauauuuuaaauuaauagcgaagauaggcuuuuaugacauggaggcauaauuuugaaacaaaaccuggagauuguagacagguugccuuuuggaaacacagccugcucauuuauagugcuugcaauuugcugccuuuucucacuuguucuuguaaugacugauuaccugugggauuuaugaaggguaagacuuuuuugcucauguuuauccugaaagaaggcauggaugugaauuacacugugaaaauccccaguuaauggaaaauuaaagguuuuuugacucaaaguuacugcuuguaaauucaaaugacagccauuaaguaauuacgaucaugguuuuagacauccaccguggaauaauuuugcucuugggugaaucugauuuauugccauucauggugauacugcuacaggcaaaggugucuauugccagagcugucuuccucacugauuucugaagaguccucauuucuacucagaauuagaagagagagagagugugugugugugugugugugugugugugugugcgugugcgugugcguguuuucccuacaaucuugauauuuaauggcugacccuguaaguauuuaauuauguuuugggcuucugaccagucugaccuuguagaaaauaagaaggucagugacucagcgacugcuuaugauuuugugcuaagcaacuucuuaacauuuuaaaaauccauaagguuuucauuguucaaguuuucagugauauuaagaaacaaacuuuguccaugcagcuucugcaugucaggcacugugcuaaguauuguauaugcauaaucuaauuuaaacuucauggugacuuuuaagggucaauauuauuauuucucuuuuuaaagauuaggaaauugauguuuaaugagaaaacuuaaauaacucaccccagaucacauggcaagagcagggguuugguaggggaggaguggggggauagagguguguguaugaagaaugaaacuuaucugucuggcuucaaagcccagggaaaaaucugccuuuuccuggacuggaauaagccucgcugacagucaaaauauauuucaguggacucuuaauacuuaggcaaauuuacuguuauuaaagaaauauccucuuucucccucuacucuccaagugaaaagauugaagcugaaaguaggugauuauuauaugguuauuuccuaucuuuaucugcauuccaauucauuauguccaagucaaauccagagaaucuuuacaaucugcgguauuucaagguaaacccaaacucugauuucuacccuggcucucgccccacuccuucauccccuggugaucuguaaaacgauggaucauuaacauuuaacaguuuuuagagcugugccuguuagccgaggccugaggcuaagacuaccuaggguauccagacuguuggguugcuauguagugugcugccuugccugucuagcuucccaaagccuacucaggcuucaggcccaucacccuuggaacauccugccgugaugagaugagcucacuucuuugacauuuucuggcuguauugccaaauuagccccuguuaugcaccaucuuguaagugugcaucuguguauguuucccuccgucugucucuguauaugugcaucuuacauccccagcaauauuauagguaucuauggugaaaaacugucucauacauuuuguuuucuuccugacacuacacaguagauauuuuccuaggcacauaguagguauucaguaaauguuugaacuguaggaacuagaugauuuccacauuaucuaacuugccuuuucucaagcugagaugaaguauaggaacaauuagaauguaaauuuuaugcaaaauuaaaauguuuucaauagggaauacauacguauaguucaaagugaaagaauauaaaaaguagacagugaaaaaaucuccccucuucacuguuucuauccucucauucccugcuucuccacaaauaagcagccacuuuauaguuuuauauguauccuuccacaguauguuuguuuuaaacaaauaauuuucaacaagcuaaauaacaaaaauacuuauuuaccucauguuggaaaagcuauauuuugcauacuauagaucaauuaugugccuuccuucacuuaacuguauagcugagagauauuuccagaucaauucauagagaccucucucauuauucucuuacagcuugguaguauuccauuacauagauguaccauaauuuauuuaaccugucccaugcugacggacauuuggguuguuuucuguccuuugccaucaggcauagugcugcggugacuaacagggacauauagcauuucacccagcugcagguaugucuggaggauacauucccagacacgggauugcuggagccagggggagauguguuuguaucugugaugggucugcugauugcuguucucaggguuuugccaccuuuuuuaccuccacaaacucguuucucuguggcccuguugacagauuguguacucagacuuuugaauuuuugccaaucugaugagugaaagaugguuaucuaaaguaguuugaauuuacauuuaucuucugaguacaguugaacauauuuuccuauguguuaaaagccauuuauauuucuuuuuuuguaagcugucuucauaccuuggcccauuuuaauaauuauuuccagcucuacauuuuuccuaguuuauaguugggcuuugcugguggucguagugggguauuuuguuggucuguuuguuuccuuugcagaaauuuccaguuuuuaggugaucaaauuuaucaagcuuuucuuuuuucuuuucuuuuuuuuuuuuugagacggaguuucgcucuuguugcccaggcuggagugcaauggcacgaucucggcucacugcaaccuccgccuccuggguucaagugauucuccugccucagccuccugaguagcugcgauuacaggcaugugccaccaugccuggcuaauuuuguacuuuuaguagagaugggguuucuccauguuggucaggcuggucuugaacuccugaccucaggugaucugcccgccuuggccucccaaagugcugggauuacaggugugagccaccgcacccggcuaagcuuuugugguauagcuuuuggauuucaaaguguuaggcccaugguuauguguuuucuucuaguacuguuuguuuuucuuaaaucuuugauccauucgagaucugugaucugagagaugaauccagcuuuguuauucagauggcuucccaguuaucccaacauuuacugaaaaauucaucuccacuaaguugagaugccaucuuuaucauaaacuagauuguaauuuggauuauauauuaccacaggaugaaauguaaacacuggacuaacaaaugaggaauacuugguggacagcuuaguucgugcauauagaugacauuauuaagcacuuaauaaauuaaacaauugugaugugccaggccuuggggauauaaagaugagcaugaaagcaucucuuaagaaaguaacuggauaaucaauauaaucuugaugcaguggaauaagagcagcagagaggccgagaaagccagggagaugcuucacagagcagagaacaccaugcugaguuugaagguucagcagaggcugaccagccacagaggaagggcauucuaggaacaggaaauaauagguagagaggcagagcuccaugagcguccauggugugugggucggggacgguggggggcaggauuuugaauagcuguucauggccauagcguaggacaggaagcacaauuggagaugaaaccagaagggcagcuaaggaagggcaguucagugaguaucugugggauuugggcaugcaguguuguuauaccuccuucauaccuucagcucccuaaagagaggaaggggaaagaugaagagguccaaaaugaauagaagccaacacuuaguuguguucugcaggucaguuguugaguuuugacaccuguugcuuauucuagagugcuccaagcucccgaagccgaagucucacuuugcucccacauggaacacccaauucugcgucucccuguagccagagacaccucagugugggggcccccgguguugucacaaucacgcaucacaagucgccugcagccgcccgaagagccaagagucaguauuccggccagcuucacgaagucagagagguaggcuuugcucuccuacuagguuaagcagccccggggaguugggggcugugacagucgcucugccgacuccucuuccuuugcgccgucuugauuuauggagagaggaccagcagcaaaccucccagccacacggcugugacgguccuuccugguuuaaaaaaaguuaauuguuccuauuucuuagguuaagugaauuguuaggagacuacucugagaacucggaaagcagagaaagcaagccuacaaaaauauggauguaaaugaaguacaguuaaauccacgcucauagcaaagacuaggccaaaccucauggauaauaagaaaauaacuuuggguguuuugaaacucaggaagugcuagacauaacgcagauacccccuguuuucugcccugcuucacuuucuuucucuccucuccugcuuccccucauagacacacuccaaggggaggguuggguagugaaaagaauacuguccuugaagucagaagacuuguuuaagagcaagucuucugacagccccgaaccucaguuucuacaccuguaaaauggaaauaaaacaggcuuugccagccuucucuggggaaauaggaucauuugugacaaugaaaacucuuuaauugugccuuauaaaagugaggcgagguuauguuuaaauuucgcuuuugaugcacugagaagucaucaguuuggggaucccagauccuuaguaucccugucauccucugcagcuguuauagagaacagacucucaaauaaaugauggugguuuugguugccuacuuccuuugagugcugagguuuuuugcucugcagcuuacuuggguacagaccaguuugcuuuccucuuagagaaaguggcagggcucuuccuccgugucacacagaaugagacuccucgacuagggucuugccgcugcuugaguuagcaugcgucuggcuuuaguuuuuaaaugucacaagccagguagugcucuguuagcugacuaucuugguucugaaucuggcccaggaaggacagucugaaauccgaaucaaaucuguagaugcauaugaaagacaauuuuuuuuucuugaaagauuuuacauguauauacugugucuugccuaauaaagaaaaaguagagagucagaauucuauuggaauuuucagguagaaugcuuacuuugaaauagucacccugauguguuaaaaaggaaaaacugggccgggccugguggcccaugccuguaaucccagcacuuugggaggccaagguggguggaucacuugaggucaggaguucgagagcagccuggccaacauggugaaacuccaucucuacuaauaacacaaaaauuagcugggcaugguggcgcgugacuguagucccagcuacuuaggaggcuaaggcaggauaaucgcuugauccuaggagcgggaggcugcauugagccaagauagccccagugcacuccagccugggcagcagagugagacugugucucagaaaaaagaaaaagaaaaaguagcuauuagcuuaauuguguuacguuaguugauaugaugaaugauugugcacagguuuauauuucuuuucauuuucuuagcaccuuuucaaaacauuguauaauggaaaauuuucaaauauaugcaaaauagaauaguaaugcaacccuauauccaucaccuuacuuuaacaauuccaacuuuccauuguucuuguuuuaucuguuuuuauuucccccaccacuuuauuuuuccugcuagaguauuuuaaagaauaguuaaguuuuauaaaaaguuccuguuagauaaauaccauuacauuaacuggcagugauaaaaugacacaacacuuaacuaugauaccaucauuucacuuuuauguagaccucaucgcagauuaguuuauaaguaauuugagaccauaaccuugaacaaaggcaguugaaaguuuaugguauuuugauaauauucuuuauuguauuauaaugaaucucuguggacuuacuguuauaaaugauaggaagccuguauguaugaaaaaaaaauguaggacuuguguguagugagcagugaccuaaauaaaaguugagguacuuuagcaugauuaauuaguagcguuugauucaacagaauguuuucuaccuucauuuaaaaagaauucaaauuuuuaaaauaaguauggcuuuuguguauggguguacaaagaaguuuuauuuauauaaauucuauaaugcaaguuuauauugcaaaaaauguauaaagaaaauuaaaauuaccuacaauuguaccucccuacagauaaccacuguuaaccuuucagugaauuugcuuuuggguuuuuuucccuguguauuacagauguagauacguaaaaaucuauacagagcaaucuaaaaaaaauuuuuuuuuuuuuugagacagagucucacucuguugcccaggcuggagugcaguggcuugaucucagcucagugcaagcucugccucccggauucaugccauucuucugccucagccuccugaguagcugagacuacaggcauccaccaccacgccuggcuaauuuuuuguauuuuugguagagacgggguuucaccguguuagccaggcuggucuugaucuccugaccucgugauccgcccaccucagccucccaaagugcugggauuacaggcaugagccacugcggcuggccagagcgaucuaaauuuuguaaaugaauacacguaugcuuuuuuuuuuccuuuaucguauuguuuuuucucuguugucuaucuguuggggaaagcuauugaaauuuuccauagaguuucaugauaugaaaaauaauuaggugaagccagguccgguggcaugcaccuguaauuccagcuacuugggaagcugaggugagaggauugcuugaggccaggaguucaaaaccagccugggcaacauagcaagaccccaucucaaaaagaaaaaagaaaaaguagaugaaaugccucuauagccauuugguuuggcuuuuguacucuugggugacaguauauuucuucagcuucuugcuuuuuguauauugauaaccuuuauuacucaaaauuuaaguaagauuguugacauauaagugccaacacugguaauggagagaauuuuagggugccgagccccuuuaggaagaguuuaaaguuucagucuucagacaccauguccaccuucacuccugaugggagaugaguagcuguucuuuggaauuugucauuuugugauguggccagguccaccuugggagcuauccgagcaaauugcacucauaguagaaaguuccgcaguuauuaauuucagagcauaaaggccacugcuuuaagguuccacuguauuuaucuauaaaauaacgagaagaaaauggaauaggauuuuuaacccagcuguucagggaagauaaacuuaugaccacagaagcaauggagaaaaucaucauacacaagacagaugugccugaauaucaggagaauaaaagagaaauagcccagccaaaggcaauagaauaaacaguaaauggaaagcuacagcauuggugaaaauaaugggacaguuugaaagauuaaaugguuauccaaaauaugaggaauugagauaccaaaggucggaacccagcauccucucaggaagugguuaggagagaugaguauagggaauuucagagacaauaucaucaggaggaacagacauauucucucuagcaauucaagaaaugaaaauuaaggcaacuguuugugaaauuaucagaauuaauucuagcccauuauuggugggguauuaagaaauguugacugugcugcagauugucuuuuugcuacaaucuggugauguauaguaagaaugaaacauaaaccaaacugcauugccagugacccauaaauuuccugcugggaaucauaccugaggaaacaauuuauggaacuggggcuaggaggaagaaaauuaauuuggauaaagcuauucauacuaauaaaggcauagauucaauacaagacauuaagggaaugacuaaacaauaauacauuuuagauucuaaaucacuauauaguaauuuaagauaagagucaugucgguauuauuacuacauggacauguaugcauaaaaugaguaggaaaauaacuauacagaauaauauauguacauuggacccuauagucaucuuaauaagcuccagaaguuguuuaagacagugguucccagaauuuuggauuuuacuugcaaacgaaguuuuagaaauagaauuuugggaguaacauaguauugcuauuuuaaaauuuacccagaaaggacauuuugaaaguagucauaaucucugguuuccacuaucucauaaaaacaucuuaaugcccccaaaaggaauauaaucucagaauaaagagucauuuauugcauugaguaagaagucuuauggggcugggugcagugaaucacgccuguaaucccagcacuuugggaggcgagaugggaggauugcuugaguccaggaguucaagaccagcccuggcaacacagacuccauuucaacaaaaaauuuacagauuugcuaagugugguggcucaugccuguagucccaaccacucaggaggcugaagugggaggauugcuugagcccagguguuugaaguugcaaugagcaacgauugccccacugcacuccacccuaggcgacugugcaagacuuuuucuuaaaaaaaaaauucuuggacuggaagauacuuccuuguggauugauucuggccugugcaucuguguuuccagucugucuccuccauugccauugucaaucacucuuugaguucaugccuugcucuaucuccagaaaaccaccuuccuaaauaggaacauuuuaucaugucaccuuucugcucuuaaagcaaacaaaaaaauccccaaaccuuuuugauuccccacuguccauaggauaaaggucaaacucuccuggguggcccacaagcccagcuuccugcagugugcacuccuccaucccccaacccucagugccccuucuuguccucacuggggacuuaggaccuccucuguugggaggcccauugcucagcagaacuuucugccaaaacagaaauguuccauacuuuacuugauauggaaacauucauaucuuggcuccacuaggaaacaguugagcguacaagaaggcuuaagaucuaugauggugaugcaggagguuuuaucgagugagaugggaugauauacccgcaacugcaagauauccgcuggcaaacaaggaagaacccagaaacagccaaggaggagaagcgcagacagauggcacuuccaaagcaagagaaagcacugauugaugaaugaugugaaggcuuugguggacaauggccagagcacagauguaugaucacucacucugcguccaaaccaacaaagauggcgggucuuucgauggagaaccuaguccaaggcaucaacuugagaucugaucuugcccuugacgauaucaaacuguacauaucaaaccuugcgaucguuuccagugcucuuguagcaaccaucggucagcagaaagugauccuucagugcguugaagaacgauuuggaccauuuuuuggaucagagacuuuaugaugcccuaaccacgacucaacagaacacuguaacaauagagacucacgucaaggcgcuuaagcacaauuuagguuaaauugcaaagacaauugauggcaguacuagaucucacauuggccaaccugcaacuacagcaacugucaaggugaucccaugagcucuuccugcauccauuuaucccuuccauauguucaagcugucaacacuuccuguuucuucaggcccaacugcuuucauugaccauggugucuuuauagaauuaaaaaaggggcagggcgugguggcucaugccuauaauuccaucacuuugggaggcugagaugagaggaucgccugagcucaggaguuuaagacaagccugggcaaucauugucuuaaugaaaccccaucucuaccaaaaaugcaaaaaaguagcugggugugguggcaugaaccugugguuccagcuacuugggaggcugaggugggagaauccuuugagccugggcaguggaggcugcacugagccaagaucaugccacugcacugcagccuaggugauagagccaaacuccauuucacacacacacacacacacacacacauacacacauacaaauuaaauuaaaaagggccuagucaaaaugagcuucgaaaugugcacaguaugaauggagaugugcuguaauauaacacgcacucuagauuccaaagacuucguacaaaacaagguaaaaugugucauaauuuuuaauacucauauacuaaggaaaucauaauauuuuauauccauucaguuaaauaaaguauuuuagaauuuauucuaccuauuucuuuuuaccuauuuauuauuuauugcuccuugccugggcuguggacagguugggaggaggucuuucuaccuuuuaaauucgccuacuagaaaacguaaaguuauguaugugucucccauuuguggcuuggcuuaucuuucucuuggauagcacugcccuagacugugagcuugcuuacucacccacuccuaccuucauucugcagguaguaauugagcaccuucuaugugccagaccacagauaccuaugugaaaggucacaucuuauucaucuuugcaucuuucagcccuugcacaaucacuaggcauacugaugaacaaauugaauuaaggacucguucucuagcuguuagggcucuuuuaaaauggcauauggagguauucaaggguugcuuagguaacuauguggauuguaugucagagaggagaccuggcaauugguugaggguugucagguacucauuuaauguucucugacugauagcauuuggugaguguacaucuagaugacuaugugaccauggggaaaagugaugauaguguaagccuauuaaugugccacuugaauuguuuuauaaaugaaaucuaguauauuuuaaaaaauuaauuugauccucucaguuauuuaagcauaugaugauugaaauguaugguauuuauuguauuguauuuuuuuuucuauuuuaacuuuuuuuuuuuuuuuagaguugggggucucacucuguuggaggcuggaguauagcagaucaaucaugacucauugcaaccuccaacuccugggcuuaagcaauccuccugccuuagccuccugaguagcuaggaguauaggcauaugccacuauaccuggcuaauuuuuuuuaaaguuuuuuguaaauauggggucuugcuauguugugcaggcuggugucgaacuccuggccucaagugauucuccugcuuuggccucccgaagugcugggauuacggggugagccacugcaccuggccuuuaacuuuucuaugucuaguuauuacaauaguuuuuaacgcggcucacacuuacuucaauagacacaaguucaauugguacaaguacaaugugauuuuaauaaaauucuuccuugcuagauguuuucugaagaaaugcaacccuaauacauguuuauacugaauacuuuuuuucaguugugacauuugagacuuaaaaaacaacacuuaauucaguagggaggcuuuggauucguagcaugaugagggaaaagguggugcuguugaauauugggugugugugaagcacaaauagagauuuaguuaagcauccagugaaaauuuauaaacaaauaggaauuauccuucuuugaaacauuuuuucauuguugacuuuugcuuccagguacacacucuccugacagaggaaagcuguuugcugcacugguuuacuggauagauuaacuggguugaggcuguguaauuuaauaugauuuuaaauaaaccuuuuacagagucugauauguggagggagauguguguuuaugucaucucaccuaugugaauuuauauguuucuucauguaauugcaauguuauauuuacuuacuacacacacauacggaagacccuuuaaugaaguucccaucuuuauaaauggauauuaacucaguauucucuccuuucaggaugauuuggugugaucuuguuucauguggauggaguaaauaccugguuagaaauucauguacagccuuuguuauggaagcaguaacuguaaacugucacccuaacaaauuuuauuagcugaucaauuuuaagguagugaucuguacuggcagaauugaauacagacaaucccaucaccagggaaaccacauuuaggguauaaagugaauuuacccuuugugugaacagagugauuaguuuuuaaaagguccuuaauuaauuuuccuguguacuuuuuggauagaugaugacaaguaaccauaaaauguauuuuuaguagcaauuugccaucucugaaaauaagucaguuucaaacaucgguuuucaaaaaauguuaauguggaauuaguuaauagcagucauuuccaaauguuuuuaaagcaauagaguggguuguuugugaguaaaaauauuagauacuuacuguguaagaacaggugaaguugguguuuuaugagagcagauuuacuuuagaagguaaaaggggcauuuguugauagugaagcagguuggcuggaauagugagaaugagaacuuaugagcaccccuacaaucccuuaucagccucugcaucugugaacuuugaaacaaacauuuguguggucuguggaacaccaugggauccuuugagaacacaguuugagagucauuggauuugguuguccacuaagggcaucucaggugaacaacaacaaaagcccaacaccgagauaugucccccaccaauccucaacucauuguccaacugcugcccuggcaggagaaugcucuguuguggucucaaccugcugggagcacggcauggcuggguggggugggggagguaggagaauaaacucucaguuuauucucucaccaggcucuuuuuguucauuuacauguuacaccuggaaauuagguauuuguuuauguguuuauugucugaccccuugucuuccuccaucuaaagguguuuuugguuuaaccuguuuauucccaagcccuuagcacagcaccuagcacuugaaagaugcucagcaaaaauuugaguaaaugagugauuucccacugaaaggauuauaaccacugggagauacuucucuauagauuagguuuaaaaagccuuugagaggaaggaguuucucaccuugcaccaucuccuuaggaguuaaagucccaaagcagaagcaagggggaacuugggccaacugcauuguacacuuacagcggcuucucacuguguccugggcacacuuagguacuucuuuuccuagugccugguguacuuuauaccuaucuauauuuuuagcaaauauuucuuuauguugaaauuuuuuuuuuuucucccgagauggagucucgcucugccucccaggcuggagugcaguggcgugaucucggcucacugcaaccuccgccucccggauuuaagcgauucuucugcuucagccucuugaguagcugggacuacaggcaugcgucacggcacccggcuaauuuuucuauuuuuaguagaaacgggguuucaccauauuggccaggcugaucuuggacuccugaccucaugagccacccgccucagccucccaaagcacugggauuauaggcgugagccaccgugcccagcuguaauuauuuuuucuaauauccccauuaguccauaaccuucuuucuuaagggcaugacuuuauuaauaauaauagcuauuacuacaugaauaauaauauuucauacuuguuaggaucuuaccaaguaccugggcucaauacuuuccuugugcuauccucaagucaacucugugagguagauacuauuauuuucccuauauuaagacaagaaacugaggcauaaagagguuaaggcaaagagagguguacuagcuaggguucaaccagagaaacagaaccauaggagaucuacauuaagagauuuauuagggggaguuggcuuauaugauugugggggcuauucaggcagguccaggauccauggagcagacacagaaguggccaucuacagauggaauuucuuccuuaaggaagccuuggcucuacucuuuagaccuuucuguugaaucuaucccauccagaugaucucuguaaucucucuuacuuaaagacaacuaauaaugaacuuuauccacaucuacaaaauaccucucagaaacugggaacuguagcuucuccaaguugauacagcaaaaaagaccaucaugagaagucacacgcgugugaagugguugauucuggcccagggaauuugaccgccaacuaucauaccaggugccaauucuugugcagggagcuggggcggcaguggcugccaaggccauggcugucucgcccuccuagaaguauggcugagacucuugaucucuguaugccucacuccuacguggccccuggccugugcaguaccccaaugaggacucgaugaauuuauucacuuggaugagucaccagaacacagcacuauucaguagaaagagcagcgaccucaguuccaguccuugggcaagucacauuacaucucucguauguaaaguggaaauaucacaacuucuuaccuugaugaaugauagaaguaaaagugcccggcagaguguagcacaaaguaggugcucaggcaaaugaucagagauucccagaugugucaaacugaggucucagagaggggagaaccucaaagcugccaucgucacccuucuaguuugucagccuggguaggccagaaugggagagguggguaucagcgggggagccucugaaaaaguucuccuguccauccuaccccuuaaugugggagcugcaucccuagcucuaacaaagguuugugugaaggugaggagacauucuccuugucccacacccuaaguagauguguccuaucuguccuucccugaaaguggcaaucuuagcaaccgugcucuugguagaaugugggagucuguauuuugccugaaagugccugccaguaacacggcagugucucagaagucucugaacaccuccuacccuacucacuagugauuuuuaaagaaagcgguagggguggugguggaguggggggaggccaguaaugaccaguucagugaguuuuguaccuugugauuccucuaaccugaccaaaggugaugagaccagcugucacugccuuguccuugaagcccuuuggacuuugagguggucuccagugggaauuccacucaggagggccacuggguuagaaugaggucauuggccccuuuuggaguaggaguggggagcauguagagacugaacaaaacagcgagcagaggccaagagcuggagaagcgguuaguggagaaguugauugcugcuagcaguuagaggguaagcagcuaagucacagaccguugggcuccugugugagaggaggccaugagaacugcuauggugcugugcuagucaggguucuucggagagauggaaccaguaggauguguaugugcgugugccuguauacacauacauaugcacccgugcacacagagagagaaguuuguuuuaaggaauugguucgcggaauuugggaggcuggcaacuucaaaaucugcagggugggccaucaggccggagaugagggaagagccaauauugcaguucaagugugaagaugacugccaucauaauugcuucuugcucaagaggaggucagucuuuuguuccauugaggccuucaauggacuggagcggcccacccacauuacagagggcaaucugcuuuauucagaggccaccaauguaaauacuaagcucaccuaaaaagcacccucacagaaacaugugaggguguuuuuuuguuuguuuguuuuuugaggcaaggucucccugugucacucaggcuggagugcaguggcacgauccuggcucacugcuacuuccaccucccaggcucaagccauccuccuaccucagccucucaaguaucugggaccacaggcaugugaucaccaugcccagcuaauuuuuguauuuuuuguagagacaugguuuugcaagguugaccgggcuggucucaaucuccuaagcucaagcagucugccugccuuggccuccuaaaguguugggauuacaggcauugauggcaguggcugcagcagggaggcuugacuggggcugcacacuccauggagcuggugggagccccgccccuucugagguggaguaggagcuccccgggugcugcugcagucacccaaaccgcaguccagacccaggccuccugcucuaucaagcaggcaggagccugcccuccuuggcggggccacagcugcccaaacugcggcuguggauccaagccucccuguggucuuagacggggcugggagcaggcaggauuugcccugcugggugugggugugggugcagcugcagccgccugacccacagcugcagacccugggccuccugcuccacggagcaggcaggagccggggacaagcaggaacccugccccuucugaguugauggggugggaacucccuggugcagccugcauccuugggggcccaggaagggccucccuuguacccuuacuggcuugaggaugucuguuccugcugucuggccucucuccucucccagugcccucuccaauccuggagcaggguuuggggccaagccuuggggcccugaauggcagcaggagagagaguccugcuagaaggggggcaggccccaguaaggccccaucuuuaggccagggagggccugaaggcugagggccgggcugccagucccacugaccagaguggggacucauggcgccucuuccaggcccgcccauggcugcccauggccacccauggaccaguuggcauguacuuucuccccucugagguccauaaaagcccugggcucagccagagcagggagaggauggccagaggacgaagugggcagagacgagauggccaggggacgaagagggcagagagaugggaugaugagcugcagaguggaguacccucucugcugauagcuggagaugauggaacaacuaguugcagagaggagcuauucucucugcugagaguugcggagacauccuacuggcagagaggagccacccucuccagggccuucucucugcagagaacugaacucuugacagacggccugccuacagaaaggagucacccgcuacgggucuccucugagcuguuguaacacucaauaaagcucaucuucgucuuguucacccuucacuugucugcguaccucauucuuccuggaugcaggugagaacucaggccaaggugcugcagccacagauguuuccaggaagaaaagggacaccuuagggagccacuaacagcaugagcuacugugccuggcccagauuaauguuugaccaaauaucuggacacugugcccagcuaaguugacacaugaaauuacccaucacaagcauccuggacugucuuguuccccuguguaauuuuaaugcacguaucuguaucuguccccugaggucccugagcuuguuucuggaaagcgaagggagccugacuaucaccugucaagcaggcuugguucuugcacacacacuguggggccagagcuugucucugacguaguggauggagugauguuugcagccuagcucuuguccagggccuugaugaucuaggcgguugguuaaacugacaugaaaguuacaugguguuacaguugucauaggaauucaccagagggcaaggccacagugggcugaucaucccuccacguagaccuacccgcucugggcuccacaagucacugggaccccuggaagagucacuccuggauucagcaacuggggcagacugacuuuauaccuuucaaaccuuuccuccugacgauuagaguauugcugaacaucugucuaucuugccccucucuggcucacagaaaauucaugucuuaggugccuuugaugcuuugcaggcagaaggaagcuaaguggcaaguuauuuuuuaucacaguucagugacaugaaaggcuguucugccuguuuuuaucucacguggcaauuuaauacaaggagccuuccgacaagugcccuaaggcucgagacaauaacauauuguauuuuggauauugagugaguggcugcagagagacguuggcugaguucaugucugugacacucaaaccccccuuggcaccuguguuuugugaucuuauucuugguuuugucuccagaggguguuagguuccugccaccgccaggggcucauucuaguauuucaagcuacaacagagauucuuccucauuuagaacccagucaucuuguucagcuuccagcagaggcagggcacuuuggucauucccaucuuuccacccccauuagaugcuugggcauucuaaaguuucagguuaaauaccacaguuuccauaacuggccaccucucugccccccugccaggaccauuaacauuucuuauugcuuugaucugaauuuucucuaauguuuccuuuuaaagguguaacauauuuugcuucuacuuuuauauuaaaggcugagagucauaagcugcccugauuaucuauugcuguaaaacaaaacaucuccaaacucaacagcugaaaacuacaagagucauuuauuuugcuuacgaaucagcaguuuggucuggguguggcaggaccacuugucucugcuccugggugucugggguuuccuguggaauuauuggggggcgggaagagcaagccaggggcuggcagggcaucucucgguguucauguugucucagggcgggaagagcaagccaggggcuggcagggcaucucucuguguucauguggucucagggccucucugcauagacauuccaguguggccacuucagauucuuacagagucaugcaggacucuaagaagcgcuccggggauagagagcagaaguugcuaguuucuuaaaaccugggccuggaaacugucacacucucacuucugccauauuuuauggcuuacggaacagagaacuuuccagauccacgagaagggcauaucauauccucaggggcaagagagcaaagaauucuuggccaacuuuaaucuauggaauaagccacuuuugugccuuagguauaugaauguagccuaaauagccccauaucccuuucugaauccuuugcuuucaugguuuggauccucuauuaauacgcuguacaaccaaguacuacagcuggguggcuuaaaccacagaaauguauuuccucacaguuauugaggcuagaaucugaaaucaagguguuggcaaaguugguuccuuccagaaaccuugaaggagaauguguuccaugccuguccuagccucuggugauuaccagcaguccuugcuguucugugguucauagacgcaucacuccagcuucgggcaccuguguccuguggcguucucccugcguaucggugucucugucuuuuuuucucuuaaaaggccaccaguuacuggauuuagagcccaccucaguucucucugaccaaaucuuaacuaauuacaucuccacagguccuauuuccaaggaaggucacguccucagguuccgguggacuugaauuuugagggacugcagagugaacucaguacagacuucuuugacauucguuuaggucacagcaugagauuagucuuccauuuucgacuuuguguuuaugauuuaguacaaugagcugucguaugugcuccaagcucuuggguuugucuuucagcauggaaggcaacuggucagcugucacuguugggaugccuggcccucuguggcugaagaaaguagcgguagucuuguuggagcuugucaggcacaggaguagacuccacccugccccuggguucucucuuguccccacuaacguuugcccuaggaggagagaggcuguaaggauagguugguggacagggccaggcucuuucccagagauucuggcucagcuuuguuuaagccguggacagggaugaggcccaguguguccacucgguguauuccugcuuugugugguucuucacguggacagcagagcucagcauguacaugcgugccuaagaaagcucauacuuauggaaugccaacauguugcccugaaucugccccgugaaguaaauuucauccccacuguacagaugaggacacccgggcuuagagagggccaaggcacaugcucaggcucauggcaggugggagcagccaggcuggaauuugagccagggaagucucacccuggagcccucucuuaacaaggcacacacaaagcauggguacaugcaccucguccccuccccuaccccauuuugccuccauuucuagauagugacagggcaggaguagugcucacagcauuagccacagauauuuuacuuuacauguaauuucuggaugauaguugguguuaaaggcaacaauaggaaguuuuaauuuuuguagccuuaacuuacaugaacacuuucuccuaugugucauuuuauagacaaaacaaacaaacaaaaaaaccaaaacugccucugcaugagcuaauaagugaguaacugguguaggcuucaauucuggguggagagccaucugagggauuagggcugugucucaggccaugagcuguucccugugggacccuugggcaagccauuugaccuuugcugccaccugcaaaaugaagacaguaggcuggguugucaacucaaagaugcuuuggucaucccuaaaucagaacuugaugucaccauggaaaagacacuguaagauuucuuucugaagguuuuucuuuccuccagcuacuuucauucuuugaugauuauucucugcaguccaaggauaacagucuuaaaauaggucugcaaagaaccauuccuguauuuuuauuuucagagagauuccuuauauuucuuauauuggagagauuucgauguaaaacacauaauaugugacuuaugcugguugucuagaagggauaaaauaagaauuauaggaguaaacaaaaacuucuguucuauauuuugagcaaaaaauagaaccuacaucauuuuaguacacauuuuaucuuuaacacaaaaauaauuguccuucucacauguuauuggagaaguucguucuuucuuucuuucuuucuuucuuucucuuucuuucuuucuuucuuucuuucuuucuuucuuucuuucuuucuuucuuucuuucuuucuuucuuucuuucuuucuuucuuucuuucuuucuuucuuuuuuuuugccuacuguguagagauuccagcauaccucuggaauaaacaucuaucaacuuaacauucaggagaugagaagguguggugaagauuucucacugacagaaaaaucaucacaguaaagcauguuauuuagaauuuccuaacauuuggguucauaaaucacagcgacaauacuucauaauuacauagugccuuucauuugagauucuaaaaagaauucauagaucaacuugugagauaucacaguugucuuaaauucuuuguuugaauauauugauggagauaauuucagaaccaaaauuuggauguggggaaaggugcccuuuaacccugccuaggggacguuaaccagguauuaaauuaucuguuauaauaaccuggccagggccaggcgcgguggcuuacgccuguaaucccagcacuucaggaggcugaggcagggggaucaccugaggucaggaguuugagaccagccuggucaacaaugcaaaaucccgucacuacuaaaaguacaaaaauuagcugggcaugguggcaggcgccuguaaucccagcuauucaggaggcugaggcaggagaauugcuugaaccugggaggcaggcggagguugcagugagccgagaucgcgacacugcacuccagccugggcaacaagagcaagacucugucucaaaauaaauaaauaaauaaauuuaaaaaauaaaaauaauaacuuggccaggugagauuuggaguuauuuauugguucagauguaacuucugugauaacucuauuucuuuaaacaaauuagacuuugaauuauuaauaaguauaaucuaggccagauuuagaagacacacguaaaucuguagagauaccuaugggccauuuguccacaaagaccucucugacuacucucucccagcauccuacucugaugggcaacuacuguuaccacugucuuguguguccuauacgugaaugggcacauauuuguuaauguguacuugccuauauaugcauauucuuuuuuuuaauggucuuguuuuuaaaaacaccaacugugguauauuacauuguuauggacuugauauauccuguuaugaacuguguugcuuucacauggaaauagcucuguagcaagacauuuaggaacuguuucuuuuuccugucuguaaaguguuauuuucuauggaugcaccaucacauacuucaacacuccuuucuuugaggcacaggcuccaggccagaacccucccugugaucuuuaggucccaccccaggcaauuacaaaggcuuuaccugcaggccucauggggaaagccguccucccugcgccgcacauggggcacagucggaggguguuagagucaaggaguccugcgaguucugagcccaggccucuccggguggaggcuuccucaucaaagggccccgcccuucccaggcaccucugcugaggucuucuugugaggggagggggcuugaaaacauuuuacucugacccaguccucaguccuugcccacccccagcaucccccacaccccaaccccucugcagugauccugcacugccauccacaggcuacaucugagccccuuucuggggaguagcggaauacugcaggagaaggcgccuuuuuccuguuuugacucuugcuuauaggcucacagugaguacaugagggcucagugguuaguuucgguuuggguuuuuguccucauugaccuccucgacaccuggaaacuuagcacucgacacucucgcugaacaauuuaggguguuucuaauuuucugcucuuacaaacaaugcuuuagggaguaccugcagccaugugucauuuaaugaaaguaagcgggggauccuuaggaucaguucauggauguguaauugcuugauggagccauugauguuagggagugccaguuuccuuacacccuguggacucacugugccgucaaaccuuuugcauuugccaauuggcuaggggaaaacuuguaucucauaauuuuaauuuaaauuucucuuaagugagauugagcaucacuucguauuuauagaagcuauuggcaucuccuuuccugaaaacuguucauguuuuuugcccauuuuuauuuaguauguguuccuuauugguuuccaggaguuuuauauauauguauauauuaagauaauucaccuucauaauuugucaguuguuuuuugauuuauuugggauguuuuuagcuguguuaaaauuuuuuuguuuuuucauagucaaagugucaaucuuuagagauuuggaguucugugucauuauuauaaacauuuuuuucacucuaagauuauuguuuuaaaauuauguuuucaaguaaugguauggucuccuuuuaaaagcagcuuuauugagacauauuacauauaauaaaaaucacucauuuuuaaguuuacagcucaaugacuuuuagucaguuuacauaguugugcaauauuaccacaaaccaguucuagacuacuucaaucauuauggcuuuacuguuuugacuuuuuuuaaauaagaaauuugguauaaagagucagagggggcgaggugcgguggcucaugccugugaucccagcacuuugggaggcugagguggguggaucaccuaaggucaggaguucgagaccagccugaccaacauggagagacccugucucuaucaaagauacgaaauuagccgggcgugguggcacaugccuguaaucccagcuacucgggagacugaggcaggagaaucgcuugaauccaggaggcagagguuguggugaaccgagaucacuccauugcauuccagccugggcaacaaaagcaaaacuccaucucaaaaaaaaaaaaaaaaaaagagucagggggcacccauugacauuuucuugggcuggucuaguuuuccaaucccauuuuuugaauaguccaucuuuucuccacugauacggcagugcuaccuaaguugcauacuaaauuaaguacuugggucuaugguuuucucugguuuguuggcacauucauauuccagaacuacaauacuuuacauguugucacauuagaauauacuuuagugucugguaaggccagcacagccuuauuguccuuagucacacuucguuucaacuauuccacaagaacuucagacucagcaugucuagcuuuuaaaaccuccguguccaccaccacccuacuggcacuuuuauucggagugcauuaaauuuauacauuauuuaaggacugacaucugaaugauauacuuucuaagaauaggggcauaguuauccagcugaaguguuuguuuguguuccucaggagcauuuuaaaguuuguggauccuacauguuccuuuuaauugccaaguauuuuauccccuuuuguugcuguugcaaaugagacuuuuuccauuacauguucuacuugauugggcgacuuguaaauagggaggcuauuacuuccuguggauugcauguauucccccaaaucuaaauauauucuuuuauuguuuguuguaguuuugcugaugauuuucuugggcuuuccaggaauaaacucauccguugcgaauauugaucauuuugccuccucuuuuuaguuuaucaaauuucucuuaauaauuuuguuggcuaguaugucuaaaauaauucuaaauaguaguggcgguugugauuauucuuggcuuagucuuacuuuugcugaaaaugcuuuguuuaccuuaagcauggaguacauauggauguauguguuuauauauuacagguauauuacuugauuaagaguuuuacgaaguccagaagagguauuaauugauuccuuugauaaauauuauugcauguguaugauauucugggcaagauuccaguucugggaguacagugggaaaugaaacagagacaaagccuuugcuguugaaaaguuuaaauucuaguggaacagacaggaacagaaaucaaaugauuaauaaaugucagguuuuaugaaguaaagcgaagagagggauacagaauaaugugaugaauuuaguuaggaauaucggaaaggaauguagaauuguuuucaagugccuuuuaauuauucuauuuucuuucuauuuaauuugaaauuuggaauacaguagcuuuuuucagaacccucucucccagccccaggcuccugcauuucccccagccuggggacuucagagcaagccuagugauugauuugcccucucaguccacugguugguauuugcuuguucucauauuauuuccaggacacugauuguuuaagaaaugaacugaauuuguuagacagcaggguaauuuaucaccuuggauagagauacuguugccaaggcaacuggcuacauuuggggaccucagucucccaacaugacaccugacaagaccucagugucagugugagccuuuccuggccaucaccucuccuugccuugccccaggccuggauggucacugugaaaugccugcgcuugccucguccuuucucccccuuucccuccaaccuccugucaaaccugcugggaugacaggaguaaaauggggaugaucuuagucuugaugauaugcugggugaguacagaauuguggcucuuugcucuccaagguaccugauuccagguaacugauucugggugaaacucagggucauuguagcuagcugcucaguuacaaaaucgggauagaaguagugucuguggcacguucuucauguuauaucacucuuuuccccugaauucucuguuauucuuuauacauaaguugaaguuauuaauaagucauuauaucauggcccaacaucuguccaauucuuaaaacacuuuccuauuuguaaguaauuucuuauuucuuauguguagucuucagugccucuuccuuuccuagaggaguuugguucuaaauuuggccacaucaugucuuguuaccucuaccuucauuguucugcuccauaacaccaugaucuuaccuuuguuuaaaagaaaaauucuuuuuagagauggggucuugcucagucauccagacuggagugccguggcccaaucauagcucacugcagccucgaacuucuggacucaagugauccucccaccucagccuccuaaguaguugggaccacaggcacgugccaccgugccccgcuaauuuuuuuuuuuuuuuuguagagauguggucuugaacucaaaugauaaaccagccuuggccucccaaagugcuaggauuacaggcaugagccaccaugccaugcccucaucuugcauuuuagcagucucuacuugugcccuugacacccaccauauauccuccaacacagcaugcagagugaaucuuauuuauuuauuuauuuauuuauuuauuuuucugagacagucuugcucugucgcccaggcuggaguguaguggcacgaucucugcucacugcagccuacaccuccuggguucaagcaauucccagccucccgacuagcugggauuacaggugugcaacacgacgccuggcuaauuuuuguauuuucaguagagacaggguuucaccauguugaccaggcuggucuaaaacuccugaccucaagugagccacccgccuuggccucccaaagugcugggauuauaggcgugagccaccguggcuggccaggagugaaucuuuuaauggacaugucagaucauguagcuguuaaaaagcuccaguggauucccauuguaccuauaguaaaauccuaaauccugucuguggccugggcuguccaugaccaggucccuggcuauguuucuaaccuuauuucucagaauccucccucccagaccccuguuuccuggguucuaguuccccaggcuggauaggaggucugcuguuccuagaacaugccaagacacucccacuugaaggccauugcacucaccguucccugcauauccacccacauggcuccccccaccccccaacuuccucuagaccucuguccaaaugccuccuccucacacaggucuuuccaaacuacucuuuguaaagcagcacccccugccccaucacucucuaugcccuugccuugcuuuauuuuuucaacagcgcuuguuacugccugacugccugacauuguauuaugucuuuauuugcucauugccugugucccacacuaggacguaaagcuucacagggagcagguacuugcucugcuuuucuaacugcggguacaaagcggaagcucaauagauauguaucaaaagaaggaaugacccuugcacuuacuguuuggcucucagcuaaaagaagguaaguaagugcaagaccaugaagaauggccaucuagacuuuuaucguugaugcauuugaguucuuuucagucuuccaggaagagauucuuuuuggggagugcaguggcgaggaagucuugucugugaacauuuguuggucaaguaggaaaauggugauuuggacacaagucccugacuucaacuucuggcaaagccaggagguauggggcugggacuucugccagaggcugcugggagggcugagggaacaagggcguaggcucucggguccuccuucccugcauccaucauucuuggaggggagguaaguggugugacggcaugauagguggaggcuaagcauccagggccuguaaccagacugccagaguucaauuccuggccugcccuugaucagcugagugacacugggcaaguuaccucacaagauaccuaugaagagugcuuuagacucugcaaauguacaugcagauagugacaguguugcuucuuaaguucauuuugaaaauuaguagagaaagacaaguguagagcuuagaacagugccagguacuuaauaaguugucagcaacuauuaaacccugcuaccaucgucaucguuauuguaagcuugcaagucuucuuggggaagagcuguucuucccuucuuguuggguuaucuugugaggccugccugagccuauggaccucaaagauacuuuugugaaaggaagauacuuuuuugucuacuaaaugaggcagguugugauggcugagcauucagcgccuaccaucagauuguggaagauugcucuuuauuugcuauuuuaaggugcuuuguauuuuguguggaucauuucacuuuaugucuuaccuaugagagcaagaaugcucaauuuguuaguagugcgugcuuagaagagaaaacccauuuacuagucauuucaaauuauuuugcuaaaaccacguauagccaaacauuugcgugaagggagaauguggaauaccaggcaauucauaguugcauugacuaguuuucuuucagcucauaauaaaagccaucuucuguuugaagccccaugagcuucuggaagggcacuguggaugagagcaugggaaugcaguagagagagauacgacuauauuuagucauucuuugagaccagcauuucugguaauaggugcaaggaccuggugugaggagagagcauugcaaauucucagaaaggguuaacauauguaauguguugacagguugugaauuuuguuuuaaagguucaucucaaaggaggagucagaaauaccuuccgugaaaaagcuugcaugguucauuuuuaaagaaacugcaaacucauaccaguucauuuaaaguguaaucaagacaaagucuugaagcucagcaugcucagauacaucagacccugagcaccuuuuacauuaaaauaauaauuacgaauuuugucaaugauuuugaaaaccauagggaaagccagguguaauagugagaauauaaaacaugcucccuuggagacaguguuguuuguuugaauuaaaaucauucccaccaaacagacacacaaaguaaggaccuugaccauuuaaacagcuaaaaaaaaauugcaaaccaaagcagauuuaguaguugggaaagugaaugaagucuuauuaaaguugaguaacuucugaaaaagcuuaauuuuaaaagcuucauuuagaucacgaaugcugcuguuuauugcuguuggcagucagcacuucguguuuugguaaaauuacaucuuguccucaugaagcgcguuugguaggcgcuguuacguuauggccacugugggauggggagcucuaccuuuaauggugcuugucugggaagauggccaguaauuuuggacuaaguaacuuugguuguuaaaaugaagggcuucagauauuuuucucuccccuucuguccuaauacgggucuccuucauuguuagaucacauucugcuuuuuugcugauugaugaugacaucaguuuguuuacccuagaggcugggucauuugcuuacuuguaagucaguggaacuggcuuuugcaucuuugcuacugacuagcugagugcccucaagcaggguuuuuuaaccucuccuugccucguuuuucuaaucuguaaaacggagauaauaucagaauuauuaucaggauuaaaaaucugugauguugauaguauuggauuucaacccuuagaauaacauaaauauacaugauucguguugauauaaauaauaggaugaacaaauacaugggguggggugaguaaaagcucuuccuuaaaauagacuucuaacuaauaaauguagaauaaugagggaaaugaaagaucaccauugagcaaacaucauaguaaugauuguugcaggucagaaccauugauguacacuaauguuaggugaaacuaugaugaaaaacaggauaugugaauagucucaaaguaucucccuguagaauacuuauuuuuuuacaaagagaaaacaguuauuuuacagaggagaaaacuaguggacaccaccgcaaccaagugaucaugguuaauaccaccaguaauaaagacauaaaaacauguaccaccaaauaugaugcauugagaagguacaacaucaccucuguguuauucuuaccaaaagugcacaugaccccaaucuaggaaauacuagggacauuuugaaaauaacuggcuuggacuuuuaaaaaguaugauagauuaaaggagauauaauagucaaaugcaacaugggaucccgguuuggaucuuggaccagaaaaaaaagcuauuagugggaaaacugaaaacaaggucuguagauugagguaguuguauuuuguccauauaaauuucuucauuugaauaacuacuuuuauguaagauguuaaccuuaggggaaguugcgcaaaggguauacaaaaaugccauaugauuuuugcaacaucucuguaaguccaaaauuauuuuaaaguaaaauguuuugaaauacccaucauacaugugagguacuuuugguuugaaggaagaugguuauaaacgucccugguucugccagggacuuagaggggcuuugaagcaugugagaaggugcucuuuuguucugucacggugcuauagacuuggcagucuuauccccugaaggcuggauaucacuguuccucccuagaagaccuuagccucuucagcugaccucaggccagcgccucucuggggagaaggggggcuguaacuagucauuggccugguagagcuuugcuuggcauguggaaguggaaccaucagaagccacuuucuuguugccuucuucuuuugaaaaggucacgucuggguggagccgauguuacacacuguucucauugauucacaaaaaauuauucaggggauucucacugaaucaugugugauuuuagaaaagccacuuuguagacuagaacaguauauuaguucagcucagacuuagaugcuguaaaaaaaaaaaaaaaaaaaaaaaggacccaauaccauugucuaaauaagguacaaguuuguuauucccuuguagauggaccagaggugaccaacuagagcugacuggguggcucuuugaucacuggcacaagcuuccauccugggucaacccuggcuauccaguugucaccuuuuuccaaguagugggaaaagaggaagaaagaggaauguacucuuguuuuuaauggauuucacuuuuauucaggauccguuugcaggaacuuggccgcuuggucacgccucuaagugcaagugaggcuaggcaacaaaaugcccuacuaagagcuggaggcaggccggaauuguugaaaagaaggggaauuaauaccaggagagagagaggagucuuccacugucuugguacaauccagagaauucucuuuuuuuuuuuuuuuuuuuuuugauacccaggcuagagugcaguggcgcaugaucuuggcucacugcaaccuccaccuccuggguucaagugauucuccugccucagccuccuaaguuccugggauuacaggugcccgccaccaugccuggcuaauuuuuguaauuuuuuuuuuuuaguagagaugggguuucaccauguugcccaggcuggucuugaacuccugaccucagaugaucuguccgccuuggccucccaaagugcugggauuacaggugugagucaccaugcccagccccagagaauucuuuacagagcagcuugagaaauguuuuccauaccuucaacccugccccuuguuaccuguuaagaaauaagggcuuaguucuuacggccgggugcaguggcucaugacuguaauuccagcauuuugggaggccgaggcgggcggacugggugcaguggcucgugccuguaaucccagcacuuugggaggccgaggcggacggaucaccugaggucgggaguucgagaccagccugaccaauauggagaaaccccaucucuacuaaaaauacaaaauuagccgggcaugguggcacaugccuauaaucccagcuacucaggaggcugaggcaggagaauuugcuugaauccuggaggcagagguuguggugagcugagaucgugccauugcacuucagccugggcaacaagagcaaaacuccaucuuaaaaaaaaaaacaacaaaaaaagaaagaaaucaggucuuaguucuuauaagcagagaggugauagucugaccauaaccucauggcauaagaaguugauauagaccuccuagcacagcauacuguugaaggcauucguggcuucuuucuuuccuugcaauggacacagguccugcuugcuccuggaguguaaccuuucaggacacggaccuacaucuuuugucugcagugugaacacggucacagcuagagauuugguuccugcagggauagaccucaggggccugggccugcugugggaggccucugcucagaaauuggccucuguuucacccacacucacaguaaaugcucagaagccacugcaguuaguuuugugccugguaaacaggcaggugagaagccagagucuuagggcuguuggggcaaggguuacaggagguuauaacccacucugucagauugagccaagggagacuuuucccgucuagucauuccuuccucugcaugugugguguuggcaguagcuaucugucucuguagggaacuuccccaacuccaaagacuuggggaccacaauaguaugucaccauaucauggagauguccaugcaguucuguguggcccaguuuauuucugccuaaagaaagagucuuuaucccaugcuccugaaaaguuguugguucuuguaccugacagucaguauccagggacuugugagcaaguccagguggcugaauccuaguccagguggcuggauccuaagucuccccgucccucuguuggagaaccuauggugaugucaguagccuuaucuuuauguauuaaaaaaaaaagaccacuuaaaagguuaacuuuuuuuggucaaggggaucguaaaggauuauuuuguagcugaauuaaaaucuaggaagauuaauaaaaccugaaacacagucccuauuuuaggcuuacuucagaaaaaccuccuagagcaagccaaaaggcaugaaaaacugcauuauucugaugacauuuuucuucugauagacuuauauaauuucugugucuccuuagcuguugucagcaugguuuucuuuucaaaauaaaauuuaaguauguaccauaaguuuuuauagcauauugaauuucaugguuuggcuauuuuaacuugacccacccaugugguucauuaaaagucuuuccuugcuguagccuuggguaguuucauggugauuguuuauucguauaagcauuuugccuacucauuugcuuucagugagagagugugguuuugauaaugggaaaggaaaugcuccuuagguugaguguuuagccuuaguuggcgacccaaagguuuacguucuuauuagcaugcccaggaggggugggaacgccugccauguuugauggcccaucaugccagggccaggcugguguuugugcugggcccaacugcuugccgagaauuaucauuaguacuuuuucucuguucucccagagaugguuuucaguucuguuugggugugaucacagauaaugaagugaaaugcggcuuccuugucaugaaccaccaucaugcucauuuacugacuugaaauaauauugagaucucaauauggaaaggacagcggaggaggugggaagacauuccauuuuagaaacaucuguggcuuauacaagagaaggcacaacaacuaggccacuucaucaaugugauucaaguuaaugugagaaguuggaccauugcuaagaccauuuucugcccaaaacuuccugccuuuuuaccuuucacuaaacagaaccuuugacccaaauacaacccaggcagagguuauuuaaaaaugcacuuuggggccgggcgugguggcucaugccuguaaucccagcacucugggaggccaaggugggcggaucaugaggucaggaguucgagaccagccuggccaauauuggugaaauaccaucucuacugaaaauacaaaaauuagccggguaugguggugggcgccuguagucccagcucaggaggcugaggcagaagaauuggaaaauuuguuaagaggguugaucucauguuaguaauuacuuaccauaauuacuuaaaaagcacuguuugcuuguaaguuucugguacugcugcuuacgauuuuugugauuugaagcaaauagguuaaguuccuugaggcuuuauuuucuuauuuguuaaaggagguuaauaaauguuuucagcuaucauuucuugagugcuuauaauguaccagggacugugacuaauucaucuucaccaacaccuccaugagcuaugcccuauuacaauaauuauuuuacaaacgaggcacuagaggcuaagagagguuaaauaacuugcccaaagucagguagauaauguggagcugauauucaaaccagcugauugacuucuaagcugauauucuuguucuuucuuucuuccauuuuuuuuuuuuuuuuuuuuuuuuuuuaaagagauaggggucuugcuauguugcucagucuggucuugaacuccuggccucaugugauccucucgcccuggcuucucaaguagcuggggugacaagccuguaccaucacgcuacucuuaacugugacuaugcuugauuacucuguuuggucuuggcauaucugaaaauaagacccagagagggaaaaugcuuggcagacauaccccacaagaagaaucaccugaguuauaguucuggaagggucuuauguguaaaagaccugcugacauauguauaccuugagguagggauucccaauccccaggugguggaccuguacuaacccauggacuguuaggaacugggcggcauagcaggaggugagcggugaaucagcaguacugccugagcuccaccgccugucagaucagcagcauuagauucucauaggaguucaaacccuauuaugaacugcgccugggagggaucuagguugcaugcuccuuaauugucuuccacaaaacuggucacuggugccaaaaagauuggggauugcugcuuuagggugacaguuuucugcaauucagauacaagcucuuuguauacaggacuugaagaagccuguuuuccaccaugaaauaaaacaggaccuaggugggguuucuuuaacaguuuacuuaguuggcacuaaguauggcauuaggcaaaaggcaggggaagguagauuauguuggcaugguccaacagaaauauaauguaagccacauauguaauuaaaaauuuccuacuagucauguuaaaaguaagaaacagguaaaauuaauuuuaauaauauauuuuauuuaacucauauccaaaauauuauaguuucaucauaugauuaauauuaaaaaaauguaauauuuuauguauuuuuucauauuaagucuuugaaacuccacaugcauuuugguuuucuuuuuuuuuugagauggaguuuugcucuugucacccaggcugaagugcaauggugugaucucggcucacugcaaccucugccucccagguucaaaugauucuccugccucggcuuccugaguagcugggauuacaggcaccugccaccacgcccagcuaauuuuuauguuuuuacuagagacgggguuucaucauguuggccagcuggucucaaacuccugaccucaggugauccaccugccucggccucccaaagugcugggauuacaggugugagccacugcgccuggccuccaugugcauuugaugcauacugcaugcauuuccagugggacuagcuauguuaaaugugcccaguagcuauguauggcuggaggcuaucauauuggauagucuauuaguagaaaaauauauuaagacagccuugcagauagcuccuuaugcccggacccagaguuuggaacgauauauauaaaaauaauuauuauuguuucaguuaacaacagggacuguaaauguaguggguuccagguugagagugcuagaaagaaccauagcuauuuuaucuaacauucacccccccauccccauuuuuauaggugaaggcuuguaugcucaacaacaugugugaggucacacagagagucauuggcaucgucaagacucaaacccaguugaucuuucugguacauuguauuguggacauggcaaaaagugacugugacuuauaucaugguacauauaaaaaaacuguguguguauuuuaauguacccucuuuuauguggaaaaauagcugugaccuuuugcaggguucacagaaauuguaguuuggagggauggaaauauccucugagaucaccugauucagcuucauuuuucucuccugggcccuuaggcucagggagguuaaacgguuugcaugaggcgauugcauugggucuccugccuugccgccauugcuucaccaugauacuaggaugaugaucauuggaaucagugacuguaaaacaucacagagcaaaggugggagauuccaucuaagagccaagaauuaguuuaguaucuuaccuuucuuuucuuuucuuuuuucuuaccuuucuuuuugaauacucaacuugaguuuccuccuggcccuuaaaucauuuguggccaggcgcaguggcucacgccuguaauccuagcacuucgggaggccgaagaggccggaucacgaggucaggagaucgagaccauccugacccaacaugguaaaacccgucucuacuaaagauacaaaaauuagcugggcgucguggcgcaugccuguaaucccagcuacucgagaggcugaggcaggagaaucacuugaacccgggagaaagaguuugcagugagccaagauggcgccauugcacuccagccuggcaacagagcaagccucugucucaaaaaaaaaaaaaaaaaaaauuaauaaaaauuaauaaaauaaaaaucauuuguaagguucaucagucucucuugaaggaaccuguaugagaaugggagaaaauguuugggguagagagaagugaggagaggggaggaaaggugucuauuacugcuugaaagauccugaaugaaguugacacuuccuguguggggaagccuaagguaaaagcccucauuggguguguaccuauaccaggagaguaaucuacuguaagaaaucacuuagagcagugguugucaaacccagggcauuugauaaugucugaagacaucugcuaauugacuucuagugguagaggccguggaugcugcuaaaauagccugaaacacacaggacccuccacccccacaaccaccaaguuaucugaccuaaaaugucaguagaguugauguugagaauccugacuuauagaggaaaggggcaaaauauauauucaauugucccuugguauccacaggggauugguucuaggacccacuucagauaccaaaauccauggaugcucaagucccuuacauaaaauggcauaguacuggcacauaaccuauguacauccucccguaugcucuaaaucaucucuagauuaccuuuuuugggggggcggggcaaggaauuucuaaaauuuauuucacuaauagggauuuucuauaggagaaccaucugauuuucuaacagcaguauuucagguaaauaucuuuccacauuugcuguacucuuaaagccuuucuccagugugaacucuccugugucaaaugagacuggaguuacagcaaaggacuucccacauuccuugcacucauaaggccuuucuacugugaguucuucgaugcugaaggagagaauggcuucagcuaauuuuuaccacauuccuugcacugaucuccaggaugaacucauguguuucuugagacuggagcuuucagcaaaggauuucccacauucagugcgcucauaaggcuuuuacccagugugaauucuuguaugaacacgaagugcagagcuguaagaaaaugauuucccauguucauugcauucauauggcccuucuccagugugaacccucugaugcacaguaacaugcuccuucuggcuaaguaauuucccacauaccucacacucauauggccuuucuccagugugaacucucucagguagaaggaagugagacuucuuguaaaauaauuucccacauuccccacaacuauaaggucuuucuccaguaugaaguuucuggugaucagugaggaggugagaccuguuccuaaaagauuucccucauuuccugcgcucauaaggccuuucuccagugugaccucguugguguugaaugagguugcccuuuugucuaaaacauuucccacauuguccacacucauaagaucuuuuuccagugugaauucacugaugauuacugaagguauuacauuugcuaaaggauuucccacauucacugcacacguaacauccuucucuagugaaaagcuucugguggaacaagugagugaguagugccgaaagguuuugugggccagacacgguggcucaugccuguaaucccagcaacuuugggaggcugaggugggcggaucaccugaggucaggauuucaagagcagccuggccaacguggugaaaccccaucucuacuaaaaaugcaaaaauuagccaggccugguggcaggcgccugugaucccagccacucaggaggcugaggcaggagaaucgcuucaacccgggaggcggaguuugcagugagcugaaauggugccacugcacuccagccugggcaacagagugagacucugucuccaaaaaaaaaaaaaaaaaaaaaaaaaaagguuuuaugaauucuucgcagcuguaaugagucuuucccucaugaaagggugggccaugcuuaguuucaguguuugucuucucuacauugugaguagccucuugcugguguaaucccaagcugggcaagaaguucuucccaaccucauaagagauaaauggcuccugugacacauggacuuuacagcuguuuacaaaugacacuucucuggcaccccuucucucgaguuucucuccaaugugcugcuucuggugcugaugaagguuuucagugucauccaguuuuuucccacaugccccacuccuguucaguuucugcuugugaugaguuuccugcugcugugccaagugaaaaaugucucccaagauggggcuacacauuucacaggggugagccuucuugggagaccccccugcccucagaguccugaccugagacucucuuuguauagaaaugcucugcuuauauggugccucuucaucuuucacuccacaccaacaacccagggaagauaaaagugccagguucuucagcaucacgucacaguacaggcaucucugaaccucacuaaggagacuccauuucuucugggaaaaguucacagccaugucugcaagggucacagugcccugcugagcuaggagccucagcacaaccauggccauucaacuaugugaggaaggccgggagcgguggcucacggcuguaaucccagcacuucaggaggcagaggcagguggaucgccugcggugucagaggugagguggauugccugagcccggccagcagggugaaaccccaucucuacuaaaaauacaaaaauuaccugggugugguggcgugcgccuguaaucccagcugcucgggaagcugaggcaggagaauugcuugaacccaggagguagagguuacagugaggugagauugugccauugcacuccaaccuggacaacaagagcaagacucugucucaaaacaaacagaaaaacuauguggggaaaguggggucgggagcugcaggugccaucacgaggcugaagaccugcuucugugcagcaggggcaaguccccuccaccuucugaguucagccaccacugugccaacccagcgcccuggggccucucaaaccacaaagacacucgacaccaaccaacauggcugcuacucucaucucuagauuacuucuaaagccuaauacaaugucaaugacaugugaagaguuguuauucuguauuuuaauugucauuuguuguuuuuuacuguuuuucuucaaauauuuuucaucugagguuguuugaaccuauagauguggaguucacagauaagaagggccaacuguauaucuaaacucucuauagucaaaaaaccacuuuuuaaauucuaguuuuuaaaaaauucacacuauuguuucucaugaguccaaauuuaauuacaguugcuuuuucacuuggaaaacuuagagagucuuccuaauuccauguuauuuuguaaaccagaggugcuuuuuaagaccuugagagagaacagucacauuuguugagcucaucuuguuucaagaaggugaauguguauuuugugcuuaguuuuggauuucuuagcauaauuuccauccuccuuaaaccuacacagcauugaaggccaucagccugguaaauaagcagugagugguuacauuaucagacacuuacugcuaauuaaauuuuaucuaaauuuagauuuuuaaaagcccuccauauguuuuaauuuucagcauaaauuauuuaugcuaggaggucauacaaacgggugcuugauugugguccugaaaacuucaacagaguugagggaagcugcaguggcugacugcuuuugcucuugcagcuauuuuaggcagaaagaaaaugacaggcgcgcuuucccagucuggcugggaguucacaggaggugucagugccaucaggagaaggaggcaggauaugaaagagacagaaagaauuagaaaaauauuucugcccucuuugguugguucgugaauauaaaaggcugugggaaauaguggaacuggggaaaugggcuaaauuaauagauauuuuuucuguuaccuuugagacuacaauaaagggagaugaaaacuuguuucaugcuuagcuuccaggauauccaaaugaugugcauccucagggccaagucagacccugguacuuccagaaacauccaguaugucuggauagcugagcaucuacaacacacacacacacacacacacacacacacacacacacacacacacacagagugccuagauagcugagagugcaaaacgcacccccacacaccaacucacccacccagugugucuggauaacugagaauuuuuacacacacacacacacacacacacacacacacacacucugugucuggauagcugagaguguaaaacacacacaccccugcacacccccacaacaccaacugucacacacacaccacacacacacagugugucuggauagcugacagcguaaaacauacacaccccagcacacacccucauacaccaaucacccacccagugugucuggauaacugagaauuuuaaccaccaccccccuccgccccgcugcaacaaaacagaaacgcugcuaugguuugucauuuuuagguaacuaggagccuuuuaauugucgccaauguugagagugggagagggggaaccauuuugcaaccuguuuaaaaugggguguuugagagcugcccucaacuuugaaaacuuggaaaagcuuuuuuacaacucgauaauuauuuuucucuuccugaauguuuuugaaaguuacacguaaugucugauugcuugaaagcucaaggaauguucuuugacuugccagauuauuacgacuugcucauuuuuaucauuuuuuuuuuuuuggagacagggucucuguugcccaggcuggagugcaguggugugauuacagcucaccgcagccucaauugcgugagcucgagugauuuacuaagcucagugucacgaguagcugggaccgcagaugugcgccaccacaccuggcuaauuuuuuuugucuugcuauguugcccaggcuagccucaaacuccugggcucaagugauccucccaccucggccucccaaaguguugggacuacaggugugaaccaccgcauccagcuuugucuugcucguuucaaaaucccucacagcaccuauauccacuguuuugcagauuguuuggcucagaaaauugauugaauuggaguaaucuguuucuuauuuuuuuuuuuuuugcucuuuguaaauguagucuuugaaacccaauuuuucauuuuaagcacuguauguuuuuaagaucauaauuaguuacuuaccuaguggucuauuuuucucacuuggugguuacuagcuuuuuagggcauaaagauaugauuuucauggauuuuaacuuacuuuggccguacacagcuuaguaaagcuuuguggaaaaaaaaaacaaaaaccucuuuaagucacuagugugcugucuuacaugagccaguaagaacucaaguuuucacuggggcuaugguuuuaagauaaacacauauuagaauauaguuauagugaacuaccucuggggcauaagacugaauugauccugcugugaaugcuuauaaaaaugaugcaaggcuaucagaaaaugucagaaccucaggggaaaugcacgcugauuuccauuucaugcuagucuuucuuuauaacucuguccacagacuucaacuccuuucaguuacguucuaaauacuguggccaauuugcuuuuacaaaaugggaguuuuuagccugggaaugugcccuucacauuaauucuuccucuaaaagccacugugcauauacucccauuuucugagguuugaaagaugcauuaugguuuuuaaacgacaagauuuuucaccuagcauaagagccaaaucuugagaaaaacaggcuguuccaguguuuaaaaugacacuucuauuuuaaaacaaaaaauguuuuguuuuguaaaaaggucacacagguauuuuuuuuuuccaugacauuuauguucaugauucaaguggaccagaaucaaaccuucuccauccuucccuucuuuugcauuuguuaaguuguugaugagucucaagugcccaguucuucaugccagccagccagggaauccucuagcauauggcuuacauuugggggagaacauuaaaaugaguuccaacaagcauagcugugucuucuguaccaucuggcuuuccgacacauaugcaguagaucuuuaugugcagcccaggugaucugauuccaaugauguuaaccucuuauccaggcaagaguguuguguagauugcugccaguggaucagagugugguguuuauuaucagggucaccaggugucagugggugguugaagcucucaaauuuuauaauucaggcuuugcggucagaccucaaggauuggcuccaguuccgagaaacuucaaggcgccauaagcaucucaguggcagccccaccugcaguuggcaagaaugcccccaagaucuaucagauggccucuuaaucuuuugcccuucaucuuuuucccccgucaguauuuuuuaauuagcagaugguguaugcgaacagcugugauucagagacagaagaauuuuauauaugugaaauguaaaucaggucuuaauuauucagaggaugauugaggacacauuucuucuugagcgcauacucagggguucauggguucugccacacacaaauggucuuuuaaagguuuggggaacauauugccaaauggccuggagaaaagucauccuaauuuacacccuuggcuggcaguguauuugacugcuuguuuuccugaacuccugccaacagaguauuaccauauuuaaacauuuuugccaacuugcuaagcagacaagaaagcaucuaauuauucuuacaauguacauuucuguaauuacuugugagauugaagcaugucauguguuuaucggucaugucuaauuuuuauuuugguaauuguuuugcuuacaguuuuaucucacugacuuccaguuagcuaaaguaaggaauauucauauggugggauaccagaucaucuuuaaaaucauguucuuaaaaauuaauguuaugguaaaguauuuguaauauauuaagcaaaaaaaaaagaauaaaaaugugugucaugauuguaguggacaucaaaguaguauauaaauguggcagguuuaguaaaagaguugcaaauguauacaccauacaacucagguuacaaggaagaaguauccucuuuauuuuuggugcauaguccagucauccucaugaucccuaaccccaaggagagaggaaagaaccuugcagagggagagucuuagucucuucuagccugaugguccuccuacgauguggccuggccuccguugccuauggugcuguguaccugcugacuugcagcuccauccugaucugcucccccugccugggcucuugcccucacgguaucuuucuugaggcagugccccugccuggcagugcucccggcucugcacuuggucccccaccacuucuuucacaggcacaugccgaguucugaguccuuuccuggaccuucagggacuuguuugcucugcccuguacccuauaggaagaguuuacaauuuagacuucuaagcuuuguucuggagaacuucagcaucuguuuucuuuuccaacaaaggcugacuagacuacucuuucaugauggacucaaggaccugaagaaagaccccuugguagugucaccuaccccugccacccuagagugccuuucauugaaucugugcgugaagaguuuucagaccacagaaucuacaggauauggaagaaaauauuucauuaaauauauguaugaaauaaacauccuagccggacaugguggcucacaccuguaaucccagcaugaccaacauggugaaaccccucucuacuaaacauacaauaauuagcugggcgugguggcaugcgccuguaaucgcugugacuuaggagguugaggcaggagaaucucuugaaccugggaggcagagguugcagugagccaagaucgcgccaccgcacuccagccugggugacagagugagacuccgucucaaaaacaaaaaacaaaacaaaaccaaaaaaaaaaagaaagaaacauccaggaaggaaguauacuaaaauguucaugauuuucucuggauuaaugaaauuguaggugaguuuuauuuuuucuuccucaugccuucuguauuuuccaaauuuccuacaaugucuauauaauguuuuaauaauuccauaaagccaauuuauuuuuauuauuauuuuuuuuuagaggcaaggucucacuuuguugcccaggcuggagugcacagguggcaucauagcucaaugcaaccuugaacuccugggcucaagugauccuccugcaucggccuccuaaguagcuggaacuacagguguacaccaccacaccuaccauacagccauuuuuaaaugggaguuuuuucuuuuggcuuccuugaauguuagagaaaaggggcaaaguuacugauuaaauauaguaugcauuuuggauuaccugugauuuuuagucuuccaggcuucuuucuuccaacuuuccuaucccacccaccaccaaauuuguaaaacaagaucaagaauuauaugcuuaccugucaccagcagauggaaucaggaaaaggacuaaguggaauuaagaauuuaggaaaaugaggcuucuaucauuucuuugauacuuguuuugacauuuauuccacacugauaauaguuaucuucuauuaaaugacauuauggcaaaaugucauaggauuuuauaggauaaaauuuggcacaguaacuccuuucaguauuccuguucauguugauaguucuagaaaacuaauuucuuguaacccugccagggucagauugcugacaucucugaaaucuagauacaggcuuaucucuagacagcuuuaaaauuuauuccagagucaccuuuucugggagaaaaaaaacaauaaccuaaucaauauguccuuugggaaguauuagcaacauuuucucaucuuugucaauuuguguaaauauuauucauuuauuacauuugugaugggcagaauacuuucuuuuuuacuuaauauauguuuccauuuauauucuguuugugcauuuuaaaguaacuauauuccauuuauauauuuacuuaaaaauaccaaauuccuuauaauuuauuuaaauacucauucuguugucggguauuuaugccauuugccauuuaaaauccuuauuuuggaaauuauucugaacugcaccuagaaggcauguagauuucaaauuucuuagcaaaacaugaugugaagcauguagacugugaaccaaucuaggacugaguggucugucuuugaucugcugucuugcugaucaacaggguugguguggcugaaccggcuggcuaauccuucccaaaggacauauugauuagguuauuaucaugucuuuuuuuuuuuuuuuugaggcggagucuugcucugucguccaggcuggagugcaguggcgcaaucucggcucacugcaaccuccagcucccggguucaagcgauucuccugccucagccucccaaguagcugggacuacagggacccgccuccaugccuggcuaauuuuaguaguuuuaguagagauaagguuucaccauauuggccaggcuggucuggaacuccugaccucaggugaucugcccgccuuggccucccugcugcgauuacaggcaugagccaccaugcccagccuaucaugucuuucgaauccauuauauaugacuaaaaggaccagaccuuuuguaguuaaaucaauccacaaauaccccugaagccuaauuuuuaggacuuuaaaagaaugaauauuggcaaaccgaauuccuugugauauuuguguauccuucgagaaguaguaaaucauucaaaaugcaaacaaacuaagggacaugaagaaguaaggaggcaacaaccauaucgugaccgcuuauucuaugccaggcauugugcagaauacuuuuucauaguugucuuauuuaauuccagaacaaccuggcaaacagauaauguucucucuacuuuuggaaauugaagacuaaggaguucuuaaaucauuugccugaaauugcaucuaauaaggaggugcgcugguucagaucugugucugccagauuaaaaagcugcugcugcuggucuggcccaugcugcucauaucuacaaaagucuagcucguaguaacugagaguuaccugagaagugugccaugauguauucuaaauggaacaaagacuuaagaaaaccaaaaccaaaacuuuuaaagugcuuaaaucauacaauauauauauauuuucaccugugcuaugguuugaguguuuguguccccaccacaauucauggugaaacuuuaaucuccagggcaacagcguuaagagguagggcucuuuggaggugauuaggccaugaggucucuaccaucagcaaugccuuguaaaagggcugcagggaacucuuccccuucugucugucaugugaggacacagcaagaaggugccauaugagaaaugggcccucaccagacacagaaccuacaggcaccuugaucuuggacuucccagccuccagacugagaaaguaaauuucuacugucuauaaauuacccagucguagguuuauagcagcccaaguggacugagaugucucaggauggagaaggcuuuuuaaaacgugacucaaaaaaucuuaagccaaaaacaacaaaaaagagaaguauaaauuugacuucauaaaaaugaaagcuucauggccaaaaauaugccauaagcaaagucaaccugggggcaaaguuacaacucaucacauagaugagagaccaauuuccccguucuauaagggucuccuaaaauugguaaaggaaaacccaagaacccaguggaaaaaaggaaaaagaauauuagaagguggcucacugaaaaggagggaauaauggcaucccugggucuuugccucuauccuugucugguucugcccaggcuuuggcacaugugagaaucaugggagugauuccaaagucuaguuugggcucuccaacuucuacgcaaguugccuuuaccuacagugaugagcaauugagguggagucuuucuggaucacagugaaucauaacuguggccauuuuaugcccagaagcuugagucucccagaauccuaaagccaugcucagaguaagguucucugaauuucagaaaauuauuaagggaaggcuaggacuuuaguuugggauuauugucugucaaugaccaggaauuaucuaguaacuugcaguaccugaggauaagccuuacaagaaucccagaacagaaaauguucaggacugagaaacaugccgaggcaaucuaguucagucucuucauuuuauagaaugaaaagaaaaaaaaacggcucagagaggucggugguuuguucagagucacccacgauguuaaugguggaguuggaucuccugacugccaguccaaaaccccuuccauugcguugugcuuguaaguaggccuuggggcuuacugaaacagcuuuaagacagauggauuccagucugggaauucuuccucgugauuuaaaaauugccuggccagaucuggauuuuaucuugguuuuuccuguuucccugucucccucccacaaauaccaaucaaacacgccuaccaugugcuguauacucuuuucuuucaaguuagcguguuuuauucaguuacaguuaguuuauguauauguauacacuuuucauuuuuauuuuggauaaaauugaggucauauauacaguuuuauauucuguuuuuccauuuauuacauuuuagcuauuuucugauaucaucaaaugaaaauaugguucaagacugcggugguucacgccuguaaucccggcacuuugggaggccgaggcaggcggaucacuugaggccggaaguucaagaccagccuggcuaauagagggaaaccccaucucuacuaaaaauacaaaaauuaaccaaguguguuggcagguaccuauaauuccagcuacucaggaggcugaggcaggagaauugcuugaaccugggagacagagguuccagugagcugcuauuguacuacugcacuucacuccagccugggugacagagcgagauccuguauccccacccccccgcccccccaaaaaaguuauauuaagucauacagauuaacacuuugggaggccaagaugggcgaaucacuuggggcuaggaguucaggaccagccuggccaacgugguggaaccccaucucugcuaaaaauauaaaaaucagcugugcaugguggugcaugccuguaaucccgguuacuggggaggcugaggugagagaaucauuugaacccgggagguggagguugcagugagcuaagaacgcaccacuguacuccagccugggugacaaagcgagaccuugucucaaaaaacaaaaaacaaacccauuuuugcuauugucauuuaagugguuuugcaauuguaaauaacacuguugugucauaacuuguacaugcauauuuaugauugugauuauuucuuuauaauaaauacaaguagaaguuggggucaaagguuccagugagcugaguuuuuuucuuucuuuccuuccuuuuccuuuuccuuuuuccuuuccuuuuccuuuucccuuuccuuuuccuuuuccuuuccuuucccaucucugucacccaggcuggagugcaguggccaugaucuuggcucucugcaaccuccgccuccugaguucaaacaauucucaugccucagccuccugaguagcugggacuaaaggcgcauaccaccacaccuggcuaguuuuuuuguuuuguuuuguuuuguuuuuguauuuuuaguagagacaggguuugaccauguuggccaggcuggucuugaacuccugaccucaagugaucugccugucucugccucccaaagugcugggauuacaugcgugagccacugcacccagccaguuuuuauuguguuuuaauacccuaagcaacaaaucacaaguuucuguggugaaucacaaacuuguuaucauuugguuuauagagaagaauguuuuuaaaaauggauuuuacaauguacuuuuucugcaguaaauuucuaucuuguuuauaauguuuuuagaaacucaaauuuuuuuaauuuuuauuuauucauucauauauauauauauauauauauauauauauauauauuuuuuuuuuuuuuuuuuuuuuuuuuuuuuuuuuuaaucggagucuugcucugucacccagucuggggugcaguggugugaucucagcucacugcaaccuccgccucucagguucaaaugauucuccucccucugccuccugaguagcugggauuacaggugccugucaccaugccuggcuaauuuuuguauuuuuaguagagacgggauuucaccauguuggccaggcuggucuugaucuccugaccucaagugaucugcccgccucagccuuccaaagugcugggauuacaggugugagccaccaugccuggccuuauuuuaauaguuuuuggggaacaggugguguuggguugcauggaaaaguucuuuaguggugauuucugagauucugguacacgcaucaccugagcagugcacacuguacccaauguguagucuuuuauuuccucacugucccaacccuucccuaugaguucccaaaguccauuguaucauucuuaugccuuugcauccucauagcuuagcucucauugauaaaucagaacauaugauguuugguuuuccauuccugaguugcuucacuuagaauaauggucuccaacuccauccagguugcugugaaugccauuauuucauuccuuuuuauggcugaguaguauucuaugguguguguguauauauauauauauauauauauauauauauauauaauagauauauugauauagauauauccauauagauaucacauuuucuucauccacuccuuaauugaugggcauuuaggcuaguuccauauuuuugcaauugcaaauugugcugcuauaaacauacaugugcaagugucuuuuucauguaaugacuucuuuuccuuugaguagauaccuagugguggcauugcuggaucaaaugguagaucuacuuuuaguacuucaaggaauguccauacuguuuuccauaaugguuacgcuaguugacguucucaccagcaguguaaaaguguuuccuuuucaccacauccaugccaacaucuguuauuuuuugauuuuuaaauuauggccauucuugcagaauaaggugguaucucauuguuauuuugauuagcauuuuccugauaauuagugaugcugagcauuuuuuccuguguuuggccauuuguguaucuucuuuugagaacugucuauucauguccuuagcccacuuuuugaugggauuauuuguuuuuucuugcugauucauuugaguuccuuaugcauucugcauauuaguccuuugucagaggcacaguuuucaaauauuuucuccuacuuuguggguugucuguuuacucugcugauuauuucuuuugcugugcagaaacuucuggguuuaauuagguuccaucuauuuaucuuuuuguuguuguugcacuugcuuuuguggauucuugguaaugaacucuuugccuaagcuaaugucuagaagaguuuuucccauguuaucgucuagaauuuguaugguuuuaggucuuauauuuaagucuuugauucaucuugaguugauuuuuguguaaggugaaagaugaggauccagcuucauucuuguacaugugguuugccaauuaucccaucaccauuuguugaauaggauaucccauuuugauuuuguuuugucaaagaugaguuggcuguauuugacuuuauuucuggauucucuauuuuguuccauuggucuaugugcauauuuuuauaccaguaccaugcuguuuugguaccugucgccuuguaguaguuucaagucagguaaugugaugccucuggcuuuguucuuguugccuagucuugcuuuggcuaugcagggucuuuuuugguuccauaugaauuuuaggauuuuuuucuaguugugugaagaauuaugaugguauuuugaugggaaucacauugaauuuguagauugcuuuuggcaguauggucauuuucacaauaucgaugccauccaucuaugaacaugggauauauuuccauuuguuugugucaucuaugauuucuuucagcaguguucucuaguuuuccuuguagauaucuuucaccuccuuaguuagguauauuccaaaguauuuuaucuuacuuuuauaguuguuguaaaagggguugaguucuugauuugauucuaaacuugguugcuguugguguauggcagugcuacuaauuuguguacauugauuuuguauccugaaacuucacugaauucauuuaucagaucuaggagcuuuuuggaugagucuuuaguguuuccuagguauacaucagcaaacagugauaauuugacuuccucuuuaccaauuuggauacccuugauuucuuucccuugucugauugcucuggcuaggacuuccaguacuguguugaauagaaguggugaaagugggcauccuugucuuguuccaguucucagggggaaugcuuucaacuuucccccauuuuaguguaauguugacuguggguuuguuguagauggcuuuuauuaccuugagaugucccuucuaugccaguuuuguuuaggguuuuaaucauaaaguaaugcuggauuuugucaaaugcuuuuuccacagcuauugagaugauuuugugauuuuuguuuuuaauucgguuuaugugauguaucacauuuuuugacuuaaauauguuaaaccaucucugaaucccugguaugaaacccaguugaucauuauguauuaucuuuuuaauaugcuguuauauucaguuagcuaauauuuuguugaggauuauagcaucuauguucaucaaggauauuggucuguaguuuucuuuuuguguuauauccuuuccugauuuuaguauuaggaugauucuggcuuuauaaaugauuuauggaggauucccucuuuaucuucugcaauacuuucaguaagauugguaccaguuguucuuugaaugccagauagaauucaguugugaauccaccuaguccuagacuguuuuuuggggggguggggggcaauuuuuaaguuacuguuucaaucucacuacuuguuauuggucuguucagaguuucuauuucuuccuaauuuaauccaggagagcuguauauuuccaggaauuuaucuaucuccucuagauuuucuaguuugugcacauaaagguguucauaguugccuugaaugaucuuuugcauuucugugguauugauuauaauaucucucauuuucuuucuaauugagcuuauuuagcucuucucucuuauuuucuugguuaaucuugcuacuggucuaucaauuuuguuuaucuuuucaaagaacuagcuuuuuguuuauuuuuuguauuuuuuuuuucaauuucauuuaguucuauucugaucuuuuuuauuucuucugcuggguuuggguuucauuuguuuuuguuucucuaguuccuugagguuugugaccuuagauuaucuauuugugcucuuucaaauuuuccaauguaggcauuuaaugcuaugucccagaaguuuugauaaauuguguuacuauuauuguucuuuuuuuuugacggagucuugcucugucacccaggcuagagugcaguggcgugaucucggcucacugcaagcucugccucccggguucaugccauucuccugccucagccuccugaguagcugggacuacaggcgccugccaccacacccggcuaaucuuuuuguauuuuuaguagagaagggguuucaccguguuagccaggauggucucgauugccugaccucaugauccaccugccuuggccucccaaagugcugggauuacaggcgugagccaccacaccuggccuauuauuguucaguucaaagaauuuuuuaauuucuaucuugauuuuauuguugacucaaagauuauucaggagcaaauuaauuaauuucuauguauuuguauauucuugaggguuccuuuuagaauuaauuuccaauuuuauuccacuguggucugagagaguacuugauauaauuuagauuuucuuaaauuucuugagacuuguuuugugguauaucauauggucuaucuugaguauuccaagugcugaugaaaagaauguguauucugcaguuguuggguagaauguucuguaaauauuugcuaaguccauuuguucuaggguguaguuuaaguccauuguuuguuuuugacuuccugucuugaugaccugucuagugcugucaguggaguaaugaagucccccacuaugauuguauugcuaucuaauuucuuacgccuaguaauaauuguuuuauaaauuugggagcuccaggugcauauauauuuaggguugcgauuuuuuccuguuggacugaucauuuuaucauuauguaaugucccucuuuaucuuuuuuaacuguuguugcuuuaaaguccuuugucugauagaauaacaauuccugcucacuuuugguguccauuugcauggaauaucuuuuucuacuccuuuaccuugaguuuaugucagcccuuaugcauuaggugagucucuuuaagacagcagauacuugguugguggauuuuuauccauucugccauucuguauuuuuuaaguggagcauuagggcauuuacauucagcauucgaauugagaugugagauauuguuuuauucaucgugcuaguuguugucugaauaccuuuuuuuaaaauuguguuuuguuuuuauaggcccugugagauuuaugcuuuaaggagguucuauuuugguguauuuugagguuuuguuuuaagagguagaacuccuuuuagcauuuuuuguagugcuggcuuggugguggugaauucucucagcauuuguuugucugagaaagacuuuaucucuccuucauuuaugaagcuuaguuuugcuggauacaaaauucuuggcucggaauuauuuuguuugaggaggcuaaagauaggaucccagucccuucuggcuaauaaggguuucugcugagaaaucugcuguuaaucugauagguuuuccuuuauagguuaccugaugcuuuugccucacagcuguuaagauucuuuccuuugucuugacucuagauaaccugaugacugugggccucagugauuauuauuauuauuuuuuugcaaugaauuucccagguguucuuugggcuucuuguauuuggaugucuagaucucuugcaaggcuaggcaaguuuuucucgauuauugccucaaauaaguuuuccaaauguuuagauuuuuguucuuucucaggaacaccaguuauucuuagguguggcuauuuaacauaaucccaaauuucuuggagucuuuguucauuuuuuaaaauucuuuuuugucuuugccugauuagguuaauucaaaggccuugucuuagagcucugaaguuccucuacuucuucaauucuauuuuugaaacuaucuauuucagagaaacaccaucagguggaggcaggcaggguuaggcgggucugagcucagacucuccuugggcagggcuugccacggccacuguggaggauggggguaguuaucaggccaauaggguuauguuccagaggggauuauggcugccucugucacuagggaugugggggaaagcugguagcaauaggcuucacccaguucccacacaguuggcaaggccagucuugcuaauagcacugaguuuaucuccaggcagcaggacucagaccuagccccaggcuauaaauuuccccacugagaaagcaaccauggcuuucaggccccacccuuccccaucugcccauacuguccacugugacucugcuguccuuccuccagcauuuccuguuugcccccagauucugcucaagagaguuuauguccagucaaaaucauuacaaaguucagcuggaagcuucuuucacccugcaaccuuucccagauuccaccugcugccuuccccaagugccccugugagacauugucaggcauggcuucccugggcuugagcuggagaaugggagugccuaaaaggcucuucucacugcugcuuguaauuuuauauuucaugcuaaauccauuucagcucuagguaagguuaaauccuuuuccuguaaucuggauuuuuggauuccccaguggagacauguguuuggaggcagguuucuccccucacacuuugggaacucaguuuuuagcuugucuuguggaauuugcaguggccugcaaggagaguggccacguuuuucaaaggaucugugaauucuuuugauuuuccuaguacacuuucacaaugguuccuggaacaaaaguccacacugugagucuccacacacuguuccaucaucuaagugggagcugcaugucaguccuaucuccugucugccaucuugaacccaguccugugcuguacacucuugcagagaaagggacauuagcacuuccuguauugucuacugagucaaauacucuuuaguaaccagcaggcuagggggacaauagcgagucacucacacaccucaaaaagaguggcucucuuaucuaaagaugaaaaaaaaaauuacugggccuugaaaaguguauuauguuuuaacaacaaauuagaaaauaagguuaagcuuagucacugcuguucauuauuuccugugauccagagcugggcaaagaugagccaggggcaugucaucugaugugcuguucagugcugcaggagucccuucacaaugugaguuuuaaaugaaaguuuucagaaggcuuuauguguuuagaaaaccuaguugcaaacuccauugauaauugcaugacuuuuauaguaaacaacauuuaaaucuuuuaguguaggauuaaagguugucugaucuugagauggguaaagaauuucuugauuuuuuuuucucuuuguaaacauuuuuuaaaaauuguuuuauugaggugaaauucccuaaaauauuaaccauuuuaaagugaacaauuccauggcuguuaguguauucacaguguugugaaacugccacuucuaucuaguuccaaagcauuuucaucaccccaagaaaauacuccauaccuguguagcagucagcccucccuucccuccuccccccagcccugggcaacaaccaaucaugguucuguggauuugccucuucugaauauuucauguaaauggaaucauagaauuuaugacuuuuuaugucuccuuucacuuacaauguuuuugaaguuuauccauuuuguagcauguacuaguauuucauuccuuuuuguauguggauaagauuccauuguguggauauaccacauuuauccauucaucuguugguggacauuugggcugcuuccaccuuuggcuauugugaauagugcugcugugaacauuugugagcuuauauuuguuuagguaccaguguucauuuauuugggguuagaaauuucugggucauaugguaauuuuauguuuaacuuuuugaggaacugcccaacuguuuuucguagcaagcugugccauuuuacauucucaccaacgguauaagaagguuccaauuccuccacauucuugccagcuuuuaaaaauuuucuccuuuuuuaaugacagccauccuagugguugugaaacgguaccugguuuugauuugcacaucccucaugaguaaugauguugggcauuuuuuucgugugcuuguugcauaauugcuugacuuuuauauguaauuaaucucaauuuuaagaccugacacacaguuuugccacuacucucugcuugauaccauugagucuaaucucauuaugcucuuuaaucagaagguggcagccaucacaggaaacccagaauucccagaucauugcacccuccugacuugcaaccccacgugccucuguauuguuguuuuugccccauccuucaacuccugagacccuuucauugugcuccuuggaauucauauugcaucagcgauauaauccccuacauccucaaccuguucucuaaaugauuucuucaccuuguucucuaacuggaaccugguucucucccauagcccucuuacaugguggcagcauucucucucccgcuccuccaaggccuggaaauggaguaaguggccucuuuuucuucucugucauuccagauuacucuuaccucuccuucccuacaggcaucuaccuuugagucuccugucaucgucacacuguguuccccaccgucccuccuucaucccuugacaguuugaguuugugagucaccaucacucccuccagcagugcccuaucauaauuuuggugauuucagcauccacauagaugaugcuuucaauucccugaccucugccgucucacucacucccucccacgcucagaccugugacuuuaacauuacuaaaaauuucaacuccuucaugaucuguuucaaggcauccacuuccuuaaccaucccuucuuuuccuagguuucuccagguggcaccuugauccuggacuccaacagcuuuuuaccccucuagaguccuauccucuuuccccuggaaacccuucucugcauguuucuguuuuccuccugaaucagcuuggguuccaugguucucaguggaagcaguccuuugcauguucccucagaucuguugcccauucucacuuggcuguacucacggggcaaacucuuuuuuaaaucccugaaccucuagcacuuccuuccacagcuccauucuuuuuuuggagagagagagucucacucugucacccaggcuggagugcaguggcaugaucuuggcucacugcaaccucugccucuugaguucaaacgauucuccugccucagccacccccacugaguagcugggauuacaggcacaugccaccauucccggcuaauuuuuguacuuuuuguagaaacaggguuucaccauguuggccaggcuggucucgaacuccugaccucaggugauccacccaccucagccucccaaagugcugggauuacaggcaugagccaccacacucagcucucaaucuccauucuuaaguaaugaccuggcuucuugugucacugagaacaaaagcaaucaaaagaggacuucuggccaggagcaguggcucaugccuguaaucccagcacuuugggaggcugaggcggucccaucaugaggucaggagugcgagaccagccuggacaacauggugaaacacugucucuacuaaaaauacaaaaauuagccaggugugguggugggugccuguaaucccagcuacucgagaagcugaggcaggagaaucgcuugaaccugggaggcagagguagcagugagccaagaucucaccauugcacuccagccugggcuacagagcaagacugucucaaaaacaaaaaacaaaaacaaaaacaaaaacagaaaacaaaagaggacuuccaacaaucucuucccuccacuugcccaucugccucuguugcuagacacuguaccuucaccugugucagccagccucgacacuccgcucgccugcuccagggcguuguuguggcaauucucccaucuuacuccucuaaagucaauuuauuggauccuuucuauuagcauacaaagcuauaacuucuuccaucugaaaaaccccucaccugaccucacacucucccucuaacaauaggucauuucucugcucccuuuuaaaaggaaucuccugaaaagcaucaucuguuuucagucugucuuucuuuuuuuuuuuuuuuuugagauggaguuuugcucuuguugcccaggcuggagugaaguggugcaaucucggcucacugcaaccuccgccucccagguucaagcgauucuccugccucaaccuccugaguagcugggauuacaggcgcgugccaccacgcccggcuaaucuuuguauuuuuaguagagacgggguuucaccauguuggucaggcuggucucgaacuccugaccucgugauccacccaccucggccucccaaaguguugggauuacaggcgugagccaccacgccuggccuuuauguauauuuguaauguaugaaagauuaccugcuaauuacaugagagaaaacaaagcuuucaagagagaugccaggcagugugcacugcacucgagucucugacugagugucacuacugugggacaacuugaugugccuacugcaugaugaagcaugacauucucagccacacucaugaguauuccuauuccaaaucgaaucagaccuuuagaccuaccuucugguuugcagaaaauacaggggauggagaagcaaguaaaccaccaccauaaaggacaaucagauccauaauaugggaccuuuuguacaaccacaacccucauuucuucaaaugucaguguggcagggacaacgauaggcacaaacauguaacacuugcuguguguuagcaacauuucuaagugauucacauuuauuaacaaauucauuccucauaagccuaugugaugagaacuauugugagccccauuuuacaguuuuugcauguuugggcauuuucuuggugauuuugcuguuuuaaaugucccccaggcguagugcugacgagugcaggaagguugugaugugccuuacagagaaaauauuuaugucagauaugcucgugugaguuauagugcagcuggcugugaguucuauguuaaugaaucaaaauguaguacauccaaaaaaggaagaggaaauuugccaaucuguaugugaggccacucuggaaagugcuaaaguaacaucuauagugcauaugaaacuuugggaaaaauagaaaacagcuacauuuguggauucaagagaugacuuuuuauuuauuuauuugucaguuuguuuguuuaaagcauaguggacagcauuaugggacugaaagccaaaaaaaaaaaaaaaaguuuggucacguuacccaggaucaggaaaugugaaacccuucuuggcuagugcuggcuugcacguuuugaaaggcgauaugacaugaaaaguguuacauuuacagaagaggaagguuccgagaaucaagaaucugagaaagaauuuuaaaaauacagucuauccucauuacagauucuguauuugcaaauucuccuacuuccuaacauguauuuauaacuucauugauacuugcagugcuuuuguggucauuuccagacacacagaauggugaaaacuguguuucuggaugcacauguucccagagagggcaaacaaggcagggcuuugccuucuuguuucagcuucaugcggagaugaccagaggauagagacggcaggggcagugcagugcaguggaagaagcucagcucuggggccccuuggaggggguucaaaucccagugcuggcaccuguuacugauguggccucaggcaaacggcuuaccacuuuugggccucauuuucucuuugguaaaauggaaaauaaaauccaccaagaugaguuguuuuugcauuuaagauuauagucuuugugagaaacacccacacauacauuuccccaaugguugaguauuugcucauucaccauuuguggugacuuuuugaagcagaacugugaauaaugaggauugacuguaccugcuaaauguuaaaaaggaaagggguuauguggaacggcugguuuucaauacuaauaaaacuggcuuauuuuauaaggaccuuggcaguugaaccuguauaaagcuaauggcauuuugguugauaaaaauguugugaccagagguucgggguaaccuaacccuguauuucccuaggagcaaacguuuaguauugucuaauucaguguuuguggagacuuuaauagaacauaacuacugugcauaaugagaaucagcuguaacugauuuggugacuuaaaaaaaaucugcuaggcaaaugauucugcaagagaaguguaauauguuuuacacugaaucuauuguuucuuaaaugaacauguuucaugaugucuggcuaaaaugacauaguguucccggaccaaacugaggguugggcugcuuauucuugcggcccaauaacaagaugcagaggaacugagaaagaagagaguugauuucuguaacggguuauagggagaaggccgggaaaauaucgucagaccaacucaaaauuacgaaguuuuccagagcguauauaccuucuaagcuauaugucgacauguaagugugcauucaucuaaagacaugagugauuaagguccgaguccugaagaccuuccucuggagccuuaguaaauuuacuuaaucuagauggguccaggugacaggggugauuaccuuugucuugucuccugcuaaaucauggagguuuggggaguuccuuuauaccccaauaaaacuuguuuguggaggucuggggaguuccuucagacccccaauaaaacucauuuaauccuaaauggguccuguuaauaauuccuucuuuaucuugucaugcuucaaagccaaggaaaggccugggcaaaacucuugguggguguuugugacauuccagccuuugcauaaggacacuggcucuaucagcuuuuaauauugaacuuacccacucaguuagugcugaaacaguugucauggaggccugccuguucagcuguuaguuagaccuggccugccacaauagcauagaaauucuguaucugugauaacauuuauucaguguuuccuacaugccugucacuguuuuaagcacucugaguguaaucucauuuaaccuucaggguaauaacugguaguagcagggacagcaacagacacaaacacuuacguaacacuugcuguguauuagcagcauuucugagugauucacguauauggacugauucauuccucaugauaagccuaugugaugagaacuauugugagccccauuuuacagguaaggaaacugaggccaaggaagauuaaacaugcccaagauuacaguuaauaagugguguccucagccuacacuccuagacacuaaacugugccacuuccuagaauggggagaauggggugcucccucgaccaguaaacaaauuaacugaguaggagcuuguauuuucucguauuuuauuauguauuguuaguuuuccgugaagcugagcucaaaacuaguucccuucuuuuuuuuugagacagaguuuugcccuuguugcccaggcuggagugcaaugacgcgaucuugguucaccgcaaccuccgccuccuggguucaagcgauucuccugccucagccucccaaguagcugggauuacaggcaugcaccuccaugcccggcuaauuuuguauuuuuaguagagaugggguuucuccauguuggucaggcuggucucgaacuccugagcucagaugauccacccaccucggccucccaaaguguugagauuauaggcgugagccaccgugccaggccucaaaauuaguuccuacaggcauuuuagcugauaguaaacauagcaagugucagacaauggacuccuguuucucaaaccagcuuuacaaacagagaugaccuguucaucaaggagaacagaccacacaggauaaaugcuuaagaaaugggcuauuugggucgauuauuuuuuaaucuuugaaauuguugauggggaaugauauggcauuaacagcauuguagaguugguauaacccccgucccccaacuuuuuuccagaggaaaggaaaaauaggcauuuuaaaauucaguuuaaaccugaacauuagccucucaggacagaaaugggaaaaugcucccugcaccuuuucucuuuaucuguaucaguagucccuugccugacaucccugagacuacaaguuuugguuuuuuuauugauugcuuuaucuuugaccacaaguuucuuugagaaucuaaugaaagucaaggacucuuuccuuaggaggaaaaugcuucuagguacaggcagaaccuugucaucaaauauauuuuguggauauucccaaaccccuugaaaaacccauugagauggcauugcaggguccauagauuucagaaccuucuuaggggauccaugaacuauuuucaccauuuaaaaauaccuacaaucaagcaguuaucuguuucuuugcucuuggcuggaguuaagugagcauuugcugggaaaucugguuuucuuauguagacaaauaacugaaagcaagaagugggugaggugggguuccuuaguggugaaaagguugggaacugacagccuauauggcgucuccaucuucaucugccucuccuuuucccaaauccuguagucugcacagcuacagucuaacucauauauuuuuauaaugaguuauaauauaaaaauauauuuuuaauaaaauauauuuuuauaaugaguuauaauauaaaaauauauuuuuaauaaaauauauuuuuauaaugaguuauaauauaaaaauauauuuuuaauaaaauauauuuuuauucuguuuuuuuuuguuuuuuuuuuguuuuuuuuuuuuugagauggaguuuugcucuuguugcccaggcuggagugcaguggcgugaucucggcucacugcaaccucugucucccggguucaaacaauucugcugauucagcauccagaguagcugggauuacaggugugcaccaccacaccuggcuaauuuuuuguguuuuuuaguagagacgggguuucuccauguuggucaggcuggucucaaacucucgaccucaggugaucugcccgccucggccucccaaagugcugggauuacaggcuugagccaccgugcccagccgucuguucuuugauuauuucaugcuugcauguuuugucuccucuguucauucuuaagaccauuuggguaccacuucuuaagggccccuuucuuauuuuccauggggcuuggcacucaguaguucaguuggcuuauuuuuccgcggcugccgucuucucaggaaagugcagugucugccaaagguguccauucuuuugucagcagggggcagcaauggaaugggcaaaaauggucauuguucuucagauuaacuuuucagagcucuaagacccuuuaagggguaauaccuacccaaugugaaugcugaggaaauuguuugugaaauaaauggagcuugauuaaaaucuagcauauauuucaauucgaagcaauauuauuguuuuaacuagaggaauugccuuguuuagagguguauguagguuuggguuccugaugcguugggguggcacagagggugaaguauacagucagaagccuaggaagggagccagugagcauuuccucaggcugccgguuaccuuuuauugcuacuaaauuuacaugaacauaggccaauuuaucccuggagugaaauauguauuuauguuguaguguggaaagaauuacauguguuuauuuuacaucugggaaaucugaaaaaauaucugcaagaguacuaauauuacacauuuucuaaaagcuucguuuaaagguggugaauuaauaguacacagauaagucuaaagggagacaauuucuaauuauuuucugaacugaaggagaaaaugcauuuuccuucuauaaauggucagauuagccaaaaauugggcagcccugagauaggaguuugguaggacugguuuugcaagguaugggucgcaaaaaccuccccugauaaaaagagaugccuaccaaaaccaagggggccaugaacgugaccucucgugguccucacuacuggucauaugcuaauuauaaugcauuaacaugcuaagagacacucccaccagcgccaugacaguuuacaaauaccauggcaaugucuggaaacuacccuauauggccuaaaaggaggaggaacccucaguucugggaauuccccaccccuuucccggaaaacucaugaacaaucugucucuuuuuuagcgcacgaucaagaaauaaccauaaaaauagccaaccaguaguccucagggcugcucuaucgaguauccuuuacuccuuuacuuucuuaauaaacuugcuuuuacuuuacucuguaggcuggcuuuugaauuccuuucuacaugaagccaacgacccaugugaccucccaggcugaacccaaauuuugagguucgccuugugacagccccgacuacugacacaauugugauaacugaagcagagcauuuucaccuggaagaaacaaaucugaagucugaggcuagacccagagccugaagggugcauucagugguucauuuaacacuuaauuagggucaccuugcacuagccaggugcuaugggaguggggacaugggccugcuccccagaccucaaggccuuacagaagagaagggcaagugcucacgggagggcucugagagacuuggggcacggggacuucuaagugggagauaaggaaggcuucaugaagaacugaggaagggcauuggaagccugguaggacuuugaccaugagagauggggaggaaaagcuuucuaggcagauguaaccugacaggaauucaagaggugucauguugcccaaguagguaguguauuuaugaggaggcagggacaagauacaaagccaccguuugugagaauuacacacaauuauauuuuuuagauccuguacuuuccaagugguuauugcagggaccacaguugaguuuuuuucucacuggcuuagugauggucgugggagaagaacuuauucccaugaacagagggaacuguuuuaaucacaacugcaugagcaaaacacaagagggcucuugaaagagagaauuggcuaauauuguagcaaaauccagagcuccucagugguaauuuuaauuuccacaaaguuaaugaaaguauagcccuccagaccugauaugaaaaaguaguauaacguagcuaauuggguuguuuucuagacuuaggaaucaccagggaaaggcuaagcuuagagaggacuguggauugagcccucaucucuuuuuaaucuccucuauaaccuggcagauucuauuggcuuuucauuaugagauuguacugcaaaugaaagaaagaggaggugggguguucugggcuugguuacagcuggguguuuaucacaggcauuuauaagaaguuaguacacuuucaggcccucugacaggaagcuuuguaaccuggcauucaugucaugccagcauuaaguuuagagaaaugcuccauuauuugauuaauugucuuggauaaaagccuuaacugauguuccaguugaccuacaaaucuugugaagugaguuuuaaaaguauuuguaaauaguauguauccuuauagcucaugaaugucagaauucuacacuggggccagcacaguggcucauaccuguaaucccagcaauuugaggggcugaggaggaagauugcuugaggcuaggaguucaagaccagccugggcaacauaaugagaccccaucucuaccaaaauaaaaauuaucugggugucauggugugagccuauacucccagcuacuugggaagcugagcucagaggaucaucugaguccuggagguugagucugcaaugagcaaugauugugccacugcacucuagcuuggguggugaugaagugagaccgugucucaaaaaaaaaacaaaaaaaaacaaaaaaacaaaaaaacuacauugggccaaacaucacagagcagugggcagagggaagacccuauguugaagugggggaucuguguccacauggugugucacauggccacuguuuuccacaucuccagugucagcugagugggcucaggcaggcaugugacccagagccaauaacguaaacucacuuucucucaucugaauuaggagaagaaacuagaggauuggguagauuuggcuccagcggcucugcugggcuuuguugcaaguggaggaaguugaguugagcaagaagaggagagaaaggugugaaaaccagcgaccauagagaccaggggauagagagaaauaagagacggccauaucucugaaggaaagaaagaguagcucuuucaaguaguuucugggcacucuuuccuguauccaugcaacaaauccccuucuccuugcaugagugugggugguuucacuucuuuguuacuaaacuuucucugugaccaugaucaacuaaacccugggagguauacaaggaaaauaugaaaccuuguccccugacuacugaacuucucagucuugauagagcaagaaaaaaaacccaaaccugguccuacuuauccccagaaaugguauuguaccuccuuuuucacuugcuaauuuuaaagucccacuggcugucacuuagauuggguguauacauuguuuuuguucaaauggauccaucucauaguggcauugagaccaaucuucuuaccuguccgaagggaggagaacagccccuucccagcucucaaagagaugccugggugcucuccuuuguauauucauucauucauucauucauucacucacucacucaugcuuucagcugauauuuuuuugcccacaguuugccacaucuuguccuagguuuggggaaacaacagugaacagaagagacaaaguggcaccgagagccugguaagggcaagagaaauuaacaaauuaguaacauaacacaucaguagaggcugggcacagugacucauggcuguaauccuagcacuuugggaggcugaggugggcagaucacuugcucagggguucuagaccagccuggauaacguggugaaaucaugucucuacaaaaaaaaaacaaaaacaaaacaaaacacaaaaauuaguugggcaugguggcacaugccuguaaucccagcuacuugguagacugaggugggaggacuaucugaggccaggaggcagagguugcagugagccaugaucucgccgcugcacuccagccugggugacagagcaagacccugucuccagaaaaaaaaagaaaaaaaguaguuaguuaauuacaaccaugauguguuuuauggaugauggggaucauggccuuuugggaggaugauggaaggcuaucuggugaaaacaaccuguaagccggggucgaagaaggaauaaaaauugacuaggagaaaaacaugucauggacuucacuggaaguugagccuggaacucauucagauaaugccuucuuuaucccacgaucauauagauuaaguuagaggcucuaagaaauuugggauuguguguccagagauauauaaugugcaguuaaaaugcuccacccuugcugggagauugguacuggagagaaaugaugguuaagccugaagcuucaaggucccaggcuaaaaagagacaagaucuuuuauuccuugagugaaaguaguaacaacaaacuaggggcaaugaaaaggaguucucaaauuugcuagagaaccgugcuggcaucuuaaaacuucuagaagcuuuggaacucgauccuucuuccuucguuccucuuucuuuauucuucccuucucuucuuccccuguuuugccucccuuuaaucgcccuuccuuucacuugcccugucuucccauuucuucucucccguccccucuccuccauuuauccacccaacaaacauacaucaggcaucuccuuugaauaagacauuaugggcccugcccagaaagaguuuggcagugaauuaauugacugauuccaccagcaggcugggccguggagagagauauauguggaacuauauucguuauagugaguucauucuguguguuuauaugaacagugaucauggacuauauacucuuacauguacucuuuuuaaaagugcaugcucagagcagugaggaaguguggagaaggaguagaaagcaguucuaaaugcaggugucugcaaagggcgguuagcucuuuugcaaagcacuguguauuauauaucauuauucugugucauauuugugugccuugaggauuacauuguaagcaguucgugugcaggaauuguguucucucuucuguaaaauggugacugcagugucauuuacccaguggggauacaauaaacguuaauuaaugguggcuuauuccuuaacauaauuuucccuuucagauuaaugaagcagauuccugauaaaugcacuugucucuccagaguuucauuugcuaaagcucaaaugauguaaaggauuugccuggaggugugaaauuuuugcccaguuuuuuuucuuuuuucaagugccauuuggagaugcauuucuuuccugaaaauaauuggcacuagugaaauuaauucuagguggaaaagagaaguauguagucauguucuugccugcuacuuuggguggcuauuugaucuaaaaacagcaauuaaguuuuaaaagggaauggcagguguuuacuggguagagcuaaggcccaguuuguauaugcuaucaagcucaaguuagaauauuagaauauucuucaggaauucuuagagacauccuauucuccuugcaaaauaaaagaauuuccauaaaauccagauuaaauaucuggacacuuagagguucuuugagauauguguguggaguaugagugaacaaaggugaagcagucugaagaaaaugguuuaauuucaugcuuguugacccuuaguuuguaagguuacguucugccagagaaaaaaacugaucuacuauccaguauuugcugagaaaugacaguagauuaaucagaagacuucugaagugagucaguaaagcagcauuuuagguuuuguuucuuuuuguuuuauaugauguguguuaaaugauuucugauuagagaacugacagaaauguaaacacuugaaugaaacuuucaaaccauuugcagaacaauuccuuacccuuucuuauuacgucuuugcuuauaaauuguguuuucuuuucugugaauuuuacccuagaggaguuugcuguguguguucucauuccguuccggaugaauuggcggguggauaggccagcuugcucccaagcgucuucuuucuucuagggggaaggccaugcuaggugagcaucagaguguguaugugagccuuugugcugugaucuguaggaacagaaugguucugcaugcuuccuggucaugaggugaggagcacagaaauguggauccuucaguccugacaccucgcauccgcaaauuaugauuugggcaaaugguuuacucuuucagccccaggauuguguaaaaugagaauaaugguaaucaggagcugggugcaguggcucaugucuguaauaccaguacuuugggaggcugaggcaggaagaucccucgagcucaggagcuugacaccagccugggcaacuuggugaaaccccaucucuacaaaaaaaaaaaaaaaaaaaugcugggcaugguguugugcauaggccuguagucccaacuacucaggaggcugagguggcagccugggagagugaggcugcagugagccgugaucaugccacuguacuccagccugggugacagagcaagacccugucucgaaacaaaacaaaaaaaacaguaaccagccuugcuuguggccaagacagagcugggaggauuagagacugugacugugaaagcacuguuauaaacugcagcccagcgcuucucagccccugccacacaucuugugaaauggcccuguuucuaucauuuguguaguggcuguuacugacauggcuuugauaacggaaguauuuugaaaagagugagaagagaaagauaaaugugggggaagcagcaaaggacuacucugugcuuuuuuccuugagcuaaaugcuggguuaaaaccagaccuugagcuuuagauaagcuuguugaaggugggaagaggcuucuaguggguucuggggacaucauaacuaggcaguuggaccucaagguugagguagaccuguuuucucuggcacuaugagggaaguguuuccccuuguucuccgugucccugggaucuuuuaggagagaacuuugacuucuccuauugcuuucuggguccaccucguucuuccaauagcacugcccucccuuugcuuaggacuuugcuuucccuuucauugcugaguaccaucacacccccaugugcuggugcccauggccagacauuuacaaggcuucuccauccuuaugaaggaaaauacucucugacucccuuuaggguuuuuuuuuuuuuuuuuuagagacagucuugcucuguugcccaggcuggagugcgguggcacaaucuuggcucacugcaaccuccaccuccuggguucaagugauucuccugccucagucucuggauuagcuggugucaauugugugccaccaugcccagcuaauuuuuguauuuuuaguagagaugggauuucacuauguuggucaggcuggucucaaacuccugaccucaagugauccgcccacuucggccucccaaagugcugggauuacaggcgugagccaccauaccaggccucuuuagucuuauuuccuuaaauuuucuuuacuggauauggaaacuuuuuuuuuuuuuuuuuugaaauggagucucacucuguugcccagguuggagugcaaugguguggucuuggcucacugcaaccuccaccucccagguucaagcaauucuccugccucagcuucccaaguagcugggauuacgggugugugccaccacauccagcuaauuuuuguauuuucaguagagauuggguuucacuauguuggccuggcuggccuugaacuccugaccucaugaucugccuaccuuggccucccaaagugcugggauuacaggugugagccaccgcgccuggcggaaacuucuuaacuuuucuuuacccugcauuaugcagggacaugaacaaugaauuaaaacaauaaaauacugguuuggauuuuuuuugccucugaaauuguuuaagaaagaaagauguuggagagugauagggcagaggacagcucacacacgacugagaauacaaauuguuacaauuuuuuuuaguugugagcuggcaguauuuauaaaaaaaaaaaacuuagcaguuccucuucuagaaguuuauuuucacaaaaucuuuuuaaaguuaugcuaagauuuagauacagagaguuuguugaaccguaauccgucauagagaaaaaaguuaaacaucaucguaauguucggccauagggaauugggcaauaaguuguggcauauuuaugugaugaaauguucugcaguauuuuaaauaguauuguagaaauuuauugacaugguauguugaauuaaaaagguuguaaacaugauuauggccuguagccauuuucauaaaaaguugaaaaagggcauacagucagcccuccguaucuguggguucugcaucccuagauucaaccaacuaaggauugaaaauauucaggaaaaaauauggaugauugcaucuauauugaacauguacaaacuuuuucuugucacuuucccaugaagaauaaaguauaauaacuauuuacauggaauuuacguuguauuaggugucauaagcaauuuagagaugaucuaaagcauaugggaggauaugcagacauuauuaucuuuuuauguagggagcuugagcauacauggauuuugauauccaggcggaguccuggaaccaaucccccauggguacugagggaugacuguacgauugacccuugaacagcgcagguuugaacugugcaggcccacugauauguggauuuucucaauacaaauuaaacugagugugacugccucuccuuucaccuccuccaacucuucugucucugccacccugagacagcaagaccaaccccuccuauucuccuccuccucagccuacucaaugugaagaaaaggacgaagaccuucauggugauucacuuccacuuaaugaauaguaaauauauuuucucuuccuugcgauuuuuaaaauaacaucucuuggccgggcaugguggcucacgccuguaaucccagcacuuugcgaggucaaggugggcagcgcacuugaggucaggaguucgagaccagccuggccaacauggcaaaacccugucucuacuaaaaauacaaaaaaauuagccagguguugugguguaugccuguaauuccagcuacucaggaggcugaggcacgagaauuacuugaacccaggaggcagagguugcaguaagccgagaucgugccacugcacuccagccugggugacagagugagacucuuggggaaaaaaaaaaguaaauaaaaaacaaaauaacaucucuuuucucuugcuuuguuguaagaauacagugcuaauaugugcuaaucgacugcuaauguuaucgguaagccuuccagucaacagugguguauuagauaaguuuuuagggagucaaaaguuauauggggaucuucugcccucaaguuguuuaaggguuggccauauauauacauaaaaauucuguaaguacauuugccaggauuuuaaaacuucucucugguauuggauauauuaugaguauuuuucuuucuauuugauuucuuuuucuaugaugaguauucuuuuguauuaaaaagagauuuuuaauuaaaacaaaacauagaguagccugcugcagaauggagcucccuuagaagccccaguuucagauguugugcaagggaggccaaccuuguguccagagagguaagugcuacucgaucugcauucaggaucccguucaggucugugucugugugugugggaggcagagaguauagauaaauuauagcauaugaggcacuuacucacugauccuuugccuucuacucggaauccuucuguuggacaguggcauuuucuuugaaaacaauuuaaaagauuauuccuuuuguauauugcaccccuuguuaccaacauguuuacauguuauucaauucugacaaauggaauuucuaaauuaacaauuuuuaaccuuuguguagaaaucauaggggaggaaaaauauuuuuuucuucacucuucauaguucugucaacuaaacaaugaugagguucauaauuuggaaaggagagcuuuauuucucacaaacggccgcagccuguagggugaccauuuugacaggcugggaagcauagucucuggccagaagccagaaacaggcacuucaagggugggaagaauaagacaggauuuauacugaacaagguggccaaauauacauauucaagaagcuauaggaggaaucaugaauauuuaugaaagaaauauguacacaugcaauugagcuucaugcugcuccaugagauccauguucaaaaaaaugcagcauuaacaugauccagggguggaguuuucagcccucugacaucaaaagaugaaguagaggacacgaagacccucacugcacauccuccauagacuggccagaaccacucucguggucaguggucucuuaucaggaauaccugucaguugcuuuguugaaacuacaaaaggaugggggagugucagugggcuugauugaaauggggguggaguuguuugaaagggcugguuucuguuuagcccuuagggaagaaagccuaagagcaguuagagacggaguuggaccucccauccugucauggcugugaacucuguuuucaggguuucucugagguccccuuggcuaacagugguaucuguuuacuugguuggggguucuagaauuuuauuuuuauuucucaguucuuaguugggauggaccucuguaacaaaagacagauuaacaacagaaaaacugaaauuuaauacaugcacauguacauaucauguauacaugagagguacucagagaaaugaguaacucucaaagaggugacaggcuucaggcauaaaugucaucuuccucugagauuaagaagggugaggggaaggcagauuuuggggagguauccaggaaaaguacuguaaacauuaguaaguuuugauaugcagauuuuuaaguuugugccuucuccauugaugaggcucuauaguuuagucauccuuauuaucuuccugguucagagaauggagacuugcuuuauaaauguaaauuucccuuacaaaaggauaacuucuuuguuuucagagcuguucuggugucuguaguuucucaaaauaauccuuaugccaaagaggcauauuuuagggaggcauauucuggucuucuauaauuauauuuuggggugguauauuuuuggucuucuacagcauauucuguuacacaauucugaaaaucuuucuuccacuucacuauuuccuuuagcaaaaauuacaugagaaaaacugauagagauugcuuugaaggaacuuuuguucuaaagccaagaccuacuuuguuuggaggaaaagcucuuauacaugcaaucauuaaaaggagaucuauguuuauugguguggaaagaugucugugauguguuucuuaguuuacuaguacugcauuaacaaaguaccacagacaaaguguguuaaacaacagaaauucauugucucacaguuguggaggcuggaaguccaaaaucaagucauugguagaguuggugccuucugagcaccaugagaaaaggaugugucggcuuguagaugaucaucuucuccccaugucuucacugcuggucuuaaacuccuggccucaagugaucuuucugccucagccucccaaagugcuggaauuuacagguaugagccacuauuccuggcccaaauuuccccuuuuuauaagaacaccagucauaccggauuagggaccacccucaagaucuuauuuaucuugauucccuuuauagagaaccaaucuccaaauaggguucuauucuaagauacugggaauuaggacuucagcauaugaauuuggugaaggauacauuucaaucauaaaaauauauuuucccccuauuuuauuuaauuuucacggaaaaacccucauguuuauuugguuaaacaaaaauaagcugcauaggaacaauuuuaaaguccagagagacaccaacuuuguuuuaaggcuguagcagcuguuacagcaucuccuugcuaccuccuccagccuucucuguggacuacagugauacauucagaagccuguuagcuaacgcaggaguuucugaacacuuuuccauugguucuucaccugcucauugccugucaugccugcggccugcaauaguaacauuuaagauuuaaaaugugaaagccaagaggagguuucccccuauuuuaaaagacaucguuguuaugaaaaauuucaaauguaaauacacuagagaagaucauguugaauuuccauguccccaucaacagcuuuagcuacccccaaagccaauauuguuucauccuugcucuuuuacccccauuggguuauuuugaaguaugucccaaguguuagagaugauacauucuaaagugaucaaagguuauacaauuauauauaaggggugauguuuuuaagauaaaauaauauaccucuguguguguagauauaaauuaaaagagucagaauaauaccagaauguuaacagcacuuaucuccaggaagugggaugacagguaacuuuacuuccuucuuuauaacugucuuuacugucugauucuguugggaugguuguugauggaaugagccagccuuuuguaaucggaaagcaaaaccaaaaaagcugguuuccagauggugagaaugggugggcugagggacaguggaaaggaaggaaccuucucauuguuguuuucugaggcaggagauaguuuuuugcuucuagaauauaugaaagaaauacgaggaaguccacaggagcaugugucagaguguaaagggcgcugaaguggagccggaggacuaauggugaauuaugccuugccaggaaagugaagcugugacuuuggcagagucauucagcuucucugaacucagguuuccugccugccaagaagcagacuugacagacccguacgauaaguuguguuaugaucucacauuucuugaggaucucaguaacgguuuccuccuaaggaguuuguaaagauaaaauuugcauuuuauguuugugcagugugguguuacuauugggagugguaaggcaaugauuguagaaaagccaaaggugaagaaaugacagaaaggaaucaguuucuuggaacugcagaaggcuuaucuccccccaucuucagaaagugucuuuugaguguguaggugcaauucagaauuuugcauuuaccuuuugcccucaacagcauggccugguuuagagacaacacuggagauuucuugauaccaacucaaaccauggaaggaccagaaaaagcuuuggauguucugggucuuuggguuguccuuucaaccacucuuuuguuccaucccucucaucucacaugauaaagugucaaauuguugaacuucaaaaugccauuagccuguccugccuuccaggggcaaggguggacagaaaaaccugggaucauggcuuaagucacuuagugacggucagccucaauaaugacaccaugaaguccaaagcaaaguaaguaugaauccagaaagcagguaaauaucuagaaauaaugaaugcaucucuucugccaauuuccugaaagggagaauagauucuauuaccaaaaagauuaguacaacuuccaaccggccaguuagaucugcuuaugaagcagucuucaacuuggaaguggaaauagggugucuacacuuacacaucuuugaaaggaaagcagacuauuauaccguuaggcauaaaaaaaugacuucgggccugagacuccccuccuacccagaguugggggcaaggugcagcuaugggcaugagcaaggguaauccugcucccauccuggaaggcuggaaacuccauucuuucgacuagaggcaccagucagaggucuggggaagcucuuucuguccccuuugguaacacuaacagggaccaguagaggcuccagaggcaggagaugaagcaagcaaaucaaaauaguaccacaauggcucugaaaugagauugucauuggaaccacagcccauacaagcaggccaggaccuauguucuaaacuuaaacaugagacuuccagccuaaaaaagaaaaaaagcaaaugggacccagaguccccuaacauaauaaccaaaauaucuaggguagaguugaaaaucaucagucauaucaagaaccaggacaaucacaacaugagugagaaaagaucuuaucugacaccgaaacugagagugaauaaaaauauuaguuucacuggaaaacagccaugcccauuuguuuauucauugccucuggcugcuuucaagcuacagugacagaguugaguaguugccacagagaacauacggucugcaaaaccuaaaguguuuaccauguggcccuuuacagaagucugcagacuccugcaguaagcucauugacgaccuaguggucacuguuuuugagauccugccgccuguuuaccuuuuguuuguuuguuuguuuccuuugguuuauaguauacagugugauauuucuuauauugguuucucccuucucuuucugugucuuuuccuuucuucuuuuucuuuguaacauugucaucuguuuagccagcacccucucuccacuggagcuggaucccucuuccuuccgcucaucuuguccguuauugccaccgucacucucuuagcccuacugagagaaauguguuuuuggaaguucuguacacuaguuggggguuuucuuucuccacucacuaaaacaggcuuaacagauacuuggcagucacgaacuguuugggacuggccuacacaggauuguguuuguggguaugaggagcaguguccccaggggcucaggaccuugccuaaagggaacgcuuggagggcuaucauuuuagguguauguugugccaggagguguagaacaagagacauaggcugggaauuaaagggcgaagguagaaugucagguagaaaaagucggcagcucauugagagaagacaaaauuguucaggugugagaccaggacugacugugccccaacacucagauguuuggagaaggggguuguggauuggaaagccagcucuccacauaucaacuuacaauuuguuaauaaaacaaggcugacuuuauuguuugccacugugaggaagaacaccaccuccacagggcacuggcucugucuccaagcggggaaggcaaggucagaauuuaucaagaacuggaaguuugguauacaauguggagacuugauuaggauuaagauuaagaaucaagauuuaacaguucagaauuagugaaaacaacaaggcaaggauuuugaggcaaggcauucaaagacuuuuagagggcagaguguugaugguuuuuauuaaagcguugaugaacauuuggggaaguuccuguaaugaaucaucaaaccauuucugggauggaguccccuggaaaauuaaaguauugcuccugagaguaguggaauaggauaauaaagcagccauguuaaggcagacaguaagcuguuugugugugugugugguuuugguuuaaugauccauaaagcggccgggcaugguggguaacacuuguaaucccagcacuuugugaggcugcggcgggcagaucaccugaggucaggaguucgagaccagccugaccagcauggagaaacccugucucuacuaaacauacaaaauuagccgggcgugguggugcauaccuguaaucccagcuaggcugaaucaggagaaucacuuaaacccaggaggcgaggcggaaguugcggugagcugaggucaagcuauuguacuccagccuggucaauaaagauugaaacucugucuaaaaaaaaaaaaaaaaaaauccuugaagcacagcuuuaaagcuuaggugaggacauuggccaagugaaaaagugccuacguuaaccaaggacugauccccugacucagaggggaacuuagcagggacucaggaauuccaccagacugaagagaaaugccaaaccaaggccaucuuguauguggcaucaaauuguauggucuccuuccaagccagacagauugaguaauugaaggcacuggggcaccgguugaggcucugccaacaagacaagcagcuuugguuccuuuaggauuaggaauguuuguuuaggagcugcuucaugcugagcuuuuggagaguaauggaggagugacugaaguugucaaauuuguugacaccugacccaucaggauuggacuuugcaggugccucugaaacugcacaggguuuacagcucagaaaaauccgaagcagucaagacaaaugaggcccuuaucuucuugcugucucccgcagcccuugcuuuacccagauuuaaacuuguugagcuagauaucauugguuuuugaucuuugcaucuucguuucagcuuuuuugacuuguuuuuuucuucuucugcagccacugaugcuauuaacauuaacuccuaugauuugauuuuguaacgcauguguuauuguuuauagugcaagaaacaggccauagaauuuuuauucccucucugacaaguuucuuaucugugaaguucaacuugaccuacguuucaucucuuuuacaaccucagaguugauauuuucaggugauuguaucucugaaauuuaauuuggggcucuguuuuugugcccauguuacaacaucaugaugccuugaucguggaagcuaaauuccagaaagaaaugaaauuugugcuuuuuguuuguuuguuuuuaaacaaucauggaugauuaauguuggugugccuuggaggaaguauuugggguuauaauuugaaacuucguaauuaaaguaaaugguucaacauuuucuuaaaggcugggagaucuaggugagucuguuuguugaugguugggcuuugcuccuuuguugauaagcugguaggcaccuugaaggggagaaggaacccucuuuaagaauuugcuguugauauuuuuggugcauucagccuuucgguaccacauuuaucuucucacaugugcccuuaauuaaaaugagagagagauggacauagcuaaaacuuguucuucggaagucugaugaagagucuucaucagugccucccagucuuagcaaguguuggagcaguaauaacugugaugcacagcuccaaggcuagaaauccuacauuucuuucaggguucauucaacuucuuuuggauucugaugaagcuaacguaaagugaagauuggcauugauugugucauuaaagacuagaguucuguuucacaucucauggaaaaugagaagaaaacgaaucuuuaggaggugucuacugugugccaaucacuguaaagcuuguauuauuuuuagcauucaguuucucaagaaagaagucaaaagccaugaggugccugguuacugaugugucucuagcaaaggguuacucaaggggcacuguuagcauuuuaaacggcaguguucuuuguuguacaggacugugcccugauucaagagacauuuagcacuccugggcucuaugcuuucagugccguaguucuuccccagccaucguaacugccaaaccccacugccuuuaaaggcuaccugccguugcuauuggcaaucggcucucaguaaauacggaugaauacuuuuuauuuuuauuuuauuuuauuuuauuuuauuuuauuuguuuguuuguuuguuuauuuauuuauuuugagacaaggucucacucugucgcccagacuggaguguagcgguguggucacagaucacugcagccccacccccugggcucaagagauccucccaucucagccuccugaguagcuaggaccacaggugcaccaccaugccugucuaacuuuguuuuuuguuguuguuuuguuguuguuguuuguuuguuuuuguuguuuuuuuugguagggaugugguuuuguuauguuggccaggcuggucucaaacuccuggccucaagugaucugcccuccuuggccucccaaagugcugggauuacaggcgugaaccaccacgccuggccugaaugcuuuuuuagagagcuaguauguggauuucaucucugagcacgugcaucuguuguaauagagaagaauauucucuaagccgguuucguguuuuuauuaucuaagauuuucauaaugucuucuguuuaugaaauaauaauuauccuauacuguauaauuggaauauaguucuuuuuguugauuagaaaugaguauauaccguauaguuuauggcuugauuuuauucaccuuuucucuuaaggugaauaaaaucuuaagauuauggcaucauucauaauaauaaaaacauaaugcaucauguuucaucaugauuucuucuuucuuuucagugcauuuuucuaagacaggauuuuaugguaggaauuuacagaaaugcugacuacaaauagcucgaaauccauuucucccuguuagcauuuauacauacaaaugucagagaauacauagacguuuuaucuuguuugaaguuaaauuuaacuaguuggcaguacuucuuggcaaacugauaauggagguauuaucuguuacuaaaucuucagccauauuauguucaucaaguauucuguagagugucauaaauggauucucuugcacuucugugagaggagggaaacuuggauucauucauucaauagguagguacuuacaguacuugggauacaucagcagacaacacagauaaugauuccugcuugcacacuagcauaaaugaauauaauaaggaaauuacaaguuaguuuggaaggagguaaaugcuguggagaauaaugagguugguaaggaagauaggugugccugggauugggcuggaggugcaauuuuuauuuuuuauuuuuuggagacugagucuugcucugucgcccaggcuggagugcaguggcgcgaucucagcuuacugcaacuuuugccuccuggguuaaagcgauucuccuaccucagccucuugaguagcugggauuacaggugcccgccaucacaccuggcuuauuuuuguguuuuuuaguagagaugggguuucaccacauuggcgaggcugguuucgaacuccugaccucaagugauccacccgccuuagccucccaaaguguugggauuacaggcgugagccaccaugcccggccuggaggugcaauuuuaaaugaagugguuugggaagauuucucaagaaggugacuuuuauuauuuuauuuuauguauuuauuuuugagauggcgucucacucugucacccaggcuggagcacaguggugccaucucagcucacugcaaccucugccuccuggauucaagcgauucuccucccucagccuccugaguagcugggacuacaggcguccaccaccacagcuggcuagguuuuguauuuuuaguagagaugggguuucaccauguuggccaggcuggucucgagcuccugaccucagguguuucacccgccucccuaagugcugggauuacaggcaugagccacugcaagcagcuaaaaaggugacuuuuaaacaaagaccuggagaagaaaugaguacuuauugagcucuccuuauuucuaggcacuguuuuaggagccagaauggcuagguagauccucuguaaucugcaaaaaaacaauuugcauggccagauuauggauguguacacuaagaugagaacgcucaaaccacaucuguggaaugugucuauuaacaauaaucuuuuuaaaaacaucguuuugaaguaaucgccgauagcagguauuuguuucaaaaggaaagagaaaaaaggcugagcaaaaaagaaacgagcuuuguguccaagucuggcaguccuuacagaauuacugcuucuucccacuggugacaucauggugacaaggauccuccagggaugacagugacaaaguaggagauguuacuucaaauaaaaacagcuuuuguggagaagauuaaaaaacagcggaccagagaacaggaauuuacuccugcuucugaugucagugggcuuugugaccuugggcggguugcuugagcuccuccacuucuuagacucgcuaauuauuuguuagacauggugccgaagcacuuuauguacaucauccuguuuaaugggauguuauaaaacaugaggaggaugaacuucacaagauaaccauuaaaguccuuuucuagaucuuguguucuuuucuuuuugauuuguuaguucaaagacaucauuagacuacuguuugucuuuguuguuaugauaagcuuaugaauugaagccaggccacaagauaugauuauuugccauagcuuaagccauggaguagggcugggucuagaauuucugguuuuucucuuccugacaucucuccugguguuaagaaggucauguccuguuuagcauuuuuuuuuuuuuuuuugcaagcgagcgaagggggcucagcauugguuucuuuguaaucuccuuuguacaaacaccagccccagauuucccuuccaauucgugaacucugaacaggacuagcaaagaguuaagguuuggagcuggaggaaaagcaaggagggaaagccacacagugcgccugcugucucagauaaccuuccguagaagaaggacucuaaaggugguugcaaggacugcuuucaauguauuuauuauugacuuaccuccagaagaucuguaaaaugauauacccagauggcccuaauggccccuuuuagcuugaaaguugacaaauucucuuuugauuagagugccuuuggcuaaauuugccuugacagauuucacccaggauugaguauuuaucaaaagacgaaugugcaccgaacacgcugaguugacccucaccuaguuuuacccacuucugugguuuaucugccgccuccccagccugucgaaagaacuuccgccccucaccuccuuacugucuucuuguuuuguagaugaugaaccagguggaagggcagcagaagaaccuugugcacgccauugagucccugccaggguccggcccccucacugccuuggaccaggaccugcugcuccugaaagcuaccucugcugccacccucagcugccuuggggagugccucaacuuguuacagcagagugugcaccaggcgggccagcccagccagaagccaggagccucggguaagacccccgggggcuuguccauguuugggaugaguacacacacugugucugugucccacugucuuccuccuuuaauuccauccauuucucuacgauccauccaucuauccuuauauccaaguauuucuacugcccuucgucucuacuguuugggauauauuuuuauguuacaaguuacaaauguaacauuucaugaaaaauguaauucugcauuaaucucuccugcccuuccucuacuguuugggauauauuuuuauuuuagaaguuaaaaauguaacauuuuaugaaaaauguaacuaacauauuuacauaaauacuauggaacaccuuucagacuugcuggcaucacauuauaagucucauuccacucaugacguuugcacucagcauucuguguuuuuuuuuuuuuuuuuuuuuuuauuugaagauucauuucauuccauucaguggguaccuuaaaaugacaaaauggacacggaaccuuucaaauguaaauaaaagcagagaacauaguaaagaaacccuauggguccauuaaugagcuuuggcaauuuuuaacauuuugccaauucucccacuuuuuuuuuuugagucaaagucucauucuguugcccaggcuggagugcaguggcacaaucucggcucacuacagccuccgccuccuggguucaagagauucucccgccucagccucccaaauagcgcccuccaccaugcccaaauuuuauguuuucaguagagacgggguuucaccauguuagucaggcugguccagaacuccugaccucaggugauccaccugucucagccucccagaaugcugggauuacaggugugagccacugugccuggccccacuucuuauuuuuauuuuuggcuugaacauuuuaaggcaaaagcuccccauucuaucuuuucuuuuuuuuauuauuauuaugcuuuaaguuugaggguacaugugcacaacgugcagguuugcuacauauguauacaugugccauguuggugugcugcacccaugaacuggucauuuagccuuagguauaucuccuaaugcuaucccuccucccucccccccaccccacaacaguccccggagugugauguuccccuuccuguguccauguguucucauuguucaauucccaccuaugagugagaacaugcgguguuugguuuuuuauccuugcgauaguuugcugagaaugacgauuuuuuuuuuuuuuugagacagaguuuuugcucuuguugcccaggcuggagugcaauggugcaaucuuggcucacugcauccucugccucccggguucaagcaauucuccugccucagccucucgaguagcuggaauuacaggcaugcaccaccacacccgacuaauuuuauauuuuuaguagagaugggguuucuccacguuguucaggcuggucuugaacucccaaccucaggugauccucccgccucagccucccaaagugcugggauuacaggccucagcauucuguuuuuaagauccauuggcaugcagcaucugguccauuauuucugugguguugaggccaccacauuauacccagcgacucucggaugacagacaacgcacauugccuccagcucugugccccacucaccucgcugcaguaaacauccucaugccuguccccucaugaggauaccucuagaauacacaccaggaguauuucuaguuguuaaucaagaagccagggauaauaaugcauuccuuugagaugccucaguccuuuuggaggaggguuuaaucaaugagcagauauaaagauauuugugaagauuaagauaaagguaaaaauagcuugagacugguuaugucacauauaauuauaaaguauaauuaacagaauaacagcagccuuauugugcuuuguugcccaggggucacuuaauuaaugaaggaaugaggcaaguuaggugauaggaaguaaagccagauuaugagugauagucuuuauauuucaugcuuuccccaacugcccuuugcccuuuguuucacugaagcaugaaagggacuguugguuuuucagaguagauuguguguggguaauuugguuuucuuuuggugaaacccaccaucauuuacugaacuuggccuuugcuacauguuuucugaaaucuuuacaaaguagguaugauuaugcccaucguucagaugauaugcugggacacaaaacaauuaaacaacuugcccaagaccacccagcuaaguggcagaacgagggcagaaccaggcucuuuccacuguggcaggcgucuucccggccugggguucuuuguucaaucuagaacaaccacucagugggcucagucccccaaacugaggccaggaaccgugucuugcgagcauuauaauucucucaaggcagauguauacauguuuuuaaaaaauaauuucagacuuaaguugcaagaauaguaugaaaaaugcucacauauccuucuucaaauuccccaaacaguaacauguuaugauguuugcuucaccuuuuccuuauauuuauguauuauaauuuucuaaccacuuaagaguaaguugcagacaugaugucccuucacuauuacauacuucaguguguauuucuuuugaaaaaaggacacucuccucuaaagacagcacagugaucgaaaucaguaaauuaacgaguauaguccucuuugcugguuaucccauuguagcaaaauaaaacaauuugggugcagaauccagucuaggagauuugcguguauucacgcuggagcaagggcgcccaaaccugcuuuucuaccuuuccucuugcuucucagcuuuaagaaugaaucucaaaugcggaagcucaaugaggcuuuugacauuuucugaucuggaaugagccucagugacccucgcugaggacugggcacaaauucggagugagacuggagacuuuucagaguuucuguggucucuuuugcccuauauuguaacuugcagcuucugcaauguaauaggcucguuccgagaaucucacuaguaaauauaagcuugaaucauuuucuuauuccuaaaauuaaucccucuugaaaaaaauauuucuucagggcuuccuagaaaauucguuguuuuuuuuuuuccuaauuuucauuggcucucuggcauuuuuaagggcccaggggaacaaagcucaaauggaugcauuucagagguggugacggguugaaauggaaauuauugggaaaaggggagaccaagaagugucccuaaaauuaugucacaucaggugcuaccuccuucauguccucccugugcucucucucccaccuuugacugucacuugcccacucuccuucuuuucuuucuuucuuuccuuuuuuuuuuuuuugagacggagucucgcucuaucacccaggguggagugcagugacgcgaucucggcucacugcaaccuccgcuucccagguucaggcaauucaccugccucagccucccgaguagcugggauuacaggugcccaccaugccuggcuaauuuuuguauuuuuaguaaggaccggauuucuccauguugcccaggcuggucucaaacuccugaccucaggugauccauccgccuuggccucccaaagugcugggauuauaggcgugagccaccgcaccuggcuagcucacucuccuucuuuuggacuguuuucaucaagaaacuuagcugaaaguuggagaauagagcaugaagcaucacgaucacuacuuuguuuccuugucaucuuacccuuuuuacaugucauauuccauguaacacagccccugaaguuuuaaaacaaccuacugugugucuuaaaucuaugcuacccacugggggaaagcagaguuacuucuugcaggaaaagcaucauaguuggcugcaguuaaaauagaauuccagaaucucaagcuggugggauaagagaauagagaauacguuggcccugggagugcugccacaaaauguguuuguuuagacacuuggggcucucaggguugauaguugcuauagcagcugccugacacacauugauaaaaauauaaugguuaugucuaagaagugccagguugggcugauggaaaucaaaaucucauuaaagugaaacucuggcaugguuucauuucaguguucgaugggcaggaaggcccgucuuaccugaagcauuaccaaauacccauacagauuguuccugccugauggcucuuugccuucugauccuugcacuguuuuuuuuuccuucugucccuuuucugaauaaaaaaugauuuaugaucuuguguauuucaucuuguauaguauuuaauugugucuucugggauauauguuugcuuuggagccuuugucuccaaauguugcucauuacgcuguuuuuguuucaaacacauugagcagccagacugaaaucugagaauacuucaguauucaucugccucccaucuauacauuugggcucccagaccuguuucugauguuauuaucuccaagauauacugggucugaaguacuuuacuuaacuuccauuuauggagagguauguaauuaaaauuaagaaaguaauuuggccggguaugguggcucacaccuguaaucucagcacuuugggaggccgggccggguggaucacuugaggacaggaguuugaccagccuuaccaacaugaugaaaucacaucucuacuaaagauacaaaaauuaucugggcgucguggcgggcaccuguaaucucagcuacucaggaggcugaggcaggagauucgcuugaacccuggagguggagguugcagugagcugagaucgcaccacugcguuccagccugggggacagagcaagacucucucuaaaaaaaaaaaaaaaaaaaaaaaaaaaacuaauuuagcuuuucggucaagacuuaaauuaugcagcucuuuuaccauuacugguggcuccuaaaucuacuucagcagcuugauggaggcaaacaguugcuggacuggggacuggguaucuguuuucuucagccuagaugugugccuuccccgugcuauggggaagaggcaggcagaaccacgcucaaaacuggaaaagguugugcucuuugggagccugggcuuuagguggguuucaagugugggaggggaacugggccuagaaagugauucgaggguacagaguacucugcccuccaugcuucugguugauuugcuauuugcuugcaagucuuagucuagguaacaugguuugaguucgggcagaugccuguaacuagacaagcucauucuagugccagguaagagcugcacauuaacagcaagaugcuguaaaacaggcuuggggaaggacacuggagucauagcugccagagcaagugacaauggcaccuuggcagaaugcaguagaugacacagguacccgugaacacaaauggggacaaaagaucaagagaauagauuugagagaagaagaaccagagcagaauuuaauauacuuuccuuaacucauccuugcaauaacucuucauccacuuaaaagauuugcggggagugucaguuaauaagccaguugcauuggucuucccauuuugggguuuggccaaaagggccaaauaagugagacuauuguaaggacccuuggcucuucuggcuguuugccuucuuccuuuugcgguacuuuacguuuuuccggagaccucuucagacuuguauuuuucaucucuuuucuaccacucagggacuuccuuugcuuucuuugucuguuauacuuucuuuccugacaccuacugcuuuuggugaagcuuugccccacuuauagucaccuuuccuuauuuuaugauuaaaagcuaagacagaaaugugauauuucaguaaauagguguauuaguucguuuucauaagacugggcaauuuacaaaagaaagggguuuauuggacuuacaguuccacauggcugaggagggcucacaauuauggcagaaggccaggagaagcaagucacaucuuauguggauggcagcaggcgaagagagagcuugugcagagaaacucccguuuuuaaaaccaucagaucucgugagacccauucaccaucaugaaaacagugugggauagaccugccgcaugauucagucauacuccacugggucucucccacaacaugugagaauuaugggagguacaagaugagauuuggguggggauacagagccaaaccauaucaauaggauaucaauaggauaucaggagaaaaggaaaaacuagcauuguagaauauuucagauaaguguuuauuuuuuauuuuuuuacaacugucuaaacagaguuuuugagugccaacuucucccuaaagaaagcaguuagaggcugggcacaguggcucacgccuguaaucccagcacuucaggaggccaagguggauggaucacgaggucaagagaucaagaucauccaggccaacaugguggaacucugucucuacuaaaaauacaaaaauuagcugggugugguggcaugcgccuguagucccagcuacuugggaggcugaggcaggagaaucacuugaaccugggaggcggagguugcagugagccgagauugugccacugcacuccagccuagugacagagcgagacuccgucucaaaaaauaaaaauaaaagaaaacaguuagauaccaaggcgcuggcuuuccacugggaauaugucuuaaaugguuucaagugaaaauucaaucuuuuugugaauuucaaucuuauucuauuuuggaaaaccauuuuauguuuacugaaccugggaagcaugaauucacuguuacaggaagaggaaagaccuugcaggggccuuguaggucucaacacucuaagcaaggcuuaaaauaaggccaaggauagauuaagacaauuccacagucaaaccuuugcccuuaaaacugguguuuuucucuuagucuccuuaugauuuuuguuuuuauuuccauacugcuuuucauguuuucuauuuugcuauacaaguuguauuucuuuuacccuucuuuaguauuuugggaagaaauaugacauauauauauaaauucuaguaguggucauauuaaguuuaucauaaccauucuuuucuuuucuuucuuucuuucuuuuuuucuuuuuuuugagauacggagucucacuauguugcccaggcuggagugcaguagcucuucacaggcacaaucauagugcagucuagccuugaacuucugggcucaaccaauccuccugccucagucuccugagagcugggacugcagguguaugccaccauacccagcuucauaagcauucuuuaaccuauuuuuuuugguaguccucaaagggaugaugcaauacuuuuugaaucuuuucuuuaaugaugaagacagggcauacuuuaacuuccucugccccucuauucugcuuuccaauuuuugcuauuauguaggcuauuguuauuaauauuuuaauauuaguauaauacuuagauaauguaugauaaugacuaauucuuuuuaaaaguaauaugugacuuuaauauucaguuauguaaccaugcuuagaaauauuauucauagcggccaggcacaguggcuuaugccuguaaucccagcacuuugggaggccgaggcggguggaucacaaggucaggaguucgagaccagccuggccaauauggugaaacccaucucuccaaaaagaauacaaaauuagcugggcaugguggugggcaccuguagucccagcuacuugggaggcugaggcaggagaaucacuugaacaugggaggcagagguuacagugagcugcaaucgugccacugcacuccagccugugcaacaaagcaagacugacucaaaaaaaaaaaaaaaaaaguauuauucauagccaauucuggagcugggaccagggugagaugaaagaggcacuagccuugagugcaaaauucaaaaggaugucaaaaguuucaguaguuaagauaaaaagaugaaguucaguaguuaagauaaguaguuauguuuuaaugcaauauuuuuaaccaaaauuaaugcaaaaacaauugauaaugaacaaaauaucaaaaguuuacauaaagacagugucuuagcaugggcugcuacaguauuauaaaacacuguagacuggguggcuuaaagaacaaaaauuucucaguuuuggaggcuggaaguuuaagaucaagaguccagccuggggccaaaaguuucuggugagggcucucuucauggcuugcugacagcugucuucuugcuguguccacacauggcauuucuuuggugugugagccuggagggcaaccgagcucugguaugucuuccacuucuuuuagcaguggucucucuuccucuuuuaucagagacacuaauccaauuggaucaggacccuacauuuuuuaugucauuuaacuuuauuaaugugaaggcccuuuuucaaaauauggucacauugggguuuaggacuucaacauaugaaucuugggggaacauagacauucaaucuguagcagagaggaucugauaggauggagauuagggugaagugaggcugaguacuauaagacuuucucucuuccuuguuucuuccuuccuuucucccuucguccuuuccuuucccuccucuuccuuucuuuucuuauuucaauuuuaaaauauuguguuaaaauauaauuuaccucagccagguauaguggugcaugccuguagucccaguuauuugagaggccaaggcaggaggauuuuuugagcccaggaguucaagauugugguaugcagugaucacaccugugaauagcacuauacuccagccugggcaacauaguggcauccugucucuuagaaaaaauuacccuuuaucuugaugacugauuuucuugaugcuuccuuuuauuuuacaucugaggugaaugucuuacuugccugacuguagucccagcccugcucagcucuguguuuaacuggguucauugcuuacuaccaguuuuuuuuuuaauauauauguauaugacauccccauuucuugaguucuuaauucugcuucuuuuauucauacauugguaaauauuuucaagcuguuuuuccugcaagaagaaucauuucugagucucugcagugcugcugagagggcacauggugcauagcguaggagucuggguuguggagcucggcugcauggguuuuaaucuggauucuaccacuuacuaguucuuaaugccuuuguuucuucaucugucaaguaggcauggugguaauauguacgugccucgugggucaccauuaggauuagaugaggcaaugcacagauagcauguaccacaguacuuggcaccuggcaagagcucaauaaauguuggccauucuuaccggggaaagacauuuuggcuggggaugaauguuuucccucagcuccccaacccccuccaaauuugucgguuucuauuuacauucuucuguuugccuguucaucuuuuggcauuuaguguugucgcaaaauucaaacugauuuuuuuuuuuuuccuuuaaggcaggucuaauuuuucugcuuccaugauuggaaaauuuuucucuugauuuuuguuauucaaaaauguugccaaacuucauaaacuagggauucauuauacuauucugucuacuuuuguguguguuuggaauuucaguaauaaaaagccggagaaaauauugccaagcugcaucuagaugugcauuuuuuucccauugauuuugcuggagugugguggcuccuuuaagcagcccccacaguucucuguucagcccaggacauguauuuauauuuacauuuuugucuauccauugauuuggucucucuccuucaggaacauggauccuuuaucucuuggaucucuguugugcaucuucuguauugucuuucuuuuuuuuuuuuuugagacagagucuugcugugucacccaggcuggagggcuggagugcaguggcaugaucucggcucacugcaaccucugccucccggguucaagugauucucgugccucagccucccgaguagcugggauuacaggugcgugccaccaugccuggcuacuuuuuguauuuuuaguagagucgggguuuccucauguuagcuaggcuggucucgaacuccugaccucaggugaucugccugcuucggccucccaaagugcugggauuacaggaaugagccacugcacccagcuuuucucuauugucuucugccucaugauugucaucugugucuuuugcaacugcagauugguagagccgccuuaucucaauacauuauuuauuugacuuucugugguguugauuccacuauuuccuguucucaguuuuaauuuuaauucuacuaauguugguuuaguuuccucauaauaauuccuugaugcauccaucucucuuuucaccucagccuguuuucuucuucugguuuucuguucuuguuucauagagggugcuuuguccuauauuuaugugcugaggaaacaccuuuccugguguuuucucuaacaccuuauguuagaaauuuuacauguauucuuccucuuagccuucuugagaauauuuuuuccccaagcucuguacaguccuuuuuauucacuccacguaagaauguuuuuuugccuucgucuccaaaugagacagcucuauccagccuccuaaacccaugaucacuuuuuaaaagcagcugaacugaucugagaugggcgucuuucucaugcaccggcucuuugauauucggaauucauaggguccacagaaaguuguguuccccagcaugcauugccaacuuuccuuguccuguccuggucuuugucuaucccaagauacagccuaccacugccaguucagacuccacuucuugcucuguggugcccuaaguugccauaucuggauaaugaugggauagaggggagggagacacagaguugaggugugggaagaauggagggaacguuguccugauugccuaggcaaguagaucucuuuucuucccccuaguguuuuguuuaaagacagggucuuacuguguugccugggcuggagugcaguggcaugaucauggcuuacugccucaaacuccugggcucaagugaucuucccaucucagccuuccaaguagcugggacuacaggcguguacaacagugccuggcuaguuuguuaauuuucuguagagacagggucucacuguguugcccaaacuucuuuaucuuuuaaaaagauuuccuaacugcucuacaggauguuuacugcuuguguaauaaagcaaagaauuuucaaauagcaccccucuaucuauggaacaacuguuuggcauuuuagaucugaauccaguuugagguuucugaggcgggaauuggucaguaggaaaggcaagagguaucuguccaccucucuuauggcagauucuagugucuugaauccugggcugguuuucuuaguucagcuccgucuaccuuguuauuugcggauauuucucucaaguucugguauuagugcaucuuuagccuuugguuuuaguguugugaguuuuuaccuuuuaaaaaauaacaugaagugcugcuauauggaugcuuuuuuugccauuaagaaaaaaauuguagucaaauacacauaacauaaaaugcaucauccugaccauuuuuauguguacaucucaguacacauucuauguguacacauuuuaugugugcauucacauuguuguauaaccaaucuccaaaacucuuuccaucuugcaaaacuggagcucuuuaccuuuuaaacguuaacuccccauucccucccauccacucuccaacccucagcaaccaccauucuauucuaugucuuucuuuuggccguuuuuuauuuuuuaauuuuuaggaggcuauaacgugcacucuucuuaaaguuuucugucuccgauuucuucagcacauucauacugagcguacacucuuugcuaaaucauguucaugguucuggggacacugcugugagcaagggcaguauuguucuuguccucaaggagcugacauuccagggaggagagacaaucaacaaguaaaugagugugcuagugaguucagacagugcuaagucccaggaagacagcaaauggcaauaugacagagagugccuuuggggugcuauuuuggccagggaggucccagaaggucucucugagcaagugauauuuuagcugacuccuggaucuacacaggagacuuccuccccgauguagaaggacuggaggaacagcccucugggaggaaggaacagaaugcacaaacacucuaagacugucaugaacuuggcacauuugagaaacggaaaaaaauacugaugugacuugagcauacuaagcaauggggagaagagaacaaaaugaggcugggcaggucacagagcaaagccaggcagcuuagauuuuguuccaauuguaaugauaagccacuugggaccuuuauuaauuuauuuauuuugaaacagggucuuucauugucacccaggcuggaggguaguggugcaaucaccgcuuacuguagccucgaccuccugggcucaaucaauccugucacuucagccucucauguagcugcaacuauaggugcaugucaccaugcccagcuaauuuuuguauuuucuguagagacaggguuuugccauguuccccaggcuggacucaaaacuccuggguucaagugauucacccgccucagccgggaucccaaagugcuggaauuacaggugggagccaccgugucuggcccacuugaggcuuuuaacaguagaguuaugugaccuaacacuugacauuaaaaaaggauuuuugcauaaaaauacacuugaguuggcuaauacugcauacagcagcacacaggugcauaagcaccgcacauacacagugucuucaucugccucugacaaccagauuccccuggggauaugucaggaauguuugggauaccuguagacuuuucuuugaguaauucuaaugaaaaggcugacagauaguauugcuuuauggauggaacaucugagacccugaaauguugaauuuuaguucaugagucaugcuguacuuuagccuaauuuuucuuuuuuugcuuuuagacuuagaacagaaucuacagagugucagucaacugagcuugagacuuaucuauuuuuuauuagcuuuuuuggagacagugucuugcauugucaccaaggcuggagugcaguggcaugauuuggguuuacuacagccuugaccuccuuggcucaauagauccucccaccucagcuucccaaguagcugggacuacaggcuugugucaccacaccuggcuuauuuuuauauuuuuuguagggauaggguuucgccuuguugcuuggguugaucuccaacuccugggcucaagcgauccuucugccucagccucccaaagugcugggauuacaggcaugagccacugcacccagcugagaccucuuuauucgaauggcagaauugcuaugggguaaagaaauccaccucugguuacuccuguuucuauuaguagguguauaaaauguucuacaauaauauaugacccuuaaaaaaaauuagaguaaaagucuuuuccccucccccgaagggaguugguggaggauucgaaaaaugguuuuugguuugcuggauugguaucuguaaaaguguuucuugcuagaauggaaugaguaccuguguccuuggugauggggcuuccugacaucugccacaccaagccacgucugagggcagggguggcauccugugcucacuuugcaggcaucuuuucugagccauggccauugugucacuuagaauucaaaccacauuuugagcagccuauuuuugauagaaucugacuuucuauugugaauauuuagaauuuuuuuuuucuuuuuugagacagagucuugcucugucgcccaggcuggagugcaguggcgcaaucucagcucacugcaagcuccgccucccagguucacuccauucuccugccucagccucccgaguagcugggacuacaggugcccgccaccacgcccagcuaauuuuuuguauuuuuaguagagauggaguuucaccguguuagccaggauggucucgaucugaccucaugaucuacccgccucggccucccaaagugcugggauuacaggcgugagccaccgcaccuggccagaaauauuuuuaaaaguucaaaaaaaaaaaaaaaaaaaaaaaaaacaccuuuaucuggcuuugguaaaucgcaauuguuuuuguccacuguuggggagugaaacagccugugaugauucugaucuugauauuauacagaaacuaguucaucaacagaugaucagaaucugcacuugguacuucauucaaaacaagcccucuguguuuuaccucaugcccuuuucaaguaggucucuucauacagugaguacaaauauuucaugagcuauaaauguuuaauuuggaaaauacuuggcaucauucuaggucuuuauuucagaaaacauccugggauggcacggguccaagucacauuccacagagcagcugaaaaaugggacacuuggcucuuugccaucagccagugccaacauaaccugggcaauuuuaccaaacucugcugaagacgaacaaaccucacagccagagccagagguaagcgugcaguccucucagugcauucauggcuuguguuaucgcuuguucagaaauauaguaauuauauuuguaacuugcucaucucuuuguuuuaagaggagacaaauuaaaaaauggaagaauugccuggagagacaaaaucagcuaugugcaugcccggcacuucucauguucuugugucuggcagcugcugugggugaauugugauccuacgaaugaggaaucuccuauuuucauugaaaugggagucacuuuaacuucaagugggagaaauucgaacagacccguuaacauggugccuauugacaugaugggagcaguuacaauauauuaugucgcuccccugaauaauggcuucuucgugugguuccugcugauacaagcucuugccucacaugcucgacuccugcaugcuccugagccaggccgggaucuguggggccauggccaacacuccucuugggcauugagcugcagcccagguucaggcugccgaggauaugcacugccucgucaggagagcaguccuugcagauccuggugaucagccaggcuccaacaggcuucauggacucucugucaucugcccgcagccuggcucuccuauuucugccucuaaguggccgcuggaggggagccaaaugcaguguuuccuuuugucaauuuuauuuuguguccugaguccauuuuuguuuuucuuguucuuuugaugcacaugauauagucuugauauagucucuugaacuggcggaggccuccuuuaaccaugcauuagagguuguucuuaauuuccauugaaaucauuuuagccugaaaauuguagaacacuuacaaaaucuauuugauaagguugaaagccccaaggcagugucuuugaucaaaugguuuugguuaucaauggaaauuuuucuccaagcagcauaggauuauauucucggacagugauguaguagcauaacucuuauaaagucagauuagccugccuacaaauauuucaucggcaucuuuaagggguguuagaagggugugaagugaauaguggcuguggauuuuugaaaggcauuugcucuguauguacaaggaguuucagggucaagaaacucaugcagcugauguguaagugaaucagaagguaaguuggcaaccgugugagugguagagaagugaguuauuagaucuuuaguaaucauuuuuuagauccuuauuucuagcagcauucuugggcaaaaccuaacuggggcuaucacauaaucaacuuacuuauuauggcucaugcuauuucugacuuuguaaauccuccuuaguguuucuucucuguuuuucugauagguguucccucugacccccaagguuugaggccaggucuguuguuuuuuacacaaaguuguugcccacuuugccucaccagucaguagcauuggcaaaaaaaauuagcauacgauuaucugugagaaauaacuaacuccuggccgggcgcaguggcucacgccuguaaucccagcacauugguaggcugaggcagacggaucacgaggucaggaguuugagaccagccugaccaacauggugaaaccccaucucuacuaaaaauacaaaaauuagcugggcgugguggcacacgccuguaaucccagcuacuugggaggcugaggcaggagaaucgcuucaacccaggaggcagaggcugcagugagccaagaucgcaccauugcacuccagccugggcaacagaacgagacaccaucucaagaaaaaaaaaaaaaaagaaagaaauaacuaauucccaaguucaacuuuaaaaaaauacauccugaagaagaagaacuagccagagcuuuuuucauuaaaguagagacagucauuaauuucuaguugucauuuuugcccuuaauuguuuugucagagcaaguuaagauuuuguuugauuccauguaguagggaaagucuuauggaguagaaugguguuuugguguuuuggugguuuucugagaagggagaguuagaauucuuuggcaaagacuccccucauuuuuucuagugagugcuacggcagaugauucucaaaacccaaacagcuaguagagcuuggacacuauuuuucuucuuaggccauugugcuuugccacauuuuuugucuuaauaguuaaaaaaacuagcgacauccacacaauaguuuuucugucagaaaaaaaaauguugcuguugccuccuuucuguacauuguggaggaauaacuucuauauagaaugaagugaaauuccuaaagguuaagaaugccuuaugagcagguccuuaaugcuuuugaucuagaggauauaguuacuuaugugagugaucauugggaaacuaacuuucagaauugugguuauuauggucguguaacuaaauuaacuauugucuucugguuuaccguuuagaacauguuaggucuuuggggggauaagugggguaccaaagguagcuccccucugcugguucuggcuucccauaaaauaaccuacaucugaaacaguaacgcauuuugaagcuuagucuguuuaauucccugcagaauaaaagcucaaagagcuguacauauuuaauacgugaguuagaagagagcuguggucggcucuguuauaaaauguagugaucuuagaauuuuauucugcuggggcuagaacuaacuaaaugugaaaaugaaauauucuucuauaaugaaaugaguuaggaucuugguuuuaccuauuaguaaaacaauuuuuucaacaaaaaacaccaucugaaauguaaaucaagauagaaaaagguuuuccgugugucgcuucaucauguaugccuuacuuuaggacaagaaggauggugauuggaguagagacuguggaccaagcucucuugacuuuuucuuuuuuuuuuucccccuuuuuuuggagauuuuuuuuuugcucuguggccaggcuggaguacaguggcgugaucgaucucagcucacugcaaccuccgccucccggguucaagcgauucucaugccucagccuccugaguagcugggauuacaggcaggcgccaucacacucagcuaauuuuuguaucuuuaguagagacgggguuucaccauguuggucagcaugaucucgaucuccugaccucgugaucugccugccuugaccucccaaaguguugggauuacaggcgugagccaccgugcccggccacucucuuaacuuucuuuccacuuucucgauuggagagauuggaaacagcuacaugucccagacuuucuuacaguuggaguucugaacacguuacugggagaugcauuugugugagauuuggagaccaaguuccuccugcucgugcugcuggcaggcaguggcauggagguuggaguguuuagaggcaguugugguguugugguggccacacuuagaguuccaggccuuagucccaccuaccugggugcgggaaucuguuguggcaagagcagcagcuuccugaccucugaaucacggccaccuacaauguugugaccuugaacuuaaaagucuaaggugccggcugggcgugguggcucaugccgguaaucccagcacuuugggugguugagguggguggaucaugaggucaggaguuugagaccagccugaccaacaugguaaaaccccaucucuauuaaaaauacaaaaaugagcugggcgugguggcgugcgccuguaaucccaguuacaaagaagcugaggcaggagaauugcuugaaccugggaggcagagguugcagugagccgagauugugccacuccacuccagccugggcgacagaguaagacucugucuccuccaaaaaagaaaagucuaaggggccccugaugucugcuccuccagccuuuuuaauaauucuacaggcaccuaauucccauaucaaauuccuuucugacuguaacaccuggagugguuucuguuucugcacccacugugacugguugggcucuuggcacaggagggaacaggagagcccagggcaaugagauaaacccauccugaaugacagagcucacacgugaccauguacacucaccuucuagaggacauaucugagcaacaaaaccuuaacuguuuuuuaaaagucagguuuauugaggcguaauucacaaacaauauaauucaccauuuuaaaaugcaagguucucaguuuuaacaaaucaaaguaguaucccuaauccaaaucuaauucaaaaucugaauuagaucugaauuaaaucugaaucccuaauucaaaaucuaaaaugcucccaaauccaaaacuuuuuaaaggccgacaugacacucaaaggaaaugcuccuuggaguauuuuggauuucagauuuuuggauuugggaugcucaaccgguauaaugcaaaacuuccaacuuccaaaaaaauucaaaauccaaaacacuuuuucucccaggcauuucaggugagggauacucaaccuguauagaacaguucuauugcccccagauucccucaugccccuuuauaaucaaaucugucccccagcccuuggcaaccauugaucuguuauuugucccuauaguuuugucuuucccggaaugucauauauauauggaaucaugcaggagggcuucuuucacauagcauaaugcauuugagauucauccauguuaugugaaucauucuaaggcauuccuuuugcauuccuuuugcauugaauaguauguaugggaucuacagauuauccguuuacuaguugaagagcauuugauaacuuuaaauuucucauauuuuuuauggguaaaauggaaagggggagcaaugaaaaauaauguuguguuaauuauuugaggguaaauaucuggugccagauaccuaccccuggccuuaggacaaucaggacuaucagucccaccccuggagacuaagcagaggguuuuuaagccuguuccucaauagcauacugucaacuccuaucaaccccuguguugacugucucaguuagcagcuuugccuaguuagucaucuggauuacaguggcaacaaugcuaucaagagaccacauacccuauaccaccacaaaucuagcaggcguagaaaaacuuauaauaucuuuauguacugaguacuauaucagcauauaaguuagcuaaauggacuuugguuaaaaaauugcauaauugaauuuucaaguaaacauguccuaaucauccuuucccaaaagaagaaaaauuguuuuaagaauaagggaaggagacugauauaaaagauuuagcugaguucugcgucaagaauuuucaugcuuuugauugaauggucauuauagcacugaacuuuugaacuacuuaacaagccauaaagcuguccaucugaaauccucugauguucagcuugaagccuggccaguacaauccccucaacacauuuuuaucauuuuuuuaaauuuuucauccccaugauacauaaagguauagguagauguugguuggggauguauccggugugggauggugauagauuuuuagagaugaacaagguuaauauguuguuuugauccuuuaaauaauuauuuuaaaguuucaaucuuauaaguuuguuugaaacagguggcacauauuuauuuguggucaacaguuugaagagugagguauagcuaucacugacuuaugaugauugaaaaucacuuuauugaauccugugauaaccucacagaguuuaacuccaaaugguugcugcauaggaaauaucauugaucaaguuuaaaauuuguuauaaguaaauuucgugggugauaggauuauccuuccccacuccauuccucaucucucaucaucaaacagacuacaucuccuuccaagaaucuguagaauagaccuuuuuuuuuuuccuuugaaucaugaccuuugauucacuaaaucuuagaauagucuuuaggagucaaauggccauuccucaaacucgagugguuguuuaacuugccaagcaucacagaacuuagguugacgcaaaauugauauguggacuuccuuucucccaagcuagugcucuuuccuucauacuacacuaucuccuauauuggauaggauucuuucagaugcaaauaacaggaaacccuacaauuaauagcucaaauaguaauaaauuuaagccuggguaugguggcuuauaccuguagucccagcauuuuaggaggucaaagcaggaggaucacuugaggcgaggaggucaagaccaaccugggcaagauagacccugucucuacaaaaaaauauaaaaauuagcuggguacgugccgauggucccagcuacuugggaggcugaggugagaggauuccuugagccugggagguugaagcugcagugggcugugaucacaccacugcauuugaaccuuggugacagagugagauccagucucagcaaauaauaauaauaauaauaauaauaaauuuuugcacaaaagaauucugggaguaggugguuccagguguggugcagcaacucaugauggccucaaagauacaaguuucuuccauuccuccuccuguuuauccuuaugcuugucacuucauuguggcagcaucauagcuguagucccaaauauugcauccucaugacauauccuuuaaaagaaaggaugggagcucuucucaagauacuuucugaggucaggugcgguggcucacgccuguaauuccagcacuuuggguggccgaggcaggcggaucaugaggucgggagaucgagaccguccuggccaacauggugaaaccuguuucuacuaaaaauacaaaaauuagcugggcaugguggugggugccuacaaucccagcuacuugggaggcugaggagggggaaucgcuugaaccugggaggcggagguugcagugagcagagaucgugccacugcacuccagccugucaacagagcgagacucugucuccacaaaauaaaauaaaaaaaaaaaauuaaaaagacacuuuuuguuugggaagcgaagccccuuaguacacucccccuguuaucucacagccagaacuagaucacauaccuacuccaaguccuguaacugguggugggucacuggauuuucaugagucacccuccccggcuguggagugugccuuaccugagaucaaagggaucucagaucccagagagaccagaacugggcuuuugucagcaagagaaaauacaguauuggcuuuugggucauaauagauugugucugcuauaccccgauguaccccaagcagguuuucuucauguaguggucaucuucagccccacaagacuuuucugaccuggcaguuucaucucauagacuuaauucuuugagggaagacaccaugugugauucuucucuggaaacuccagaguauuuaggaaaguacgaugcauguagcagauacucuuaaguacguaaugaaugaaugugaacgaugagguucauugguaguauucaugacuaaagggcaugcuuccuucucguucucaucucuguucugugcucuucccuguggcuuccgggaguuccaguagaaguaaauuuaaccuguugagugacauaugacuuacauaugcugcugugaugaaagauucauccauggucagcguccuggagcucuccaggcagaagaugcuucuaugaauugguucauuccucaucuguggccuugauugcuaucuaacaggugcuaagugguuguaguuauacauggaauuauuuugugugagggucucucaucaugggauagaauucuuauuauaaucuuuuagaagagcugcugaagacauuccauuuagauccucacacuaaaggaaugaacaaugauuugaucauccggguuuuuucuuuuucucuucuggcuguuguuggucuggggggaaaguaguucauccuuuaggcaaauguagaagauaugccuucuagcuaucagacccuuaggacucacuaaaaaucagaaagagccauaauguuguuaugcuuaaaaauauacugcucccucaauuaguucguucuguguuccaguauaguuaaacagugaugauucaucuaugcaauuauuuuauucacucaacagauauugagcucuuauuauauagugggcauugaauggagcccuuccuuaguuuagcagauuuucauaacccaguuuauuagcucuguacauguuucauaauaguuauaauuauucuguauucaugagauuagaagcaagagaaaugucucuuaaccaagugacguuuccaagguuaguacccuaagacuguguagguccuggugccguguggcuguggguuuaccuauggccugcagcaauugagaugaccaucugugagaugacguggaauuugaagaugugcuucuaugguuaucucauaggcuauacugccuccugugguuaagagcuccuccugucugucuugcaaaacagcaucuuucugcccuccuuccuucucaaucuuagcaacucacaacguaaucaucacacacaaaccuaaacccugcacacauuuuuuaagaacuuguuggacuugguuucuggcagcuuucaugagcugucugaguacaaggcaugauaguauauuuuucugugcaguuuugggggauuaauuucagcuuaugcucguuuuucaaggauuuuuuuucuuuccuccauugcuuuucuccuccucucuuccuuuuuugugggugauaauaagguuuugcuucuuggguggguguuguuuuuauaagagaggaggugaauauaguggaagguccgaaaucaugccuuugcuauggccaguaggauaugugcuggggcuuuuaauggguuucgacacuggacugagagagucuuugggagcggccuuaggaguguucacaguauugccuuccuucucuccccucccaccaggccuguguggcuuugugauguaaacacccaccagagugcuggggagguagccaccuuggauuugccaacugugagcuggagccauauaaaaaagcucagcaccgagugguauaaucucuccuauccugcagcaguacucaaagaauuaagcgcuuugaaacuggugaaugaaaagggcuuaaagcacugcaguguuuagucugaguuuucccuccuccuuccccuuuucucuuuuccguucauuuuuguugccacaaagggaaaaagucagaucugaaccagaggugaagaguugaagagauuguagcgaugugguaugaaaaguuuuaguauucuguuguuugggguauuuagucucacccucuaaacauggcccuaaauuucacagcucccuugcuuccuucucacuugccuaguucuaugaaauuauaccaguauaaaugagcuuuucaccaucugccuggcuuauauuuuuauuuucccacgaugaaugacuauucuaaaagugauuuauuuucuggcccugaugaugcucgccuucuaaagauggaaagucaacgcucagagauuuaugaucuuggagaaagaauguuauggaagaaaagaguaaaauauuucucacauuuacuuugggcuuugccugaguuaaucgaugaguucuuguaucccuuuuguaauuugaauugaguuuuguagauggcuuauggcucuaugcauugcaggggcuuacugugugcuaaauaauuguaaauuuaaaauuuuuuuugguacugaugauggaugugagcaacuagagggaaagggguguguguguguguguguguguguguguguguaagaaacagagcaagugaguaagccauagaauugucuuuaaguucuggcaguguuuuucagaucuuauggauguaggacucaaauggccauucuguaauacuugaaaguacuguaccagcagcuguuuggcuauccauccuguccccagccaccccgggaccauagccuuccucaccccuaaagauacuggagcagcccuggccaaggccguggacuccaugaggugcccaguggaguugggugucaugcggugcucugucaccacugucuuuucucucucucagauaacagugugcuccugucccucccaaucuccauccuuuucucugucauucaccauccacagccagcuaagccugugcuggacaguccucaugucacauaaaguucucucuauuggcuguaguggucccauuaaaugaccacauuacuaauaaguauaagaagagugguggacauacagccaugcgaaggagaaggaaacucuaacuuuuuuggaaaugaaauuaaaugcaguugagaacaguguaucaauccuuaaaaccaugggagugcucuuuagauugcuccaaaucuccauucacauuuuucuugaucaucucaucagaacugcuuuucuuuaaaaaaaauauaagaaauguauauaacuuuguuaauaguuauuuaaaaauuaauauuguaagaguaucaaaucuuuauuuacagcaaauguauuuagcccacauuaugaguuuaauauuguagguuacccuggaaacccccaggaaugacgguuauuuuuugauaaauguguuucagauuccaaauaucuucuuuuuccuagcuuauguacuaaaaugcagagccagcuuguaauucugacuuuaaauauauauauauaauguaauucaaggagaaaacuacuccuuugaaggaugugaacuuuucuuauaguagauugaugcuaauuccauguauugaauugagaaaagaaauggaagcaagagggacuuacacuuauguuuaccuggcuuuuaaaaaccccauuaugaugaauuuuuagugcuaaaaccuuuauuuagaauguaauauuauacagaaauucccauaaugggaaaauccuugcccauuuuagguauugaugugcuagaucagugguucucaagcagaugacucuugugcccugcagacaugaggggcaggugcuccugauggucacugacuagggcuuaugagaagccuuuauaaacuucagucuccaccucacaaaagccagguuuuuguuuauaucaucugagaauacagguuccuugacggagcaaucaauugguuggacauaagguacaaaaucauaaugaaaacaagagauucuguuuuugauaauuuggcuguuaagaugaguuaaaaaaaauuucuaagucucaaggguauuuugaggggguggcaguuaaauuguugcguuucuagguuggugagaaugaggugaauaagcuuuuuucuccucagcauuugggucucuuuaagcuguuucaugauaugggggauggggauuaacaugaugucucucuggagccccagcuguggagucugacaaagcacuuugaacccaaacucuuucaaugauugcauguaagaauguaaacaugugaaucauuaaugguuguauaaugguauguccugaugaaaauguuauaaacauuaugugagaucauauaucgcuaauguccagcucaaugccuggcacucaauaguaaguccuuauuaaaauuguucuuuggccgaccuagcuuaucuuuauuuguagauaugaaguauguugggaaacacuuaagaacguguguugucaugcuauucuaggcuaaguaagauucauuucucuuuugucuuccaaaggaguagucuggguauaaauaaugacaucugccauuuauauaauggagcaugguuuacaaaggaccuccacuaauaacuuauucaaauauggcuucuccacauagagcuaauuuaauaauuaucaggguagcucuguugcuggugucuugccuggguuuucucugaggaaguccugaaaucaccuggugcggccccaggucagugagcauccacaggugggaagcccagguagcugauuugcacagcacaucccagguuugugcaucagaggaagucuguguauacagaaauaaaggaaauauaaguaggucgcauuagcuuccuauugcugcuguaacaaauuaccacaaauguauucucuugcaguucuguugguuagaagucugacacaggucucagugggcuaaacuuaaaguguuagcagggcuguguugcuuucugaacgcucuaggguagaaucuguuuccuuggcuuucccagcuucuagaggcugccugcauuccuuggcuugggcccauugcuccaucuucagagccaacagcauugacccugcuuccguagucccaucucccucugacuucccucuucugcuucccucuuccacucuuaagggcccuugugauuacacagagcuuacccagauaaucuaggaaaaucucccuguuuuaagaucagcugauuagcaaacucaauuccauuugcaaccuuaauuucccuauugccauguaaccuaacauaucaggacuuggacaucuuugggccuuuuuuuuuuuuuuuuuuuuuuugagacagagucucgcucuguugcccaggcuggagugcaguagcgugaucuuggcuccagguucaagugauuaucaugccucagccuccccaauagcuaggauuacaggcacccaccaccacgcccggcuaauuuuuuguacuuugaguagagaugggguguugccauguugcccaggcuggucucgaacuccugagcucagacaguccucccaccuuggccucccaaagugcuaagauuacaggcaugagccaccacgccuggccgucucugggccauuuucccaccuacagcagcaggggaguuggcuggcauucacagaauacauuacauagagcauggagauaaaacuaggcucaaccucuggcugguggaaauuaagcaaguuguucuauugcuccuguugaggaaagcagucagcucagcuggacucauuauuggaaaagaaaugccuggcuuugcuuuuuauacacagugaagccuuuucaaacuugcuuuucccaggcugccccugccauugccccucccuuccucccuguaucucccaagagccucagaauuaagccggacaugaaacuaugaugucucauuuuuuacaguuucuacaguucgugcuuuggcaguaguaggaggaggguuuuuaaaauuauuguaaaacagcauaauuauugcauuaaaaaauacaguagaaaccuguagaaagucagaaguaaaaacccuguauuuccuuuugaugccaccuccuuagaaggagcuacugugugucuuuuaugggaaauuuguuuuuacagcaaacauauacauauaauauauaaaauauauauaauauauauauauguucuuuaacuuuuuuuauaccaguggaaucacaguaugaguaauguucuauggcuuuucaauugucaauuagacaauauaucuuagguaucuucccuugucaguacguagagauuguuugcauucuuuugaacagcuacaaagccauuccagucuaugaauauaucauaauuuauggaguuauguauuauauuuuauuuaacaaggaauuuauuuaacuggacccuaggaguggcauuuagguuguccaguuuuucauuauuauaaauuguccucuacauauauuauguacacuuacagaaauauaucuuauauagggaaacuuuccggcaguggaauuuaagggaaauucaguuaacaaaugugggaauuuaaauuuugauaaguauuacuacauugcccuccaagauuaagccaaauguauacuuucucagcauugugugaggguugcuauuauccugucugucaccauuaagaaaugaaugucaagcucuuauuuuauuuccacuuuauuuuuaagauuaaugguaucuuguuuuuaauuuccuuuuuuauaauuauguaugaaguuaagcauauuuucacauauuuauuagccguuuguauuucuuuugucuuuaacaucuuguucauagucuuugcauauuuuucaauuggguuacuggacuuccuaauuaauguuuucuaagaauucuuuuaauauacaaagccagugaauuuuuaauaauguggaguaaguauuuuuccaccuuuugggugcauuuuuugagguaagaagcaguaacaacaaacaugauuacguccccacuguaaaauuuuuucucaugaagaucccuuagcuugaaucguuuugagagucagauuccccuuacauccuuuuauaauuuagcauuaguuuaaaauucagcucccggauuuuauguguugcuguccaggaacacccacuggaaugagccagcaggugauucuacaugugggcuguuuuguagggaugaacagcagcuaugggaauguacacuaacugauauauacauuuauccuuccuggaaacaucaucuagcaagacucuagcaguccucuuauuaagagaaaugcaccaugugaagagguaguuuuccuacccucacuuucuugcuggucuugcuccuugcuugaaaacagaugugaaaauauguagagaugcauuccauggagguucugauuuggaccuuccguccccaucccgggucugauguuacugguuuuuaaugcaguuuuaugcaggauacuugucaaguugaaaaaaacaauucguuuguuccuugaaaaugaaacacuuaaugacagaaaaguuuuuaaaagaaauucaaagacauuggauuaaguguagcaugauaaaauauucaguuaaauaucaauuuccaauaaaguguuacauacucucaguuguucugaaacuuuugaaacucauaugaaggaugcguuucaugauccuguuuuaugaaaacgggaugaagauguguucaggaguagagaauucugucaaaaucucuaaauugacaaauucucuaaagugacagaaaaccuagcuuggaaagucaucaugguguuauuuuaugcuacagaaauggaaauucuggggcugggcauggugacucaugccuguaaucccagcacuuugggaggcugaggaagacagaucacgaggucaggagagcgagaccauccuggcuaacacagugaaacccugucucuacuaaaaauacaaaaaauuagcuggguguggugccacguaccuguagucccagcuacuugagaggcugaggcaggagaaucgcuugaaccugggaggcagagguugcagugagccgagaucgcgccacugcacuccagccuggacagcagagugagacuuugucucaaaagaaaaaaaaaaaagaagaagaagaaauggaaauucugugcaacagagugauacaaacaaaaacuagaauauuuaguauugaaaggauuguagguccuaccugagcacaguuguaucuuaaaauucaccuucuuuuugugcuuaauauaagaaucccaccguucugauuauuaacagugcuacuacauaccguuugcauuaccccaggaugauuacagcugucucacaaauuuccccuggaaguuuucacugaaugaagcauuugagagcaggacaaagcagagcaugauaaugugacaguuuuuaaagcagaggacauagugagccucauuugggguuuauggcagcggaauaaugugaaaaaaauaugaauugcugcaauuacccucuuacauccugaguaucauuucacauuugaguaaaaguacagggaaaccuucuuuuaauauccugugucacuguggcuagaaaaauggacacacauaaugcaaauuaaagagaauagaaaaugccugcuguuuggaccaaaagguauugagugggauuuagagauugcagcuuuauaauggggcauuauuggugccuccucauuguggaauuaagggcugugguaguuucgcucuugguuuauuucuuuuuuuucuacaaaaugcuagagccuguuuucugccagaugcuuucuucuugguuuguuaauauuuacagaaaucaggacggaauaggcguauaccagaguugucuuuaagaaaaauaaaaagaauaagaccugagcuuuggguuguuucugauauuccuagcucuugaucugcuugugguaccaaaucacugguuugagagucagaagauaaugauccagaaacuaccucuugaagcaaaaugggguggacuugcuugauuuuaucccuuaaagacugggcugcuacccuguauguauugacaugugccuggcacauggaaaguccucaauaaauguaccuucugcguggccuggagagaacauuauaacauuaucugccgaagaguucuuaaugcauuuugcuuuuuccauuauucaugaugcagucccuuuuggccugcaaagaacaguaaaugccucuugcuucuaaugacuuguaaaucaaaaccguucugugguuugugaugcuccugauuauuuccuuuguguuaucguacgcuucagaaauuuccauuggagaguguuauuugggaauuucugggugagaagcauaaaugauuaaaguggacacauaaaauucaaaguuggaguugaaugacugccugguguggccacugaugaaaauauaaucacccuuauccaaucaaaggugauagcuuucugaaucuguuuuggggucaucaaaugaaauuucuggaaccuugucuaauguugaagaauauaauuuucuucaacuugugccuacacaaguuuaugagaaaaguuguccauaugucuguguuuggaucccccuagcaucuaggccagagccgucuccucacuggccgccuaggauuggguuuggagaaucugaggggcugguagcacaccaccugugcugcuccucccugggagccaggccccuaucacaccugcuacuuuucucugcuguuccucauagcccccauggccggggaucauuagagcagaccuucucaaauguuagagugcgcccaaaucuccuggagggccucggggagcagggaggaggagcaagggaguugcuguucaguggguauagaguuugcuauacaggaugaaaaaguccuagagaucuguuguacaauaaugucauuauaguuaauacuccugaaccauacacuuaaacaaaaaguaugaaguuggauauaaagugauacauuugucaaaauucauggaacuguacaauaagauuuguauauuguaccaaguauaaguuauaacuauauuucaauuaaaaggauaaacaaaccccaaaccaaacaaauacuggucucugcccugcccccagaguuucugugucuguaggucuggaggggggcccuagacuuguauuucuauucaguucacagugauucugcugcugcagguccagggaccacaguagaccuaauuuagagccuuucccgcugccacucugcauucccacagugcuuuacauguuuucugcugucccugccguagaguucaggcccguaacugcauaauuugugggaaaagcaaggcagucuagcaauuaguggcaucaaguguacaguuccgaaagaaucacugaugugguaccgucgacuuuagucucgugucucuuuuugaauaaggccauuuaccauccgcagaugagaagaaauccaucacccagcacaaagcauaagucaauaaugauuucaacuguggauauagaaagccagacuucuagucucggcauggaccagugcuuaugacagaagcaaaucaucgguaguagaauuccuuuaaguuuuuaggcacagaaucauuuuauuacuauuggccaccccaacuacauuauuccuucaucaguuuguuuuugaaauggagguguuuguaaaauuguucugugguguuucaucaggaauuuuagauuuucaaaauaaucucuucccacugaacuuucuauuaccaagaaauuaaggaaagauagacauggcaguaacguucgagugaucccaguaaaacuuacacauaggauuuagaggagggagggauugcuccugcccagauuguuagagccagcaucauggugccaaugcuguucuuacagguagauaacaauugguggaaggaguagaaauugauugggaggccaucaaaaguuagagcaccacucuccaaucaaacuugcugcaaugaugaaaguauuuucuuucuaugcuguccaauaugguagccacuagucugaauguggcuagugccaucaaggaacagaauuuuaaauuguguuuaauuuuaauuauuuuaaauagcuaaaugugacuaacagcuucuggauuagauagcacaagucuagagaguagggugagaagugaguauacuguccucagacuaggcuagaggaaguuuaggaggggaggggaaguaugggucagauugaggaaaaccgaaguacugacugaguagacauuuuccucugggcagugggaagcaacugaagacuuuuuuuuuuuuuuuuuuuuuuugacacagcccucaggagauccugagaauaugugcuugauugaagacuuuugaacagagcagugggugucuggggaagaacacucugguggugugguacaagacaguguuaagaggaggcgucuggagcagaaggaugagcugggaggcuggcagggcccuacauuuauguggucaaaaccuagggugugguagcagcaaagaugaggaaaggaagggauggugggccagguggcucucuagaugggagguguccgggaacuugcaggucucaagccugggugacuaggaggauggugcgcaaaacaggaaaggcaggacgcggcugcuggguuccuuucucgagugcacgcagggcugaaaggaggggagcugagaugagaacggcccuuuuccccacugaaugcugccugcccaugugugucgucuuagcuguuuucuauuugcccaucguguuuaguagaauaauugaaucugcagacaguuuugacuaguccauuuugccucucacuccaccccgcugccucucgugcuuucucucucucuuccuuaccugccugcugccagcuccuugccuccccucugauuacugcgcccccgcaauaacucacuguuugaucuuccacauacgggaacucgaaacccagcuacugucugcccagcaaggcugcaguguccagggugacccaggccauguccugcacugauuguaauccuccucugcgccuaacacagagccuuacguguauaccgaguagaggagaaggaaggaugucaaacaugucacuaccaccccccagugcauguuggucucccucacgcuggacuguggcaggagucuuccaaaacugcucucagugccccauccccucugugugcaaucauaucguugcuuacuuaaccaaccauucaucuccuagggccugaguucuguuacccagccuccucagaaucuucagcaguuccucauuuccauaggggaaagccagcuguuuauuuccuuuacuuaugcaacgaauaagucagugucagauaguauuuuuguugauaaagccacagcggcgagcaaaacauuuugguccugcuuccugugagcugacuuucugcaagggagagagaugauaaaugcacauauaauauaguugagagugaucagugcugcaaggaaaagcagagcugaggaaggagcaaaugguggagagggaggagagggaguggugcuggccuagacggucaaagguugcugugguaaggggacacuggaguuaagaucugagugaggcugggugcgguggcucaugccuguaaucccagcacuuugggaggaugaggugggcggaucacuugaggucaggaguucaagaccagcucgggcaacauggcuaauccccaucucuacuaaaaguacaaaaauuagccuggcauggugguaugcaccuguaauuccagcuacuugggaggcugaggcaggagaauugcuuaagcccgggaggggaagguugcagugagccaagaucacaccgcugcacuccagccugggcaacagagugagacucugucacaaaauaaaauauaaauaaauaaaauaaaauuaaaaaaagaucugagugaagugagggggauauggaugaagaagaccuauaagagcaggugcaaaggcccugagguaagccuguccuuugcguguuccaagaacagaagguggcugggaggggugagcagaaugaacaaggaggggagcgugaucaagagaagaguagagaagucgugggggcaacaucguguagggccucacgggccacagucaggacuuugacauuuagucugagucaagaggagagggcuuucagcuuaggaguuaugugaugaacuuuaugauuuaagaugccuucuagcuacugugaggagacugacugggaagcuguugcaguaauuaggagagagaggugacgguggcuuugccagaguggcugagguugugagaaaccaugagauucuagauauaauuugcagaaguugcugauggaugugauguggaacagugcguaagcaagaaauuaaagucaaggauggugccaaggcuuuuggccaagugauuagaaaaacaaagcuguuauuuacugagaugaggaggaucauauuuuggagguaugaauugaaaggucuguuuuagacacaguaagucugagauggccauuaggugauguguuuucacugcuguaacaaaugaucaucgacuuauugauuuaaaacaaugcuaauuuaucaucucguaguucugcauaagaagucagacacagguuucagugggcugaaaucaagguguuggcagggcugcauugcuuucuggaggcccuaggaaagaauuuguuuccuuggcuuuuccaguuucuagaggcugcccacauuccuuggcuugcagccccuuccuccaucuucagagccaggaacguugcaucuauauuccucuuccuguccacagcguggaaagauucucuaacuuuagcgauucauguuuuuacaucaaggccaccucagcaauccagguuaaucuccucaucucaagguccuuaacguaaucacauguguaaagcccccuugucacuuaaagugccguauacacagguuccgggaauuaggaugugggcagcucaggggucugcuauccugcccaccucggauagcuaagggggagauguugaauaggccacugggugcacaaagcuagaguucaggggagaaggcugaacuugagauacacacuuaggaaacauacauuuagaaauuauugaaagcuguuggaccagaugggcucuccaagggaaugaguccuauuauaaggccaaaaccaugugcuuggccucagcuguacuucccugcaguaagguucucuucaucccuggcuggcaucauuucuucuguuggacuguccccuccuucucuuggcuacuuuaagugcuccucuuuggugacacccagcccagagucugccuucucugugugagccccucugaucacccugggcacgcccuuccuccuggccuuugcuauuugauuuugcaucauauauccuuucauuuauuuuucuauuuuugaugacaacauuauugagauauaauaggcaugccauacaauuuauccauuuaaauuguaccaaccauuugguggauuuuaguauauuuacagguguaugucacugucaccacagucaauuuuagaacauuuucaucaccucaaaaacaagcccuggacccuuuagcugucacccccauuccacccauccucgcagccucuggcaaccacuaaucuuuguugccugucuuggaugucucauagaaguggaaucacaacaccuggccuucugugacuggcuguccuguuaaaucuagauuuuguccuugcacacucaaguuucccaugcuuucuuuuugguuuuauaaauucauuccuuuuaagaacuuacuguacaucuguuauaaaccacccuuuguguuggaauucuagaaaugaaacccucaguuagcuaggauuccuccaugaaagaauuccgauuaagguaagcugacaaccacauggccacugcguuccccuccugagccacuggcugauauuacuaauugaucacagcauucuuucuccccagauuuguauauggccucuacguccaccuccacccauggcccugaguagccagccccaaauaaucaauuuuccuuugccaaaagagggcugacauuucugguccaguuggaaaguaggugugcacuugcauaaauccacuuugcuaagugccagaaugggcaugucugaagcaccuagggacuccuugcuagaauggaggcuccaccucugugaaacaugguugaacuaagucucaaaucaugaguugaaacuuacagucugaaacuuacuagucuccagggguaggagaaagaaagauccauguacuccuucucaaccagaacaccagccuguugaaugcugagaccauaucuuaagcaaauuucuaucuucaguaucuaauguggugcuuuguuaccugugggcauuggagguggcugaggugauuaacccuuucaggccuggugucugcuuaccauuaaaccuacccuuaugccuuuaugucuaaacccauugcauucccucuuaucagagcuccaggaaggcuagaauggggucuugaaggaguuucuucccuaccuuuccuaggucuggagaacucaaguagcuguggauggcagguuuggauggcagguguggauggcugcugcuccugucaccuccaaaccacagcugguccucuggggcugguugcugggauacuaucucugauucacugcacuugcugcuuuguguuugucuugcuuaguucacacauuugcaugugaccuugauugagacauauuugaaaguucucugaauccuuuccuaguguagcuccagaccagggaagugaugcuuaccucguggacagggcccugcagccccaaagcccucaguggggaaggccuaggagaggagcuuggguggugucaaucagcuuugagagggaagcuguggggggagaaggggagcagcacaaguaggaagaugcaggaguguuagcagcaaccucaagucaacauaccacugugugcccaguacgaacgucacaggccucgucagagcauggcuguuuaccaagcacuucuugugugccagccacuguguucagugcuuuacacgcuuugccuuguugagaccuagagcaggccucucagauaugagaggugguaccaucuccauuuuagagacaggaaggcugagccuuacagguggggcauagcgucuuuaggauuuaucuccaggacuaucugcagccagaucuccaagcuuuccuuuugugcaucucugucuccuaaagcugugguggucucugauuucauggccucuuccuuauccucacuaugacuuuuaucccaaauacucaugagcuuccugugaucggugcugccugaagaccuuggccccacaaucauaaacagcuuugcuuucagggugucuuucagagcucuuggcuguguuauuaauucagcgcuggauuugguuuuaaagugcuagugucuugcucauugagaugcuguaaagcaccugacacagugcuuggcaccuaggaggcccucucugucuuguuggggcccugcccuuucccugcuuuuccaggcagcaggcugaugcuaagcuugauuugcagccucugggauucugcacgcuggcaguugguauucauacuggcacgcuccaaaagcucagcugcaaaauuguugccuaccccuucauuugccgcugcuucuucccuuuucuuuuuuguacuuucuuuagguuuuccuugcuauuucuugauuucuuuuuuucccuuucauuuaaaaauagcaggacucugguuucuaaucagaaauguagaaauuagacaaagacaugcugcuauuuccugugaaugcuucccucgaauguuuuaaaggaacgccuguugaauccucucaauauaauuguucccaauuaucuuggcugaugacaaaugcccccacucucuccccuccccagaagugacuuccuucugccuuccaggguguguuuuauuuaaaacuaaccuuucugcaggucggccccuuugcucaggaagagcaucuguccuuccagucuauaagagccaagugugguaaauguguguguaugugugguuagagccagccagccagcucauccccugggaggcggcaggaggauugugaugucagugacgacaaacucagcaucuccgaaaggcagcugggacuagcuugcuguguggacaugcguguacuuggaccugucaaggauaagauccagcuucuccaucggguuccccucacaguggccucguuguugaaucuaccuccaaauggcaagauaagguccccuaaauucgccgguggccuuugaggcacaguugguugccuggcuuuggaaguggcuccauguagaggauaguacgugugcaggagccuucaacagccgcccugcagcagggccaagggguaccagcuauaccagacaccagcugaaggcauguguccacagcuucugucuucggcaugacuucugaccaaaguggaacauccacccuuucagcugagauacccucuacccaacaaagauggccuacuuuuggagaauuagacacagccaccaaaaagacucuuccagaggagaaaucucaccugugcagugugugggaaggacaguagguucaucaggaucaaccauuuggcauucauaugccaaaacuuucuaucucuguguccucaggggagauacuuuuuccaagcauguaguagugaaugccuugcacuugguagucaugugauaugaguugcuuauuggaaauggguacaagaaggccaagugaaauuuccuggauugcuggccgucuuuauauacccugggcuaugcugauguuauugacauauauacagagucggacuggaucuucagauguggcuaugucaguuuucaugaccuuugccuguuagauggggcuucuuaagaaaugucacugauugugaagauacacugugaggauuauguaaugauugugauaauuugguuaaauaugcuguacauauuggaaugagaaaaugacuagagauaaaagggacuaaguccuugguuuuauggauucuguacugcaaacacuaacacuauuauuguuagaacugaaggucgggugcagugguucaugccugugaucccagcacuuugggaggccaagaugggaggaucacuugagggccaggaguuugagaccaacuuuggcaacauagcaagacccugucucuaauuuaauaaaaaauuuaaaaauuuuaacugaagaccugaaaaauggauucaguaauugguuguugggcacuugcuccucauagacacugagaccccuuuguuucucuucuguaaaaucacuguguuucuugauuuauccccuuugucuucuacuugccuacucuuccaaucucuccagucccuagccucuaucuaugucucaacuccacacucuuuauuuuucuagaaccucucauuuguugggaaaccagccucuguugacucuuuuccccuagaaaacauaaguacacuugcccugguggccauuagugcauguuauugccuguucuguguaguuauggaauugagaaauaauuugucuaugaggggacaucauucccugguuacuucuuugccaugcugcuguguaccugacaguucucuuuucugaggauaucugagcauggugcuuugggucuucucaccuacugccugcauuucugugacccucagacuacccauuuuuuuugacauggcuagauuuccccaaaaagaucauaucuagauguguauggucuugucacucagugccaagguuuuuugguauggcucaguucaccccagugccuccuugccaaguuaacaguguguggggaaaguugccaggcuuuaaaaaugauugaacugcaauaugcuugcugcuaaaagagaauuugauguucauucucuagcuggcuuuauugucuguccuugccauauagguuuucaggaaaguugcaggucacuugaguucagugggugcuguuuuucuguugagauauugucuguuuauuggauacuuauuuacuugggcauaagauggcuuuaggaggucgucuuaauccgugcuagaguagacccucuugccccugcaugucugugauuccugguuuggcacagaaaagcucccuguccaaaggcaaaaugcaucuuuaaugguuagguaauggaaccacgcaggcuucugccaugauaucucaaaucuaaccagugaggauucaguccucugaauuaagauauuagguuauaaggccauguacaaauaaaggagauguuaguagaucaaacugcuuguguugaccccagcuaccugaaggccaggucuagguuaagagagaaggcaguucacuaaagcaggaagggugggguggggugggagucaucugucugaggaggggaaagcaggagugaagugccaggaaagagaguaccuuuggggacauggguggagugaacgaagccugugacagggaaaugaguggacucugcagacaaaugucuauuucaugcuuuuuccugggagggacacaaacuguaguuacauuacauauauguauugaauaaaaagauuggcauuucagucaugcuugaaaucugcauuuguauugaagaauuaagauauuuguuuaagagaugaaagcaaagcuaaauguuucucccacauugauguucccauugagaagacuguuggacccacacaaaccuaacacacgucacaguuuugccuccuggcuuuggccucgguggcauagccccauauaucuccuucuccuuacuagauaagaagcagaggcccaugguuaagggcagagucacaucuguagaugcugugacugucuuggauuggaccauucccagcccaagaccccaucucucacauggucucagccuuugguccucaagaggcuggaggucagcgaaggggcagagacccuucuaagaauccaaggggagcuauggacccccucuucagaaaaaugcccagacuuacaauuuuugcauaaaauuucaaggauggggguggauaucuuaagggcuguccaugugacccaggccaagaacccuugcuccgggcacaggucacugugggucaccagggaaugucccuaaaccccagccugcccgugaagcuuuuuccugcccauugauuuuucgcuuaucguucuccccauuugcuaauaggcacaguugcuugauuuuuguagcaccauaugcccugaggugcuugugugguagaaauauugucguaauuucuguuuuuauuaaaauccucauuuuuccaaagccugcuucucuuuaaaacauauuuuaauuccauuuuaucuucaaguuugcauacauuuuuguggcugggcuggcucauuugcaaaaaucucugggggaugggggaucugaagauucuucugcuuaagucuuauaaauucucucagcaguaugaaaccguuucucacauucauauuuuucagagaugggggaacacuguucugccauuuuugaugaccuugagagaguuguuacuguuuuauaagugaaaauucgcagagauucagagaggggaggcgugcaggggcucccaggagacaaguaggacuuugugagagaaggggaguguggauguggauaagcacggggaccugauuauggaaaacagcacuuagaaaggaugauaauuauccaucucuuugaauuccacaucagaguagcggaaucaacaaacccuugacccugaaagggaaggagguuuugugucuuuaaaacuccaucaagaccugcuucuucaaacccuccauuccuugcagugccugucuaugugggugcuuugugguugccaguagauugguauuuacauugccauggaccucuuucagacagaguugaccugcugacuacugcugccuuuccaucuauguacccccaaguuggaccgcgaugggggugggggggggggucuucucuuugugcagauggacugagcugcaguguggguggauugaaaguguccucuaagauguuuacugucaacaugguguaugaaaccagcuuaacucugauauuuacuugaggcuggguaggagaauuguuuacaaaucacauugggagagaaagggcaaguucucagaggcugugggagagaaaacaguccuagguccuuguuuaagguuagggcauggcuugcucaggauuugugccaccaaggggcagugugccaggcucccauggccguccuucugugggcgggacuucagggccaccagucaucccggaugacucagcuucuggggcaccugcaccagccuuaauuuccucugcuggagccacugucuuugagaggaauugucagacacagagggcaugugcuguugauuuacagugggaaaggauggagggguuuguuuucacauuuauguguguacuccguaucaugcggcuggaucuuguggaagacuuucuggcuacuagaagucagggacaagcugggucuaauuuucgaguaaggcagacagcuggaggaggugugguccccgaaggucuauaaacacaucacagugaguguagcagugagugggaaagaugaggauuuccccugcaauggcuugugagcaaauaggaaaucacagcuuuagaagaaugaaucauucuuugcuucaugaagcuuauggcagccucaguggagcaauugauuuaguaugcaguccauucuuggugagaacagcuaauuucaagcagaaaauaauugcccgcaaaauggagcuacuucuccuguugagauguuuaaggacuuugcagcccacuccaccuguuggguacaccauggugguuggauuucacuugguuuugauuguccuuuuucuucccaaagcagaaugcccaggcacuacccucuccucccccagcuggugcuggcaugagaggaauucugcuaauacagauuacugcccaccgggucacugcagaggaaguugcagcuauagcaccuuugccauugggagggauuugugucugagcucucugacuuccguagcguagacuggaaauggaagcucacagggagcugagacagccacccacuuucaaacugaccugaaauccagaagaggcaaaagggaggagagccaggaggacaggccaguagaagggaggcccugcuaaucucagcauuagccauucagacucauggcagcgguggccuuggcaccaggagcagucacgcagcagcacggggugucaugagguggagcuggaggagacccccagggccacuggcuguaagugcugggcuccugugugcuucuaccccuaacuucccaguguagaaucaggguagcucacagcucagagacuucccucucuggcucuuccucucaggguuagcauagguaaggauuccucaauuauuucagcauaaucuagcaaagcaacuugccaaugacgucagauaauacccauuaugagguggcuagagaacugggcacauaauaaaagaaaacucagcuuuuggcugggggaauauccugugggcuucacugagaucuucccaaccaucucuuuagaauugggguuauuuagagcugauugagaacaccuuaggaguaugucuguggaaaacgucuauuuacguugaaguuuuaaaaaugccuaccccaggagggaaggaacaccguuauuaccucucuuuggaauguuggaaaggaaugguccguguggguauguaaggccagacaauuuuaaacaccuugaccacuaaaauaaccuuuguauguuagaagugccuguagauauaagaugauucugucuaaugagguuaguaaauuguucguuuuuugcauggacauuuggacaagucuguauccuuucauguuuaacaucuuugagcuucugaauuucuguauauuaugucugaccuguuauugauaauuggaaagaaauguauaauguucugugcagagugcuuuugcuuauauguaagcaagcaucauaagaacauagguaaauguggaguguggaauguggauacuucuuucaauagaauucugagggcaaguuaaccuuguaaccagaguccuuaauacuuggauacuggaaaauuuuaugugcaauaauccccuugcccaguuuauuaaguugccuguuuucuauguaaugugaaaaauuggaauugagugauugaauuaauaaacuugcaucgaggaaagcaggguauguuggccagugugaaucccaguaguaucauaaaguuucaguuuugccuuaaauuuucauuuguugucuuccucccuaaauuaaugccaauucucagcauuuucuuauaccugcuagagugauccuaauugauuuggguagaaauagucuuagagcacguuuuuccauaaauaauuuuagucccuggauaauccaacuuuuacuuauaaacagaaaaauuuauauuagauaugaaguggccuggauugugcaaguuaacaggagucuaacuuugguaaacuccuacuugcuaauaggcaaaaugaagggggcucauacccauauacuauaguuaguuucuuaaagaacagggagcuguuuugucaggggaaguccuuacacucacuaaucagggaugacgggagagaugaaaggggauaugcaguguccaaggcacagguccgacccccaggggacuugucugccccguggccaauaggacugggucacagaggagcucugcccgggacaggauuggguuucuucugucauugcaaagcaugugaauucauacacuuuauuucuaacuucuauugggccagcuggugauuuuuauugauuauuucauuuuagccaaacucaggcucugaauugguuuugucugaagaugaaaaaagugacaaugaagauaaggaagagacggaauugggcgucauggaggaucagcguaguauaauucuucaucucauuucacaacucaaacuuggaauggauuugaccaagguagguuggcauguccccuggauuuguggucaguuguugggguucugucucuauccucaagccuucucuaugcacauucuuuucguuguggugagauuggagaagaagaguggggaaaaaggccagcauugcuuucaaguauggauauuccagguauaauuugaaaggacauuuguacauaaaugguuauccucagggcuggacagcccugcauuugaucuugggaggaguuguugcuacucuacaagggcagggagaacaucagaaaaagcauaugagaugguauggaaaauucaagguacuauuucuuuguuucuugcuauguucuagagauaacuguagguggccuauagagauggcuaugcacaguggccauagagggaaaagauggggaagggaaaugguggcaccaggaaugacgccacucuacacgcccaaccucacgaccuucugagggcuguccuuagcuguaacagcugguccccaaggguaaccuuguugcugauccaaaucucauugccauagguagaaguggaaccaacucuucuuggugcugagugcaggcaggaugcuuccugaggaaccucaccaacagaaccaguguccugaccacuaacgucauggagagggucccacauacgucaccccucaccucuagucaguagcuucauucuagaggcaagcaggaaaggcaauuuuguacguagcugaaagcuuguguggugucacuggggccauugucaggugguagaaagagccuggaguucagccuuccugggcuccacucccagccaguuacuccaguugggagccuuccuggcacgguggugugagaaucgcaugaggcgugcggaggaccuaacccagugcugagcuccuagcaagugcgucaccaucuuauccuuacgaaaugcuauguuaugugguucgacugugguaggguagagaagcagcuguuacacagacagacagacaugaucugcggggagggugugcuggggaaggaaguucuagauucugaaggccagcuagaaaaauauggaugucagagccacugaaggcacagccuggggaacagcccuaagggcaguuggcuugguuggccacaguggaggcucuggauuccacaaucucaucucggacuaggcagggggcaagagaagagagagggaagcggcaguagugugaggaauucuuugaggaggaagaugacagaacagagugacuaaccauuuauagaagacaggagagagacugaggagauaggagccucucagaugacagacaaaucuuuucuuugaaguguuuucauggguuugaaugugagcgugucugauauucugggagacugcaccacuuuaaacaaaacagugggcccacacugaggacgccagacauagaaaguuccuucuucaccauccuccacccucuguguggcugcuucuguuuugcacaccaagcuaugacgacuuguucuccaugcugcugccuucccuucaucucaguccccuagcuggauaaugcuuauuguuuuuucagcuacaggagucauuuaagugcuuggcuuuuaaaagaugcccauguuuuauucuuguggauuguguagacacccagacagagcuugaguugaaguuugaugaaguguggaugauaacguguacaaguacaaucuaaaaucacaguguuuccaaacugggucaugaaccauuagugaguugugaaaccaauuuaguggaggucaggccaccauuucuaaagaaugaaauaaaauacagaagaaaauaucagagcauucugcacaugaaaccuaguucuuuugauacauguguacuggguaacgauguaggauauauucucauuguggauuuuuuuuuaauguuuauaaaacucagaaucaugaaugauggaggaaagagauuguaagagaaauugaaauugccaaggucagauauggagaagcaagaaaauauugaggggacuauauuauggcaagcugagugucugagcgacuucacguuauuccugucuugcucuaaaauaaagaaauaucacaacugugcauuucauauuuauuauuguuuuauuagaauaugauuguuuugcauuuccagagccacagccucuucuugaaagagcagacauugcauuucucccaauacucaguugaguaccugaaagaauaacguuuccugucuauaguuuauuaacuuacuuuacuuggaagacucugucauucaaaaaccaaaggaagacuugacaagcugaaauacuugugagggaaagagguagaacuguuacuaucccaugagauuucuuggcuucuguugcccuguauuauaaaaagguugaugaaauuuccucucuccguacuguccccuuuucucuucuuggcaguuguccaugucauuaaauuaagccuguacuaaauaagcaauggaagaacuuagccagaauggaguaucugaugagcaggcacccuggagagaaaaucuucuucaccucaaggaugaaggucuagucccucuccaaaaacaaguacacuuccgugucccugaggaugugccaguguugacacauuugugagucauuaccagcccaacugggcacauagugcuguaucuugcgaugguucacugugguuaccagacagggccagguucguggauguuugaccugugagguugcucagcaccccaugcucagaagggcuccaugcuugguuuaaugcccugcuaucacugucuugaaauucuuaauaauuuuccaacaaggggacuuguguuuucacuuuccacugugccccacacagcauguagcugguccugccucuagaagcacccuugucugcccucuuuccucaggguggcaccauaaccccaaguuacuggugacuaccuccacuggaauaacccacuguauuuccacaaauuguggguagccuagaaaagaagagaggauggaggaaccacagugagguggagggucaccgaaggucuggcguguugugcaugcuggugaguggcuccauugaaccuggaguggacguuaggaucagguccugcagagccuaugggccaugugaaggggacaaacuugauccugagggcuaugggaagccuuggaaaguuugagcaaaugaguaacaucaugugguauucaggagauccugacaugacuguugugccaaguuccaagcuccaaggagaagggcccacaaaaugcaauauugagcuugcagguguaggaccauuuuuaccuaguuuucagggauaugaaaagcaacaauuuguaacguguucacucauguaacauguauuuguugagcacugcacaugccagauacuguuuuagacacugggauugcagcagaacauugagaauccaugcccugauggggccugagugaugauggaaggaaacagacaagaaacaagugagagagagggaaggagggagggaaaagaaaaggagauggagaugaaguauaaugaagagaaauagagcauaucagggaggguagcuaguggugggacgggggucccucuuagguaaacuggucaggguaggauucuacuagguaacauucuaguggagaccagauuuaaaugagggagccagccaugugagcaucuacggaagaguguucuggccggaggggaugggggugaaaaaggcccaagauggaccuuguuuggcauuugggcaugaggccaaugugguuggaucagagugaauugagugggauuggcaggagaguaaguuggugagacagcagguuauagggccguuuaggauauugugagggcucaggauguuguuuugagugauaugguggccauuggaggguuuugagcaagggaauauguggccuuacuuguauuuuuguuuuauuuuuauuuuauauuuuugagauggagucucgcucuaucacccaggcuggaguacaauggugccaucuuggcuuacugcaaccuccaccuccuggguucaagugauucuccugccucagccucccaaauagcugcgaucacaggugcgugucaccaugcccagcuaauuuuuuguauuuuaaguagagaugggguuucaccauguugcccaggcuggucucaaacuccugaccucaagugauccaccugccuuggccucccaaagugcugguauuacagacgugagccaccauaccugcuuaguuguauuuuuaaaggguaauuuugacucugcugugaaaaauagacugagguggggugacuagggugugaacagcaggggucaggguagaagagagaaggaagcuggccaggcaccguggcucacgccuguaaucccaguacuuugggaggccgagguggguggauuacaagguuaggaguucgagaccagccuggccaacauagugaaacccugucucuacuaaaaauacaaaaaauuagcugggcgugguggugggugccuguaaucccagcuacuugggaggcugaggcaggagaaucgcuugaacucgggaggcggagguugcagugagcugagaucacuccauugcacuccagccugggugacagugcaagacuccaucucaaaaaaaaaaagaggaggaagcuacuguaauaaccuaggugaggugcugguggcacagugcuaguggcugauucuggaugugcaucgaagauacugccaacaggauuugcauaugaugugcaguaugagagagaggaauaaaagaugacuguaaaguuuuggccugaacagcuagaauaauuauuauuauuaauugcuauucguuuuauuguuuuuuauuuuuuguuuuauuguguuuuuaaauuuuguuuuauucuuuuauuucuggccugaacagcuagaauaauaauuacuaauugccauuuguuuuauuguuuuauuauuaauugccauuuauuauuaguugccauuuguuucaauugucuauugcugguaacuaacccccccccaauuuuuuuuauucaugguuaugcaaucuggaaugggcuuagcggggcagcucuucugcuggucuugccuguuguucacuggugaguuggacuuggcuggaacagcugggcucuucuuucuucaugaagucuuaggaccuuucccucuccguguguucuucccacaugguuucuccaacugggucgcccgacuucuuaaauggcagcucaaggcuucuaagggggcaaaaguggaagccgguaagccuuccuaagacuuaggccccaaacuggcacaagaucacuucuauuuuauugauuaaaguaagucacagauucaggccagauugaaggaggauuaugcaagaguguaaauuccaggaggugugguucauuggaagucaucaguguaacagauuaccacuccauuuuauggaggaggaggagacuagggaagaacacguuggagauguuggggcuaucacaaauccagucuuggaucugauuaggucugagauauccauccacuaggcauucaagaggacauguaggcauuuggauauauacaaaucuggaguucaugagugaggcucagguacaaguuugagaggaaacaauguauagaugguggucaaagccgugaggcuggaugaguuucucuagagagugaguagagacauggggaaaaauauccaauuacaggguucugggauauuccaacauggaggggucagggagaugggaagaaucuagcaaaggagaugaagaagguucagccagugaaguaagauagaagucagaggagugugauguuguggaagccacgugaagagagaguaucaagaagaaagaauugaucaacuguguugaauugcugcugaugggucaagaaagcuggggccugcaaauggaccauuguauuuggcuuugccaaagucugaugggagugcauucaagggagaaugggaaaaaaugugguauaaagacggggaguaaagauagcucuuuaaaggaacuuugauauaaaagggaacagaaaauuggguggaaacuguaggaguaucugaaauuaagggagauuugguuucuuaagaugcuugaaugcugaugggauuaggagacagaagaaaaaaugcugcaggagagaggaagcagaugagugcaggaauuugaggaggugagagggcaugggauccagugcauggaaggggaguuggccagagauagcauaaugcauccauugcagcaggggggcaggcagagagaggggugcagacaccagaagauggcaggagacccucaugguuaaccacauggcucugagccagacugccugggcuggcauccccacugaguuccuaucuauauauuaccuugcaucugagugccucuguuuucucaucuuuaaaaggagguugauaauuguaccuuccucauagggccgcucuguauguaugcauacugacgugugaaggauucagagcagugccuggcacagagugagugcuguguuugcuauuaugauuaucaagugaaccuucucucuggacugcuucaauuuacccagugagaaaagcaggaaagugaccagcugagagugauaaagagcaaaggguuauuagagguuugagaagggaggagaagacagggaacaaguagagagaggaagcagguaggaggauugucacacaccaccagggggccacuuaagguuuugagguugugaauuuaaacuaagagucugcauguugucucuguuucuccaagaaaguugagcugccagauugagauauacagaaugugaggggcuggauuaaacagaguuaagguuuucuugguuagugccuggauggagggagagaguggcagaguugcuuggcauagaucaaagggaguuaaguauaggguugggccagggacucuauacugggaguggagggaagugagaccacaagggggugguggacaguaaaaggucaaugggucaaaggugcugguaagacuagggacuggauggggugaaugggacauauggggcaauagcagagagagggaugcuugaacuugagauuauggguggcaguuacagauaaugacagugugccuguuuguaacccuauguggauuucucagaggauuuagucuaaacuccaguguuacagauauagaaaaaccucgaacaguguauuuugaacccuuucagagagcacagcuggcuucagagaguagguagaaggugggggaugcagacuguggcuaaaacuaguggauugagcugugcuccgguggugaggucccuaaccuaaagauacccaauucauagcucaucaaucaagaacacaugaaacaagauucaugcuuugaggccggguggcuugugccuguaauuccagcacuuugggagguugaggugggcggaucaccugagguugggaguuugagaccagccugaccaacauggaaaaacccugucucuacuaaaaauacaaaauuagcugggcaugguggcacaugccuguaaucccagcuacuugggaggcugaggcaggagaaucgcuugaaccuuggaggcggagguugcagugagccgagauugugccauugcacuccagucugggcaacaagagugaaaguccgucucaaaaaaacaaaacaaacaaacaaacaaaagauuuaugcuuugaaagagcuugcugagauaauuuucuaugagucuuaaagaauuauuuaaguuguuacuaaucaaagaaagaaaugaccuuauuuuagaccuucuaaaucagcaacaaaauaguagauacauauuuaguguauacaggguaaaaaugauaccccaacuccuugcugauggcauuauaaauugauugcauuuuuagaaagcauugacuacgugucaaaaaucagcaauguucacugaaacuuuuuaaaaaauuaaaauaauuuuaaaauuuaauauugaacagauacaaaagaauauaagauauauggauaauauagggcaggggucagcaaaccuuuuuuuuuuuuuuuuuuuuuuuuuuugagacagagucuuacucugucacccaggcuggagugcaguagcaugaucucggcuaacuucaaccucugccucccgaguucaagugauucuccugccucagccuccugaguaacugggauuacaggugcucaccaucacgccuggcuaauuuuuguauuuuuaguagagaugagguuucaccauguuggccaggcuggucuugaacuccugaccucaggugaucugccugccuuggccucccaaagugcugggauuacaggcaagagccuuugcacccggccagcaaacauuuuuuguaaaaggucagacagguggcuuacauccguaaucccagugcuuuuggaggcugaagugggagaaucacuucaguccaggaguuugagaccagccugagcaacauagcaagaccuugucucuaccaaaacuauuuuaaaauuagccaggugugguaacacacaccuauguucccagcuacuggggaggcugaggcaggaggaucacuuaagccuaggaguuugaggcucuagugagcuaugaucauaccacugcacuccagucugggcaacagagcaagaccuuaucuuaaaaaaauuuuauuuaauuaaauaaaagaccagauaacaaguguuuuuggcuuugcagaccguauugugucuacugcaaccauucagcucugccauuugaccacaaaggcagccguagaaaaugcagaaaugaaugguuauaguuuguuccaauaaaacuguuugucaaagcaagugaagauuuggcccauggguuguguuuguugaccccugguauauagaaucacacuacagcagacaucauguucucaccacagguuuauggaaaaugacaucauuaccuguguacgcuuuaauggauauauaacauucuaccacauugcugcguuauuuacuuucccaacaaauagucugugguuggccacguugucucuuuuuggcuucuugauguuauaggugaugauauagugaacaucuucuuaggcauacagccuuuuuccuuugauugaauuauuucauuaggcccaauuucuagcaucaaucacaauaugcaaagauuaacauugcugugcuugagcuuuuuuuuguaaaagggaaauuuuaaugaaaagggucagaaggccaguguuuauccuggaaaugaaccccacaaggcagagauauggaccucaggggucucuggucucccugauccugcuuccacuucucuugccagaucccuccagcuguucuucucccugaaucugguuuucaguauacugucaagcaaagccuguuaucucucccgaguguuugccuuuuaauagaagagagaguggagaccuggcuucccuaagcuugucuguguaaaucuguuucaugaggcgacacaguuaugcgaucuccauucuuucucccuuucuguccuguuggcagcaguucaucaauccacacuucuagaaagagugacagucacaaugguagucuucaggccccuugggggcgcugagcaacccagcaugggccuuggccaagcagaauugauucucauuccagcucuccacugacguagccauuguaaauugcaaaaccucucugggcaguuuccucaucuguaaaauggaauaguuguaccugcuuacagacaucuaagaagauuacauaagauaaugagugugaaacccaagcacugugcccuggcuugagcucuaaaaacaguuuaaaucugaaauauuucauauauucuuacagcaauguuuuugucuuauacaauuguuucuccuuuuucucugagcaggugacugauuguuuacagaagugucagagguggucucgggguugcucugggcauugugagucauuuuagcuuucaacauugucacugaaauauuaugugacaaguuugugucuaaugccuguugcucguaucuucccuggucuccaaaugagguuacugauuccugauuauaggggucuauaaucugagccagcaaagaaugagcguuuccuggauacuagguaggcacuggacuaauuuaacacugccauuuaauacucacaaucagccuagaagguugguauuuuuauuuucucuauuuuuacagcugaggaauugaguccuggggagaugaauuugccacguacacauggcuagucacuguuaagggaugacguucugcucccaacugaauuccuucugugagcugaugucugggacucuggaaaaacacagggauuaacuucaacagauaucuuucuauauaguaaauaucuucuuggaaaaaguaaaauuuuauuucaaacucuucccaucugacaaaaauuuuaaugaaugcuuuucauaauguuucaggcaccaugaaaugggugugagggaaccuggcagguuaaggaaaccuagggaaaagguuggcuaagucaagaaaccuuuugcagugugaauugucugcgcuuuauuuuguaaaauuggauuuuuguguauuucuccugguuuucucaaaauaggacauaaaugaaccuuugcggugguggaggccucucugcuugcuuguuugcacuggguguguuugccaaucuaaggauaaaauacgaagauggcucccaagguuaugaagucauguuucuuuuuucuuucuuuucucuuucuuuaaagagacaacucaggcuggcauacaguggugcaaucauagcucccugcagccagaaaguccugggcucaagugauccuccugccucagccuacagauagcuaagacaacaguaagacuacaggcuugcaccaccacaccuggcuaauuuaaaaacauuuuuuguguagagacaacaaggucuugcagccagguuggucuugaacuccagggcugaagcgauccucccaccucagccucucaaaaugcugggaucaugggucugagccacugcacccagucaacugauguuucuuugaagaaaauugcaccuacucuuggccuucuauuugcagaggccagcugugcucccugcuguggggaggggacugucccuccuuccaaguguccuucgccuuccccuaugggugauuguuuauuucggauuucuaagagccuaagaucccaaccugaagauugguuauuuacuuuuagauugaugcaacuuuaaauguaauuaauuguucucugagucccuagugcagauccucucuuuuuuuccuuccccccaaauaguucacugucuuaauuauguuaacggaagaaaaggcagucuuuauugauggcucgguaaauccacagcagugauuucaggucauuuggaugccaucagucugaacagcugggccgucacucacccucugucagaggcagacaacccaauuaguacucaccacuccuuggcucuguaucccugguguucacuguccaagaaauggaugauuaaaugacuuauuugcaaacacaccaaaaaaaaaaaaggagagggugcccaggagauuguaggagaggaagaaaucagaccagacuaggaagucuguuuuaaugaaaaguaugacaucuuguccagaauguucaguugcugguuuugaaguugaucuggcauucugcacaaacuccaaugaaacacacaacagaagaugaaagaggaaauaguaauucugcucccaacccauucugcuccaucucuccagguauucuauuuuuuuccugcucugacaaagccacgucauuuuaaaguacagaauacauaccuaguagguuggacuugauguuggcugugagcccauauucccucaguccacaauuuugggaagguugucuuugaaaauuauuauucucagguauugcauucccaguagaaccuuuuuucuuuuuccuccaacuuuuuuauuuugaacauuuuccaaucuacaguaaaguugcaagaguagcacaauggacucuuguauuaguucuugcauugcuaucaagaacuaccugaaacugaguaauuuauaaagaaaagagguuuaauugaccaguuuugcaggcuguacaaguucuggggaggccucaggaaacuuacaaucauggcagaaggcgaaggggaagcucucaacaucuuacauggccagagcaggagaaagagagcaaagggggagguguuauauacuuuuaaacaaccagaucucaugagaacucacuaucaugagaacagcaaggggaagugugcccccaugauccaaucaccucccaucaggccccgucuccaacacuggggauuacaauuugacaugagacuuggguggggacacaaauccaaaccauaucaacucccauauauucuucaccuuuuuuggccaauuacuaacauuuuguacuuugcauuucuucucccuucuucccucucugccaaccucucuccuccccuccucccaccuuccuccuuccauuuuucucucuaguucucaagcuguuucccuccagaacuuuuuccguacacauacauguauauguguguguaacacauuggguuaguccauuuucaugcugcuaauaaaagacauaccugagacugggaagaaaaagagguuuaacggacuuauaguuccaaauggcuggggaggccucacaaucauggcagaaggcaaggaggagcaagucauguuuuacauggauggcagcaggcaaagagagagagcuuguuugggaaacuccucuuuauaaaaccaucagcucucaugagacuuacuguuaaugagaacagcacaagaaagacccacccccaugauucaauuaccucccacugggucccucccacgacacgugggaauugugggaguuacaacucaagaugaaauuuggguggggacacagccaaaccauaucauacauguauguuuauuuuuugauuaaccauuuuagaguauguugcagacaucaugacaguucuuuccuaccccuuuggugagugucuucuaagaauaaggacauuauaguauacaugugucacauugggaaauguaacauugaggcaauauuauuucauauucagcccaugguaaauuuucccaacuugucccaaucauguccuuuauggccauuuuuuaaaacuccagaauccaacccagauuauguugcauuuggucauuaugaugucucuagucuccuuuagucaagaaaauuccccgccuuuuucccuuucauggcagugauacugaagaguucaagucagguuuucuuugcuuucauuuuuguuuuccaaacuguuccucaguuuggauuugacuuuuuuuuuuuccucauaguuaagagccagacuaaacaauuugggcaguaauaauuggcagaaguugcugagcagagccuuuguuuuuccuuuugauaaagagaagaggaagaugccuucagacuaggcaauuucauuccuucuggcuccuuuggagccuuugaaggcccauccuggaggucauccagccacauucuuuuuggccccaaaggugucuuaggagauccagaagaguguggggcagaccggguuugagucuacucauucauuagacauuuagagugcacuucugauacaucaggcucugguuccuuaccacccaaaacacguuccugaaauaagcuagauucuguguaagcuggcuucagccuagaaguugguauguaugugaauauucucauguugcucgagagaagcagcaacugaaaacuuggcuggauauacucagaagaauuaaaagcauagugaaugagaaucugcauuuaaaaauauggguaacuuaaacaugucaaaggaaacaaaggugucucucaugcaguucaucuguuugucuuguuuuuugcuagguauuaaggagucaggugucuauccacuaagagcuuacaguuuugaaacgugugcauuaauaagaacaaaagagccuugcagguggagauaugugugaggugcagaggauaggagagagggguuguugcuuuagccuugaaagcaggaacugucaaaaaaagcuucacagagcagggagcuacuugagcugaugagcuuuuugucauagagacagggcaggagaaagggcagaaaaagggagugugugugugugugugugugugugugugugugugugugagagagagagagagagauuugugcagggagggaugggggcagucagucaggacaucgugugagaccagagggaggugggggcguuaucucuuacauagauuuuagaaagaugacucuggcuguuguguggaggagaguuggagguauggcaggaugcugggccuccaguucaggagccacgccuccuacgcccuuccuucauugcaacgaucucccucccauuuaugauauuaaugauacuguuuggaaugguggauuuucuugcuauguugggaagagugaaauggcccuaaaagguggggcucaugucccauucucuugcccauuugaucuccuuugcccacuucuuuuaaaaaaauuauuauuauuauuauuauuauuauuauuauuuguagugauggguucucacuauguugcccaggcuagucuuaaacucuuccugccucagccucccacuguugggauuacaggcacaaggcaccauaccuggcucuucccccucuucuuaauccaugacagcagcugggguggcccagacauccuagcugucucccuuguccacugagagaagauguucuuguuaaccagaagcagauaaucaugaugugucaugggguaauggcagggacuuggagguggcaccugggagccugagguucccugcuggcucggccacuggguggcccaggcauagcgcccucaccugugggaccagggcagugcacuaaaucaucuugcuuuuuaguucugacauuccgugacucaggguuccaaguggaguucuuuuucuuauuuauuuacuuauuuuuuuuuuuaaauccuucagcuuuugaauucagaaaugcugacuaaauuaggggaaauaucuuaaauucuucuccuuuucaaaaguacaucacuagagaguaaauauuguaucaguuuuccuuguuaacuuuaaucuuggguacaaacaugaagauucuugucuagagguggaauuauugccacagaagccccauugccauagaguggggaaaaagacacgagccaagguuacgcaauuaucuuuguuugaaguuauacccaucagggcugauggccucaguguauauuucuguccuuccccuccccuggcuugccuucugaucacagggccccuuggaccugggaagggagagagcaggagacggagucacuuggggaagggaugcagaugcagacauuuguggcagccuguccuuugucauugauuuggcuucauuaagggauuuccaagcugcuuaaauucacacuccccagcuugugcacccugucuggguggaguucauaggggagcccuugggugauucuggggcagaagagggaaguguggugaguauuuggggguuauuuacucugcuauuggacagcuaaguggugggagaacacagcagccugaccccagugaagccucauuggaagagcagcccccagagagcacagugaugguugcugaaugaugaccuguccccacgaaaaaggcauaggaaguaauagagguggcaucugaagguuauuucaagcuaaaugcuuuucuuggccagauaagauccuaggacagccagauucucaauuuuuucaagucguggauuaaagaaaauuaggaaaccuccauugauuugcauaguuguguuuuuaaauaauguuucuuccuuguguguauuauaaaaacaaagcagaaagauacucagaaaaaaaaguguuaaaaucacucaguucugucacccggacagauauguuaacauuuugaguguuuuuaugauucuuggauuguauuacauguucaauuuuacaucuggcugcuuuuuuauuuaggacaggcacauuuucuccugacauacuuuucaaaugaaagauagaaaagcauuaaaggagaucuaccaagcuuuaccucucuagcagauggggcuuuuucuaguuuccucugaaauuucuguacuuugcuguucucaugucugccuaucucucucuggacaucuguauuagucccuuuaguguugcugugacagaaugagacugagucguuuuucagaaaaguacauuuauuuagcucacaauucugcaggcugggaaguuuaagagcauagugucacaucuggcuggcuucuggugagggccaugugcugggucaaaacguggcagaaaagggagcgggugugugugcagagaucaugugggaagcacaagggucuaggaagccaaagucgcuucuagaacagcaugcucuugcggucccuaauucaguccugagagagugagaacucgcuccugaaggaaggcauuaaucucuucauaagggaucugcucccauuaccuacacaccuucuacuaguccccacuuccuaacacugccacaucggggaucaaauugcaacacacauuugggagaggacaaacucagaccacagcagcaucucuucucccuuccaucacauccaagucauuugcagggaaggguguuggaauccugaaguagagucaggguuacagaucugugagccugugugauauuugugguccgugaucauacacccucccaaauguuuucaugggagugagggacugcagaaaggaaggacagaauuaguuauguaaagagagauuguaaaccagccccaugguauuggucaacucgcuggaacccgguguguucccugcguggcccagcaggucugggcuagcuuuccaguuucaaaauccugugaguccacguuaggaggaacagaaugagaugcucuggguuaaggcuggcuguguuuugcagcuaaguggguggauuauuaauacccgauaacuguuugggaggccaagacggguggauugcuugagcucaggaguuuguaaugagccugggcaacauggugagaccuugucucuacuaaaauaaagaaaauuagcuggguaugguggcaugugccuguagucccagcuacucaggagacugaggcaggagaaucacuugaacccaagagguggagguugcagugagcugagauugugccaccgcacuccagccugggugacagaaggugacucugucucaaaacaaacaaaaaauacccgauauuuguuucaaguuaauuuaagaucacucuaggacagugaaaaauggacuuucucuucuuuaaaaagcaguagcaguaaugaguuaugggcuucccaguuucagaguacccuucaguugcuuuaagugacuuacaguagaugauuaaauaaucauuggguuacaggcauuugggguuguagagcccccugagugaccaccuggauccacuuuggaucaaugaggagucucugucuuaucucuaccagaguuauccgggccucuacaaggucucugucuucaaucauggugccaauaacaaaccuagggguagccacucugccaguccuuuagcagcagguucuguauguuaagugccagccugcuuuguaacuuccacugguuucuccuggaccagccuugaggaccgaccuccacagauggaaucaccauggccccucuugucugcggcagcucuguggauauuugccugcugaugggccugccccguccuggagcugggcccuuuccacaguccuacccuuccucagucaugguggggcuuguacaccauucuucuaccgaggccucccagugcacacugucauuggugguggguccuggucugccuggacccccuaugaaguggcaccaacaaaccccaguauccauguuugugagaacacacugauugccgaccccucccuuccccugccccagcccacuuggucuugccugauggcagggggaauacagaaaagcccuuccaggcuguuuucuucacaucucuaaauaauggagaguuaggggagaaauggcaguggagacugagacagagacuauuguguuagcccagguaaacaaggaagaaaaucacucagagcagucuuguccacaaagcugggcucucguugauuccacugccacuucucauuucuuugauauuguuucccuugguuugucaugugugcacaagucaaaacagacugcucccuggcuggagauguuaugaauuugcuuaacagugguugcagccuuuaccuuucuuuucagcuuuuccguguaaucccagggauugucugacuuuguguccuuccaaaugcagguggugcuucccaccuuuauccuggagaagcgaucuuugcuggagauguaugcagauuucauggcgcacccagaccuacugcuggccaucaccgcuggggccacaccagaggagagagucauuugcuucguugaguauuaucucacagccuuucacgagggccgcaagggcgcuuuagccaagaagcccuacaaccccaucauaggcgagacauuucacugcuccugggaaguucccaaggacagggucaagccuaagaggacugcuucccgcucuccugccagcugucacgaacacccaauggccgaugacccuuccaaaagcuacaaacuaagguuuguggcugagcaagugucccaucacccacccaucuccugcuucuacugugagugcgaggagaagagacugugcgucaacacucauguauggaccaaaagcaaguucaugggcauguccgugggggucucuaugauaggggaagguaagccaugucguauguuggaguuuggcucuuacacagugacguuucuauaccugguagaugauugauaauuuuguguguggaguuuuuuguuguuguuguuuuuaacugguuuuggaauuagagugugggugguaaaagggucagguuuuguuguuugggaacaaggucugguaauuucccagcggggccaagguaacggacuaucugccugacagccgcccaccuggaccuucccaccuggaccuucccaugcugugcacgcgcgugcgugcacaccuuacagguacuguuuucuuucagcuuugcaugaauauaagaguuggccuccaaaucugugaaaacacauuuuuauucauucucaccgguguucuggcucacagacaaugaggauaaucaugcugccuauucaaaaucugcucguaaaaauucccaaaacaaaucuuuugacucuaugcuggaaauucugaagcaagaacauaguauaaucacgccacugguggaucacacauucuuauuuuagcaaauagcugugaaugaaguuuauucauuguuugaagaaaccuauaauaauccuuguuaaauucaagcaucuguguuacugguucuucaacuuuuuuuugagucacaaaucucuucaaggcucuaaggcugugauucucuuccuagaaaaaaggaaucuaacuccaaauuugucuuugaguuucagggaguacauggcuccuuagaagcccuuccaaaaccccaugagauaagagcaccuuucauucacuuagcacauuuuuauugagcaccuacuagaugcuuggcauugccuuaggagcugugguuacuugagcaaacaaaacagaccaaaaaagaucuguucugaugaugcuucuguucuccuucuuucucacggggaaaugaaauaaauaaguaaauaaaauggauugugugguaaguugaagaaugguaaguguuguagagaaacaaagcagguggggguccggggaagaccagggagagggcaguugagcuuucagaugagcuggccagugggaaggccucacuaaggugauauuugagcaaagacccaaagcgggcaaagagggguaaggcaagccuuauaggucacugggaaagaguuugugugcagaaagaaugaggcagaggccuacagguaaaaugucccuggcacggggauggagacaggaagcccauguggcuggagcagggugaacaggggcagguggaggucagggaggugaugguggccagaucacauaggaccucaugggcuauugcuagggacacuggcucuuacagugagggagcccugaagccacuggugcuuuugagcuggagaguaccaggcucaaucucauaguucagcaagacugcuccagccguuuguugaaaacagacccugggcggggguaaugguggaaacaaggagacuagggaggagguugugagaauaacuaagcaggugaugaugguggcuuggaccagguggaaaauaguggaggaaguaaauguaguggaguaguaaggaucuggauagguucuaaaguuagagccaagaggaucugccucuggaugggauguggagugugagagaaaguguugccaagguuuugaccugagcaccuagaaggauggacuagcuguuaaaacugagauggggagacuugagggcuggguauugggcuacuuugaaggaagaguaugggagcucagggcgguuguuaggguuuagucauugaagggagugcuaaaguaggcaauuguguaugcaagcuggaguuucauagggaggguccuggcugagauaaaauauuuaaggccuugagacuaaugagacugcugagugagcacugauuucugaagcauuaagcagcauuaagaggucugcaagaugaacagccagccgaggagacugaugagggguggccagagaaguagacugaauggaaugggagaaggugcuccuugcgaggcaagugaagaagggcuucaaagugcgagagugaucaacugcaucacaugaugcugguuacuccaguaagaugagaacugagaagggaucauggauuuuggaucauggaggucauucgucaccuugacagcaguugucaguggaguagcacuagugaaaaucugacuagaauaaagucaagagagaaggaaggagaggaauuagggacuguaaauguggacaguuccuccuuauuuaggguuugcaugcaaugguacuguuuuggaaaauagccacucuuggguuccacuucucuguuagguuuacaccccaaagcgcugcucccccucuugcauagguaagauggcaacuccagagugcccacagguguacucagcauucguguugggccuucacuggggucuuccuugcaugcaggucuaguaaucagcagcucaugcugcacucgucacaccuuccucucaaggaucaaucaggaucaagaaguucaccaaugagacauucauuaauuuguguaggaagcuagggacacaccugucaccaggaugaucuugggucacccaguuuaggccuuuuccacaauucagauggagguggguuguaucugugggggaaagauguaaaaauacaucuaucuuuagauaaaccucaucaauaaugaguauuauccuccucuuagguuaucuucuguaagagugcaguauuacaacuauuuuccaauuagaaaaaucccaauucaugacuggguugucuggcuuuuccugcuguugacaaggggagauggaugccugaaguggucucucuucuuaaagaggaguuguuaccagugaugacuggaccaugaaaucuuguagcugaaagggcauuuguccaccauaugcuccaggguuuccagcugugcuguagagaaucccaggcuccuuagaggggcacaggaagugaguggcaagguugguguucuuccaaguccacuccagcccgaguaucuccauccauccuuaccuauuuaccagagggacuucccuauacaaguuuauuuccgaaaggguucuguugcuucagaaugcucagcagaccccggaugaguccagcuauccucauuucacagaugaggagcccgagagaggcagcuugccuaggaacccaugcauaauucacaguauccauccugcccucagcacaagccauugaagggggaugcagggcaggugcuggggucuccuugagucaggggccauuucucagcucaucucugaccuguggaugagauaccagaaucugaggagguucaggcagcccccugaguucacaagcccaggaagagcagaggagcaggguugagcagcaggcggugggccggggaagggggaucaggucaagggcgauuagagcccuauauggacacagccagggcuguugaggccucucucugacacugagaaaacaaacuugauucaagugugcuucugugggggcagggcuagaggaacgagagguauuuccucaccggccucuuuucugaccccagugacugcuuguucuccugaacucugccuucuccuuggaugaagcgacagggagcuaccaccgugcagcacuguuuggguuaaagcccccuggcagguuucaaaaagguguuucagcccagacuggggacucuugaaguugugugaacuaagagcuccgguuagaauacucggguaacucuuccuauugaaagcagggagaagauugccaaggacuccccugugggagguuuauguucacauugauuuuuauacuugaguuuguaauaagaaaugggagcaacauuaaucuugauuuugacuuaucuggggcucuguguuuucauagguugcuuugggcuuggcucgugcuaugagguuuauauugguaaaaaaucuuuuccuuuucuuaaaaacaaaaauugguauucaggagacucaucucauucuauuuaauuuuauuccuuauucuaaauuucccacauaauaaauauuuugaagaugaaauauguuuguuugccagagaagguagagaaggcaguucacacuuuguauuuaugccccauaugcgagauaauuccuuacacauuuucuacaguuaguauuuuaaucauguuuaccuccuuaucgguaacagugguggcucgaauaaaucugucauuuacccauucacuuauccauucauccauuuauuugugaagugauuggcaccauccuugaugccagagaugcagcagaggccacagcacacagauucccugcccccgggagcucaugcuccaacaggagggucggagagaagacaagacaugugcgugaaguccucaaugugauggaugaugacugacacuaagagacaaaguaggaaggaggagagugaagcuggggcagggagguugcaauuuucaauaauguggaccucagcaagauagagcagcugaggaaaggccugaagcagguuuaagaaggggucuucuaugcaaaaaagaacagcaagugguaaggccccaaguugggagcuaguggcugggguguuuugaggacagccaggggccacugugucugcagcagugagugcguggcugggaagagaggagauaaagccagagaggagaggccacauuuugggaucugauuuuggggcucuggaacgucuuugccguuugcucugagaugggagucgcugaggguagacaugauuuuagcaucccuguguuggcugagugaagaauagacugaaggcagaaguggagagggcccagugcaaagauagaagcagagaggcaaguuguuucuuauuucucuucuucccuccuacacacacacacacacacacacacacacacacacacacacacacacacaguuugaaucugugauuagucagaguaagugcuuggugaauagaaugccuuuugucuggggauuucccugcacucagcagaagugcuuguugccgcuugucaaggccugagaaagccagauucuuaaauuggaguagagggucaauaccucccagucugugagccccuaauucuugccauuagacaaauauguggaaauguucgaaaagguagauuugcaauccauuuuuggugauuuagggaauucuucacagaaacgcaaucucucccuucaggauccuuccuucucuaccaaauagcagucacuuuuccccuguccccgaccaccagcggugggcuccgacaaggagguggcugugcaguggugucacgugugugauuguguuuuaaagcugguuauucucucuuccccacacaauguguucaucuuucccuucuucccucuacacagcauguucaucaucaucuucuucccucugcuucccugcacccuuguccuuccugucucccucuggugucucuagccguuucacuuaagccacaccgucaacggggcaccccucagcccagcacagcacauggccuccugucauugccucugcagcugaacuugagagagugaugagguccuuuuagcccucuguccccugaacuaaccaacaucuuugcucugucuuuuuuuuuuuuuuuuuuuuugagacggagucucgcucugucgcccaggccggacugcggacugcaguggcgcaaucucggcucacugcaagcuccgcuuccuggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccuuugcucugucuuauguuggccguuguugaguguccgugucuccacaggguaggccugugaggucucaggaucauagcuccucuguuucucauaggcagcaggcagaggcuggagcccuugauucacuuuacccagcccaggaccacagugucgugggugagaagccguggaacacccucuccugaggcccucagaugcagccugcagaugaagcagaauuagaauuuguugcucucacuuuuucuaacugcuugaaaaugccacucagaauuucucaauagcaugcugaguucagaaagaagauucuggagagagacugugaaaggccucuccuggacauggcccuuccuggccacucaccugauguuuuccugcugugggugggccugggcauggccaggggacccuuggcucguucuugugaggccuugaguuugccuaagucccuucaguagcugcguccccuuaucuuuuguauuaauuaaaauguguccgcuguaaugcaggaucugauuuuucacacaaacuauuucuaagaaucuccaaacuucgaagcagaagguucuggcucccacacucagagcuccuuugauugggggaaggcaggagguuggauaauuucccuucccucgcauauuuccugcauauucuaugaauuuguugauuggguguaaauaaugcuuuuuccaucuccucauuauaaaaaugaggucuuacauggguccacuuggaauugugaacguaaauacgugggcucaucuccuaaaucauggccuuuaggcuguggcauauuugacuguaaugaaaugcuauuaugaagugcuucauuaugcccugaauucacucacguugaccccagagacugcaccccuuucucccacccucucguuucuauugcucuaacagugagagccgacacuguucagucaaccuaagaccucuguccacgggaaagugugggcugcucaccccucccaaccucgcaccgcuguggagcugaggggcguucagcugcucuuugcagcccacuucccucaaaaugccugaaucaaugccugguaaauggugcaggcucuuaauugagucuguggggaaaaacaguuaguucuaaugagaggaagcaacaugauugccacugggcuugugagugccaaugcugccgggucugcaaacacacuucccagaguuccuucugugacucuacuuuccaggaugaaugucccagcugaauauuuugguuccucagauugagauuggacacaaaauuauuuuaaguuuaucaguuugaaaaucuuaaugcuuugccuuuauuggcgaaucaauuuguggaauuucaaaugaagaucucccagccugaggaagaugcauggaaggauugauuauuugauguuuuuuuuuuuuuuggcuucucuuagcuguuaggccaaaugaagaaguaacuuauauuugugaucccauuuguaagucuaauuuuaauaugucuuuuauucauauuaaggagauuuuuuuuuaaaugcaacccugaaaaaaaagaguauguacuaagaaggcauaauugcaggugauuugaugaaugaacacacauuuauggauuuucagaaacaagccaaaggcauguggucuugccagugccuucaaaucaguuuagcucugaggcucacugaccucccccaggacuugggggaaauuuuaccuugauuuggaagagauuuuucugaagaaaaaugggaggaggaugcuaucucuuaugcaguauuacauuagagaaagucugcccugugucucuuccaucccucacagguauagccuauuggaagacguuguaguuuccucuuuuuuuuuuuuuuuuuuuugagauggagucucgcucugucgcccaggcugcagugcaguggcgcaaucucggcucacugcaagcuccgccucccagguucacgccauucuccugccucagccucccgaguagcugggacuacaggugcccgccaccaugcccggcuaauuuuugguauuuuuaguagagauggggguuuuaccauguuagccaggauggucuugaucuccugaccucgugauccacccgccucagccucccaaagugcugggauuacaggcgugagccacugcgccuggcccugcaguuuccucuuuauugccaguuggugauacccaucgagagggcugcuuuaaagaaugaggaguaauuaagacauaaaaccuucaggauuuuggcagugugccaugcugcagugcuguuagcugaguuuagaaucgccuucuccaucuuuacgacagccaugggagauacagauaccauuaucucugcaucacagaugaggaaacugaggcacagagaaguuaagauugccaggcuggugagugacggaggacuuggaaugauccucuaagauuucauccaggucuuaaaaaaagucguggcauauucuccaugaaaaaacauggugaagaaaaucucagcuguauaauccuaccuuacuacaaaguuuauauuuaugaaugagacuaggaauaccagccagccaaguuuguggcuguuguguguuuccagucuguagagguuuccugcuagacaugcaagaggugggaguucccaauucccaagguaucccgauuaaggacaugaagggugaaccacaaaauaggaaugcaguagacaucaggggcaagguuauggugccagggagacauauugcucgccuggaaggauuuuacuaccaaguagagaugcuccuuggcuuaugaugggguuaugucccaauaagaccaucugaaggugaaaauauccuaagacgaaacuacauuuaauauaccuagccuagcaacauccucgcuuagcccagccuaucugaaacaugcucagaacccuuacaugagccugccguugggcagagucauccgguagcacaguacacucgagaggauggguuguguccuaguccauuuguguugcuauaaaggaauaccugagaggaaagagguuuauuugacucacaguucagcaggcuguacaaaaagcauggcacuagcaucugcuucugacgagggccucaggcuacauccacucgugguggaagaggaaggggaaccccugugugggggucacauggcaagagcagaagcaaggugggggaggugucggacucuuuuccaucuaucuaucuaucuaucuaucuaucuaucuaucuaucuaucuaaucuaucuaucugucuaucuauuugagacagggucucacucuguuguccaggcuggagugcagugacgugaccauggcucacugcagccucgaccucccgggcucaagugauccuccuaucuuaaccucccaaguagcugggacuacaggugcucaccaccaugcacagcuaauuuuuuuuuaaaauuuuuuuauagaaaugaggcuucgucauguugcccaggcuggucucaaacuccugggcucaagccauccucccacuuccaccucccaaagugcugggauuacaggagugagccacugcacaggccuagccucuuuuugacaacuagcucucaggggagcucuugcaagaacuacuaaugcgagcacucacucauuacuguuaggauggccauaagucauuaaugagagaucccuccccaugacauaaacaccucucacuaggccccaccuccaacauuggagaucaaauuucaacaugaguuuuggagggggucaaauauccaaccuauacaggaguuuguuuagucacuuugggaggcagaggcaggaggaucacuugagcccaagaguuuuaagaccagcuugggcaacacagggagaccuugucucuauaaauaauuuuuuuuucaauuaguuggguaugguggugcaugcuuguagucccagcuacucaggaggauugcuugaguccaggaggucaaggcugcagugagccaugaucgcgccacugcacuucagccugagugacugagugggacccugucuccaaaaaagaaaaagagccucgcugccuggcauuacacgagagugucaucccauauaucacuagauucagaaaagaccaaaauucaaagcacgguuucuauugaacacuuacugcuuuggcaccauuguaaggucaaaacauuguaaguugaaccacaguaaguugggggcuaucuguagcccauuagugcuguggggaggguggcaguggacuaucuccucuggggccuugaaggcaugguaaaugcuagccuucucuacaggguccaggggccucucucagcugccacagucuccaagucuguggggauacagcuggcacccaaggaaccggggucuugggagauaaaacuugaguagagagggauauuugaggugaccucucucucuuccacuuucccuggcuguugaucaagaagaaccaaguauugaucuguguuugacauuggcugcaauuuucuaccugcuuuaggcugucuucucaacccaauucaaagaaguaagauauaaagguaggcuuugaacaaaaaacacugucagacuuggccauucuucuccaaggguccugaucagaaacuaucaggauugaaacaccaaugucuaauucuccucagaacacaacauuccucccuuuacugcuuggauaggacagggccuccagggucaucugggaugcucuucuuucuaaaaugcagaaggaagaaugaaugacagaaugagagcaagagguggccuggggcuuuacuuuuggcaagaugaguuuagucaagagagcuccagcaaguuggaguggagaagaggggagaaggcccaucucuucugauacgcaguguauuugguguaguggacuuaugcuguuuguggauuugcauuaaauguacucaauuauguucccagccagagaaagauaggauguaaaugcagcugugauaccugcccuccaguccagcccacaugaucugcuucuccugggugucucagugccuucaucuguccaugugucugaggaucccuccacacugggagggauugaggccccuaaucacauacuagcaugucagcuuggguuuucagaaccagccaaguauuucauggguugggaaaacugacuuuaauggacuuaacugagaacugagagugauguugcugguucggacaagccuaguguguccuaaauaccauagugcaugggcaauuagaggaauucuccacgguaaauugaacuauaguugaacacaucuuaguauugacuuuagaaacuaagagcaaccaugacuccuuuguacaaauuaacccuaucucuccucagacuccccuggcaagcucaucuauacuaaaagaaacuuccccucccuccgcacucccaccccccuuccuucucucucucccuauccuccugguguguucucucucucucccucucccucucccucccuccugcccccccccccgcccccgcaaauucuagcucuaagugauuuagaugcuuauguagccuaagagggaaguauuaaacagcugaauuacuuaaccucucuuaaaaguuuguuuccucauucuuauuaaaacgauaaucauugccaaauagggcuguugugagcugaagaagauaguucauguggagcucccaggaaugucuggcagcuggaaagugcucucaugugggagccauugaccccacucuucacucuuuccacuggaggacuggaagcccaggaaggugccggucgcuaaccaccucugguccucuacccuccuaaggcucagagcauucuugacgagcucagagcaacccuagagugaggccuggggugagcuggaguggagccaagaauaugcaucucuagggagccaagugccaaaguauuggaugggagacugagaggugccuugugaagaugugaucuuaagagagcuguagugcugggucucagggccucugccagucuguauagggccucuguauacaacucuacggcaguccugggagcuucuguauuuuggggguagucuugaggacuugaugaaaacuguggcccuguucccuagaaaaaugaacaaaauucugcauugcuuugagaggaauaaggccuuucccacuuuggguuguagguuggagaacccuuucucuggaagugcgugggcaguaaguguuacagagucccacucuuggcagaugucuuuccuaagguugcugacagcagcuguacagccugauuucucuauuuucaugagaaccauugagcuugucucuguagcucucaggauaaaggcagaacucuuccuagaaguuuaaaagacaaggucugaccccugcugacuuggucauccuccacaccuauauauaucaucucucuucugcaugugggcccucuucccagccucuucacacuuaccaggcuccuuccuaccccagggccuuugcacaugcucuucccccugcccagaacacucuuccuuccccuguucauuuucuuaaggaaaccuucccuuaccaggucagucucuccuguuggaggccuccauugugcuggccaccuugcccuccuaccuuuaucacuguuacaauuuuguguucauuuggugacuaaugaccaccuuucucuucugcuuucugagggcagaaagugggucugucuuguucacugcuguauucucagugccuugcacacaguagagcccacagugaacgagcagcucaccucugcagaggugggagaugugacaucugugcaggaggcucuuugguuucccaucuucauuucuucugauccccagugcccucuucacauguuugcaugccuaacucucccuccucucucccuggagguguguugaggcuccuggaacacggggaggaguacguauucacccugccuagugccuacgcccgguccauucucaccaucccguggguggagcucggaggaaaagucagcaucaacugugccaagacuggguacucagcgacagugauauuccacacgaagccuuucuauggagggaaaguccacagguaggagcuggccggagagacucuggcuuugucuuaacaagaugcccugaguuuccuuucaccauuagaagacugaguuucaguaaugggaugaguugaaaaucaagauaaacuuguuaaggucuuuuccaaaagagaugccuuuucccuaccuuacauggcaguuuuuuggaguccuccccacccuaaacuuaagguuaaaucuucggugaugcauuugcagagcacacgccagaaaauaaaagcacuucuguuuguuggaauaaacucucccuucugaagccacaguuuguugcuuugcucuaaagugauugaaucuaugaacccagacauagccagacaguuccccauuucacauuagcuggcuacacuauccucaauucugugucaugcauccaugaggucaagaucauuuccuucuuuugaaaaacuggggaagcccaagccuaaguaauugaaggagaggucugcucuuugaggaagcacaaaauuguuuuuauugcugcagcuauaaaaaauauuccucuuuuagcacagcucuacuguguaagcaagauauacuguacaaacaaacuuccaucuuugcccuuuuucuuggaaagcauuauucugcauggcauuagugugaguguaucagagugucacaggggcacguggacacccuuggggacaccuggagccagcacacaccagcucguaagaacugauuuguguguacuucacguucagugcuaucauguugguaguugaaaucagccaugaugggcaccacagaaauuggcaaaugguacagaucaggugucuucccuuuuagagauccaguuguuaaauauuuaccagaaugccacuaauaucuuuccacugugugcaauccagaagaugccucauaccugccugugagccucugcauugcuaccuaagaacugugacuguuuuuaggcucaaggagaaagccucccagucuguuugaaaacucuaaauucagccugagcugggccuuaaggaaaaggggaguuuagauccuacacauggcugcuuuggggcaggcauccccguuccugugguguuccuucaacugugcagaaagcucagugguggagagggagcugggagucugcuuucacuuggaauucccacaggugaggcaggugaaagagaggucgcaaaucuccacaaaggcccuuuaaaugagagguugaagucauuccucagagccacuacugugaguaggaagcuauugauugagacugagacucuagguuuugcucagccuucauucaggggauguguggaugcuggaguggauguuucccuccuuuuccaacauaagcucuguugggauugugggcaaccauguuugaccccauacaaaauagaccugauuuaaggauugaaaagcucacccuacacucuuacacacuuuuuaggguuaaaauguagcauuauuagauacuauuuuggagaagacagaguauaugcuauuuuguuuuccuuuuuuuuuaauuaauuuuuugcauaaguuauugggguacaggugguauuugcuuacaugaguaaguucuuuagucgugauuugugagauuuuggugcacccaucacccgagcuauagguacugccccauauuuguaguguuuuaauucucguccccuucccacuuauuuuuucuugaauugccugauuuucaucccagugauaucuguuuaucacaauugagaaauuaacauugcuguauuacuaugaacuaaucuauagacuuuauucagauuucacuauuauuuccagugaugcuuucuuuugcuguucaaggauauuagaucaucuuuuaagagcuagucuuugagcaaagcugcaaaaacaaucccuccuucccauuucugauuaaaaaaaaaaaucucuagagauggguguaccuuugaagucucuguuuuuaucauuuugaaaaguguguacucauuugacucauuaauucaggguuaccgcagaagugaagcacaacccaaccaacaccauuguuuguaaagcccauggggaauggaaugguacuuuagaguucaccuacaacaauggagaaaccaaagucaucgacacaaccacacugccaguguaucccaagaagaucagaccucuugagaagcagggacccauggaguccaggugagaaccgggcugugucuuccucuccagcuuagucaugcugggcaccugacucaagggacagagaagaaagaagacuuugaaacuuagcgacuggaaacaggccaggaaucauguucuacuggcuucuuuagauauuuuaauuuucuacugugugucacuuaggagcagaaccuuucagcuuucaguuacgucauucuguagucaugggguggggugugaggacagacuucacugcuugucuuacaaaaguuugucaacucaucugaucuguugcuuaauugcaaagguaaauaccgagaguugauaguaaucaaagaacugcacagugagucaauaagauacuauuuuuuucuugccagauuagcaauauuauuaaaaaaauuaaaugcugggaaagguguaguaaaauugacacucuauacccuguccuucuaguaggagugugugcaguuuagcugcauggaucaguagcuuucaauucaugaauccauuuuaaucuugcauucuacuucuaagaaucuguucucagggcaaacucuuaaauucagaaaaaauuuaaacaacauaaaaugguuuauucuuuuuuuaaagaaaacuaagcaacaaaagaaagaaaucaccugucuaauauuuggaaaaugguuaaguaaauuacgaaguauccauucaguuuguauaucuaugcugugacuaugguaugaauauaaugcagccacuuaaugugauguuuaugcaggcacagaagcagaaucuccuuggaauaugccaguuuuauuuuuuaauguaggacaucagcaaacuauggccugugggccaaauccaaccugaggcugauuuuguaaauaaaguuuuauuggaacacagccaugaucauucauuuacauauggcuuauggcugccuuccugcuacaauggcugaguuagguaguugcaaccaagaccauauggccugcaaagccuaaaauguuuacuuucuggcccuuuacagaaaauuuuugccaacugcugcucuaaucuaagagcauacacucuuuagaaauacgaugcaggguuaaaaugaaauuacaaaugauuuuaugaaagcuuuacuauuacuacaagaguuuguaaccaaauagaaacaguucuuguaaguggaaacaaagcagggauaccacaguauguauaaauaauacauuauauuaauaacuggguuuaauggaaacagagcuucaguaucccuggaaccuuugcuuugcuguagaauuaguacacucuugcuuguuaaucaguuuauuugaggacagugagcauaaccuuucucugugucuaacuggagagcuuggacucuuaccaguugucuuuuucaguccauccuguugggcagcaguagcaggacaagggaaaggcugcgauaaggaaggaaacccauccccuugcccacacugccucugaugaagcauucccagaauggggaaaccugugguucauaucaugacaugacuguuguuucugauccagcuauugagaacaaaacugugaucaccugcuacuuuucuuccaaggauaucagaguaguuuagcuacuccuuauuaagacucuuuguugcuuguuagccuaugggaaugcagaauucagcuuagagcagggauggagucuggugccagaguaagagagaaggugcuaccucuuuuugucuguuuauguggauuuuacugaaauagggaacaagcuacaguagcccccuuuaucugugauuuugcuuucuuuaguuucuguuaccugcagucagccaccaccugaaaauauuacaguauuuucagagagagaauacauucacauaacuuuuauuaugguauauuguuauaauuguucuauuuuauuaaucucuuacuaugccuaauuauaaauuaaaugacaucguagguauguaauguauaggaagaaacauaguauauauagguuugguacuaucuguggcuuugggcaucugcuggggggucuccaaauguauccuccauagguaaagggggacugcuguauagggauacugagcccacccauccuuguucucugcagaggaaacggccuugaggaguggaguggcugguuccagucuccguggcugcucagagcaccuguguucacucucccagccgggugugcuaggccuucccugcagaggcaaaggagggaccaucagcauggcuagguggaccagcaguuagaacaguugucuuagcucucacaguggugccagcccuuggugaggccuccaguccccaacuagaauuccuggaagggaacuccagucccauuagugguagaaugaagauaauucuguggucuucggucuucccauaccuguaagucugcucacaaggcccagagcuuggucugagcagaaacucugccuuggccagagcccucaggggcccaaugacuuaaggcagagccagcacccagggaugccaguccugcccugccucagccacuugcucgaccucugccauggugcccuccccuccucagagcaagcuuaccucagcuuccuuuggcuuuucuuacugaauugcugccaucucuccccacccuggagacuccuuuuucuuuuagcaugguguucagagccuccuccacuccauucuccucccugcucucaagugacucuccugguugggucccuauucauguugggcagagaucuuugucugugguucuggucccaucacccugucucugguuuugggcgcucugcccucuacucuuggggccacugucuuaagaugggacuuaccaugggagguucugcccuucagaggacccccugaccccagcuguccuggugcccagccccacccucagcguaagguguguguugaggcugugugaugagaauuacugugauuuuacccaacacccaccccucauuuucuucccucacccagccuuacuguuugggcgagucuuuccucuuaaaucaguuaugaggguacaguggaaagaggagggacugagagaccaaucagaucuggcuuaucucucagugccagcaguuuucuugugugugugcagcugggguuucuucuguuggcaucuguacccccaggaggugcugcuggcugucccuaguucacuggcagccccaucugucuguccucugccugaccaugccagcacucaagccuuccugcugcucugagcccuugcuggggaaaggguuaaggacacccgcuguagauaugcuccccggcccaggaccuaaagaugggcauucacuugccccugggugaaggggccucauuuucuagaagccagggagggaaucuccaccaccuggcauucggacaguuccuugucugugaaauccgaccuucugaugcauuuaagugaggaagugcuuggguggugguguccugauuuaucauggguccuuuccuuucucucuagaacagagugugucugaauacaggcuggucccaaggacauccugaggaggaaagcuguguguuaaacauaagccaaauacaaacuaguguuaaacacuagcuucuuuccuuuucucuugucccacugucaaagugcuuuuuuuuuccaaguagucagccuugauugacguaaaccaaccaagcuccccuuuuauuuugcucauuucaugggguuuccuccugccaugccaggguaggaaggucaaggucaucugaguguccaaagagcagcugggcugaagagggguagugagcugaacagccuggccucacuaccuuuaggcugcguucuacaaugaauucaugaagcagagaaauggcuuuguguagacauggggggagaugagagaucccgcacuauaagcaugcacacacaaauacccacacaucacacaugcaucagccucuaaccccuaauuccagguucccuugugggaaagcaggucuuguucugauuuaccagugugguguccuugggcaagucaccuaaccuuauguggaccuuaaauuuucuccucuguaaaauggagauaagaaucuaccgucuauaauauaucauuggguugcugugaggauuaaagagguuuauguauguaaaaugcuuagaaauauggcaaaugccauaugugccugcuaccguuguuuguaguaguagcagaaugccaacuacuacuauuagauuugauucccagaaucuccgggcccugagaaaggcaugcugccugguacaagcggagaguagaaacaacacagagguggagcuggguagcccuggguucaaaucuaggcucucggggucuuugagguaucugggaugagcuaccccagagggggcuugccuggcggccccucgcugcucuggcugcuccuggcagaguuccguuagcuugcagccagcuggccuggcugauuguuuccucuccuccacgcauccccaggaaccucuggcgggaggugacccgauaccugcggcugggggacauugacgcagccaccgagcagaagcggcaccuggaggagaagcaacggguggaggaacggaagcgcgagaaccuccgcacaccauggaagcccaaauauuuuauccaggagguaacucugccgccugucauuggucccuugcccaggagagaacuuguccugagaggguagauggguuuuucuugcugagcccccaagacuggauaaauaccaggcaggggaagggauggacuagggcagcucgguucugacuccagcuuuggacaaggcuucaggacagguuuucugccacaauauucaugaaaccuucuggagggcagaacugagcaacugacacuuccccuccaguaucccuaugucagaaaagcaugucagccugccugugagggaucgcgaugggacugcagacuggauacuguucuauuuuuaaaaagaaaaucaucauggcaccuguuagaucaucuuuaguaacaaauuaguugaggagugccucacaggccaucucaacaccugggugggcuggagcccucacugaugaagaauugccuuucagagcuuugccuccugugggccacaagggcuagucaugcaggggaaggccagccugaguccugugccuaaaaugcuguugcugucaccugcaaaugugacacuagaagcuagaaauaauaucugggcaagugggcagggcacugugugcccagcugaagcccuuaugcucuugaaguuguggagggauugggaagcacucugagaacagaauuggaaauuaugaaaauguaggagccacacgucuuaaagcaggcccacaggaacccagcaacaucaaugaagagcaggccggugagggcuggggcagaugccacucaucuuccagugauaaaacagauugucuaguuguucaugaggagccagaaaucuaaauuuuuaugagaaaucucauauuugcauggucaaagauuuaaaaaaauuuaaauaccaguaggcaaucaaaauguaucugugggcuuuccuuagcccaggugcugguaaccccugacuucugcuacaaagagggauuauucugucuauauacgaggcugagaagugaguuagggcaacauaguagguaacugggguggauucaugguuaagagcaggaagagcaggaagccaccacuguucuccccagagucaggcuguggacugaaggagauuucaagguuggauucugguucagacaggaaagcugccuggagaagacuuugccuuuaugggucacugaguggggacccugugugggagcccugcccaggugagguaaaaccuugaaagauccuucugugagguuagcucccuuuucucuugagggagcuaguagcuugagagagcuaguuugucuggcuucuguggaaggcugugcauuaaacagcaacaacaacaagaaaaaacauuuacaguucuuccugaguuuaagaaaagccaguaugcccauaacagaagggcugggaacauguaaggaauaagagucaucugaacaccagcacaguuauucaguauagugccuucuagucauaacuagaugguauuaauaccauuuuaauucuugccuuuuucucacuugauauuugauugaugguguuucuugugugugcugauuuguuugugacuacugccugcuggagagagccuuuguuggguguuccccugugggcuggaagucacugguaugcacacccuugccuuuucuuuccccuggccauucaucuagcuacucuccuuuucucuugucccacugucaaagugcuucuuuuuuuuggccaaguaaucagucucgauggaagccaaccaagcuccccuuuuauuuugcucauuucuugggguuuccuccugccaugccaggguaggaaggucaaggucaucuagaucuccaaagagcagcugggcugaggagggguacugaggccagcagccuggccugcgugugagguauuaagacacggcagacacacagaguggcugcgguuauccuugcuuccccuuuucccuguugagaggucuccauguaauaaugccuccuuucuucucuugcagggcgauggcuggguauacuucaauccccucuggaaagcacacugaugggguggaggugcagagcuuuccaguauagcccuguuuuuguaggaauauuaaaguaguagaguaucaggguuuuguuggcauucacugagaccuuguauuagcauccaagaaaugaugagagagagagaaauuauauacuaugaaaagugcacccccacacucugcuagaggaaugaauuuauucaagagccauucggggcacguguguguacacaccguauacguucacacacaugcacuauguaaacaucugaguaugauuacacauuuaaauacugcacucaccaagguuaaaguggguaaucauaagcuccuuuuuaucaaugaaguuugaaguuuuucuauuuuucacuuugccaaaaauguuuuacacucacaaagauauucucacuuagucaacuccugucaaaaugaaggugaacuggcauggcccgaucacuguccauaagggagaaaguggcucauuccugguagaaguaugggugguuaucauuucaaaauuauugugauucucaccucccuccccaccucaguguuuugucuguccgcgcccaagaaagauaagcaaguauuuccugcuggauggggguuggcaggaagcuguuaaagauuuaugccagagccuugcaggauggagcaccucugggacaacuaagagccaaggcccaccaaggaguuuuccacccgucucucauggucacagcgcuagucauucauuuuugagaaguugcuucuuuuacaucagaaaaccagucaaucauauggagacuucuuuugugaugaaaaagggcuuuagaaguuaaauacaugcaugcacaugaaaacaugcacaaccacagccucaaucuuguauuuaguuuggggaaagagaagagaauuuccuguggauuauuuuuuccucaagugcaccucucugguuaacccaaacucugcaagaaagcacugugacuaaaacauacauaacgccugcauaaauauuccaugguuucaguuaaauuucaguuuuuagccuuuacacaugaggucaaaggagugacgaaaauacaaagcaaggaaaaaaugaaauaucugguuuuugcugaaugcuuaauuuauuuuuuacugugccacuccaauauuuaucaaauccaaauagcaugaaugcuucucuguaguaauacuaauuuugugccuuuugucugcuuucuuaagaccaguuguucacacuuuguagauauuagacaaauauauuucgauugaauaca

SEQ ID NO: 192107 - RNA, 367469 nt, Homo sapiens
uucauccaucaucuguguagaagcagggugacaugucugcuauauaaaggugauacagagcagacuucuugcuagggaucagguuuuccauccaaauucuuguugggaaucuuccaaugaaaaguacauaugaaaaaacacuuacaguucuuuagcacacauuagcaugugacuccacacuugaucgaggcgauaaagaugugaaaugucuucggggucuugccacacccacaguuuauaugcaccacugccagccugguggauucauuacaugagguuucuucaacuuauuucaucugucuuuuuaaacagcaaguuccaaaguacgguaagauuuucauccuuuaaaauuuguauucauggacauguacuuccaagauuuuaggccagauaucagugcuugagugaauuauauaacuauuuaauagaaauaauaaaacaucgauacaaauauaaaagacauaaucaguauaaaaggcuuauauuuauaaaaauacuuuagguaacaguuuuccccugaggguugaccaugcguguugcauccauaaauauugcucggcucuguagcucacucuccaaaguucagaguucaucuuuaaaggaaguggugcuggccccggucgugugaccuggccgaaguggcugccucaggcuggcaccugggcuugauagaaugaagaagagaacagcaucaguggggccuccgaaaaaucuggagaagauuuuuuucuuccaaauauggaagauacaaagaccaaggaugacaggcuagugaucaggucaugugacugguguggcagcucacugguuuuucuggacccagucccaacugucuucauucucuuuccgguucuucucagcuucgauaauuucuuuguaccuucggcgaaagaagcccaucugaaaggcagaaagaaagagaagcugaguuagaagugcugaagaaucagccauugugaccccaaggcagucugucccuggguaggugugaccugcacucacagggcuggggaggcuuggaggaccccucggauuagagaaaacacuggcaagaaaaacauccuguggagacauuuuucaaaaugcauggacuuccugcgggugauauuacguaagcuguuuguuccuucuaaaaugcaucugguguaguguuuuccagacugugugcuggggaauaccaguuacugagagcuguucaaagguguuugggaguaaaaaaagguuucauggcugggcgcaguggcucacgccuguaaucccagcacuuugggaggcugagacaggcagaucacuugaggucaggaguuugagagcagccuggccaacauggugaaacccugucucuacuaaaaauacaaaaauuagcugggcaugguggugugugccuguaaucccagcuacuugggaggcuggggcacgagaaucgcuugaaccugggaggcggagguugcagugagccgagaucgugccaccacugcacuccagccugggcgacagagugagacuccaucucaaaaaaaaaaaaaaaaaaaaaaaaaagguuucauggucaaauaaguuugggaaguguggcuuuuuuuuuuuuuuuuuuuuuuuuuuagagagucuuaauguacaguggaaaguaaaggauccauuaccauuaauuccgguggggaaaaaaaccagggaccugacauuccccaagcuuauuuggcuuuugauaaaccuaguaucuugagagaucuuagccaucuguggaauaauuuaauaaauacugcucucacgugagaggcuguuuaaagcgucugcaggucugcauucuaccuugcugucauuuacaucuuucucucaaacccauggaauuugugcugucugugcaccacagucagcagcacauucucacuuagaacgggcguuucauccugacccaggauggcaauuuccucuagcuuaguucugaaaagacccugcccuuugauguuacauuuggucuuacaacuuuucacauaugguaagacaagugucuaguuuuucucacauagucaucaccaccaaacagugaagcaacguuuguagcccaaagcuuaccuuuccucccaugcucugagagacucggcaucucucguccuuggcucacuaacauuggugggcucuguuuaugaggucagacauuccucucugcaucuuccuuuaaacaaggcugacuguaucggguguacaaauaccccagcucccucucuccuugggugggauaacccugagguguacguucuaccaguuuccccauggagcuugccugcagagguaaccagcuugaugacaaaucuuuuauuggcuuccuucccugcucuccaacaguuuuuccugagaucaccuuccaaauaaaugacuugcccucaaaucauuguuucaauccccuugaauagaggaaaucaaacagagacacacacuugaccuggugcugguaggcuugccacacugcagguugugguaccaugguaucaucagcuugcaauucccaagucauacuggaaaacccuuaagacucucugcagucugcugccaacagugcaugcacauauaagacguguccuacacaaaucgugaagcaaacccagcugucaugggcacaucaaauguuuuuguugucuguguauuuguccucaugcuucuucacugugagccaaacauccagggaagcaucacagccacccugauggucauaagcuccccugaagaagggaaggcagguggagcugaggagcugucuguugccaccaucuuucuacuucccuaaaggggguuuauuggccaagccaaagacgagaacugucaagagagccagcagguaucuucacccacguugccaaggagauccugagcauucaccgugaggggaagucgauaagguggugcaguuugaaugacugggaaagagcagaagcuuucuuagaacaacuggcaagagucuuguguucugagcuucaauccucaaggccaguuuuguaaacagauauugaguuccuggugauuucagcccuggagguuucuucccagcauaagaccacauucaucagaaugccauguucugacgcccccacacauauacuuuucucuccugaaaccucuucaccuucuccccucugcaagaaaaggugcuuggccagaauuuucuggauaauuaagaaaaagucauagacaucauccccacagcacacccacagaaggccagaaaaacggaccaagacugaauggaaaucuaagaagcuacugcuugaaaugucauucuuuugcgauaaagaugugguuggcuaagaaaacauggccagauguggcuggucacaugccaugaaggagaauguaaucaugaaacuguggaaggauguaacagggaaauaggauucucuagcacauaccuuuggcugcugauguuguaaugugucaauaaucccaggucacucaguuguaauuccagagaagucacauuucccuaccauggcacuaucaagcagaaacuuaacagucugcccccuuauuaucuccugcauuugucuuaggacucuuugaaggcaggcuuugugcuuucaauccccaguacucagcaucucaccuguccuugguaccagcgauaaauugcaaagaugcccacauacccuccacacccuuuaccaugugacucuccagcucuucccaucgugagguggagucuauuuucccagccuugauucuccacugagacuagcuuugacaauuggaugagagggaggagauguugugucuguuacacaguccccaaggggcugugcacacuuccaauuacuuucucagaacccugcccugcuuccacacaaaugccuaugucuaaccugcuaagagaccaguuuuuuuugaagcccucccagacuagccaacucccagcugcccgcagaggcacauguaagucucgcugagcucaaacugccccacugagcucaguccaaauagccaacccacagaacugugaccugcauagauggauauugcuuuuaagccgcugaauacuggggugguuugucaaguagcauaaguuaacugguacagacucaauauuuuuuuugcugacuuaaugaaucagacagacagcugauagggcucuagauuuaaacagcaucaguuagugugccuugcugaacuggacuuuucacuuuuuuuuuuuuuuuugagacagagucucacucugucacccaggcuggagugcaauggcgccaucucggcucacugcaaccucugccucccagguucaagugauucuccugccucagccucucgaguagcugggacugcaggcguguaccacccugcccagcuaauuuucauauuuuuaguagagacgggguuucaucuuguuggccaggcuggucucaaacuccugacaucaagugauccgccugccuuggcuucccaaagcgcugggauuacaggcgugagccaccgcgcccggccugaaccagacuucucuuguucaucucuaagagcaaaagcuggcucacuuucucaucacuaugcuaguguaaggauuugacauagacaguguguuaacaaucuggaaaggauuuagagcaccugaacucacucuuacauguggcuuucaugugcucaaguuuuuauguaugcaauucuugcuaacaacaaggugaaggcacugucaucucuugcaggcacccggaagcaagcuucuuucucucaguggaguggugucagcauuaggccugaaaaucacccccacccaccccuggcugaaacagccuugcaagcucuaugccccacucuaacacugcagggucuccaguccuguuccuaacacagccuaugcguaaucucuuggaugggagaucagagcuaccacugauguaugucuuccuuuuuuuagagucugaagaccauuucuuaaaacauaaugcacucucauggcuagggaguuguagguacaguagugcaggugcuacacugcauuuaaggggcugggggauaccacucacaucacagauaucauguauguguauaaguuuauuauaacuguuuuccaacagauggcaguagagugucuuguucucauaaaaucagaguuuucugaauuuuuucugacagauggaaguaaagagucuuuaggaagcggugcuauuuacuauuauaguuugcacaaagguacccuauagucuagugguggcucugucaaacuaauauuguuucuuuuuugggggggugggggauggagucucgcucuguugccaggcuggagugcaguggcacgaucuuggcucacugcaaccuccaccucucggguucaagcgauucuccugccucagccucccaaguagcuggaauuacaggucugcaccaccaggccuggcuaauuuuuauauuuugguagagaugggguuucaccauguuggccaggcugaucuugaacuccugaccucagaugauccgccugccuuggccucccaaagugcugggauuacaggugugagccaccgcgcccagccugggaagguuauuuucuggcuucgagccauagugucuucgucucugccuaagagaucaaugggauucucagaccucuuccagcccugaaacaucaugacagcuuuuucuguuuuccccaaagugaauucaaggcucuagacugugggccacacagcuggguacucaggacucacacuaagggggaacaaggcacagagucuuugucccaucucaauuuuucucaaagauuuuugagaaauuuuuugaaaauucaauuuucaauuuuuaaaaaucuguuaauuuuugaaagaaacaaauaaaacagaauuuaauaauauuuuaaaagauuaugaggucuuugaauucacaaaacacaugcaguuauguucacuuauuuaacuuuuauagucuuuugaacugugggauuuuaaggucaauuuuaccgaugaggaaaguaggcaaggcuugauggaguugaacaugcagcucuggaucagaugucuuauaauaagugucagaauugaggacuugcuaaguaagucuaggacucuuaacucauguaacauagagacugccugauuaccucaucaagaacagaaaaaauaucaguucucuaaaaauaaaaacucaaaauaagcaacccaugagaacaagucaccgaaaguaauuugcaagaaccagaaaaaagcauguuaucuucuaaaugcccuagaggcacaauauuauucccaacaguucucaauaaaugcaagucaauaaauaaagaacaggucuuccuagcuaacauuuucuaauagaaugucaaucaggaaugaggaagugaaaaacuaaauuuagcaagguuuuugucauccccuuaaguaaagauaaugacuucaacuaaagauaauggcuaaagauaaaauauaaaaacuaaagacuaaagauaaacacuaaacuaaagauagugacucugaauuugaugaucuaacaaguacaaauaauccccaaguuaccauaccucgacuuaacaguuuuuugacuuuaugauggguuuauugggguauuaaaugcauuucugacuuaaaauaugauaagucaaggagcaccuguaguuccuuugcuuaagagauacauggucuaaaucuguaacucuucauacacaugccaggaaacccacgagccccuucagccugcuauaguacuucauagccaguccuaccuauuccauuacugccaggacccaaagucccccuacacuugggaaauuagcacaucccaagguuaaguaggccuccuucagacauacacacccgcucaugugagcacgcaugggugccuuggggagagcuuugagaaacacugggcaaaucucuguuuuuguugccagcugagcccacccugaaggugcugggaaaugauuaaugaugggcuaagcuggaugcccagcagccccacacucacuuccaagccaauggagucaauguuuuucugcauuuuuucuggaaccuuccagugcuugcuucaccauuugaggggcaagcggcucuguuaacuguucuaucuguagcagaagaaacauagaaacccuagaggaggugacucaagccaagcuuugcuuggcuggaagccgaaggaacagugugcuuucugguuuuugugucugcugguccugcagcuccaaagagcagcucccugaacccucguaacagacauacacaauuuucucauauaaccauguauccaaaagcaaccagaaaacuccuagggaaacaacagauugccccaaacagccuuacuuagaugggugcugcgugaggcaugaggccugacugaguucugggguauccacccugcagcagcagccucuuccuccccagcccccugcagggugagagggaccagcuggacaacaccaugacaucuggucucuugggggauccuacccacuccgcggccuuuggguugcuuccuagacagugauucugaggaccugggacaaauuccuuuuuuggacuaacucaagacuucauguuuauaguucucuucaguuacuugacuauuuacauagcaugucucugucucgagaugucgacagugcaacaucagcccaauauuuacucccaagcauaaacaagcccccacugaaugucauuggcacaugguucuaauugaggcagugugaagggugugugugcaagcacaugggcaugugucuguucauuuuuuuucuuuggaggagaagcaaggaugcccucccagcccaguuugaagggaaggugauaacccagugaccucuggagggguugccaaaccuuacacauucucugagccauuucacagauuuguuuucuaaguguuucugccuuaggucagaaguaaugcucucaaauaaaaaccaugagcccaaagccaguccuaaagcagcaggcucuuggaacagccccagcugauagaggguuugaggcagcccuuuucagagggcuggcaaacacauucugcagccugucucuuugccacuugagcaaguagguccugggccuccugggaagacauggccauagggcuggccaagcagucucacuucccuuugcuccaaaccaucucgguuugcaaaagggucaaaugggagagagaggguccuugguugacagcagugagggaggauauggucucucuccuucacugagugguggccuguauguuuuggcaaacugcaaacaaacaaggacagagcuggggaggggaggagggugagagggaagcagagagaaagacagggagggaagagcuuggagcccuaaauaagggaaggggggugucuuucuucaaaaggagaaacaccccaucaucuucauucuuuccacagaaaccaggcuggcuuauauaagcugaagguauuucuuaaaggugccagucacacacaaaguuguuaucccuccugcaccucugagcaauuuaacuuucuccuccuaaacaggccuuuaugauugucuugaagagaugccaggcccaggcaucuuccaacccagucaggagcugcaggaaaggagaggggacucauuuggacuuuucuuccuuuaaaagcauuucauauuucaaaguuuucuuccugcauggugguuuggcuggcuacuguaauccucgcacauaaaguuuaaauuauggcucccagugucugcuaacaucucagcuuugggaaagcugauuaggauccauuucagaauuugaagagcggucugguuagcuuggggcccucauuguggauuuugugucagagccagggccugcugccgccaagcaugagaagaugccugagaugccagcagaugggcuuucuugaaggccgccaggagcugcacagggucagaggcagaugaggggcuggucuggcugagcacaucagcagggagccuggagcucagcucuggaaaagacacuugcugacacgauaagggcuuucugauuuagguaaacaguagcaccacagugcaugcguagguggggccaggggcugguggcacaggccaaguccugcucaccuucagggcuuugcugaagcugauuuuccuaaaggucuucaagacuaggugagggcucuguuguugaggccaggcaugguggcucacaccuguaauccuaguaguuugggaggccaagguggguggaucacuugaggccaggagcucaagacuagccuggccaauauggugaaacccugucucuacuaaaaauacaaaaauuagccaggcaugguggcgcacaccuauaauccuagcuacacaggaggcugaggcaggagaauugcuugaacccgggaggcggagguugcagugagccaagacugcaccacugcacuccagccugggugacagagugagacucugucaaaaaaaaaaaagaaacagacuaggugagggcuguuguuuauuuaucuuugucccuuugcccagggccugccaccuaguagggaccuacuacucuuugccuagugaaggugcuggccaucuugcaagcauaaagcaugcagaccuucaggcuuguguggugcugugaaugcggcggcauggccagcugcucugcucagcuuucaguaccaugucacgauucacguuuaugcaacacuuuugggaacaaccacuuuuggcuccggaccucaaggcagcagcaaaugaccauagguagcaaugccaagagcuacucuagaaggacauucaagagccacgguucuguaaagggaagaggacuucaacacuguccccgccaaccgcugucuucaaaggcccucagugaagugggcaaccggucagcaguggcagcuggguaacacucaguggcuuuccccuugaaaggaauggaggaaauuacauauggaauauggcaauaagccggaaacauuaagaccucccguauaagucaaauaugaggcuggaguuuagaccaucaauuaacaggucuuuggguuacugcaccguacugucagugugauaccgaaucacuauucacuaaacauaauguaucauucuuagguuguagacaugggaaucagaguuaacaagaggucuguaguugaaguucuagaaauacguaggucuuuaaaauaauccuacauuucaauugcccuuuuaaccucuuauaaagucuuuugagacuuuauaagucucaaaagucauaguuagccuuuugagaaaaaaaaauuuuuuucccuaaagaaauccccuccaccaagccccuuaucacauuacaacacugccucaacagacugcacacucugacauaaaugcugcaccaacauuuucuguuugccuccucuuccccaaaggaguucaacugugauuuuaucuaugacacuaugggagagagaugagguuucaucuacuuuaaaauagaacaaaacuucuaguuaggcgaauuuuuguuuguaauagugacuuuuagggaaaagacacgguggcucacaccuguaaucccagcacuuugggaggccaaggcaggcagaucgcuugaggccuggaguucgagaccagccuggccaacauggugaaaccccgucucuacaaaaaauacaaaacuuagccaggcuugguggcaggcaccuguaaucccagcuacucaggagacugagguaggagaaucucuugaacccaagagguggagguugcagugagucaagaucaugcuacugcacuccagccugagugacagagugggacugccacaaaaaaaaaaaaaaaaagaaaagauuuugcccauauuucgaacaucauguaugugacagauaaaagacagccacuaaggcuuugccacuccucucauugagaagcagggucuauuuccccucucuugaaccugagcuggcauaugacugcuuuuaccaacagaauaaaugaugcuaugccagcugugggcuagcauuuaagacaacuggcagcgcucucuuucagccuaagccaccacauaaaaagucagaccaucugcuggaagaaccacauggagaggcccugagucaacauggagaggaagaaggacuugacugaauccagccuuccagcugucccuaccaaggugccaggcaugagaaugaagcugucuugaacucugaagaccagcuuagccaccagguaaaugccacuaagugaccucacucaaugucaugugggacggaagaaucaccccgccaaacccuuccuggaucccugacccagaaauuugucagauguaaugguugugaaaagccauucaauuugggggcaguuuguaugcagcauagcuagcugguaugauacaacagccugcaauucaggcagcagcagcacuaacaacgaugaaauccugcaggagcgaacuccuuuggggugccugccuaauuguuuucuuuucugagagucuccuccccaguauccccuaaaccaccauccugcaucuuucucccccacuagccuccgugggagacauaugacccacauugggccagguggauucucucccucccaacucccuuccucccuuccacaguugaugggaguagacauuugacuagagcugggccaggcagauccucucucccagauaugugggaccaggaaucagagguggcugaucauucugcgucuguggcuaguaguccuugagaugcaaguuuggaggggcuggaggcaacuaucucccuacgauguguagggaaacauagagaaagcuggucugcggugggaagagaaugaugcggauguguagccaaguagagagaaggggcuuccuucuguugaccuuccuucugcugggugggggcgacagggagugaggcaagcccagccuugucuccuagccuccucuaagcaccacucacucagaaagcccaacaccaagcuccuccucuugccaaacuaauucgcaucuugccuuccccacccugauuaagggcacccauccuuugucugaacuuaucuuaaggagagacagcuauucuuuuuuucucccugaccucucaaguccaacuggucagcaaacccugccuguccuaccuugacccauggcaauggcccuacucuugcccccacacugucccuagaucucucuuuccuuuuagagacagggucuugcucuaccaccuggugcagugguaugaucauagcucacugcaacuucaaauucuuaggcucaaguaaaccucuggccuuggccucccaaagcacugggauuacaggcaugagccacugcacccagccccagaucucucucucgacacagaucuggucaugccaccgcucugcucacagaccucccaugcucccccuuuguccugguuagcaguggccuucacaacuguggcagacggucuugcugcaggucagugacugcccugacaaacuuuacaagcugcucuccacaaacccugcuuauuuucccaccucuuccuucccucuggauggaaucuucaucuacccuucccugccuggaaaacucaaaccacacuaaaggucagacucgaaugacaccucauuuaugaaauauccccuggcuucugugugcuaagcgcagugcuaaacauuuuccuugcauaaccucuacauaccaaacuggaggugauggucuccuuuuuacagaggaagaaacugagggucacagaagguaagcagcccccuuaaggccucaugucaggcaagugugagagucaggauugcugcccacagcugucagccugaaagcugcucucaucuaccacacuguucucugugaccuuuuaauccucccuccuccuugggggcaagggagggggacucauggcaccuucuucucaguuuccagagcaguuacugcgcagcacucaccacccuccauuaugccugcaggucuauugcuagguggugaggcggucaagugcagggaagggcacaguuauugcugcaucccagugccuaguccaggcaaagcaaggacuggggcaaaguaagcguucgagaaaugugagccgaaaugagauacugcucuggguugacuagcaaagcuguugugacccagguggccucauucaacagccuccucaaagcuuuccugccacccguuaguuacggcaagcccuggucugggcacacggugugucccuggcggccgugacugcccucucccucccagucuguggcagagggcagagucugccuucucagguccuggcucuuuggaucccacacagcugggugaccucaggguucuccccacccaugacagcaucuccugcaaccaugcuuuuuuaaacaaacacagcaaaagcaaggcaaagcagguggugggcuggaggaggcaggggcugugcagaggagacaggacaccccugagaggcagagccagguggggcggccagaaggagggcaugcagacuauaaggggaaguggggcacggccacaacacuccccacucugugcccugucugguuccacacacccagccauaaaggacacagcuccucucauuuuaagagcccauauaaaggcagaaggaagucacauacacacacacacacgcgcacgcacacacacacacacccacacacacucaugcaccaaagcccucaacucagcaagaagccuugucuuuucagaugccaaacacugagcaggcuuuguucuccacccacaaaccagaggcugucucagcaggaaggaguuggaguuggagaaaaaggagaauuaagaaucuaucuggcgauguggauuaaauaaacaacaaauuggcagauuguuuuuaaaagguaacauccacuauuggcaaacagacauuucugauacacugcuugugggagggugaauugguaugaccuuucuacagggcaaucugcaauaguaauaaaaggcuuaggccgggcgggguggcucacaccuguaaucccagcacuuugggaggcuaaggcgggaggaucaccugaggucaagaguucaagaccacccuggccaacauggcaaaaccuggucucuacuaaaaauacaaaaaaaaaaaaaaaauagcugguuguggugacagacgccuguaaucccaacuauucaggaggcugaggcaggagacuugcuugaacccgggagggggagguugcagugagcugagaucacuccacuguacuccagccugggagacaagagcaaaacuccaucucaaaauaaaaaaauaaauauaauuuuuaaaaagcuuaaaauauacacuccuuuugauggcaauucuauuucuaggcuuucaaccuaacgacauaaugaaagauuugugcaaauauuuggcuccagggauauuuaauguggcacuguuaaaagaagugugaaacagaagcaaccuaaauuccaguaucaggggacuggaugaguagacugcagacacucuacagcuuuaagaugugcuggaaacgugcuuugaacaauauggaaagauguucacaguacugucuucagggaaaaauagguauacguuuuucccagauuaauaaaucaaauccaggccaggugcguugguucacaccuauaaucccagcacuuugggaggcugaggugggaggauagcuggaggccaggaguucaggaccaguaugagaaacauagugagacccuauguuuacaaaaaaauaaaaaaaugagccaggcauugugcaugccuguagucccagcuacuugggaggcugaggcaggaaaacagcuugagcccaggaguuagagcuaugauugugccacugccuuccagccugggugacagaacaagaccccauacuuaaaaaaaaaaaggaacccacugcuuuuaaauuuagagguacuucaccugaaaauaugcugaguauauuacuguaaaauuuaacuaauacacuauucaaaaauaaguugauguuaugagaaugccuggucuauaucuauauaugcagagaaaaaggucaaaaugaggcaauacuaugcucaucaugguuauuucugggaugugaacuccugguguuuuacaacuuuuuuugguaauugauauguuauguuaggucaauacauacauauuauuuuguaaucccaaagaaauuaguugucuuauuuuaaaauauccaucuauaauacucuaagaggcuguuuucaccuacaucugaaauuuguaauucuagagaaguauggacuuuggugucaggaaguugcaguuauggucccuggugcuguuuuggagcuggggacacaguggaaacaaggaagagacagaccuucaucagcuaaagccuccaauaccauuacugaugaauagagaggcucugaaggaaaaggacuccgggucucugaaaggagagugugaggcaaacaaaucauccuagacauggggaugaggacaccccuuucuccuugagagagugaugcuugaggcaggacaggucugcacccugggccaccuccaaaugaaccaccaugagguugggagaaguuaugaugaagcuacucuggacuguagcccaucucaguuacucaaguuuucuggucagaaaucuuccucacauuccuuagaggaaaagaaggaagaauuguucuauaguucgccuucugaucuuuuuuaagcaaaugggaaaucgcccccuucuggcaguugcuccccagacuucuguuuuggaguuagguucucaccauccuauguuagggcucuaagggaagguaagagaagagagaacugagacuuuugccuucacucugaagugguccaaauccucaguugugaauggccucaaggggagccaagauuccacucccugccugaagggucacuguccuucacuguaccggugccaugaaggaagcucuaacaggauacuccuucuucccuggaaaggcaggagagcugggcaucuaugaguggggaccccagggggaccugcaaucaccagacucaccuuccagagcagcacggccagcagcaggaagaugaggauucccaccaacaaacugauggcgaugauccaccccacgacguagccacggggcuccagauugugcagggccucgaagaccaccuaggaggcaacgcaacagugaaaacauuuccuuuuuuauuuuuuuuuugagacagagucuuguucugucacccaggcuggagugcaauggcacaaucucggcucacugcaaccucuaccuccuggguucaagcgauucuccugccuuagccucccaaguagcugggauuacaggugccuggcuaauguuuuguauuuuuaguagagacaggguuucaccauguuggcuaggcuggucucgaacuccugaccucaggugauccacccaccucggccucccaaaguuuugggauuacaggcacgagccacagugccagcugaaaacguuuccuaaacagaagugcgcagagcaugauggagcccagccugggcuugacauuuggagagaacuacagagaaguauccagacuguuguuacuaauaaauaaauacauaagcuccgcugaacgauuuucugguugcaaacugauggauuuuucacuggcaccugaaaaggcacuugaaauccaagcccuaggucuugaaaggguuguaaugacaacaacccugauuuaaauaucaugaagugaacaaaaguguacugaaaaacuuagaggacacacuauguucuugauucagaacagauaacgacaauguaccuuuuguuucagcuuugaaacaaagaacacgggagugcucugcauguaaggcagcucuucuuuccaaguguucagcucaaugugucacuuagaggaauuauuugauuaaugccaguuuccccaguagacuguggaccccacuagaguuaggacacagucugucuugggucucaugguagggccuagcacauuggagaaacucguucgagaggcuguacuguaguuucccaugggagccacagcaauuggagcccauguuccaaugaggcaaguuuucccaacuuuuccugaaacccagugguauguggaacuggcucauaucagcucaugagaggcaacugugcaucucuuccuaacuccguaccuagugacauugcaauggcaguuugaaaugggcuauggugggaguauuuggcaaacaaaucagggcaccccuacccuccugccagagaacugauuguuaaacauguaucagugcucacuucugauuguccccuucggcucugcuuuauccccacuggucacaggggaguuugguuuugcagaauucaaagcaucuauugcgucuucugcuaccaaauaacucuccccaauacaccacugucccauuuaagcuccucacugcaaaagacaaaaaaaucacagcucugggcagucauucucuccuuuggcuccagacaggcuggccaaccacaggucuuucuccaagcuuugccaucucuuuggaauguccauuccccuuugggaaagucuuuucuaaaccuaguucaauccucugucaagaagccucacugaucgcugaagcccacugguccagccccuugcucaagcccaagcagugacugggcacaauacugauguuauaaugccuagcacugcuuauuuaaccuuuuuagggccuggcuuccaucccucucuaacacuuauugaauauugucugugucaguuuaugcuuuuuuuugcaaucucuugucuaagucauacaacagcccuaugaggucuuccacacccauuuuacagaggggaacauggagguccagagaggauauuugcucuggauuguguaguucaaaugcacagucacgauuugaacccagcucuuagccaaccccaaacccccaaaucugagcuugucaucaccacacugcagugccugguugacaguggccuucuuuauaggcuaccugucaacugaaugaauuacuuacuggcucuucccuggugauaaggaaagaaaaugagaccaccucuacuucauugccuccauucccgcagcugggguaggagagugugugcgugugccaggggaugaggcaaauggacacacaggccaccacaguuucugagccucaguuuucucauccgcaagacaggagcagaacagugccuucccagaaauugaaaagggguaaugcacacagaguccccagcauagcaucuggcacagaguccgcccuugacaaauggaguguuccuguuagcaucauuguagggaguuuuuuuugagguugugcauggcuggcuacuuuuuaguuuuuauuuuauuuuuugagacagaguuucucucugucacccagguggagugcaguggugcaaucucagcucacugcaaccucugcauccuggguucaagcaauucuugugccucagcucccaaagugcuggcauuauaggcaugagccaccacucccagcucuuuuuacuuuuuaaaaauuacuuauugaagucgaauauacauagagaaaaguauagguauccuaaguguauagcucgcugaauuuucacauaccaaaugcuaaaugcauguguguaaccagcacucagaucaagaaacagaaggugaccggcucccuagaagcucccuucccccuuccuuccaguccccacccccaccaaggaugucuaacagcuuggauuagcaucaccugcuucuuuggguccuugcuaugaauggaaugaugauguaugaacuacaguaccugguuucauuucuuuucucuuuucuuuucuuucuuuuuuugagacggagucuugcuccguugcucaggcugcagugcgguggggcaaucucaacucacugcaaccucugccuccuggguucaagcaauucuccugucugagccucccaagaagcugggauuacaggcgcaugccaccacacucggcugauuuuuguauuuuucauagagacaggguuucaccauguuggccuggcuggucucgaacuccuggccucgaacuccuggccucaggugauccaccugcuucagccucccaaagugcugggauuacaggcaugcaucugguuucuuucucucacuguuauguuugggaaauugcuccaggcuguggcauguccacucucacugcuguacaguauuccucuguguggacauaccacuguuuauuuauucaugcuauuauugauaggcauggagauuauuuccagcuugggguuauuaaaaagagcaauuuucagauaauaggcaauucucagggaagaacauuuacugguaggaggugguaggacagagugggcucugaagucugucauccuaaauccacuauuuucuaucuaguucaaaugagcagcucucaucuuuaaaggcagacagacucaugucuuuggguuccugcccuuaaaaagcuguggaucaaaucacuuccugcauuuggaaucucucauggugucuuguacagaugaacugugaggaacuguuaggaaagauggagagggaggagcgcuggcuuuaaucugguccuggugcaaccguaggcaaccaacuuucucuuccucugugaaauggcggucugauagggaaauguggcaguucugugaaagcaccugggugugagaaaagucugcuaaaccuuauuguugacuaugaaucagacugagacacugagcucagcgggguuagcuguaaaacccagcccccugugcuaacccagauggcuucuuagggacacugaaaucugcauaccagcaacgccacguuggaggucugguuuuguggacacagagguuaaaguagcagcuacaguuuagucugucaaguuccacaagaaugcccugucacuuccccggaaugugggcuucaucucuuauuauuuuuagggaugcuguucauccccuuggaugcgugcuccaugcuuuggcagagccuguucucucacaucacaacucucaaacucaucugugagugaugagcugaguguccuguagcucuaggaagucauaucuuagauuaaaaaacaaaacucuaaggaaggaacagcagcauggacgacauggagaggcaagaagcacugaugaucaggucccgucaucaccaccaaugagcugggugauccuugguuaagccccuacaccuuucuaaacaacuuuucucuccauccucuuguuuccaucccagguaccuccuggcucacaucucgucuucucucaccagcacuauuucaggaggcuuggaaaggccuccuugcugauagaguuguuuuucuaaggcacaggucucaucaugucacuucucgguuuacaguauccaugacuuuccuuuaggcugagcaucuaauucaggacaccagggccuucauacucuggucuccuuccugccuuuccagcugcucccaggacacauauuuacauucuagccaguuagaggccucuccucugugagaccggugguccccagccucucugcaggcugcucuugccuccugaaaugcccuuccauccuuguccauuugacaagcucauuauugcucaucugaaaauguucauacuugaccagucuggccaacauggugaaaccucgugucuacuaaaaauacaaaaaucagccaggugugaugguguaugucuguagucccagcuacuugggaggcugaggcaggagaaucacuugagcccgggagguggaggcugcagugagucaagguggcaccacugcauuccagccugggugaaagagcaagacucugucuuaaaaaaauaaaaaauuaaaaaauaaaauaaaaauguucauacccuuugauccauuaauucaguacuugaaaacuuacucaaaggaaauaaauauaaaauacggaaaaaguuuuaugcucaaagauguucacugcagaauuauuuauauugguacuaaauuagcaauauccuaagugucuaacauuagggcaauagauaaguaaacuauggucaaucacaaaauagaauaccacagaacuauuaaaaaugaugacagaaagcugguugucaaagcauaauuuucaaaaaguuaaaaacaugauucucauacaaauauauagugaauacguggcaaagauuuauuuaauuuauuauugaggaagucagcaggguggcaaagcuaguuuuaaaaagaccagaaaaaaauguguagucacaggaaaaaaauuacugaaaucagauuacuaaaucaaauacaaaacuggcuaauacccuacaaggcaauaaauucuaaccuuugggauauuuucagucaaacagaaaucauuuuuaucuuuacuggcaagagucauuuauaacuuaucagccuuccguaaguuaauagguaacuuuacagaauuugggaccuccaccagugcuucucaaauuuuacuguguauaagaaucacaugaggaacucuauuaaaaugcagauucugaauuagagucuagaauggggccugagagccuagauuucaaauaaucucccccaugaugcugaugcugcuggucuguggaccacacuuugaguagaaaggggcgaggggaugcuccaguaugacacugaaaggauauguaaucaucuuuuugccugauuuccaaauuuuagauacuuuugaaaacauaguaauaaugugggaaaaugauguuuauuaugcuaaguuaaaaaaucagaagaugcuggcucaugccuauaaucccagcacucugggaggccagggugggaggguugcuugagccuaggaguucaagaugagccuggguaacauagugagaccuugucucuacaaaaacacagaaauuagcugggcaugguggcaugcaacugucgucccagcuauuuggggagcugaggcaggaggaucauuugagcaugggauaucgaggcugaagugagcuguaacugugccacugcgcuccagccugggugacagagcaagaccccguccaaaauaaaauaaaauaaaauaaauagguuggguaugguggaucacaccuguaauuccagcacuuugggagaccaaggcggguggaucaacuugaggccaggagcucaagccagccuggccaacauggcgaaaccccgucucuacaaaaauuagccaggugugguggcgcacaccuguaaucacuugaaucuaggaugugaaggcugcagugaccugagauugugccacugcacuccagccugagcgacacagugagucucaaaaaaauaaaauaaaaaauaaaaaauaaaaagauuaucuaauacguagaagacuucagcuuugcagcaauacaguaggaacccuuuaaaguaaacagguguuuuuuugauauuaugaauauuauuucucuuuucuacguuuuacuauuuuuuaaauugagcauuuuaaaggcaaguaaaaccauuuuauuuuuuuaaaggagagacucugcuccaauaucugcuuucccaagaagccugccuuacuccuguuuucagcagaauuaaucauucucugagcucuuggaaacauagugauuuucaaccuccuauagcaucccaguguauacaauggagcuucuuaggugggcagcuagaacccagacuacucagcccccauuuguuuuuauuuuuuggagacagggucucacucuguugcuuagacuggagugaagugguacaaucuuggcuuacuauagccucaaccuauacuauagccucaaucacuugaggugggcucaagugauucucccaccucagccucccaaguagcugggacuacaggcaaacaccaccacagccaacuaauuauuauuauuauuauuuguagagauaggauuuugccauguugcccaggcuggucuugaacuucugggcugaaguuaucugcaugccucagccucccaaaguucugcaggugagccacugcaccugacccagccccucuuucuaagcccuguuccucccuaaccugaccucagcugcacugaacaaacucaagggaacccauggcuccaacaaaacagaguuuuaaaaccacagcuguauacuucagagucccaguucuagguccuucucacucuuuaagguaaugauaaaucuuccugucuacggacuccaguaaacugugauuuguauacaauaaagacaugaaugcaugcauuccugucaccugaaccaaggcacugauucauuauaugauucaugaauauacaaauuaauacauucaacaucauuucugcuauaaaaucagaugaaguaugaacacgacucaguuugcaacaaaagagaugugggauuugaaguggagucucugagugugauuauuuucucucuccuucaaaaauauauuugcaaauguuauaucuuuugggggaguccuggccauccauccaucuguccauccgcccauccaccaccuauccaucugucaaucaaccuguccaucugcucuguccauccgucuguccgucguuccauccauccauucauccauccauccauccauccauccauccauccaaccaaccaacaaaugugucugcaguaucuccuaugugcuagacauuguggaaauucauugaugaauaaaacaggcagucuuugcuuucacagaacuuccagcuucuagagacuacuagucaauuagaaaaauaaaugcaucauuauaacuguggaagugcuacaaaggagaaguucaugaugauaaaagauccucaugauagaggcaugggagugaacagaguucccugaggagccauuugagcugaaggugaaaggacaagcagaaguuuaccagcuaaacaagggagggaagaucauuccaaggagagggaacaugaugugcaaacccccuuuggcaugagugaacuuggcaagggugagacacugccauuggacagugaacuggagccaacaggaugaacaagaagcagcgggaagauguucaugauaugcuggagagacaggagcuggaggcugcaguaagaucuccaugcuuuaccuuaagaggaaugagaagccacuggaggauuuugagcagggcagugaugugauuugcauuuugcaaaguacacugcaaaaugaaucuaggucagaagagauaacugaaugugggaguacaaggaaaaagcccccgugagagggcugcgggggaaaugguuuccccagguuagauccacgcuuucaguaagaaaggagguggugugaaaggagaagauugacugaggaggaggagaagucugcugguuuugggggaguggcugugagggucguagcaggcugagcuggggaaggcaggagcucuggccagugaagggauggcugauggccuggugcggacccuggcuggagggcucacacacuggacgcugacuaacaaaacagacgaaaauggggaguaugaggaucugucucaagggggccuuugaggagggcaaacaggccuuugagacagguccagacacuggcacccugccugcuucuguagaauuuaacguaccugagguugccaagcuggugucauggaguggccagaagccagcuuccagucugaggcagugggugaaccuaaaccacacuauuugauucacuucuguguuucuggaaacuuuuauguucugaucaaugcaaauaugccuacuguaacagcuggcaaugcccaugucuccacaaggccugagaauaugaucacaauggcaguacaucucacccaggcuucugcuggauggagggcuuccagagacggagggacagcucggucaauaccauccaagaggagguucaacuccagaccuaggccagcugaaggucaaugacaagggcaagaugcucucugcagucaacaucacacacuugucucaauagaaggaaggaauuuauauaaaauaagaaguggaaagagaauaacaucugugacagugagaugacauuuccacccgauucugauuccaucuaauagccagugcaggugugggggagggaggagggagacagggugguuggggcuggaauaaauguuuucagcagaaccaugccucagauggcucucagaacucagccuagaaggcaagccaguucagaggcacagggagacuuauggagacgacauaaaugaacagaaaauaaacuguacauuuggcaagacuggcacuguaagucugugcugugaugaacagagaugucaaacaugccccaugccugccaggugucauguuuccaaaaucccuuucucugucagaguuugcagaggaaugagcugggcuuucuaauuccuguuacugguaauggaucacauuuguagaguacuuacuaugcaccaggcaccaugcugagagguuuacuaucuacuacuccccauaauccucacauugcucuugagagagagagggauggagcucauuuaccucaagcgauggagaaucccgaggagucuucauucuccccuugacugcacaucugugcaucuaguuaaggaccaggacacaaugggaagaguuccaaagccaacugaccaccaaauaagucugagcaugaugugcuccugaggccauuagagccaagggucacuccuaagacagagggucagcugucuaccacccaggaaugcgauuccucccaccugcucugugugugggcucugggcuacaggacagcacaggccagagggguaaggggucaagggagacucagggcucgccaacaggcagagcuguggccagaaauuccucuuccacugaccggcuguggggcauccagcaggcuccuucacucccggagccucuguuccaaagaagauggaaguuguagugccuaguucacaggggugaugucagagugacaggagguaaucauagcacaugccuagcacuucacaggaauucagcagauucgagcacaccucacacaaugaggucauucaucuuaaugggacauggacacgcacacugagcacagcacccaagcucugagugcagaacauuuccaucuguggccaagacucgguucucugcccagauccuuuuggguccccucucuugauuuggccugcccagcccccagguuugucaugccuucacuucuagaggccugccucacuuuuagaggguaaaguggcuugggguuacuaccucuggaacagccccaaccaaugacuggcagauacaggagugugagaccccagcuccccugcuuccaggcaggaccaacuccgaggucaagaucaggguggagcuaagauggucccugaaaucucacccuugcuucccuucuccucuuuccuauccugucccauuuauuucugggucucauuaggagcaucucccuaaauaaacugcuuacaugaugcccucaucucagggucugcuucuugagaauccagcccaagacaccaucugacuucaucuugaaugccugaucuuccuuguccacgugggaaauuccuucaauacuuguucgggggucacuccuucugugaaaccugucuugaccucuucagcacagauacucugggcacguaugcauacagugcugcaggggugugaugugugugcacguguguguguguguguguguguguguguguguguguguguguguguguugaccuguuuggggcuguggaagucuugaggguaaaaauuucaucuuguucauaguuacuggggguauaacuagcaucuagugaaagccuuugauggacugggcaaccuucugagaauacaacuuuccauagcaguggcuucuuuagagcccacggguccagugaggggguauggaagccaccaagagggaguuccaggaaccucaccccugagucaacugaagcauauuucaauuuagaaauggguucuguugccuaaaaauaauaaugaugaugaucauacucaucaugacgacuggaaacuuugauuuagaguaaacugaccaggacuugaggauuuggggagaaggaggcucauuuuucaugugguucaucuccuuggccaucucuuuaugcaaugacagccacuauuaacagagugccaccguggaugugcugugcaaggggcuuugcaucgagaugacacuggaucacucccagcccuccaggauaagcauuccuuacgugugaguggcaccggucaccgcaccuucacugacauagacauacuguccacuugcucugucuccucugccacccugaccucuugccaggugaaaaucgcagccuucuaaccagcuccuuauuuccaccuuugccccuaaaauccaccauccacacaguggccuacgauuuuuaaagaacauacacuggaucaugccauucccugcuccaaacagaagcuuucaauggcuuuccuuuguaagugcccagugguguuaccuggcauggacccugccuaggucuaccaugguucucuucacugcuaaccagcuuccugcuaccuggucuuucagugccuugaagaggccaagccuuuuggggcuccauacagcucuccuccccaacugagacacucuuccucaugcuuggcaagcgaauuccuucucaucugccagucucagcuuccuuguagaaacauuccucgacccccaaucuaaagcaggcuacucccuggggacuaaccucaacuggaaauagaauucuuguuugcguccuugcugacugcugcccccucggccagcucugggagggcacggaucaugucucuuuuguuccccaucgaguccccagugccuagcacagugccuggcucuuagcaagcccucaauaaauauucaucaaacaaauaagcaaaugaugaccauuagaaaauaugacucguguguuuggaaaacuauaccgagaguuuucucaauucuugauggucagagcuuaauucucacauguggggaggugggugaagagaaagaacuacucaccacccacugcugauggcauaggaugggggcggugaugacccuucaacaacccuccucuucauccuacaucucagcauaaugugagguucaaggggggaaagauucuauugucacauggaacaugauuguaacuauaauuggucacauaaaugauaaauaacaagucacagucuauuucaugacaguaaaagcaguaaacuuugccucuagaagcaguacaccaaaggaaugguaaguggcauuuuuuuggaguaaucuugcuugccauguugaaagaugccucucugguugagauaccaggcuugcaucuuuggugagggcaguguuagggaguggugugaaggggcaacucacaugugggcaggacuguggaggggcugugccacccugagcagcagcuaugcaccagcccuucuucuaggagcuucaugcugguaucacugaaccuucucagcaacuccagaaaguagaaagguuucugccugacuccagagcacgagguagagagaagccagggauagcuguguccaguguccaggacaccaugccagacuuccugcgccuggacgcagccuauagcccucagguuuccagaucccucugauuuuuggucugguucuccagccuuccagcgcaauucugagcacuuccacuggauagccuucgaauccauucugauucugcugaaaugagacagagccagucuuuccagcugucaccaaagaccucagucuggugcaugcuccauauggcagcagcuuaccgacucaucuguggacuuacaaguuuaucauguauucugcuauuugaaaauaucaagaaaauagcaagaauucaugcacgcuucucacacagacugagacgggaguuugaggggaugucuugcaguaacagagcugauuccauaaagucuugauuugccuugggggaguuucuggcuucagggguccuuuccucuucugugggccucaguaaccaauucagggaucagagaaagcgccuucaccccucagccucaccugauaacuuuuuauggcugcacgaagacagaugaacgucuccggagccuacucauuuucuuucugaaggccuucucagagauaaauuccuuuucuuucugcaggccagcuuuccagggcaugauuaacuacguuucuccuguucuucaucuuuauaguuucugugggccucaaacaacacuuucugcauuuuccccucucgcccccuacucaucacucccugaaagguaaguagaguuggguugaagaugaaauucaacauguaauuggcaccucgcaaccagcacuuugauucugcagucacacaggucucacauggcauucucagguuugggucuguacagagccaggucuggcugauguggcugguccuagaaacaugcuaacaugcucccugagaaacgcccuggagccugucauuagugaaccaggcaaagccucaagaaucuauggcauauuucuaguuauucacccaaaugcucuguaaagcacaacuuguaccauggcauaaaaauaaaagauauaaagaaucacaggacaugugugcaugcuccagacgcccuggaggcuuccugugccaguguucccacaaguggcguaaaccugagggcaucauguuaugagaugggggcugcagugacucgcaggaucaggcauuccaaccgagagaaccgagcagaaugggaaaucagcaagaugaagcccucuccugcucccaggcaccccucuaccaacagccuccugugagagcagauuagucucuauccagaaauuaagggagagauugcucauaaagaugacaagcugcugccauuucuaaaagauguguauguugauuccaaagaucuugugucuuccgcgcagguaaaagcugcugaaacacaucaagagccaaaggaauucagauugcugaaaggucaucacuuugauaugauaaauauuaagagcauucccaaaggcaaaauuuccauuguagaagcacugacacuucuuaacaaucauaaacuuuauccagaaacauggacugcugagaaaauagcgcaagaauaccaauuagaacagaaagaugugaauucccuucuuaaauauuuuguuacuuuugaagucaaaaucuucccuccugaagacaagaaagcaauacaaucaaaaugaagaaaaucacaaaaauuuccuauguguacuccucaucccucauccugacuauuuucucauuuuuggcauauuaaauuauguuaauuaccaaauguuuaaugcucucauugugagagcauagucuuuuuuuuuuuuuuuuuuuuuuuuuugagacggagucucacucugucacccaggcuggagugcaguggcgugaucucagcucacugcaagcuccgccuucuggguucacgccauucuccugucucagccucccgaguagcugggacuacaggcgcccgccaccacacccagcucauuuuuuuuuuuuuugguauuuuuuaguagagacaggguuacaccacguuagccaggauggucucgaucuccugacuuugugguccacccgccuuggccucccaaagugcuaggauuacaggugugagccaccgcgccuggcugagcgcauacucuuaauauauauugagcucccugacuuuucaagauugccauggaauauauuuuguuuucuuuuaauuugguuuaggcauauuuuauauguacaugucagcaugucuaaucaguacaucugcaccuuuauuauaaguagaagaguuaauuugcuauuuuaggcacaucauaccaacucuuaaauuggucagaugaccccuugggaaauguccugaaucccucauuuaaguuuuacuuuccaaguuagguguuuaguucauucuucauaugugauagugaaaguaaaagcuuuccugacucguaaggcugacauuuucuuguuagggaaagagacucgauagcaagguaaacuaacaguauuucccaaauaaaggcacacaggagaaaauaaugaaucaauagaaucuaauuaaaauuacuaccccagggaauaagaaguauugaggauuuauuuuauuuugaauugguuuuaaguauggaauaaucaucuuuacaguuauaaaaaaauuaguguuuacaaaauguugggcauuucugcuuugacaaacaaacagguaagucccguggccuucagaggcaggcagcaguagaaacuuuccaaaaaguaacaauuucucuggauuuaacauggaaauagaaaaauuuaaagaauaauuaaauuaaaaaaccaugguaaaugaaauguggugaugauauacaguuucggauguuaaugcuaguugaaagagagaaaaaauaucaaguagaagcagaggacaggaucauuggaagggaccugagaaauugccgcuucauccauuuuagcacacuuauuagcauggcauguaccaauauuaggaaauugagugacagugugugaguuuagcucugccuaauauauuacugcuugugggaucuuugggagacuguauccucuuugagauugaauuucuucuauaaaaugagcauaauacuaccuuacuuaaauuuaagggucaucaugaagauaaauguacuacauuuauaaacaguaaaguacuacaaaggaccaagcaaauacgaauuauuuuuugcaguggagaaacaagcgcccggugagaauauaugaccuaagguucuguaguuuaugaccuaaccaggcccagaaugaaguuuuucauauccuaguaguguguuuuuucuguuuugacaaaaaacagcauaccucagagaaggaaaaaagugugaauuguggguauauugggguuaucagugugcuucugagggaagacaggcaucacuacuucccagagaugcccuggaaaugauauagaagaugcugaagaauucaacgugauaacagaaugaggcauuuguaguaaugcugagaacagaaaaauggacuaaguggaaaauuuguuugcaugucuuugaauguagauuuguuaugugaacaaacuaccuaguuuauuuuuaguucaauacaauaauuguuuuaagaaaacaugaaauaacuacucaauauaaaaugcauuuuaaaacuccuauuaaaaaagaucacaggaaaauugcuugauuucuccaucaguuaaauuuaccaccgugcacacguuaugugguuaaaaaucugauuguuuuccucccccacucgauaccaaaugcaaguacauuuccuguuccuuccaaggccauaacaauuuggugccuaaucuaaaaucuuugaaacuuugccuaauuuaaauuugguggcgaggcucuauggaaauuccccuucagacugauaguugacagaaggccaggcauucagaagaaucacgcagggaagaucguguuuguucuaaaaaggcaaaccuuccuacucagaaaagauuuuuuuuuuccugccaggaaaauugagaacaacagauuguagaacuucauuguagcucauggacugaaaaggcaaagucauggaaaggagggagaaggggcauuguggaauucccauguguguuaauuuuuucuuaggagugcuaaaaaaaaccucucggccucuucccaagaacucuugauaaugaaaauaucaccauagugcucaaaauggaacaguaauuaauggaagugguauuuugggggaguacagaugacuuggaauccaacaacgagauguuaagcaacauuuuccuggaucccacagucuaguccuauaauggaaggcaauaugcccagugauuuuuuuuuuucaucuacacaagggauucuacguguagaaaaccuguuagcuauuuccauuagcuuccacuuauuaacacugugguuuaccagaacauucuaaaccucucauguugggcaaguauuucauucuauaaaacuuuuaaaccagaacuaugacaaugagcagggaaccacuuuucuuuuucacuucccagguggaggucugaauuagcaguuaaauggccagaaggcagggaagaaaagggaaacaccaacuccaaauaucugaccugccagaaaaacugacccuaaguaguaaaugacccagcaucauuccauuugguuucuaucauuaaaauuagugccuggccugagccaacagguggaggcugcagugagccaugauugcaccagugcacuccagccugggugacaaagcaagacccugucucaaacaaacaaagaaacaaacaaacaaacaaaaauagugcuuggacaacuuaucuuguggguagagcauaaaagucugcauggaacacucauucuccucacugaguagggaaugcccaaccccucacucauucaggaauucauuuucaucccagacucccugauguucucaucucuugcucaccaaaaacggacaggacugaaguuuuauugagguccuaagcauuauuacuauugguuuuuuuuuuuuuguuuguuuguuuuuuguuuuuuugagacggagucuuacuccguugcccaggcuggagcagaguggcaugaucuuggcucacugcaaccuccgccuccggguuucaagugauucuccugccucaguucccaaguagcugggauuacaagagccuaccaccacgacuggcuaauuuuuauauuuuuuaguagagacagcguuucgccauguuggucuugaacuccugaucucagaugauccgccugcccagcauuuauuuucuauaugaaacuuucccaaccagggucuuguaagaguagucuuugguuugaaccccauucugacauuuugacauguggugucuccacuguugucagagaguaaauuaacaacaguuucuaagcacaaaaucauuauaaacuuaucacuuuuguaaaugugucacagcaacacugacuguucuaagagaggguaaauuccacagaagggaagcagacagguagcaucauugcacagcucacuggcaaaagaagugcaucggcugcugucuccuccucuacuccccugggaucugagugugggcaucaaauacaggaugaaccccccucaaccccccucaaccccccugcuccugcaagaacaacaauaaaaggcaauaaaauuccaaggccauagcuucccuccagccucucccacaccuccacucucagccucgugguuugccacacccucccgugucucugaggccuuggugccaacugcacuuuauggaggagaagggggugguaaauaguuaaagagcaguuacuaggucuuggcaauuuggauguaaucucuuuaagucauucaaacaacuuguuuuuaaaacacccaguguuugccuguaaucucaguguuuugggaggcugaggcaggaggaucgcuugaagccaggaguuugagaccagccugagcaacaucguggaacccuaucccgacaaaaaaauuuuaaaaaauuuaaaaauuaggcaugguagugugccuguaguccuagcuacucuggaggcuaaggugagaggaucccuugaggccagguauucaaggcuacagggaguuaugacugcacaccagccugggugacagagugagacccugucucuuaaaaaccaaaccaaaccaaaccaaaacacaguauuuacccauggaguaaugugacggguaaggcagauguggucugucuuaggaaaggucuaagaaagauauaaauaguccuggcuccacaguggaaauccaacucuguugacguggguguacuuccagaccauuuucccuuuggacaaucauagcaggaaacauucacauaaugauggcauccuaaaggacaaugcuaucacaagaacgaaccacagaaguucuccagggggggccuggaagccaaggcaggcauagucuugggucugccacaaacccaacaucuuggcucagagacugucuugacccucaaauuccagcuccaggucuccaagucacccagcuucccuugcccucugaggagggcuguccugggguggcugacucaccgucaccucuucuggguucccaugagcuauuuccaccacccuuagggcaggauccaccuucaccuuggcgcgggacaugaacuggaugacagacgaacuguccuguggaagaaacaacacaacuuacuugaagauuuuucuaugauaauggcugggccuugagagggacugggcagaacugaaauuccaugauuccauguagcccagacaaaaauuuuaucauugaacuagauaccucuccaucccaggcacccacauaaacacagacuagggucucucuuaaggauucuuugcagaucaugguggauggugggaaaugauggaguuugccaguaaucaacacacgcaagaugugugcugugguuuccaagcaguuagagccagauauuuggauauugauauugacauguucacaaagaguugaggauaaauaaagcuguuuaauuguguagagcaaaucuaggccuggcauuccacagaaggcaucugaucuacauuuuauaggcaucuuccugccuugaccacaacccucaaacccuucauaugaguugcuuuuaacucuuucuuugcucuuaaaugaagucauuuuggaaucaaaaccauuaaacauugaaagaggaugccugauggagagauggggaagggguaaauaucuggcuuaugaauuaaggagaaaggggcagggguauaagggagcacagcuaagacucuggaaucaccccccagccagaggcaggcagaggucuuccugugggcucagauucaaagacacugauccagauaaccagaaaauggcgccaaaacagggauggagaaagaauuuggaagaagacagggacuggaaaaacuguggucuggggagaagccagaaccucaagccagugguacagguugauuguggagcagaagggcagccuggcuucugucguggaaacagauagcagagaacuagugcauucaacauucuaccuguggggcaggaggggcuccacaggcaaggugucuugugguguccccaccuacaucuacccagcuugccugucaugcaaggagcuuacacuuaaaugccaccuuugguuaaacccucaaagaaacaggaagguagaggacuccacagaaaacaguuccaaggguacccuuugcucaucucugccaaagaaaccacaaagaccuuccuggggcacacagggacccuggucuguauaugugacuugggaguuaugcaccaauuaucauucuuuucuuaaaacaaccauaagacacauuuuaaaugcuuuugggaagcuugucauucaaaagaguuacuccaguuaacucacuuuaagcaagaaauaauuuuaagcaacaaauaaucuuuuaccaauuuaacaguuuuauaaaguugggguuuuauguaucaggauaugcuguauuuucaaucuugaauaauaauaauaaucuugggccaggcacgaugguuaaggccuguaaucccagcacuuugagagacugaagugggaggaucacuugaggcuaggaggucaaguccagccuggggaaacauccuaucucuacaaaagauuaaaaaaaaauucaccugucaugguagcaugugccugcaguccuagcugaggacuagcugaggcaggaagaucacuugagcccaggaguuugaggcugcagugagcuaugauugagccacuguacucccaucugggugacagagcaagauccugucucuaaaaauauuuuuuuaaauaaaaacauuaaaauaaauaaaaauaaacuuggauauuaauaacgauaaugaugaugauaauugccaacguuacaggccaagcagacgaggagucuggcacaggaugggcccccacgguuguagaaucagugagaaaagccuuacagacugaaagaagaauacuuccaaaaaaauccgaauccuacggugauuuuuuuuuuuugagacagagucucgcucuguugcccaggcuggagugcaauggcacgaucuuggcucacugcaaccuccaccucccagguucaagcgauucuucugccucagccucccgaguagcugagacuacaggugcccaccaccaugccaggcuaauuuuuguauuuuuuaguagagaugggguuucaccauguuggccaggcuggucuugaauuccugaccuugugauaugcccaccucagccucccaaagugcugggauuacaggcgugagccacugcgcccggcuccuacagugauuuuaaaaaucagauccuacauuucaaaugaaaacuuguuaaggucaaaacaguaaaaccucaaauucccuugucuggggccagaucuugaggucaaaaggaaaauaaacacgacugcaggcccaggcaaaccacaaggcuggcgcugcuccacauccuucgggaggccuggagccaugugggcuccacuccccaagggaggcuguagcuggcuucagggcaacugaagcucugggagcagcuggggccccaucuggcuuccaggucaacuuuguucuaagcuuuucucugcaccuggaagugcuccugguuucugcugaaagggcacauggagaaugagccuugaaggcuucauaugacacccuacagcuuucagcucucuugccugcggcucuacuggccuggcuggcccauggggacaguagucacugggacauguuccuuggcaaagggucaccacuggcugccgggauagaaaagcagaagaaccaggcugcagagcugugcaugauuaagugcaaauaacugaagugcaagcagcagccaucuggguugaggauaaaggaaacaucagaguggcuuacagccaccagugcugucaccagggcucuauggacaguggcaaguauggcacaggcaauaaaacugucugcagcaccauuuuugaagaauacaaacaggacagguacauaugcagaggcauaguccuccagccuggccugcggacacauuucaggaagguacuucuccagacgugggguuuuccagccucccuuauggaaucagaggauggccaguggugcucuaagucaggccugguccuccuccaacacuguccuuuauaaagggagagguacaaagggagaagaaagcacugcagugugaguccaacuugccccaaaccaguuucccuccagagcaaaccagagaaaccagaacuaugcacagcucucuucaggugugugagggcuguaacggcuacagauugaaaauggaaaaacauccccugaugccugcauccucucaggucaguguguuaccucugugccuauuuaaaaauaaccacagaaugacuuuucuaagguuauucauucacacguggauagguuuguacagauuaacacauuuagucuuucuaaagaaaaauaauuggaaucucugaggcuaacaugcauauuuaguuuuaucuucacauguaauuauuuuuacagcaacuuguuggaaguggccucucagcagcucucaccuuaaaauaaaucauaggaaauuuguaugauucuucaagagccaccgaugcacugguugaggugguuuuuuaaugaaccaccugugauaaacucauaauagcaaagugaccugagguucaaaaguuggaccaaaacaaaccgucauuuaaacuaggacucaugggucaaaucuggcccucugccuguuuuuauaaaguuuuacuggaucacagccaugcccauuuauuugaguguugucuauggcugcuuucacaauacaauggcagaguugaacaguugcaagagacuguagggccugcaaagccugaaauauuuaccacuggcccuuuacagaaaagguuagccaaccuucauccaaagcgaggucccuagacugcaggacuggcaucaccugggugcuuguggcaacuggagagccucagacugcaccccaaaggaaucuguguuugaacaagaucuccaggugauucugaugcaagcuaaagcaugagaaacuuaaauggccaaacaaaaucccuggggaauguguuaaaaaugaagaugccgauuuauuaagucugggguggagcccaggauucugcauuucuaagaaacucucaggugaugcugaugcugcugguccucggaccacacuuugaguagcaagggucugguauuuuacccuggcauuaucuaccagcaaaauuaccaauggcacuugcuggaaaaguuucaaaaggggcagccagacuauuacuaaacaguucaacaacaacaacuacaacaacagauguuggugaggaugcaaagaaaagggaacacuuauacacuguugaugggaagauaaauuaguacaaucaaaaaagcaguaucgagauuucucaaagaacuaaaaauagaacugccauuccauccagcaaucacacuaauggguauauacccaaagggaaagaaguauuguauaaaaaauauaccugcacugguaaguuuauugcagcacuauucacaacagcaaagauagggaaucaacuuaaguguccaugaauggaugacugguuauagaaaaugugguauauauauauauauacacacacacacacaccauggaauauuacucagccauaaaaaagaauuaaauuaugucuuuugcagcaacauggauggaaaugaaguccauuucccuaagugaaauaacucauaaguagucaacuacugcauguucucacuuauaagugggagcuaaguaauggguacccauaggcauaaagaguggaauuaacagacauuggagacuccaaaaugugggaggggggugaggguugaaaaguuaccuguuggguaccauguucacuauuggguacacuaaaagcccagauuucaucacgauacaauauauucauauaagaagucugcacuuguacccccuaaauacauaaaaauaaaaacagucucuuguagacagccaaaagggggggcagccagauugucaugaggacaccaauucaaaugcuuuccuuuuuccuuuuuuuuacccaaaaucagaugucaacaauucaaaugcuucuaaaugcauccacaagugcgguucauuagggcuuaccuuuuucaguauuucuguguucagcagcauguaaaugucuauaguacgacuuucuucuuuagcaagagcacuaaaguuacagugugcuguuaggcaagaaauuccugguuuuucacaguccugagaagaaaagucagaaaaauuuccaauggaauuaagaacaaagacaaauccacaacaauuuacagaguagugggcuccaugaacuuggugacuaaggcaauuccaggcagaggaaauccacaagaagaugcaaucguucuuucucgccaccagagggcauucaagggauuucccacccagugggaaccagagcaugccuuuaagucaagcaacugggagaaaacagcucacuaauuuauccuaccaagaauuggaugaauucacaaagagaaauaauuguuuuuuuuuuuaaacccacaaacuuaaauuuugcauucugaaagcauucuuaugaguuuugaacacagacacguuuccuacauuaugugacuuccaccuguguaguggcaaauauacuuucaugccuauuuauuagguaggugaauaagagggcuaagaagucaugugacacuuccucaagaaaacacaaaaguuacaauagagacguaaaucucggcugggcgcaguggcucacgccuguaaucccagcacuucgggaggcugagguaggggggucaccugagaucaggaguucaagaccaguuuggccaacauggugaaacccugucucuacaaaaaauacagaaguuagccaggcauagugguggccgccuguagucccagcugcuggggaggcugaggcgggagaacugcaugaacccgagaggcagaagcugcagugagccgagaucaugccacugcacuccacccugggcgacagagcaagacuccaucucaaaacaaacaaacaaacaaaaaaccaaaaacauaaaucccaaauuuaaguuacaaaaguuuucuuuuuuauaugauagguuccaaaaugcguauacauaccuugaugauguuucaucuauacggcaaaauuuucagccagacagagucguaacuauaaaaucacuagguaucacuacaucuaacaagucuaagggcuuucaacaauaucacccucacuauguaaguaaaaaaaaaaaaaaaaaaaaaaaacccaaccuuucaaguggcaaacagucacccuucuccaacaggagaaaagaaugagaaaggaaaugauaaaggugagaugugccagggcugaaauaaggagcuuagagaaauguaaccaaagauaaaaaaaaggaggcuuuggaaagcauugucauuccaucuucaauaccugcacuuuuuaaaaauggagguguaacaaauauaguaaauagaacaaaucugaagugugugucuuuauaauuuuuuuuuuuuuuugagacagagucuugcucuguugcccaggcuggaguacaguggcacgaucuuggcucacugcaaccucugccucccugauucaaccgauucuccugccucagccucccuaguagcugggauuacaggcgcccacuaccacauccagcuaauuuuuguauuuuuaguagauacaggguuucaccauguuggccaggcuggucucaaacuccugaccucaggugauccacccccucagccucccuaagugcugguauuacaggcaugagccaccgugcccggccugucuuuaaaaauuuuuacauguguuuauaccuggaggacuaccacccugauuaggauguaggacauuuccagcaucuaagcaggcucccucaugccccaucccauccacauuccucugaaaguaaccaccuucuugaccucuaucaucaugauuaguuuuugcuauuucugaacuucguauaagugaaauauuacaauauguggcuuuugucucuagcuucuuccacucaauauauucugucugugagauucauucauuagcaguaguuuguuauuuuucauuacuguguaauauuccaguguauggauauaccacaauugcuuacuuauucuccuauugauggauaucugcauuguucucagcuuucagcuauuuuaacauuucugugagcauccuuuuucaugucuuuucugggaagcacaaguacucauuuuucuuggggauauacucaagaguagaauggcugugucauaggauacacacguuuuguuuuaguagauauuaucaaacaguuucccaaaauguuugcacaagaauaaucacucuuguuuagacucauucuaguggaagaaacauuuuacuuugugcuugguggguugcaaagauuuaucccuuuuccagguaauaggauuuggaauguaaauuuaacauuuugauugaaaccucagacugaaaauuaggaguugaccacagucugugccuuuguaagucaaauugauuaaaaccagauuuaggaaauaauaaauaucaaauagaaaacuggugucuuccgagugaggaccacccguguuaccccaaccacuaaacaaauccuuaccaagacuuuucuuccagacuuugugaaaaaagcaaauauuguguggaagauauuuucuuguucuugagggaugaugcagggaguuggguuuuucuggaaagagcaguuucccuucucuuggcccaccugcaaaugaaaagaggccugucagaggagucauucucaagaaugaaucaugaugcuggagccucuuauuguagaggcaggagugguagaaccccaauucaccuuuccuccuuguccauuuugaaguggagaacaauggcugaaaagcugaaaggcagaaguuguagcaucaacagggccaaauaauagaaaauguggaucuuaggucccccaauaauugaugagauggcauauaacaugcaaaugagaugugacuaggaaauaggaagacuuaaggaguaaaauaagccuuauacuccaugguuuugaaagcacacuuaagaacauccuuacaagcaauucuugucugaaugaggaaaaugagacugaacuuaggucacuggccaacagucauggagucaagaacccaggucuggaacuugggaccaagccugauggaugaucugcugccagagguuuucaaccauucuagaaagcccccacggugcuguaaaacuccuuagggguccuucuagagaaagggaaugagcagcaagcaggacugcucaugguccaacucuaaagccagaguuuugcuaccaaaaaaauaacugaccagucucugcccugagccagacggggaccugcaugcuugccgagcucuuggugagugauuugauuuugcuucugacagcaauggcaacggugcugagugacagcaacaucagaaacaaaacaauggugcuuagucuuucuugaugauuuccuuaagaacagcacucuuucugauguuuaaauugaggaacuguuagaaaaaugaagucuucuuuauauaucaccauaucacacugguuguagcugaaggcuggacaggaugugagguuaaaccagaaaauuaauaauuaguaauucauaauuuagaauugugcuuacaaucccauggcuaaccacaggcaucuguuaaauugcccugucuauaaugcccuugaguaaaauauaguuguucaagaauguuucaacuuuuuauucaugguagggaacaaaaacuuuuuuugcuguugguuuuuuuuuaacuuuuauuuuauguuugggaguacaugugcagguguguuauauagguaaacuugugucauggagguuuuugguacagauuauuucaucacccagguacuaagccuaguacccaauaguuauuuuuucuacuccucucccuccuuccaaccuccauucucaaauagacuccagugucuguuguucccuucuuuguguucaugaguucucauaauuuagcucccacuuaucauugagaucaugugauauuugguuuucuguuccuguguuaguuugcuagggauaauggccuccagcuccauccauguuccugcaaagggcaugaucucauucuuuuuuauggcugcauaguauuccaugguauaucuguacaacauuuucuuuauccaaucugucuuugauggguauuuagguugauuccaugucuuugcuauugugaacagugcugcaaugaacauucaugugcaugugucuuuacgguagaaugauuuauauucauuuggguauauauauacccaguaaugggaugcuggguuaauuggcaguucugcuuuuagcucuuugaggaauagccacacugcuuuccacaaugguugagcacauuuauacucccaccaacaguguauaagcauucucuuuucuccaaaaccucuccaucaucuguugauuuuugacuuuugcuuuuuuuuuuuuuuugagauggagucgcucacuguugcccaggcuggagugcaguggcgcgaucuuggcucacugcaagcuccgccuccuggguucaagccauucuccugccucagccucccgaguagcugggacaacaggcaccugccaccaugcccggcuaauuuuuuuuuguauuuuuaguagauaugggguucaccguguuagccaggauggucuccaucuccugaccucaugauccgcccgccucggccucccaaagugcugggauuacaggcaugagccaccgcaccaggccaauuuuugacuuuuuaauaauagccauucugacugguaugagaugguaucucaccgugguuuugauuugcauuucuguaaugaccagugauacugaguuuuucacaugcuuguugucugcagguaugucuucuuuagaaaagugucuguucauguccuuugcccuccuuuuaauggaguuguuuuauucuugcaaauuuaagucccuuauagaugacagagaucagaccuucgucagaugcauaguuugcaaauauuuucuuccauucuguagguugucuguuuacucuguugauagucucuuuugcuguguagaagcucuucaguuuaauuagauucuauuggucaguuuuugcuacacaaauaaacuaaagcuaacaaugcuaaucuauuaauagugaauuauaaaacaagaccaccaaaauuugcuaaauuuaucucuauuuuaucuuugaucugaauacauuccaggauuuacuauauaugucugaaaauaaauaaggugaagguuuauauccucaaguuaaacuauuagaaaagaggauguugccuauaaaaguuucucacaguuugggacuuacuguccuuuaaaauuuaagugucuaauaauuuggaaauuuuguuuuuuguuuuuuguuuuuuuuuuggagacagggucucugucucccaggcugaaguacaguaguccagcucacugcagcuucaaccuccugggcucaggugauccuccuuccucagccuccugaguagcugggacuauaggcacaugccaccacacauggcuaguuuuuguuuuguuuuguuuuuugcugguuucuuuuuuuuuuuuuugguagagauagaguuuugccacauuacccaggcuggucucgaacuccuuagcucaagcaaucugccugucuuggccuuccaaagcacugggauuauaggcaugagccacugcacccagccucaauuacuuuauuugaacgacaacauuuggggaaaacacacuagccugaaaugaucucaaucaacaucaggucuggacgauuuuagaggucacgagagggaaacaaugggaaggaggcaaugagcuuuaaugaagauuugguaauuauuccuuggguucaauuguugaaaguugcaauaaauauuugaaagcccauuuuagaaagcaauacguaagcuguugauguggggagcagcaugaauauucacuugcaagacaaaugaggaaaacaacugcugcagugcuacgcaagugggcguuggugugugccaaucaaauuucagcaccaacauggauucaagaaguucugcauuucaacuaaauuaggcaaauuguagaugauauauucugguaaacugcugacuaaaaauguggcuuagaaaugaaacccaucaaucucagaagaugcacacuuggauaaaauuauugugugaaacauaagaaugaagaguauuauagauuaauauaucauucuuauaaaauuuuaagcauucaaccacaugauuaaguuaaacauuauacacagauaguugauuauuucuucauuucuccaaacuucuuuuuauugagguaaauuuacaggcauuaaaauccacagaucuaaagggugcaguuugaugaauuaugucacccaguaacuaccacccccaugaaaguacagaacuugucucucacuccagaaaguucccaccagucccuugccagucaauucccacugcccacuccccccaccucaaaggcaaucauaguucugauuccuauuaaguuggcaaaaaaaaaaagagaguuaaauuuaucuaauuagggaaauggaggaugugcuauuuggggcuugcccuauauuuaggcauauauaguacauuguggauggaaaauauuuauguuuauugggcguuugagaauccgaauguguguaguugugcucuuaauauccaucacuuuuucacuccaaagccuguaggucuccaaauucccugucugucuucuggaguggacaucugcugacagaccgcuggaaacuguuuucugcagcccuguggcaugcacauuccucugcugagauuacgaggccuggccacccaaacacauuuggucuggguuuagagaaacagaaccucugagcccugcaggaugcauccaucccucauuaaaaucaggcgugggagcagaguuccuccuugcucugcacaucggugcuucagguuucuaggcagggagaggaagcuugggagcagagcuccagcccagccaguguugcuaaugugcuucaggugugaagagcuagcacugucaucuggccacaagacgccagcggagaggggcagggagcugggaaaggcagggcaagcgagugagaaacagccuaagccucagugucaaccccaaggggcagagucacagcucagaaguuaguuucugucucccgccgggaguuucugggguggccugugaacaggguaauggcgauggcgugaugugaugcaaugugacaccucaucugccccuggugggaucuggaaaggggaaaugaggacugagucugcggugaaugaaaaucuuggccaguugugcucccgacugugguuacaugggaaucacuucaaucggggaaagcaacguuuuucugaaagguucagggugguccccuuucaaaaggagauugaagguugccuggugcuacauaagucugauucagaccagcuaauccuauugcagucacaccuucaguccucagcuaaaacucaggaacucaguaccuaccaagggucaucaagguggagggaggcgguccucuaaguguguugaacagguaccaaugugacagccaugacaacggcaccuaacacuugcauggcccuuacugcacgccaggcucucggugcuuuccacacauuaacauucaguccucacagcaguucccugaagcaggugcuauuacuguccccacauuuuuguuuuuuuuuugagauggagucuugcucuguuacccaggcuguagugcaguggugcgaucuuggcucacugaaaccucugccuccuggguucaaguaauucuccugccucacccuccccaguagcuggaauuacaggcacacgccaccaugccuggcuaagcuuuuuggauuuuuaguagagaugggguuucaccauauuggucaggcuggucuugaacuccugaccucaggagauccaccugccuuggccucccaaaguguugagauuacaggugugagccacagccccuggccuacuguccccauuuuacagauggaggcaagcugagaggcaacaggaggcccaauuacaaccagaggcuccccagguagcaggccacagaacugggcugggacacacgucacacagcugcagacaucugcuuaucaccacuuuccugcacuaccucuuagguggaagcugaggauggggcuggggcaggagucacagaggaguagagguggagggaaagcuuccuuuccucuuacuguggucagaggaagaaaccacuagccuggaaaccucagcauucuccagccugacccauuuccaccacuguagcaaaaaaaaaugacuccugccuagaccaugggagacaaaagugccugcugacugagaagaggccuauucugcacagucucuugggcuggaaggggggaacagagcauucuggaauguuguuucuggaaggcagcugcgagaucaugcaguccuuguggccucagcugacagauaaggaaacagagguccccgaguucagcgacuuguccaaggucauguccgggccccagugaaguucugugguacagacgcucuugaugaauacucaauaguccuggcuucagcccuagcucugccugcuaacagccgugccaguuugggucuccagggccucaguuuccucaucuacacaugaggauguuggcccauguagucacucagguuguccuuaguugcuaauuccucacuucaugaacugucugugcauuuucauuacagcaggggacuaccuuaucucaucacacagauaaacaauuacugacuauccauccucccacaacuugguuuuaaccgcacucuuugcucaaagucaaggggacaugaugcuuuuuucauguguugcagacaacccaagcauccccggccaaugaccaacaaugucauuuccuuggcuggcuaaggacucuguggccaucgcccccuugcucuucucugcccagucaguccucauuuauuucccaggcuaccggaguccaaaugcuucucaugacauggcugcuuaucucucagggccucugggagcuggcagagguccauggcuauuagaauuugaacaaaaggacuucaccaggcacccaaacaaggaaaggaggaugcaggacacagugacaaggcuguauucuaccaaggcagguacugaggguuuucuguuggcaucuguccuccccuuuaccccaaagaggacauugugcaaacugaaaccaugaaaugguggugacuggggaagcugucaggaacccuggcugugggagcccaaggaguggccaucacuugguggcagagucugggucagccucagugaaaggagcugucauggucagaagccaccacggugccaggccugugagaggauaaagaauccccuguucacucuaggggaucuggcaagaccuugcuucaugaaguaguggguuugaagugugaaucagggcugauuccauaggugugauacugagaaagagagcagacccuuuguuucaaauguugucgucaucugaucccagguggagaagggaagucaagagcuguuacuuuccaggcugagguggucagauaaacggcuuggaggaaauggcauuuccauguuguaggcucagucaggcacuucuaagaguugucuguugacucagagcaagagagaggacacagguuuccucccacagggccccaaacagagcagccaaacacagucccugugccuggguuugaacacugaagaggcagaaaaguccucugaucuuuuuucuaagugucaugcuccaagcacaucauccugggaaaucgcuuauggucccaucucuauacugaguucagauaucaauggaaauaauacaauauuaggugcuauuaguauguuagagaacggcauaugcugaauccuuacggcacccauguguggaggguacugcucucagaagggugaccauauaauuuauugucuaaacugggacauuuuugagguucaaccagcuagaacagcagcacagagacauuuaucagggaugugacagauaagcuuuaacuucugcucuccuuaaauuccaccccuuuuuacagaugagaaaacugaggcccagagagguuaaguaaccugucaugucugagaagcacaucucgaaaauccccaccaggaugcucugucccacuccaucuuccuugcaccaggcugcauaguagcuauuccacauacugaagcccaaacaccaccugaccaccaccucacuguuuauccauucgcagccccucagagcacagcuccuaaugagauuauaaaucuugucuacaaauuucucccuccaccaggaagucagccccucucauaucugacccagaggaaguggcauugcagguagaucgcaaaggauaaagaaaacuucucaggaguaaagggaggagggagaaaggaauuccaggaagagaacagcaugugcaaaagcauagaggggcaaacuugagacuggagucuagagagccaaggaguucaacacaggucaagcacuggaugaaugcuggguagcaguggccagaacugaggcaggggagaugggccuggacacagaggagggcaugugacaagucuuacacauggcguggguggagguaguuacccagaagguaauaggaaccagggaaagcuuugaaguaggagaaugugugagaauguaugauuuagaucauguggauuaacgucgcucaaaauuaaagaaauaauuugcagcuuugguaugugauauuuuuagcuuuuuuuuuuuuuuuuuugagacagaguuuugcucuuauugcccaggcuggagugcaauggugcaaucucagcucaccacaaccucugccuuccggguucaagcgauucuccugccucagccucccgaguagcugggaugaugggugugugccaccaugccuggcuaauuuuguauuuuuaguagagaugggguuucaccauguuggucaggcuggucucaaacuccugaccucagaugauccguccaccucggccucccaaaaugcugggauuacaggugugagccaccacgccuggccuauuaguauauuuuuaacaggcagaagcauagaugccucuaccaguuugccauuuuaccaguacgaaccccaucagcuggcugggguuccaaggauagggagggucaccaaaguguccauggcuugaugccccuugaaugcgugcaucaccaaucaaaggaaaauggaagauuaaauuagcagaggaacaaacugaaugacaguaguguuccccaugagccacggcuggagucauccccagugugguuuuuggguaaaaaaaaaaaaaccuaaaagguaugaucuaaaagcuauguuuguugaauuggcuuggguuaaaagggaccuagguucauuuuagaauaacauguguuuccuguuaacucacguuucuguguuauucauugacuuuauguucucaguuacaucccugggccacuuuuccauaucauauuacaccaaucgcagcugacggcaaccggguaaacaugacccacccccugacuuaucgccugcuucucugaagucacacgcuccuugaguuugaaaacucagagaauguuuugaaugucuacuuugcuaauucaauuacccauugccuacucugagaaccaaggcaucaaaagacaguaagccccuauuccggcacaggcggcugaacacauacuacaauggcuguggugacauuaauuuuaggacuucaggguuugaaauaaagauaguagucauacaauaacugagaaaugauaccagcugguugauuagccugaccuaaggugucuaguucuagaaagauaaauaagauagcuucauauuauccaucuagaaaaaugcaaaccaugauucaugguugcuuagcagccuuaaagagcccuucaaauuauaucucauguuaaaucauguugcuaugauuuacuauugaguauuucuucauauugaccaaagacuaaaauauaauaauauuaaugaauccuaggacaaauacuuucacguaucaccauucauuucaagacccuguaauaaugcagacucaggauaaccuacaaaggguggaugcucacaggcucuguucauuuacucuaauuuuucaauugcaaugacacuauuuaauauaaggccagagaaacagcaauaaugaucuuagauugcuccuuaauaugaacauggcuaauuucaugcuacucgugugugcaucaccccauuugaagguaaugaggaguuuucaauggcauucuuugggagauccuucugaagaaugauggucuuuugcuuugugaaaagagaccccguguucauuagugcaccaaauuuggauuuucugauauuuaccccucuguguagcuagugguuccaagguguuuauuuaaggacaaaaauccaaaaaacagaaacagucugaugaucacaacaacauaagcuaggcuaauaugaggggcucuggcuuuggacagucccugcuagcuucaguguucaaauaaagaguucugucuuugaaccgaaacggguaaacaaaaucacaugacagcccacuccaaaccugcagagcuggggauagagcagguggagcaagaaguuaaagaaugaccuaguaucacuuaagcacagaaaggaaaagaucguaacuuuaacucuagaugucuucucccuuucuaacugaaaacugucuucuaaauaaaauacuugcuuucucuaacccuuuccccaucccuuaaggcagucaucccugugaaaagugguauggagucugaaaaggucaggguguuacugagaucaaaucugaaacugaaaauaaaggggcaaagccuccagaccaacguuucagaggaaagguugaguauaauccaaugcacagccucuguaugaggcugccauuauuucaugaacaauuucacuucucaugauaaaagccaguggauuucauuuccaucagcuuuaggguuuggcuaaaacaaugccccugcauccuccccuccucccucuuccuuugcgugugacaggccaacaugcuggaaagucaagagugcaggccaccaccaccaggcugcccuguaaaacgggaugggcuuuaauuaauuuacauguaaucagagaaagacaaguuccccagacaaagcccauuucccaggcauggggauggccuuuuauuggaguuaaagcgauacagaugggaaguagucugagagaggcagugacacaaaagaauuuccagaugccgucagauucucuuuagugaaaaagcgauacauaaauauguuaucugagcacuugacaugcauaccaaaaauguuuuccuuccacagauaaugaaauauuuuggaagcagaauggucuguugauuuggguaauaaaugagugaauagcccccauaugagacaaaacaugguccuuggaauuguaucugcuuguuuaaauucugguucuagcucuuggacccaucuuaagguaaagaaugaagcucagacccaucuucccuuaaaggcuaaagcagcacaccuauucacuggguugucucugcauuuccugcauauauugcuuuauuaguucccuuuuaucaaaggguaaaucacacucauuuucuggaugccaugauuccuacaucaccaucuaucuaaccucuuccacugcuuuucugagaguacauacaccagagcagugaaaagugaaaccucaguguccuucauuaagucucaaguuucaaggacuucaugggaggccugaaauaugcuuuaggucauaaguuuagauuaaagagaaguaagugagguuggcucccugacagcuggggagaucauuacuucucagcgucuaacaacauugaggcaguucuuuuuggucugaagaaacuugggguguaugucagaaaagcguuuuccuguuuuugcgcuuccgaagcauacacaauuaguccuuggcagguuaaaugagaaccauguguuucucggcaauggccgaugagcccuguuuauccucagugagauuuccuguuaucgacuuugguaacaacccaucaccccugccauggcaaggcucugugucauguugcuuuuaaggaaugaacguaagcaaacuccucaccaccaacuuuugacgccuauucauguagcagaccagaaaacaccaggcaccuacgcaucggcauucaacuagccuacaugcuggcaacaaaguguuaaugcuuccagaugucacagcagcugugagcacaagacauuugggcuccuugauaaggccgggcgccuucagucagcagggagacagcacugcuggcuugauuuauucucucuggccacacagguuaaagggcagccucugaaccacacucuguacggacagccgggacugaagcuuacccccaccuuccagaggguguguguugaguguaacuugugcacagaaacacacacgcuuucucccucuagccaagcucaaauuaaccaagagccuaggaauguaacuuuuguuccagaauucaaucagccaucucccuucuuuuaaguguuuggcuucuguugagaaaaagauuuaaggcaaaccuaauccugacccauuucaggaacuugacuauucagcuugcauucauacaugugcagaaagaagaaaaugcaaaagaaaaagaaaagaaaguuuagggccauuacugagaucagcagugucugugugagagaaacugagggggaaggaaauauguguucaaaucccugaccaaaguuuguagaguuuaaauuugcucuaagaagcuuucguuucugauaaguaauucaaucucuuauuucaaaauuucaccuucuuauucucacauugaaauuaaggcaaccucugccauggguuaaaggaauuuguucaaaauauuccuacugggcgaucucaaguagagauggggggauguccuggagccaauccccaggagauacaaggggugacugugugucugaggaugccacuaacagaguggaagcagccauuucuuucauuugucucaccacucacuauggucucggcaccaaaugcugcaaauacacagaaaauaaggaccuugcccuuuacucucaugguguuuuuaaucugguggaagaagacugaugauaagagaguaauuucacauagugacaagugcuaugaagaaaacaacauacaaaugagauagagaguaauggggguuugcaacuuuagguaaaguguucagggaagacuuauugagaaagugaacucugggcucagaucugcauaauaagaaggagccagcuaugcaaagauuggagggaacaguguucucagcaaaggcaggugcaaaggcccugaggcagggccaucugugaaggcaucugggaagccuugacagagaggacauaugaacugggucuugaagaaugaguagcuuuccacagccagaggggaggagaagucacuagcaagggcagggggcccagggaaguacaaagugagagccuucagcagcauucaugguccagggaggcuggaagacaaggucagggaugaggggcuauuggagaaaauggccuggaaaguugggugggagggaacgccggguuuuggaccuauggcuuuggccauuaagauuuccuugauuuuuuuuuuuuuuuuuuuuuuuuuacugagaaucucggaguguuucugagcauuauacggauaaauuauuaggacuagaaguugguguagagaaauuauuaggacuaaaguucucagauaguaaaccagguccuuacuuccugagugauaaugauucaugaugaggagggguuggaugaagaggcacaggauuugcugcucaguuuugaauuuuuauuuggagaauauggagagagcaaagaggacacccuaggaugggaaagaaaauuaaaggaauuguaaucuuuuuuggaagagaagggggaagucaagguaauagcucaacuucucuacaugagggaacuaggcaauuauuuuucauuuuagcuaagaaagggucauggggcauggagaauuguggauagucauaacaagggauuugagggauaccagaauggcuuaacaaagagaacuugcuggaaaagcaguucuguguacuggggagacaucucgauuguauucuguccaaagguagaggguuggaucauauaaucccccaaauccaccucuuccuacaugagagggguuucuaauccuuguuagaaggaaccucucacccagagagcuggcuugguacagucaaccauugaauuuccacaaaaaaaauugagggugaaggcgaggaaaaaaagaagcauguguucaugauggggaagagcagcauagauaaaaaugugcauuguucauuuuuguuuuggguuauuugcugggcuguuuaaagugccaggucuggcucuuauacaagucucagcuccaauaagcuggcugcaggggagacuucuuguugcaauuauccucuaagcauagcuaagucauaaaauccaggacuuuucugaugugaaaugugcaggcuuuaaaaaucagugucacugucaacugcugcugccagcaaaauaagugauucacauuguggcagaaaacucccccagagugaaagcuaaugagaacacacacggagacuucuggauguccagucggaaccccacacaacggcagcaugggggcuggcauuucaaaggucagaaaucaaacagggcugaaaucaagggggagagaauucucagaaaagacauagacuuggcaaggacuccaugggcaaagaaauucucauugcaaacucccguaagauagcuuuggucccugcaacuucugaauaaaggucuccgugaaacugucccugaccacuccguuuaaaauuacagccuuucccaaucccuauccucuugcuuuuuaaauuuuucuccagagcauuuaccaucauguaauaaacuauaugcuuuacuuauuacucuuuccccaccagaauguaagcuacaugauggcuggaaauuacuuuuugucuguuuuccucucugcacuaggugcuuagcauaugcugggcgcaaaguauuuguugaaagaaugaacauguguauaaaaauauccccacaacagccucuuguggugaggacugucaucaccauuuuacagauaagaaaaugggagagcagagauuuaagucucaugcuuuagaccagggcuucuuaaauaugaacagacaaaggaaucccuggggaucuugcugaagugaaggcucugacucagcaggccuggguggggccuuaguucugcaugaccaugccucaacuuccagguagugcuagagcugcuggacagcuacgcacccagacaaaaggauggcgcaagacccugcaaguggcuaaaggaaaucaaaauguuuuaucccaaaauagauuucuuugacaucguuugaaauggcugcugcugggccagcagacagaaguggccuugcaaaacugucucuuguggggaaauuuugcaccuguagagaaucuccuugaaugcagccagcccuucucuuuccaggccuuucccagaucuaggacagauugagucugacaccuuuacaagucugaaaagaaauucaccaucuauucucucuaggaguuaugaccuggaaggcuucaucuacauaacaaugccaccuuugcuagccaagccuccuucuuucucucccccaugacaugucuugccauuaaaaccugguuguggucaugcucugagccugcauucuuucuauaaccucaagaugguauauaagcuucuguaccuuaccaggggauugggucuucauucugaagccuccccuguauacaaguuaaauaaaucugugugccuuuucuccuauuaaucugccuuuucugaguugauuuuucagugaaaaagaccaaggguuccccuugaccccacacuguacaguuguggcaggaugaacccccaaauugggguuuggccugggagggccgguggguuuuggcuuccuaaaggaaagaauucaagaggaagcccagagaguaaagugaaagcaaguuuauuaagaaaguaaagaaauaaaaggugguuaccccauagguaacacagccccaagggcugcugcuugccuauuuuaaugguuauuucuugauuaaaugcuaaaaaaggaguggauuauucaugaguuuuacaggagaggggcugcgaauucucagaacccaggguuccuucuguuuuuagagcauacagaguaacuucuaggaguugccauggcaucuguaaauugucauggugcuggugaauuaucauuagugucaccaucuugauucuggcugucuucagcuggcuucuuuaccacauccugcuuuaucagcggggucucugugaccugcgucuugagaaacaaguccugcugaacuccuauuucacagugaaccccacuguuaagagugaacgucaacuuagccacuuaccaauuuaccuuggccuucccucuaacucuuccuugccucaauuuccuuaagaaauuauuaugaagauuagauuaauuuguucuuguaaaguacuugauacaguaucucugcacuauaccuaucuguaauaaguuaguaagauuucauacuuuuuggucugaaucuaacaacuuucucucagaauccuaagggagcauuauuaaaguuauauucugcuucaccaaaauagaagucaacauuuaugcugagaacccugauaauauacaccuacuaucagaaaauuagaaguuucuccuggauauauuaugugaaaauuuugagacagguuccuaaaaguggaauuguugauauucauauuuuaaauuuugguaguuauugucaaauugccuuucauaccagcaguauuugaaagugcucauuucucuucaucuuaaccaacaauggaucuuaacaauuuuuuagauuuuugccaguuuaaugaggagaaaaaccucauuuuaaguuugcauugcucugauuaccagugaggcuaggcaucuuucuauauguuuauuugcuauuaaaauuucuuuuugaacuccuggccucaagugauccuccugcuucagccucccaaagugcugggaugacaggcaugagccaccacacccagccccuaaaauuucuucuuuugugaauuuccuguucauauaacuucaaccauuuuuauaauuuuuggucuuuucugcauuauuuuguagaaguaauuuauauauuaucuauuuguuacccauguugcaaauauguucucccaaauaucuuuucccuuaugauguauuuugaucacauaaaaguuuaacauuuuuauagguuuaaauuuguuaauuuuuucuuuaugguuucaggauuuuauggcuugcuuaggaagaagagcuucccaucuaaagauuaugaaaauauucaguucugcaaauauuuuuuuuaacaucuaacuuuaauucaccuguuuuuuguuuguuuguuuuuuucugugagguacaggcuuucucuaaugucuucccaaauggauagccaauugucuucauaucauuuauugaagaguuuauacacugccacuguuuuggaacgauauuucaucaaauuuuuuuuucugcccucuuuucucuaucgucuuucucugcaacuccaauuguguauaucuugauaaacuuuguggugucccacaaagcacaccaaaggccucuggggcuucaaccauuuugcuuguguuuuauucuuuuuuccuucuguucuucagauuggaaaaucuguacuguaauccagcuucaaguucacugauucugugucagcucaaauaugcuauugagccccucuaaugaauuguucauuucagguguuuugcuuuuuuuuuuuuuaauuaaauugagacagagucucacucuuuugcccaggcugaagugcaguggugugaucucggcucaccgcaaccuccgccuccuggguucaagcaauucuccugccucagccuccugaguagcugagauuacagacgacucuccugccucggccuccugaguagcugggauuacaggcaucugccaccacucccagcuaauuuuuuguauuuuugguagagaugggguuucaccauguuggccaggcuggucuugaacuccuaaccucacacccgccucagccucccaaagugcugggauuacaggcaugagccaccgugcccagucagguguuuaacuuucuuuuauuuauuuguuguuuuuuuuuugagauggagucuugcucugucauucaggcuggagugcaguggcacaucucggcuuacugcaaucucugcuucccggguucaagcgauucuccugccucagccucccgaguagcugggauuacaggcaccugcccacgacaccuggcuaauuuuuguguauuuuuaguacagacaggguuucaccauguuggccuggcuggucuccaacuccugaccucaggugauaugcccaacucagccucccaaagugcugggauuacaggcaugagccaccaugcucagcccauguuuuacuuucaauuccagaauuuccccuugguucuuauaauuuccaucuauuuuauuauucauuuauuuaauuuccacuuauuuuaauuuauucaucaauauuauuacugauauucuuuauuugaugaaucauugcugucauacuuuauuuaaacugauuuuaguucuuuaaacauuuguaauagcugcuuugaagucuuuguuaaauccaacaucuggguuccucaguuuuuauuaacuguuuuuuucuuccuguauagcacaugagaaauauauaugauauauacagugucuguguguauuuaaauuggacauuuuagauaauauauuguagcaauucuggauucuuaccccucccauugagggguaguuguuacuuuuuuuuuguuuuguuuguuuagugacuugccuagacauagucucuggagucuguuuuuccuggagugugcagccucugauguuucugcuggcaaaauauauauugcauguaugcauauauauguauguggguauauguguguguguguguguguguguggguauauauauauguauauauauauuuaucacuuguuuuuauuuuuaagccugguuuuguaggggcuguccuggaucagcacagcuuagugaucagccagugacuggucagaggcuguauguaaacaucuugaucuaggaagguuuucacccucaguuggugggucugugugugucucuggggaaagcauuugaagaucaggcaguuuacagucagcuucagcucuuaccuucuguauucacaaguccucagggccaaucaguugauucucuuggauuuuuuuagggagacaauaacaauuuuuacaauaggauacuuuuuuuuuuaagaauaaaggcuaucauuucuuuuuauuguuaaggccuccaacacaacuaaacugaagagacacuagcagggacucaugccuguuccucacuuagcuugaaguuuccuauagguuucuggcaaagggucuuugucaaguugaggaagucuucuaugcuuuccuuacuggaaauguaauaaaauaucauaaauaaauguugaauuuaauuuuuaacuuuuuagaaacccuuaucaagauuaucauuugguuauuuuucauuuaauccuuuuauuauuaauaauaauauauaaugaguuauauuaaucaguuuccucauggagaaccaacuuagcauuccuggauuacauccuguuuuacccagacuauauuauucuucuaauaggaaucaauuugcaauuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguaucugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggcccucaauuugcaauuuauuuagaacuuuuguaucuguuuucaaagugaguuuggcucacugcuuccuauuuuugcgugagugugcccgcucuccauuucugguuucuguaccagggcuauguuaguuuucuggaaugaguuucuuuaucuuuuucuacucucuggaacagcuuauauuaacauaagaauuauccauuccuugaaagccuacuagaaucugccuauauagcuaucugggucggugauuuuuuuuaagauauaggucuuugucuacuuuuacauuuuuuucuaagauagucuaguuggacuuuuuuuuuaaccucaugcauauuuuauucagauuuuaucuuugugugaauaaaauugaaaagauuuuuuuguuuuguuuuuguuuuuuugagacaggaucugucauccuggcuugaguacaguggugugaacauggcucacugcagccuugaccuucuggacucaagggauccucccaccucagccucccaaguaguuuaugccacaugccuggcuaauuuguuuuuuauuuuuuguggagacaaggucuuacuuccuugucugggcuggucuugaacuccuaggcucaaggaucuucuugccuuagccuccuaaaguccugggauuacaggcaugagccaaccaugcccagcucaaaagauguuauaaauuuuaaaucuucauauaaguaugguacuucuuuaaaaaguauuucuaguguuguuuuuuggcaucaucgcucuucuuuauuucuuguugaagcuugcugcagguuugucuauuuuuuuggacaaaaaaacagcuuuugauuuugcuaauguggaauacuuuuguuguuauuauuuuuucuauuucaggauaugcuuugucuuuaauaauaccuucauuuuacuuucuuugaguuggguuuauuucauugucccuugucuaguuuuuauguugucaauuuaguucacuuauuuucagucuucccuauuuuccacauguaaguaguggcauuuuccucuguguugguuuugucuaaaucccauugguuuugauaugaacaaccgcucacugucuuucacuucuaauuuguucaucccuucaacuuugauuucuuuuuuuucuaaaaaguuaauuugaaugguguuuaaaauuucccaaguggauuuguuuuugguugguuguuugccuaaccuuuuguuuuuagcuuccaaguuuauugcauuguggucagagacuguggcuucuacugcuuugacuuuaaaaauuccauugaugcuuauuuuuguguuguuguauguugaauaauuuguaaauguucacauuugaaaagaaugugcauucccuuauuuauguuaggaucucuguuaauuacuccauauaaauuaguuucuucaguccuuacagugugagauagguacuacuacuaguucauuuuacagaugaggaaaauaagauuggggaguuaagguaacuuccuauagguugccauagcugguaaacaagggagcaguaaugaaaaucagacauucugacucauucugucuuggucucuauauaaaugaucgcaacucuaguugcauuauucaaauacucauuauuuuacuccuacuugugugaugauuuuugaggggaaagcaauaaauuuucuugcaaugacugugaaugugucaauuucuuuuuguguuucuaugguuaaagcuguguuguugguuauauaaaauuucauuuauguuacaaauucuuaguggacuaaaucuuuaacacucugaaauauauuuucuuuugcucuguuuaauguuuguggguuuugggcuuuaauuauacuucauuugcuguuaauauugcuauacuuuauuucuuuggguuaauauuugccuuuuuuuuuugaaugccuuacauucuggguaacuuugaagguguauuucuuacaaguuauuugguacuuggauuuuuaaaauucuaaucugagagugucuuuagggcauuuaauccauuaauuauuauuuugauuauugaaauauuuagguuuauuacuuccaucuuauuauacauuuauuuuuuucuucauaaauucuuuccuuuuggauuguuuugaauuuaauuauguuuuaaauucuucuucuuuagugguuuggauguccuacauuguuuuuuguugcccuuaaaauuuuacauauuuaaacauuuauuuuaccaaagccuugagcuaauugguacauaaacuuguccccccaagacaagaaucuugacuugcuuucauuuccaucucucuugacuucuaacucuuauauuaugaucaucugauauuuucauuccagauugcuauuuaaaaaaaggaauaaguuuaacuggcuuuuuuguucuucugcaauacauucucagaaaauccaaguuucgaauccccuacuuuauucuuuaauauuuauucuacucuauggcuuauauugaaguuucauuugaaugaucaauaucuugaauuuacaaaucucuaguuuauucuguuucauggaaacacugucuuuuugcauugcucugaagacaucagucuugcuuauucagaagccuucuguuggccuuguuacugcacccucugguauuaguucuuuugauugcgguugcugccucucugcccugguguugaugcuccuccucuggugggugauucuugggggucuacuccucaucugucuguccuauugacugagccugccucuggugauuagggagugggcagcacuuucaggagcagugugcaauucagcacaaugggaaccacgugaacuuuggagucagaccugguuacaaacccagcucuacuuuuuagcagcugugucagguugggcaaauccuugaagcuugguuccucaacuugggaugcugaucuuaccuuaugaaggugccauaaggauuaaauuugacagcacaugaaaaaggcuacuaaagccuugggacagcaauaaaugguauucauuuuuuugggggggucaguuauucaggaguaauuucuuuacucuuuagcuuuggauuauaucgacugauuugauggccccaacuuaagaagcuccuccaggucauccuuggggaaaacaauucauuccuccauuuaugucuaauuuuaagcuccuguuauggucagugauguaucaggugcauauuuucuucauagggaugugagcagucccacuauaaauuaauugaaguucccacaucaacugacucauugugggauacccaucguacaucauggguaggccugucuacuguacaagcauggggagggaagauuuuacaguuuacuaaaauaugaguccuggcaccaacuuggaauauucuaacagauguugguauucaugccauauugaagucaauguccuaaugguacccuauggcaaagacauugauauaucuccuuagaaaauuaucauucaucccuacaauuuuaccuccuggaaaucaggucaguucuuuagaaucacugccccauagcaagaaaacaacaagccagagaggccaauauuuucaauugguuuugcaggaggaggaaugaaugguaugauauuuauuuuauaucucuucuggacuaacacuagaguucuuucaaaaauccaguacuuucaccuggaauaaaaguucuagcccuucacucccuguuagcuaucauuucugacuuuuccccuucuugcauauuaacaagagccaaaucccaaagccuucuccuccagugugagaaagcugcucacagauacagguuuuuaacuccaucaagugaagcuugcagucugagauaaagcucccaucucuuccauugaaccuucagaaauugugaguaaaacuuaacuuuggaaagaccacuacccucuucccuucauaagccaugaagcuugugacagauguguuaucuuggugcaaucuuagaccugugcucaggggcuaugcuacacggcucgccucugcagaagaauggcaauaaagugaagugguucaauuuuucaggucuguucugaaaaauugagaagaugaucuaucuucacuucaaaaagaaaucucuaaggagcaaguggacacagccugccucccauaagcugucuggcucacucauuuuauuccuggaaaucaggugaguuuuuuagaaugacuguccaauagaaggaaaaaaguaagcuagggaggucaguagcuacugcucauugcagcaggccaagggugguuugcugacaauguccaugacauguaguuagacucuaguaucaaacagggagcuuggccuucuccaugccuaagucagcagguaggaagguucaggucuacagcacacacacgauguacccaagaagagugauuaauuuacaaacugacagaggaaaugacugugguucaguacucucugucauucugccaaaauaucuaucugcuguacaucugcagaaggcauacggaacacuuacucuugccuauuuguauaagagcuaggcaaacagaauggagaaccggguguagcucccagcacagcagauacucaucauacacucacaaguggugacuguuccucuaucuggaauguucucuucuucaccuguucucuuggugaacuagacauccucuaagcccugacuugaagagguuccuuugugaagcacugaaccuuuguagcauccuggggucugggcaugccuccauuauugcauuuguuauacgguauuacaauggcauuuuauguaucuguuuccugcaagacagugaguucuggggcagaugugggacuuauuccucuccuuggagccuggcacguaauagguacuugcugagccaguguuugugaacaaaucaagaaugauuuguuacuaguaauuuugcuauuucagauagacuagaaaggucugucauucuuccccucuauuauuuucaugaucauuacaaccuggcuuccugauggacagacacuagguccacagugaccuguuuccuuuuuuuucugugcugugggaagucagaguaggguccacacaacccccgugggugggaagcagugaaaauugauagucuuuccucaggccaccaccguggcucuguuuuuaagguaaauacaagcacagcagaggggcucagagacauuagcuacaaggaaagaagaucacgagccaaggcugggaguuuggagugguuacacuucauuaggcuccccguaaaaaccucccauauauaagccagacacucuccacuuacagacagcuggaccucaagaaaugcuuugggcaaacacaaaagacucuuuggugaaagcuagaggcagguugguccugcccagggaccccagaagcagccccagagacuucuaaaugaauucugaaccaagucagaaaacugugccacacguggguccguagguagggugacagcccagggcccauagggcgaguaagcccauccucauuaugcucuauggaugaugaucacaggcaauacagacaccaagggcacuguuagagagggagaaacaauuugagggucccaaggguguggagaggaaugacagaugagccuucccuccaugccuauaaucuguuucugcuucaguuggcuuaacauguccagcuggugcccagcuguucaguagccuuuggagguuggggaauggugguggcugagaguggggguggggagggaaugccaccaggccaaagggucaccuccuagugcaguacagagaaugagugcugguuucuccuaauaggacugaauuucacuugcaccaagccacccaaauccccagaaugaaagcccugcuccauucaaagucccauaaggccaaaguggaaaccgucaugagcucugaaucacaccugacccagugagcauucucaggcccuacugagcaagggaggggcggagccacaggaggcccuugccgagggcuuuaaggcagagggugugccagcugugggccucugaaacaaguaucuggggacucucgccucuucacuacagcaccucaugcacucgcuuuuaugcuucuacucuuguugucauucugggcucaguggugaucguuuauaagaacacagagagcuuuccuacuugcuuagugagaugugccagugaauuuacuuuuccauacgaugaagaugcccacagccuuugaucacaggcugggcuauccagauggagacuuggccauccuagggccaagucuguuacagacuuuaugaaaauucuaaauauaguuuugaaaauccaaaggauuuguuucucagagcccaaagaacagagugcagccagcucacaccacuuggguaucugaggguccacucagccagaacgauagccaggcaguuguccaggucuucaggaaaccacuucuaaugccuuccaugcaagccagcuauuuguaagugugagcccaagucccuuccaguggcuuuuccuuggcucgaugaucaguaaagaggaaaagggguaucccugguuuugggguaccuucagaaucugagugacuuaaaugucuuguuuuggucaauagaugauuuugcccauaggaaaaaaaaaggcuccugcaacacuguagauguucacgugaacaacucagaaagcaugcucuaggaagagaacacuccuagaugcuggggaaauguggcauggucagcaugguuaauaauauuuaagaggguagccagaagccugugugguuuguucaccucaugcuaaguuccaaccauaguacaucauaggugcggaacacuggcggcuuucuucugcugggucagcagagcccaaagacaaggggaugccauggaacuggaauggaacaucaugagggauguuaacaucugagcuggcaucucgggaggagugaccuguucuacauucaacauucacaugcgucugguuuucaguccacaugacccagagggcagcaaugccagaaauuacugucaccaucacacaauguuuucugaaccuccacccugugggcuguguccucuucaacucucggcucagauauucaccugcuccauaugggccuugcugcccugauuuucaagcuaucuauggaaaaacugucccuuuggcugaauguccuucacgugccccuauagagagcaaugcuuucacaauccucucaacauggacugcaggcacuuucccugugcaaaaugcacucagcaaaaugcauucagacgcaugcaacugcagaugcugcuggggguucccagagccagcgaaguccaucccaggagcugguucguaauuaacucuuccccaucuccaaagaggucuucuuacagcauuaaccaaauggucucaauguagaaauucagguaucacagguccccuggccucuccagauaugucuccaaaggguagaaugaguugaauuuuccaaacccucaagguggaugucaggguaggguggaauacaaaauuugaaugggcuggcucaaagcugaaagcaauagugaaaacaaauggagaacucaccaccauuuccuggacaugaaacaucucugcaccaccagaugagagucgauuagggaaagagaugcugacagaugacccuggaagggugcuugggccaguguuguagaccuguggguguggaacacacacagcaagucucaguggaaaauagcagaccuccauuuccugucaugcaauauauauucuaagauucuuugaaaucacauacagaaacucuaagguucggaucuggaaggucacaacuugaaguaaagugaacuacugaaugacgggaaauuucaacaaaauagaaacacuucuaacaugcaucuaaaaaucucaaacuuugaaacuaccauauucucuuucagcauuuugucuucuuccugcuaaaacuuuucuuuuuacaugcauaggaauuuacucauagacuauuacacuuggugagaacucagacaucauaaucuaguccagugguucucaaauuucagcaaaacaucagaaccaucugaggggcuuguuaaaacacauuuugguggggggguauggagugggggucaugccgaguuucugacucaguaggucuaggguggggcuggcagauucauauuuauaacauggucccaggagaugcugcugcugcugguccaggaaccaccacuugagacccacagaucugguccaaccucuuuccuuugccaguuugagguaacugaggcccucaaggaccaagugggucaucccaaaaccaagcgaucgaauauacagaaagggcuguuuuuacuacaugagccagcugauuugguuuccaggcaaucugcagcucaucacuugcacaacuguaccccucuucugucucagcauuugguucuauaaaacuuugccucucuuguuuucccuagcauuucuccauuuucugucuucagaagucaaucauuuccugagaaaugaggaaaaagauggaggucacagagaccaguaagagcaaggagggagaggaaaaagcugaacaugaaacucgaggaagaaacagaauaugcagaggaauaaaaaaagugaguagaucucuagagacagaaaguagauuagcgguugccuagggcuggggagcaggaagaauagggaguaggacaggcagcaugacaggccccccaaagauguccauguccucaucuguggaaccugugaauguuauguggccagggggaauuaagguugcuaaucaagcgaccucaaaauaaagaggguaucuugaauuauccaggugagcacauuguacucacaagaguccuuauauagggaagaggcagaagucagaucagaaagagaacauccuaagacuugaccagccauugcuggcuuugaagauggaagggggccaugagccaaagaaugcaggcagcccuuagaggcuggcaaaggcaagaaguggauuuuccccuggugccucuggcaagaacacaggcccugauacuuugguuuuagcccagcggggcccauuuuggacuucuguucuucagaacuguaagauaacaaauuuguguuguuuuaagccacaaauguuguaguaauuuguuacagcagcaauaagaaauuaauacaagaagcuaugucaauggguuaaggauuuuucuuuuuucuuuuuuuuuuuaaacaguccagaggucuuucauuuuuuagacaccuauuaugccaugaauucauagggaacagguuccagcagcucaggcuccuucccauugguucucacaaagugugcuucucuggguggugcaggcuggugcuucaguuggacccagguaucuuucuguuuggcuuccuucuuuuuuuuuuuuuuuuuuuuaagacagagucuugcucugucgcccaggcuggagugcagugggccaaccucggcucacugcaacuuccaccuccuggauucgaacaauucucccugccucagccuccugaguagcugggauuacagguggcugccaccauccccggcuaauuuuuguauuuuaguagagacgggauuucaccauguuggccagguuggucucaaacuccugaccucaggugauccgccugccucggccucccaaaguguuaggauuacaggcgugagcuacugugccgccagcuuccuucuuuuucugaucauuuuccuucacguguuucaggaagcuaucuuggcucuuagagugcuuaaugugcucaauacguacauuaauuuucuuggcaagaaucuugcccuuaacuuguguguuuauaacaaugccaacagcaugcuggguaacaccguagacucuuucaguuuagccaugguaauacuugcggggccuuccuuuuugaacaguacccauucccuugaugucuauaaugucaccuuucuuauagauuugcauacacguggccaaaaaaacaacuccauguuuucuaaaaagccuagagaacauauaucaggugccuuuccucuuucccuuuguguucgacauuuuggcgaauuacuggaagauggugguucuggccaaaaggccgaaauuucuuuugggggugauugaaauguuccaaaauuuugcaacaacaaggacggaacuggaggucauuaugcuaaguaaaauaagccuugggaggcaggcauguuugagaccagcugggcaacguggugaaaccccguaucuaaaacccgacccccucuccacaaaaaaaauuagcuaggcguggugguguguaacucuagucccagcuacucaggaggcugaggugggaggauugcuugagcccaggagguugaggcugcaaugagcugagacugcaccacugcacuccagcagccugagugacagugagacacugccucaaaaaacaaaacaaaacaaaaaaaaaaaagaaaaaaaaggaaagaaauaagccagauauagaaagacaaacaucacauguucuuauuugugaaaaucaaacaaaauugaaccaaaacaauugaacucaaaaccaaaacaauugaacucaugcagacagagaguagagggaugcuaaccagaggcugggaaggauaauggggggauggcuguggcggggggugguggggaugguuaauggauuaaaaaaauugaaagaauaagaccuagcaauugauagcacaauagggugacuauagucaauaauaauuuaauaguacauuuuaaaguaacuaaaagaguauaauuggauugucugaaacacaagggauuucuugaggggauggauacccccauuuuacaugauuauuaugcacugcaugccuguaucaaaacaucucauguauccuauaaauauauacaccuaccauguacucacaaaaauuaaaaugaaaaaaauuuaaaaauauucuacaacuagaugaugaugacagguucacaauuguguaaacauauuaaaauaauugaauuguaugcuuuaaaugggugaacuuuaagguauguaaucauaucucaauaaagguguuauuuuuaaaaagaugaguaaaauauaaaauauauaaguuuugucaauuuaaaacuaaauguuuaaaaaggauaaguaggagagaggaaggaaugacaugcugcuugguggccugggcacuagagagagaauccagggaaucugcaacucugaaguugaggucagaagggcagagccaacaaaaagccagaaaucuuaccaggucuucacacaugacaggauguaugaagaucuagcuccagcuagcucuucccuagaaaacugugucuuugguuuucugcaauaguugguuccacuucaaagaauaaauagauaaaaacugauagagcagaugaguggguugccaacuccugauucaaaaaagaacaauauucaccaaacaaccugaagacauagaaaaggaaggaauaucugaccauagcugaaauaacuaauuugaagugaaacaugagugcacagaauuaaaaagaaacauccuggcaugucugggaaaucccauuucaagcaugaaugggguaagcaaugaagaaaaggaugcugauuugcacuauuucacucaucagagccaggaggacaggagagcuuguauuaccaucuuuauuuuuaacaaaugucuuuauacuggauucucugcaaauguucauguguaauaucugcauuauuuuuggccauuguuuuucagguggggaaaugcuuuaaauuuugaugccaaaaaagccucuuauugucgagaaauuaaugugucuguuuaaaaacuaugaugaaauguaaaaagcaggcccaagacuaguauuucugccuuucuccuguguacaauggcaguggagccuuuaaacaauuauguagcuuguugaauaaccgauuuuuaaaagcauagaaaaaucuguucauauggaaagucuuauguucuccuucaggaacaauauuacuggaauaaggaaauauagaaacauuuucuccguauuccuggccuccuuccacaguauuuucaccuucuggucauuaucacugccaagcugguuagugaccuuccugcaggacaaccacaauaacaaccauuauaccaauaaauaaguagucagacaauucucaaggaaaaagugggcuuugcuagcacagaaggaucuccuucuaaucaauggcacacacuaucaaucuuucagacccaacucucucaacccuggauugaaugcugugcacuuccugaggcaauggaucacggaggaguuuaucuaagggacaugccaaucacucauuccccagggcuggauucucuagccugaguccuauuucaggucagaugugaagaaaacuauuugccugaauaccaaacuuuaaacucacuguaaaaauuaccuucagagaaacaacuggaaggauaagcugcauacccucagauuucuuucuuuuguuccccagagggugauaagaacauuugguauauucugugcaaccccuguucuucuuuuccuucuuucaacacucauacccucuucauuacauggucuguguuacuugaacccuucuaaauaauuuucugaacuacaucuuuaauugcaagacacccccaaaacuauaagaguaggaaagaguagaaacaacuaagaugaaauaaacccaucaggucuuuaucuauuuccuacccaauuacgaaaagcaaaggagaaaaauaaaauaacucugagaagcaauucagaaaugcagaggugcuguucacagcaaucacucuacugucucaaaaacaagcucuaaccccauccuucccuuucuccccuguaaaucaagagcagggugugacagcaggggcuuaguuggucagaaggcacauccucugugagcuggggacauguguuauguaucaugguuucgcagucuguugcugggagaauacucuggggagaggaagaccauuguuugucagagcccacaaauguuuuacugccacauucucuagacccucacccugucauuauuugucauccccuaaguccaccuaggagaggccacaaggaaagaaaauaauuauuauuuagccacagcagugaaugccagagugggaaaccaucucuccauggggaaggacgcaagaggcagagaagaguucugggagguagaaccagagagugaggagauauggacuguuguguccuaugggugaguugggcccaucuccuucacuucauccacacaggguccggccagugccgccaggucuuggccccagcccggcuucucccagcucugggaccuucaggauauccuuucucgcuugggccuacauuucaugaugugaaaauuauacgaaauucaaauuucauugucuauaaggaacuaaaauuuuguuucuguguuaucuauggcugccuuugaacuacagaaguaugguugaauagaugcugcagaggccaaauggcccacaaagccuaaauuaccccauggcucuuuucagaaaaaguuugcugacccccaacuaagagaagaaacaguguccuucaugagguccacagucuacaccaaguggacuugcuggaaaugaugccugugugccugggcaagccagccauggcucagugagggagcagcgugccucccgugggggcucacaggggcucacacuccucuguucuuauaaaacugcccuuccgaaaggcuguuccccugcaggaggagugggcuccuggaugagcuggcaagaaaaucucaggaggaagggacacagcaaauccucugaggcagcccugcccagaagguggggaaugauggagaacagaaagggguccucauggggucaucugggcugggacauuggcugaggccuccaccacacagagggcuucuuggggaaaacuggcauucaugacguggaccuguccuuccaaauccugaaaaagcagaggggccugcacagcagaguaccaggcaucgaaaaggauucauucugugugugguuacagaucucacacacacaccacaccagccaaccacagaaggguuucuccugacaagagcuuagcccucuguaggagagacaucccaugugcccuuccguuagcccccacggacagaggaggucuccaggaguggguaccugaagggugauauugaugggcugaaagugacacuccaggucauccagcugaaugaaguuggcugcguccacggacucgccauauacaaaggagguuggagacaugauucugaaagaggaaagcaugaaaucugucauccccacccacagucaagcacccauggucacugccauucugagaagcaaacauuugucucaauuuaauccagugucuugcacccagugcuucccugcuggggcuguuacauagccagucugugcuuucugaccaggcaugaauaguagugucuucucaucuuagguuacgucaauaagcugcauggagaaauaugcacugggauuaccuuucugaaaugacaagauuaucauagcuuugacuuuuuaaaaacuggauuauaaaaguauacauuuucuguuuugucauucgaaaaauguuuuauggguugaagaagaugaucauaagcuuuuaaaaaauaaauauaaaugaguuauguauuuggcauccuaaaccccacucuaugacaaauucacuuaaaaaacuuaaauuuaucagacugccaagaugacuagaaguuaggcauuugaaagcugaauccguucauugauagcauuuucccuuggauuucggaggcuacauaagaggugagaagaauucaagcucaguuugcagcaaugcuuucaauguugcuuauaugaacacauuccugagaagaaacaaagcucugacugacacucccagacaaauaucgacuucuagaugcuggaggccacucacucaccuaaacacaacaauggcagauuuuugagacuaaguccgaauagacaacaacucauccauuuucaauguuuagugcauuauuuuaguaagguagugaguucccagcauuaccaaauggcaagagcuguuuuagguuccuggagagaucagagguugacucauuuguuuaacugauggcuucaucaggggcuguuaacaccucccaacaagguccucuaaggacugauuacaugaucaagugucugggggugguggggagaauguuuucucuuuguccccaaggauagggcuugguucuggguauauucuugcugugccuuugaugagacaaguaaauaaaugauacaguuaaaaauagagcugugaacagaggcaaaaauaugcuaauuugcaaauauauuccaucaguaccucauguuuaaaaaacaugaccaaaaaugccaaaagcucaggagcaggaaugcuuggagacucauuccacuggcucccagcagugcgggcuagugcagggauggcucucccugcaagggaucaacauuucuacugcuaaucaaggcugagacccagaagcacuugaaaaccgaaaaauuagaaacugugaaccuccagaaaguucagcuugcauuugggucaaggguucaguggguccucaccugaucuaaacuaauuguguaaaucuuuuuuccacuaucaaagagguaugcacucuguuuucugaagcuggaaagaaauggaguucucauuuuuccaagcuggggcuuugguugaaaacugacacagguuguuucaggucuccacagacugcagcccaggguccugcuuuccaacaaugccagcggcacugaaugaccguggacuugacccagacagacaguguggccgaugggaugguucccugcccauuccagaccauuauagacaucaggaaaagccaccucuggcucugcagagggaguuaacagaaacaagcaaagccagcacugccuguggagcuaaucagaaagugguccuccugugagccaggacuggagacacaucuggugauaaucucuggcccagcaacuuccagcugagauuuuaaucccaggagccaugcugcuuguuaccauacagcauucuggagggacuaggggcggaugagaauauaugcacauaaagguauauggaauguucaaagaaauuauggggcuuaaacuugucaucaaacuucucagauuaucuaccagguggguggguaggugggacagaggagaaaacaaggagggaggaguguaugaguuacugcagcuaaagcuucauccugcuuuucaaggcugggaggaaguggagguggcacagcccuuggcuccuggcuggcuacacaugcaaauaugagaagcacaguguuccacuggagggcacuccuguguuguggcaacccaggaccaggcuacucacccggugauggacguguccaccucgugcaucaguggcaccaucagcacgaggguguugucaugcagggauucagagcgcuccguguugccacugugcagagagaggagaaugaaugaacgcuggccaacacuagcuguccagcagugggcuuucucuguuccacuuuagaguugaaucucuacauucuccaagggcagauggcaccucauugccuucagucuguuuuuggucccuguacauaucuaucaagggcacucuauugucuugguuguguuccacacaaagauuugaguguaaguaguuuauucgagagguggccccaggaaaugccaguaggacuggagaguggagaagggagagagcaaaggaaaggagacaauaaaggcaugccauacaggagggucgugcugucggcagccagggcccagucucgcggggacucugugaggcagagucagucuuccuagcugagggcaugggagccaggccuuuauccacugacuccugagagcugcuguugcugcugcugggggugggggugggguggaaugaacccccuggcaccugccugucaggcaagugagugggcucuggccagagaaagccucagcaggguggcuggugcugggagccggaaucugcccaguuugcggauagauugggaagggugagggcugagggguuaugggcagggcaccuacugugugugcuacuuguguaagugccuguuccacgaacaauggaccaaugaaguuaggguauugcagccaggaaggaguugcuagacuucagcagcuaugucucaccugaaaggaccacccaucauccauggacagccaagcccaggaaagaggcccugaccaaaccuaccacuauaaacaucauggaagcucucgcuauagacccuggcuauagcaagucuauggggguagaucaggcaucgauauuuuugaaagcuccccaggugauucuaaaauacauccacauaaggccuccgggugagaaagcacagaacggggauucuugugagaucauucuggaaaggugaacaugagggaauugaugcuguuaaguggcuacuaugugccaggcacuaugccgggcauuucucagcauggccucacugagaccucagagcaaccccagagggagauggagcacccaccuuugacagguaaggagcaagucagauaaaucagguaacugcccaaggccccccugcaaaccagagcugagauuccaaccagcucagucagacuucaaacuagggcucucucagcugugacuccugcuccugaugccagauuugggagcgagaaggaagaggagcaaaagaagaagggaggagaaggaacaggaggaagagagagaagaccuaguuucccuuuauuacuuuauuaaauuucuaauaggaauugugaucauuauuccuugggaaaaugcguggcucuuggguacauguucuugaaccuacauucacaguugguucccaaguucacccugcaugggcggaagaaaagaguccccuagaccugcugaggcuggcucagcucauccugacuguuccccaccacgccguucccugaacaucugcugagucccugucugcucugugcccucucucugcccccuccaagcccugccccacugccuuccucucucaaccagcaagugcugaauggcaacagcacuuaaauagcucucacauccccucuccuucucccuccuauuguucugaaacaauggugcugugugacgcugaccccauagggccacagucucugcccuggcuccucaucugucuuccuacauggggugacaucagucccucaggggcauccacaguuugcaaaagcagcaggaucaggugcccacacagccugacuuccuuguccuuccuuucccaaggggugacaaaagccuugggaucacugcugugggcaggccaaaggcgacuccccuguggauggguuaacaccauccuggcccacucccgcccccaccccagcauccugccaggucuugcccugccguuuguuuggccggcucaggcccaaccgucucaucugucaucgugugacugcuccagaaugagcuaaguugaagaguugagauaaagacgucaaacaucaaaaggcuucccgucauuccaaaagcuaaugagcugggauacuuuccaguggucugcaaaagccaggcugguggcugcugagaggagagguucaagaaacugcucagucucaauguuaugucccccuaaaucuacaaguaggcaaagagaccuucaaaggguggugauggaagaaaggaacaauugagauuuuaacuguaguuuucaagauaaggagcuuuaaggaucuuuccgucauagcagggagucaagcgcugugugugggugcccuccggggcagucagaccauaucuucaccaaugccugaaaagaaaugagcaucugaaauauucuggugugugcuuagaagauaauauggucaucuuaacauuugugauuuaagaaacuagaaauuuuuauauuauugaagcuacagauccuagggcuuccugaagcuaugcagcacuguuaauguacauaggggguguucuugaauuuaguagguuacugucauuuucucaugugcccagcauuuagcacugcaacugguaaauauaaggugcacaauaaauauuuacugagugaaaaugugcccagcacagaguaagggauuauaaauagugguucuuagccuuggcugcucauuagaaucauuuggugagcccuucugaaaacuccauugcccaggucucaccccaggcagaggcagggucagggucucuggggauagaucaggcaucgauauuuuugaaagcuccccaggcgauucuaauaugcauccaaaaccagagcacugcugcuguguggacauguuauucuaacaaaugaaccuuucacaauugcaauacugguucccugcccucucugacuguuaugauuagcccugaauuagguggaggcaggaagugucuucuauuuugacaagggaaaucucuuccaugucacauuccuucccaggcauacaggcugccucagguguggaaggaccaagagagcacauugaugggucugcccaacaauggcgaguguucuguggauccaagaaauggcaagagaaugagaauuuucagguuugaaugggcaucugccgccccuuaucaaauucaucaaccucaugcucuggggccaagcuguugcacugugccacuccccuuuucaaaaacuuucaguggcuccucagugccaucaggauauaguucagauuuucuaggugaccuuugucccccaugguuuagcgcccaggcuccucuuucagccccauucccacugugcuugugugcuccccauccuucuucugagaaggugcacgaauccccaguacacucucgugcccaccaccuacacagguguaacagggcuucuugccccauggacagccucacugccgugcccauguugcuucagccugaaaacagacuccucuguuuaaaugcuaccuccccacugaagcccuucuggauuuugugcaaugggaaugaagucuacccuaucuaugcuuugcauaggcuucuauuagaucacagucauguuuuaugugauguaaauuaugugaucuugaaaauagugucaauagaaaauaaccaagucuuguggaccaguaaaaagaagcggcuaaaaagacauuauugggauaacuggcauaaucagaacauaaacugcggauuagcuaauagcauagugucaauguucaauuuccugaaugugauaacuauacuacaguuuauuaagagaacagccucauucuugggaaugcacacugaaguauuuaugaaucaagaggcaugauuucugcaacuuucacaugguuaacaaaaaaaauuauauagaaagaggaugauaaaauagaugaggcaaaauguuaacacugggugaaucuggguaaaggguauauaggaguuccuugcacuauucuuguaagacuucuguuaaguuuaagaucauuuccaagugaaaaugaaaagguugccuuggguguccaaccaccaccccaaucaaagcuugugucucccuguucacccaccugaacgccccucccuccacuggagcugccagccaagugcuaccuagaugcugcuucaaggcaugcuggaucugcccuggagaaggcaucuuguaacuccccagaagcccccacaggcacucauggcuauccuggagaggggcgggcacaugcuacugaggggagaagcugccaccccacgauccccuuuccuauccauccacuuggcuuccaaauuaagcccucucuugaguagcaucucuuggggccucugccaacaggcucagccaggcccucaggcugcaggugaccugcccacuccaucaagggauacagcaccauguccaaaagcagcagugggcccagccagacaauuugcagaggacaucugucugaucugggaaauacacagccaagugggaacugaccuuggacuagagccucaccccccugggccugucucuccucagcuguagaaucaucaccucugaguggcugaugcccaguuccucucaguucaaucugcaguggcggcuaugcaagcagcacuaggcaaccaccauccccaagaaauccaauuccacuuugcggcucaaggcuuuaucacugaguaaccauuucuuccuccucagcauccugggauucaucaaagcuuaaccaggacacauccuuuccuggucccauaaaucucucaucuuugaaaaaaguguuuaaaccccccccuuaccucugagcaguaacaaugaagcugagaacuuccucuuccccagacagguggcuuguaucaaagaucacgcugaauucauacuagugaaaaaggaagugguauuuggcaucagcaggcauuccaaacuuaaacuguucucuuccaucuucugcaguuuaugaccucuggaagcucauuugcaugauaagcuuuaguuuuauguauagcuuucugacugucaggccaaagucacagcuuuaacaguaaaaccaagccugacacauacucuggccagagaccugcugcuccuguuccgccaccgaggcucuccuuaggaagugaugcguuuacacucuuuaaccgggacuuucuaaguuucacucacauaccaucuuuucaauuucugccacaucugcaaauuacaucaccugggauauuuguucauauuuuuguugccuuacucuuuuaguuuaaagauuguuuuaaaagaacaauuuauaucacugucauagaugggaauccaggaucacuugccaaaaagagaagguaguuguaaaaaugaacacaaugaaaacagagcaaugcugaacucuguugccuuuggaagccucugagccuaaggucuacuccaucuuuguugaaaagggagauuugcuggugauagagaaguguuaaagaugugcuagcaggauuggagacguucuccugaguguggcuaggauuggaagacuauugaaaagucuuaugcgcugaauguuuguguccccccgccacuccucaaauuaauauguggaaggccuaaccccccuaugugaugguauguggagauggggucuuuggaagguacuuagguuuagaugagggugaggccuucaugauggaauuagugcacucagaagaagagaagacaaagagaucucucucucuccaugcacacacaccaagggaaagccagaugggcacacauagagaagguucuguuuaugaaccaggaagagaacucucgccaggaacugaaucugccgggaccaugaccuugaacuucucagccuuaagaacugugagaaauacaugucuguuguuuaaaccacccagcccaggguaauuuguuauagaugacugaacugacuaaggugaaaagggucacuguuagggucaauguuguucagugcugcguccacguaucacccacgauaauuucaugaaccaucuaaaauuaucuaguguaccacuuaguggugaacauccugugaguagggggcacugcccuaaguaaaugguguucaccauauacaugucaggcaugugugagaaugugggaggaacccuuggguaggggucacaggaccagguuccaccacaaacugacugugaucuuggcuaagauacugucuuugcauuucaauaaaaaaaggagguuggacaaaacgguucuuaaauuucaucaaauuuugagagccuauaacuuauacaaugucuaaaccuuuggguuccauuauggugaauucuaggcaauggucuaauauuugcaacacugaauucuacugaauguuuccugaaagcaacggacauugguccauuacaauggaccaucaucuacagugaacauggacaucucuuucuagacagaaauuucuguugcugugggacuggucagcuuacugugggguggggggcaggcauggagacagggcgggaagaggacaagaaggaagagagaggcagggucuugacugguguagagucagcacugggaggagaucugaauuaaauuaaaaacauuaaagagcacagugagaugacaggcaaaagaauugggugagaagccaaaaucagggauggaggccuggaagaacagaaugucagaaacugggcaggcugugagagagagaaauacauggccauccaagguaagccaaaguauagccaugaggcuuagcauguggccuggagccugaggacccucaggguuggaaggacaugggagugcacgcugggcugcggauacggggagccccgucucugcugggugacuuguugggcuuucuccagggaaucacccucugcucccaugccccccaauccccagguuuagucagucuugcuucaggucccagcaucuguaugugggaggaaagugguagcauuaccagcugggaaaacaaccaacauuccaauguucauacuucugugggcucuaucuaauaaauguuggcugggcacgguggcucacgccuguaaucccagcacuuugggagaccuaggugggcagaucacuugaggucaggaguucaagaccagccuggccaacacagugaaaccugucucuacuaaaaacacacaaaaaauuagcugggcaugguggugggcaccuguaaucccagcuaccagggaggcugaggcaggagaaucccuugaaccugggaggcggagguugcagugagccaagauugcgccacugcacuccagccugggcgacagagagagacucccucucaaacaaacaaaaauuugacaaaauguaacacuccacuagagagagaaagacacaucuuaggucugauaugugauauaggcuggaguuuaaaaugaaauggaaacuguugcaaguuuuccaguuaagccuauuaucuguuacucaaaagauuuuaauuaaauuugugugcagaugugccacauacauuacuauaggcaauaguguccauggauuguggucguccuccuuuaucuccacccucacccuaccuggagucuaaugggacuuggccuguacucugccauccacauguaauccauuuuccaagggcagacacuuauugagguuucccuccuccuggggugaauguggacagaaugaggaagagaggcagaaaaaaauccgaggagucaugggccacuuggccacuuggccacugugguuucgccaagaucacacaguuugugguagagccugguccuauaaccccuacccagggguuccucccacauucccacacgugccugauauguauauggugaacaccauuuguuuggggcaguguuacccaaaucacaggauguucacacugggagugguacacuaagauuauuuuaggugguucaugagauuaucuugggugauaugugaacacagcacugaacaacauugacccuaacagugagaaaguuauuaccuuuuugcccuagucaguuugggauucuaucacaaauuacccuagcuugggugguuuaaacauuuauuucucacaguucugaaggcuggaaaguccaagaucgaggugcauucaauggggcuuauggguucaagugauuugcuaagaaaugaccaagucuucucccucaccagaauauucucaccauugguuuacaaauagcuacuagauacugggaccaaagagccuuggagauuaaaaugaucugaguguaugacccaggcaggagaaaaggaugaagcuuucacuuuuuuuuuuuuuuuuuuuuuuuuuuuuugugagacggagucucacucuguucauggcagggaaaauagcuuccauuuccaaaggcagacuuggucuuuuagauucuaguuuugccuccaaucaccacaucuuuuuaccuauguuuguaucuccuuauaaugauggcacauacuacaauguuccaugaaugucugaagaugcuguaguauacuauuugaacuuagaaaaucugucuccauaccaauaccaaagugacuuaauuucuuuacucuucuuaaaaaugaagugggauacagguauuuauguuuugagaauuuugagaguucucuucagaaaacugugagcacccaagggaaugacaggacuauaggugacagaccacaucuucuucuguguugucuaggggacucaaagaggcacagaaugucucagaaaaaaaauuauuuuaggaaggucaacuaaauggcacgugcuaaagugcagaggcugugguguguccuucacuuucacauuugggguacaucaugugaaucgaagagaaagaccauaugaugcagccccuccggaguauaccccgguguacacagccagggacaggagcaugucagggcuucaguggccgccccagcugcuaugggaggcagggggugggaggacuccucaccucagggaggcggcggaaucaguggcugguggaagggcugggggccugcugcugaggaagggucccgucugugucccuuaccuuugacuuugaccucaugaaaggaaaucccacgcugcauuugaggaaguccgauuccagcagcucacaggagaugcccaucuccuccugaaagaaaaagcaccaacagaugggccggcugcacaaaaggcaggugugugggagcaggcuccacggggcaaucgaguccuucagagcagugcucagacgguaggcaccagugggacgagaugcccugaccaggccgucuccagcccccuuccagcugcccacuuuuucauggguucccugggaagacagguaagaggacaaaaccacucuucauuccuaacuaaugcuuuggguucaaacccuagggcaguccuggugaggugggcugggccauggcugagcuggagaccuccuaagguuuggaugaaaaggcaacccugucaucuucuuggccccuuucuccuaagcccacacccuaauccugccuuuucagaucuuggugguucaggaaagacaaacucuaagaaaaucacaccaagaaaagagaggguuucuuccuaaagccugaagcagugagggcugggcuguccaccagcaagucuccccaggguguggggaggguacaagggugaggagagguuuccaaguguagccagcuuaggcuggacucugcacacagcgacuugagagaaacagaagagaaaggcuguagggaacugcugucuuuccaccugggcacauggcuuccaaccaaggucaaaggaaagccaagaggcucuucacaaaccacagggcuucucagagucacugaaagcaaaucaagacugccaagcggaaacaguauguuuacagauuuuggaagagaagguacagagguccuccaauuuccaggacucacaucucagcucagacuaacauuucaaggcaucuagacagguggaugaaaaacauuuuuauuuuguguccaacugguaaaaacaugugagcauuuaccauaauauaucuacuuaaauuauccaauuauacauaucuuauuauucuaauauauuaugaacauuaucaaaugcaccaaaaauaaaggugauaaaagguaaauaaucuauggggcuagaaaucaagacaguaauuauggaauaaguggaaggcaguucugagugcagguuacacagguuugaucauuuugugaaaguucauugagcugggaacuuaauaacuuguauauuuuuguuuguuuguuaaacaucaauacacucuuacuuagaaaauagcaaugaaacaaaaccccuaaaagcccaaauacaauuaaacaaaagauaagagauauauaaauauaaaacuaaacucuaauauaucuuuucagcauccagucucggauauaacugaucucaaugaugauuaguuuucuaacaucucucugugcucuuagccaguguuauucacacagagacccaggaucgccagcguuaguaucaccuugggagccucuuuaagguugaggcaggagaauggcgugaacccgggaggcggagcuugcagugagcagagauggugccacugcacuccagccugggcgagagugcgagacuccgucuaaaaaauaaauaaauaaauaaaaugcagauuccugggccacacucuaauugcacagcaugagucuuuucugaguagacacagagacugcagggucugggaugagcauuuuuaauacauaaaauuauugagugauaaaauuagugauucugccggauaaugauguuugguagcugcugcuaugagcuuuccuuccccuucaguccauuuggcuggcugccagaggaagcuucuuaaaauaugucuguccccacugcaaacagaauaaagucucaaaucuuaagaucccagcuuccauuuuggcccauccuguucuguugugguucuuccaccccugccccguggcacguauaugcuacuauucuacacacacccugccugcucuuauguucacaccucuguuuaaguuguccucacugucaaggagcaccuuuccuuagcccuucccccaagguuuucuuccucugucuuguccccaaacacucauggauggcaagcucauguauguaacaugcaaauggcacaggauucagaacgcgcccugagcaugcacuggguagcugaguugucguaucacacaccacauuucagcacugagagaacauaucugagagauguuaaucgcuguccucguagagcucagaguucagaagagguggggaccucccagcagagacauagguguuuacauagcugugugauggcaagugugagggcugcucuuagaaccuagagaacaggcauuggcaauuucaauaaggaaaaccagagaauaauuucucaaaugcugucucaagaacugcauggcauuaaugauucaccauagauggccuuucccuaccaucuucuuccucauauuccuccugccagaagcaacacccacaacugucccaaguagacacuacccuaaauccuggcuaauuggccuguggacaucagaggcagcaagccaaagucuuggaugacuuuaguucucuugguuuccuggggacgguccugguucauuucugucauucugguauaauuagucucaagagugucccaggauaagcaaauauauauaaguguauguguguguguguaucucacacauacacauauacauauauuacaugcuuaccuaacucuguuuccaguuucucuuguaaugcccaauaccucacugggaauuccuuucaaaccaggagagaagcuuuaauuuuaagucaaaggucuguucuugaaguaaagauuuauuggcugggcgcuguggcucaugccuguaaucccagcacucugggaggccgaggcaggcgguucacgaggucaagaaauugagaccauccuggccaacauggugaaacccuguuucuacuacaaauauaaaaauuagcugggugugguggugcaugccuguagucccagcuacucagaaggcugcggcaggagaaucacuugaaccugggagguggagguugcagugagccgagaucgcaccacugcacuccagccuggugacagagcaagacucugucucaaaaaaaaaaaaaaaaaaaaaagaaaucaaaaagauuuauugccccaaagacuucuucaguuuuugcaugugugaaauaaaugucuucaaaaauguacucuggaacucgaggaaaccucaguuuaauuagcuuugaccuaagacaacaguacuuuugaucauucaaaagcugcucagcuaccuuauuuuuguuaauucccaaaugcuagaacguaacauuuauaucagcauuuauuuaacuauuucuggucucucuuccaccuuacucagucaaauaaaaauuucaaaauucugguuggaucuuggugaggacaggccaaaagaguaaaccaaagacaucaucucuaggaacaagagagcugagcuuaugguucaugacucaugugcuccgggaugguguuacaggaagggaugucauggauuacccuucugcugccugucagcaccaacauagcuguuuauacuggccaugucaacugcccugaccaaauguuuuuaauucuauaccccucucuucuacuacugugauuuccaaggaggcccagagguguaucagagcaugggcuuuggcaagcaguaccacuccuuguguggaugcugguggugcuccacucagaaccccuuacuagauaaguacaacagcuugaauggagucgcuuugccugggagguuaugacaccuuccccaaaagcauuccguagccucugauugauguggguacccaaggauguccccuuugccucaagacaagaccaacucuguuguacaauuaauguuccagagcucccauaggacugggugaagcagacuccagcugagcccacaugccuguuugguuucuuccccuccucauucugcucccuucgcuccucuugccccaauaaauccccuucaugagaguccaucucgggugcugcuucugaugaaccugaacucagauaauacucuucccuuaugaggcugcuggcaccgagaaccacuuggaaaguccuaggcauuugcucccagguggggagaggcaacaaaaggaggaugaggagaaagcucacguguuuaugauucuuguuuaaauccauacuaaggaagagaaaacaguccugacugcaguuuauaaagguugcaaggcuucccccauuaggggagcacuucauucaaggcaacaccaguacccacuuuguucuccugguuucagaucaugcccagggcauaaccuuaaaaagcagagucaucauggagccacaugucuucuuggcagccaggcaggcacccaagagucacagacauacccacaagguaauucuuuaaauaaaaauaaaaucccauguuuaaaauggauucaauuuaaaaaaucaauucaauuaaaaauacaaauuuuggggagauauggcuaaucuaagcuguccccagcucuaagcaacaugucaguggagagcgcucugguugggaguugccuaugacuucugccaggcacuugguauccaccaggaugcauaugggagagauuccagggaccaggcuucuucugugcucugauugcuuccaaguuccaaucauugccuacacuggcuuuaacuuagagaacuuaacauuagcauuuaucaaggcugaugguuaugagacucuuagcugacugggaacgcggaccagugagcaaacugucuaucuaaugucccugacugcuagugcagacaucugauuaucugacuacaauacaaugcaaaucaaauacagagugaagcagaaaucuugcucuaaaagaugcagacuuucaugaaaucaaugaaagugauguugaaaaauggauaaaaccacugcaaaaccacugauaaaucuggaucuggcagaguuagaucaguuaacuguugaaggagucaaaauucuccuggauacuacuuuaagaugcuucagaagacaaagauuuaaauaaaaaagaucaagagaagcccuuagaaaaaagugaccauuguuaaaaugauccuuuugugauuguaccgaaaaccagacaaaauaugaagcaaaggauguuaucuuaugaaauaguaggaaaauucacauucaaaagcugccuauccagcacucaauuccuucuuuuguuucagaaguuagggcacuguuauuuuaaagacucuaauaaagcaaauaaucuuuugccuuuggucuaagauaucuuugacaauuauaauuacaauguuuugagugccacugaauaaaugcaggauaaaauaaaccuaauuucguaauuuucaguuucacauuucaggcaaagucucaaucaaaacuuuuaaaauacauuuuuauuauaaaauuuuagacccuauuuuaagaggauucacauaacuggccuuuuccccagucccacuuuuccuugucuggcaaagacguucaauauucucaggguuucuugcugaagauuacagaagauucaauuaaaaauuucuacuaccauacagauagucccugacuuaugaugguucuacuuaagauuuuucaacuuucugaugguguaaaaacaauagguauucaguggaaagugguagaaagcuguacaauacucucaagaugcuggccagcgcagcgagcuguagcaccucgucagccacaucaucaccaggguaaacaaucgauacucuauggagggcuguguugccagaugauucugcccaacuguagguuaauggaacuguucuaagcauguuuaaguaggcuaggcuaagcuaugauguuucguaggcugaguguauuaaaugcauuuucaacuuaugauauuuucaacuaacuauggguuuaucaggacauaaccccaacauaguucaaggagcaucugcacauuacucucaggaucaggaaaucaucaguuaacauuuuuaaaaacacagugaugaaaagcacacuugauuuaugcguacucauuuccguauucucagugucuggcaccgagccuggcacuuaguagcuccugagucugcauuuauuaaaugaauaggccuuggcuuaugggagaugccaaagaaggggcugcaagaagcagcucauuugcuggucugccuggcacaagagaugcuugucuuggcaaagaccuucucucauccagacauaccuugccugucccagccccggaagcuuggccaguagacccaggcuacagcccuguuuguaacgugcagugguuggaagaaucgaauaaugaaauuagugagccucuuuggccuucgggcuccuuccucccaaucauacaagcauuugaugucagucuagacucuggccuuacuugaccacgaauauggugcucuuugggaacagaauaucuuuguggucagugaccugcuuaugcucaaugcuagguagaguuugaagucucacuuccaacuuucuaguucugacauguguuuguuaaacugaagaugacccuggugucuccauaucugacugucagucuggcaauuuguguuccucuaagacccuuuccuucuuccagacacaacaagcgugacccuugugggcugguaaaagcggcuuccacguuaacucacuuaguuaauuuagaauucaaauaaauuuuggaagcacuucaucccaaauuccccaaucaacugaggugucagaggugagcacagguucuuaauaaccuggcucaaugaguuaacagaaaacauucucagcaaacacuuuauuagcagcacucaaugaugagucagcuugaaccuuaccagaacagucguauucccagaggggaauccuucgggcuugagccauaaaguuccuacccaugaagaaaaacaccugagccugcagcauagaaauuguaaaaccuuuggcauuagugucccaauuuugauuauuggcucagauauauaccagcaauguguugucaggcaaauuaaccauccuuucucuaagccuccaguuccuuaccaguaaaaugaagucauaacaugugccuuauaggaguauugcuggacugccacugcugaugcguguaggauggaguacauagccucuacuuaguaaugguuuacugugugccagguaguguuuuaaauccauuaucuaaaaacucuauguacaccuucucuuuauuuccauuuuuaugaggaggaaacuggaaugugaaguuauaucacuugcccaggguuucccaguugguaaaugauggagccaggaugugagccgggcacauuccuucccaaagcuccucugcauguucuccuucaaucuuaacuuccuucuccugacccaacuccccugccuaucucccuacagaacaugacauggugcuuugaauacacacagguguggggaaaaggccugucauuugaacagcauaugaauuacagaccccagcugucaagacauucucuuccauguacuagauucacacuauaccuugucuccugccacuugcucaggcccugaugauacacucuuggcugaggguuacucauggauaguccuggagucagaacaaacacaagucaugguacucuugaaucaaggaagacuacaugauacauaacuaagaaaauaugaaccucccacuggaaugaagccacauaagcaagcacuccuguugaucccugagcagagaugcagagggugaacuguuuuguugauuugcuagucaaacuucugaaagaggcucauguagucaauccagcaggggucaugaaagaucagaggcagaugggaucugagaagucacagagagggugcuuuucuuuguauccagaauguuggcaacauucuggauacaaagaucaaguauaagccuuccuggggucuuaacauacucaaaguuucccucugaaaggacuuauacaucauccaucuguacauucauuaauucacucaccaaucaucuaacaaacaccuacaagaugucagacacagaauggggagaauacaaaugacagguaagaagggauuuugaccgggcucaguggcucacgacuguaaucccagcaauuugggaggcugagguggguggaucaccugaggucaggcguuugagaccagccuggccaacauggugaaacuccgucucuaauaaaaauacaaaaaauuagcugggcguggugggcagaugccuguaaucccagcuacuugggaggcugaggcaggagaaucgcuuggacccaggaggcagagguugcaguaagccgaguuugcaccauugcacucuaggcugggcaacaagagcgaaacucugucucaaaaaaaaaggagacagcauuuaguaagcaaagacuccaaauuaacgcauuuuaauagagggggaaaaacuauugguugaauacgauccaggcuauaaggaacuuauaaauaaauuguuccaagagcucauagcagggugccacccucuuugccugguggaguaaauaaaaaagcaaauauaucaaaaaaggugacucuaggguaggucuugaaaggauaagaauuugccucauuuggguggaauacugugaugggagaggcagugacauaguagcagagagggugaaaugaaugggguagauguuucaggacaaggcuaguauaggguagcaccaagagagacagcaccaggggaaguugcagcugugugcccagaggcugaguggcauucccuuccuugaugugagcccgaggcuuccagcuacacaggcucugaagccagcuucugaaugauacagcagauccagcugugaagaacuuccauccucugcuccugggagaaauacugaagucagagggcagacauguuaauuuccaaugagugacauaguugcccugugcaacauggggcuccugucagcagggccagagaauuccugucuuggaggccaaaaagggaaagcaguugcaaucagaagguugcuuagugagucaaggaagaauuuuacauuuugagaaccacuuuguuuacuaacucacugaagagcuauucacugaccgcugcccuauaucacgcccuguucuaggggauggggcuacaauggcaaacacagcgcugccgucgcagcacaugcagccuacacggggagauggcaaaaacaaaaaauucaaaaggaaaugaaaaauaacuggcagggcacagugucucaugccuguaaucccagcaccuugggaggccaaggcagguggaucacuuggggccaggaguuugugaccagccuggccaacauaacaaaacccugucucuacuaaaaacacaaaaauuagcccaguuguaguagcacacaucuguagccccagcuacuugggaggcugagguggaaggaucaauugaacccagcaggcggagauugcagugagccgagaucgcacuacugcauuucauccugggugacacaucgagacucugccucaaauaauaauaauaaaaauaauaauaauaauuacaaaaguagcaaaaaaaacuggauaaucuggauaucaucaaaauuuaaaacucauguguuucaaaggacaccauuaagaaagugaaaaaauccacaggaugagaauauuuuaaaucauaugucuaauaggaacuuuaggauacauuuuuaaaaagucuugcagcucaauaauaaaaagauaaguaaccuaacuaucaaauggguaaaggaucugaauaguuuuuccaaaaaauacauacagauggccaauaaucacaugaaaagaugcucaacaucauuaaccuucagggaaaucuaaaucaaaaccacaaagagaugcuacuuccuacucauuagaauggcuacaaucaaaaagacaaacaauaacaaaugcuggacuagauguggacaaacuggaaccauuacauacuacugaugggaauguaaaauaguauaguggcuuugaaaagcagccuggcaguuucuuaacagugaaauauaaguuaccauguaacccagcaaucccacucuuagguauguacccaagagaaauaaaaacaugagcccacacaaaaauguguacacaaauauugauagcagcauaauuuguaauagccaaaaacuggaaacaaucuaauguccagcaacugaugaaugaauaaacacaaugugguauauccauacaauggaauauuauucagccaugaaaaagaaugaaguaugacauaugccacaaacaaaugaacucugaaaacauuacgcuaagugacagaagccagucacaaaggacuggcuccauuucauauaaaugauuccacuuauacacaauguccagaauaggcaaaucuagagagaaagaaaguagauuucugguugccuuuggcugguggaaauaggggaagggguacgacagcuaagaaguauggugguucuuuuugagguaaugaaauguucuaaaauugacucuggcaauagaugcacaacucugaaaauauacucaaacccacugaauuguauacauuaaaaggguuaauugcauggcaucugaacuauaucucaacgaaucuguuuaaaguaaucacagccugugagaggcauucugaaggaggcaaacagcauuauaccugguauagguggagggaaggcccuuuugaggagguaccauuuagcugagaccugcaagcuaagaaggggcuaagcacaugaagggagagugaagagugucccuggcagaagaaccagcauguguggggaaaggcauggugaguuccagaaaccaaccagaggccacacguuugggaagcaacagaugaaaggccaggccaugcggagcccugcugcucaucaggaguuuggacuugguuccaaguacagagggaaggcacuggaggguucugagcaggggagucauaccaucugauucacauuuuuaagaauauuuuuaguugugauguaagaauagaucagacggggccugggguggggaacgcgcaacaaugagcagaaaagguuucuuccucaccucucccaaaacauucauggaaauggagucugaagagguguggagcacagaucagauaaacuaaaaguauccuuaaggaacuggagcacacagugacuccagcgcagaugccaaaugcagacaaugggcuggcaaggcugggaaggagcuggccacgaacacuccgagggaaccagaggugauuacccaugcacuuggggaauuuggagaagcaggacaaagaaagcacuacaaagccaguugcuuccuugaaauuuugucaaaacauccauguggaagccaaggccuacacuauucuaaguuuguucuuuccaagcuuaaaaaagugaaacaagcaaaagcuagagucaaaacaaauguuugaggcagaugaaccauguaacugcuaaugcaaaauuccucucccaaguuagguagugaaauuuggaggccagguauggauggcucacaccuguaaucccggcauuuugggaggccaaggcaggagguucacuugaggccaggaguucaaggccagccuagacaacauaguaagacccugucucaacaaaaauaaaaauuagccagaggugguggcacacaccuguggucccagcuacuugggaguugaggugggaagaucacaggcccaggaauugaagguugcagugagauaugauugcaccacugcacuccagccugggugccacagugagauuuuuucuuaaaaaaaaaaaaaaaaaaaaaaaaaggcaagaaaagaaauuugauugaagugcacaugaaauaacccugugccaaucacuggcaguugcagacuggcuggcaucagaagcaauuaugugaucaaauggagacggcgaggucuccucccaaagaguccacuuggcccugaggaaaaaagugcuuugaaagauuuaaaauaaguaaaaauaaucuuacauuuuaaaaaaccaauacaaauucaaaagcacuugaauaagcugucucguuccuaacgugucccucuguagugcggugaaucaacccugcuuaggacuaaucuuuacauuuuuccaaagugaauaaagacaaaaacacuccccuaaauccuggugauuguccucuucaggaccacaggauaugaaauuaagaagcuaaauaaacaaauaaaucuaagucaaccagucguaacagaaagcccaaaguacaaagacuagcaagccaucccuucugaagccuaagaaguaauuaaaguauuugaugcucacucaggaaguuuuuccuucuguuaaauagucacaaacgaauuauuuucagauuuuuaaaaauuaguuuuucuucaauuaaaaaaaauuuccucggaggcugcaaauucuuagucaacaaacuaagaauucaaguugaauuccaucuaaugaaucaaguuauuuuuauuuucuaucacucuuuuccuuugccuuauaggcugacggaaaacucaacaaguggggaccuccccugaaaugauaggaaagaauuuaaccucauggcauaaaaacaacucaugaaugguguuuggaugaaaagguuaugcgggagucaaauguuugaaggggcucagguacuuacuaaaauccuggccagaaaucuucauagaaauguacucauggugaagaguuccuucucaccugcaaacccccuucuacucugcucauucaaaacugguuugcaacuugaagcugucaaggucuugcuacucaaaguguggucccuggacaugcucacuguuagaaaugcagauucucaggccccacccuagaccugaugaguuagaagcuaaccucugcgaacauggacauuugagaagcacugcuccaugucacugagcccucccuggaggaaacaugauauucaccccacgaagaccaccuuccucaugaugcccucugcccuccagaaaaauaacauauacacugcccauguuauuugagagauauuuccugugugaguauacacuuuucuggaacugaagaccugucuauucacacggcccuuaucugagcagacuuugggacaagcauuggggugcaauuaguuuguaugggcagugaucucagggagcuccaggagaggguagugaagugugucaucaacgggugagaaagcuggggcaucuauccaucucaccggucucuccuugguagaaaacuguacuggggacguuaacuauccugcacuuccagcccuccugacucgggugcagcacacuccuguagccagagaaaguuccuaaccagagaaacaguucgccuauggcgaacugucauaggcggccuccaggguggguggaggggacauggaggguguugacagcaucucucccacauccucucccucugcacaagcaacugggcugguggagcuguggacugagaacagaggccaggggcagcuacugcugaacuuccuuuggcugaagaugaagggauggggccugagaggaccucuuccuagucuagcaccuucagaguguaucuccacagaucaaccugucagcucauggagcccugucucagggggcagcagcuuacuaaucucuucccucggguuggcacauccacuuugcuacuccuggguacaucucaggacucuucuuaaagaacugguauccacuucuaggaugauccuuccucccuuucucuuuguugcuucaacaggucagcuccaaucuccucuuaccuagaccagcacaaaacggccuccugguggaugccuugcacacaccucucuccccugauauguucugcaaacugccacagaugaaucccaauaugacacuuuguuuuugcuaaaaagccuucaaagguuguuaacaagcaacauucuucauugguucuuaacugggggugugcacuggaaccaccugggagccagagaugccacacccagcugugcaggcugaucacugcauagaagaccuggcugcucucaccaagcccuucaccuuggcaugagucucuccaauuugcauaacagugcuggaaaggugacgaugacaauccuaugaaaagcuuuguaaaaaagacccagaugcaggccccucuguguggccgcagaauuaaugcauguggcgucggcaugcauuugcugaaagcuccccaggugguucugauggacaaucaaguuaaaaacccucaaaagugaaacugcauugaaauucucuggugggcuuguuaaagaugcagauugcaggccccagccuccagagugggauucuuuacagcagaagcagagucaggaaaccuggaucuugaaucaucugaggcaaguguucuacacuagccuuugaaacacuggucccaagagcuaauguagccacugccauuuuugaaguuaagagauugagaccuagaguaugugagaaaaaaaaugccuucucugggauucuuaugcuggugaggacugaggaacccugguauuaugguccucucugucuuugagucaguugucuggagccuccuaugucaugugccucuggggcagggacucagagaaaugaacucugcagaccauggcuggcuccaacaugggugccuaccugcugugcucccagaggaagcccaucuacucguucaacaaguguuucuuauuuugucucaaaugggaaacagcuucuacacaauaauucucaugugugagacacguauguuuucuguuacaucuuacauuccuuuguucaugcucucauuuaauaauuacugaguagccucaguguccuuuguugggccauaugccuuuguaacacaguuccugcugucuccaaggagaaguucccagccuaggaggaagaagaagaacugguucaaggaaagacacuuaucaucucacaugaugaaugcaugggggugcuguugcaccaggggcugaaacuggccucccuuuaccagagaagcauuggcuguccccauucccaccccacaggucguauuuuacagcucauuguuauuaccauuguuuuaccuuucaacuaacuaaaaagucuacuaguuauuuaaauuauggaauccaauacuggacuaccauagucauacuauguaccauaccagugcuuacuuuagugggaaaauuagcucaucauuugcacacugauauggucuggauuugugucccuacccaaaucucauguugaauuuaaggagggaucugguggaaggugacuggaucauggagguggauuuuccccuuauuguucuugugauagugagugaguucucaugagaucugaagguuuaaaaguguguggcacucccccaccagcccccuucucuccugccaccaugugaagaagguucuugcuuccguucaccuucugccgugauuguaaguuuccugaggccuccuagucgugcuuccugugaagccuguggaacugucaaucaguuaaaccucuuucuucauaaauugcccagucucggguaguucguuauagcagugugaaaacggacuaauacaaacacauaggucaaaagcuauuacaaaugacaguaacaaaaaacaccauucauaaacugccugauguagcuaaggguuuacuuauucagaacuucaucaggcuuaaagacugugaauaggccuuuguggcugcaguagaacuucuguucugucacgaacuuauucaacagauagugagcucaucuacugugccagguguggagguaugugaguauagcccuguccucagaagcuuuuccauuaaauaucagauguaaaguaauugccuuggcaguugauguaacagagaaacauauaccagcuuagggcugaagcuuuaggaaaugcccacgaggacaggaaggagcacacaggcugucucuuaguguguucugaucaugcacacaucaaagaaaagcccgaugccaagaaccucggugaucaauacgcaauuagaacaagggcaagacaguuuuacaagagcacugaaugacggaccuccuaauauaauuaaaugaugaaguuaugugucccuuuuguauuuuuaagaacaauauagggagacaggcuuugccuuccaagauuaucuuacuuuucuccuauauuuguuuuugacauuuuucaguuaaugggccagcuguuuaaaacgacuugcacacacaaauaguaaggguugcuuuugguuauggcaauggauaagaucuaaauucaaucucaauagagucauuuuuugaaaauuaauuucuuugaaaaaaaggaugagcugcagggccaugagauugccuuaagaucuaguaugcuuguucugaacuuguuggaauauauuaaacuuccaauuauguuaggaguuggcuuggcugugagggagagauaaauuggccauuuacugauuacuucccaugcuuugagccugcagaaguuguugacugagcaaccuuuucugugucuguauaugucauuuucaaugucucucuccucuacaggauaguuuugcucauucuuuuucucccuuugaaaauuuuuucaggugccuugcuuuccauaccauuuuuucguucugcuucagauggcuggacuggcugcauaccaucucucucacagcagaguaugggcgggauguaaaucccacaucauggagcuccauccaggggucucuaccaugcacaaccaugcacauugaccccccagaugccaccaccugugugucuuuugugggaggauggccacggggcuccuggcaccuucuuugcaugaacauggagagauggaagugcuugagaauucacauccccuugggggaauccucagccaugcucuuuugucccugauugggacagugagaugugaccuauacuuuagacggugccaaagucacccaccuucuuucugucuccuggggacuuugcuugauaucacauccuuguuuggccuccuucccuuugaagcucuacuucccauuccccugagaacacuuccuaacaaauuauuuuuacaugaugucucaucucaggauuuuguuuuagggaacucagccuaagauagcaggaaagagacuaccacacaaaaacaucuagucccccucuucuccuuucugguauagagaugccagucagaggcaguguaaacauuucagacucugagcaaguggucuuccagguccugggaaucucucguccuaucucaugcuucaauggggcagccaguuucaagcaaaccaggauuuuuuaaacaaagaaauccacccgccaaacauuaaggauggcuuagcagacuuaugugacuacauauugauuuuaauccacuuaagugccccuuaaacauggacucauuuaauuaccauucccauguguuuucucuuugucugcuuugggaaggaugccucucacacuguccaaaccagccuccagggaaugagggcagaggcccugaacagcagguugaagccacucuccucuuuacagauuccuaggggauggaacugggacccugaaaaugucucaaauugucauugcacaaugauuauguuuuuuucaaacugacuuggcucuaccacuuaucaaguggugccuuaaguaccucccuguaaaaauacagauaguaacuccuaacccacagcguugcuggaaugauauaaugaguuacucugguggcugccaccaugguaaugguuauugcuauuaggcucuaagagaaacuuuucaagaguuuucuuugcucugucaccuacaguuguagauucucaagcuguccaaagccacucucagaaugagacccuuaaccugggugggcugccucaacauuaacaggauggagcuaaccuguccugagcucugaacacguggcauuuugcuaaacauuuugcuaggaugaacagauugaugcuucucauccucaauccaguauuaugauuguuccauuuugcagaugaggacacagagacccagagagggugagggaacuuuccaaggucacacaacagcuauauaugguagagugaucaggucccaugcugccucacagaugcccguauucaguggggccuucagagugcauugugcagaggagguuuuccuuccuuugcucugggauaaccugcccguagcacaguggcucuccaacuguggcacacauucgagucauggaggcuugcuaaaacacagacugcugggacuacccccagaguuugacucaauaggucuggggaggagcccacgguuguuuuucugaccaggccccagcugguguggaugcuaguggucaggagaccacgcuuugaguggcacugauguagauucuagaaacacugguggcuuccuucccuugggagggaagcagcuuccuggaugggacccacauggaggauggucucauaggagaggggaagaaucagccugcugagcccauggacucugagagccccuucugagcaggggaugcugagaagucugcagggcccguugccccugaccuguggacuccucaccagccaccagcugucacugcgacauccagauguuaccucccuccaagcugccuccaguuccccuucuaaaauaaaugaggcuagaaaacuuaagaauggugcuguggugaggaagugcugaaaaggaacccagaggaggaggaaggaauggacauacauuuacagaguaccuucaucauuuugcccugucuuauuuaacacugacaccgugagguaggucuuauacuucccaccuuacagaugaggauaucaagccucugagaacucaggcuacuuggcaauauccauguaacuauuaaguggcugaaacugggauuccaacccaguucaguuuggcuccauggcuccugcauuuguuccaccccugugacuguccugaugggggacacccugcuaggcacaucaucaugcagccacuguccccuugacacugcacaggcugcagagggagggcuguggcucaaugcagcauuucuaccaggggaggaaauguuuugcaugcagccuuuuaaaccgugagacagacacuggucuguguaggguuucccaaccagaaauaaaaagauuggagggaaucucagccaccuggagggucauccucagcucagaaacagccguguggcuguaagcagagcagcccgggccuuuagggcuggccaggagacccuugcuggcaggcagcaugcccauuugugaguccccaccagcagcucccuugugaagaaagcucgacaggcuuuuuacaaaaggcaaagcgaguuuucuuuggcagcagguucagauuuccugcccuguuccaugaucucacgagggagugcugaaaguaccucccgcacccccuccccagcuccaaccagcucaguuccacgcucagacuuucugcuuauuuggggagauuguuuguuucuugucuuuuuaauuugagacccuccucccuccucccucuguggcucaauccauggccccagucugcaucuggagacagcaucagucccuuccacugaaccuuuuagcugaggguugguggaggagggagugccaacuuuguguggccucagcugauggauuuuuaacugcugaaaaaugacacaugggaaaagaaugcugugcuuaaaucuuacacuuaggcagcacuaaaaggugaaaggaaaggucacaugaacuucuagacaacaaaagcucccacuuuuguuguccagacagcugaguucuucaaagggcuucugacaggagagacagaaauucugucucccaucagcgagccaucaucccacgccacugucuucaguuggugggguuuuaauccagucacuuccagagcugcuggucuguccuagagcuuuaaguggaagauggccacagagcacucaggaccaaggacuggaaaggugagacccucguccuucaucaacacuaguggggcaggaggaugacggucugcaccugcuauuaucugugagacucuggccaagcuacuugccugcucugagugccaacacuucauugguaaaugaggauaacaauaccauggcagacauguuucuugccacccacauccaucuacccuucccucuggggagccauccccuccccacuccaccucacucccaacccguuaggaggugggcaugcgacccaggcuuaacucaauuggaccaaucagacucuaugacauuuuugcaagaacuuuuaggaaaugagauuauuuauuuacuguagccuggcaaccauuuugccacccugaagggacagagagccuguuugagaacgaagccaaaaggaggaagagaagcugacagauggagagagagaaagagacacuaugacaacuuccagagguccaaccagaagcuguggucgaagccaaccccagguacuuucaguuugcaaaacccuacauucucuuuuaccuacaccaauuuagguuuucuauugcugucacuagaagaguuaaaacaaguacagauaccucacaguguucagagaagcaaauuuaaucaaggcccuagaaaaaaggacagcccacagaguaggccucugagcuguaguucugaggccugguucccuaagugggaaggacaaccagccaccauggcuccagacaccaaaggguggguggggaugcucaccagaggguuucaggaggacacauggaaauguccacacugaggugggacccucuguggucaccuggaaacccuugaggagugucccacaucugggggaggcucagagccugcuccacagggcucacaugaguucccugggaugacacucguggcugugcccaauacagcuccugccgcauaggagguauguuccuccccucccuggcacauucuaagcugaauauuugugaaaauaaauccagaaaaguaaauacaacacugaacuuguccgugaggagugucccacaucugggggagccucagaacugaccuaacuuccucaggccccaacuguacaggugacuugggcucaucuguauuugcagggcugcucaggcuuacuggacaucaaaccccguccgugcccaccagcauucagaagugcagcugcuggacucuggagggccaagauucuguuuuuaaugggugccagguacugcugcaggcacuuuacacaugguacuuaacuuauaaguguagaacauugacccuaaguacagugguuuuaaaauauguucacaaauuauuugacacuccucccuuugaaaggugaagccuaggcaaggugcacuggcucacaccuauaauccuagcacugugagaggcucaggugggagggucacuugaggccaggaguuugaggccagccugggcaacacagcaagacaccaucucuacgaaaaauuaaaaaaugagcaggacgugguggcacgugacuauagucccagcuacuccagaggcugagguggaaggauuacuugagcccaagaguucaagguuacagugagcuaugauucuccuccccuugaauguaggccagacuuaguggcucgauuuugaaaaacagaauguggcagaagugaugcuaugugacuucugagaggucauggaaaggcgagcuucugcccaguucuugcucuccuggaugguuucauuggggaaagucagucacuacaugguggaacacuugagcuaccuguuggagggacccauauggagaagaacugaagaacugaggccccccugccaacagcagguacaaacccucauccuccugcccugcuuguguuaaugaaggacgaggguuccaccacuccaguccuugguccugagugcucuguggccuguggccaacagccagccaagcgaggggccacaagggaagcagauccuccaguggagccuucagacaacugcauccccagccaacauccugacugcagucucauaagagaccucgagccagaaccacucuggaauccccaacccacuaugagggcuaaucaauguuguuuuaagcuacuagguuuugacaugugauuugugacacagcaacagauaacuaauacaguggguguuagggcugcuauccagaugaggaagcagagacccagaaucagacaguggaaagagaagcgcucccucagcuggcugcgaggccagagccuugccccucauucccucuucaggaagcugcggagacaccaagccuuccuuguauuuuggccauuaaguggggucaccaugcaucuuaacugccuggggcagucccgguuucugccuguuguccuagggcuaauuauucauacugucccuuucagcuccuaaaggaucccagucugauaaaauaaaaaauaacaaaugguuaaauuauguagucacuccccagauaaagaaucuaucuccgauguucaggacucagagcaccucugaaagguuacugugaagccaggauaacugucauguucagcggacagcccugcgagcccaggaucaagacauccucccacacaaaccacgcucguggguucauccuccgacguuaucuuuuauuguucucuauuuaugugugugggggggggauauuuauuucuugacaacaccgucaguuucucgaugucggggaucagguccuacuccauuuaauugugaggcagaauagcaaaagaggaagcauugccauuagacggacgaggguuccaaucucagcucugcuacuuacuagcuuuguaacguggagcaaacugcaagcuuucugagcuaagcugucaccccuguaagaugggaauaacaauuccugcuccacagggcucacauaaguguccccugggaugacgcacauggcuguggccaauacagcuccuguguuccuccccucccuggcacauucugagcugaauauuugugaaaauaaauccagaaaaguaaauacaacacucaacuugguuugcucuaucacaaggagucagccagagucuuuuccucuuccuacugucagaaugaaaguuucacagaguuucgcgcuugucacccaggcuggagugcaguggcgcuaucuuggcucacugcaacuuccgccucuuggguucaagcgauucuccugccucugcuuccugaguagcaagcauggagaggguauacuuuagaaacccuggauucaugcugucuacuccggacuuuccaaaaccuaucuucucacaagaaugugcuguuuccuuccacauaagcuucucaaauuaaagacaaagcgugaaggugaugauguucccauacaaggaggucugacgccuucuucugaaagcaugggguugugugugagggcaggcgucugcucaguccacccauggugagccucagucacacccgcccaucugccaaccaagggaggaagagcccucccgcaaugcugccacucagcuccuggcucuccccuuccucacacucucaggucaucauuuccaaagcauggacucacuuauuuggucccuauuuagucccccauuuuuaugcccuugcagaaguuuugaaagaaaaacugaugguaaaugaaggcuuccaagguucaggguuggccuugggacacuuaagagaaaggaucuguccugugugccaagcuccccagauggaugaaugcuugagagagccuguuuacuacuuugcugggagagaaaaaucucuuuccucccagccagcuucacaugccaggucagcaccaugacuggggauuuauggugggcacuguaucagggaaagaagaauuagacaaaaauaacuaaaggcuacuaugucucagguaugguccuaagugcuuuacaugaaugucuaauuuaaucuuugcaacaaauuuauaaggucaacauuauucuuagcucagucucacagauaagaaaacuuaggcaucuguucuguaauugaggcagcauuaaaaaaaagaagaagaaaacuaaggccaaggcagagacaucauugaacuugcccaagguacaacacauauuaaguggugcugggaugggagcagauuuaagccagaaagucuggugacaaaacccuacucuuaaccacuguauugugcugcuuuguagacaagcuaaaacuuaaacgccaucaugcugaaguggcuugacguauucauacgccugagagggauacuagcacagugagugcugaagaguacggaaaugggauuaaaccuaggcuccaccacuuagaagaccuguaagacccucaucucauguguaaaaagggauaauccaggguuucucagccucaaugcuguuggcauuggggcuggauaauucuuuguuguauggggagcuguccugugcauugugggguauuuagcagcaucccuggcauacccacuagaugcuaauagcgcugaacuaguuguggaaaccaaaaauuucuccaaaaguugugaacugugucuuaggagacaaaauuacccuugguugagaaccacugggauaauuauaccuaccgcucagagguugggguagauaguuugcaaaaacgcccacucuccaacccucccuuuaacuacaucccuugcaguuuugacuucgcagcuacucccaucacgagguagauuuuauucccccaccuugaauuugagcugaaaucaugacuugcucucaccaacagaaugcagcagaaaugaugcugucuguuccaggccuagauuucaaaaagccuuggaacuucuacucacucuuuuggaacccuacaggagccugggccagccugcuggggaugagagccacuagcuaaaucacuccccuuguuccagacaacauuuggguuccagcugaccugcagcuaaccacagacacaugaguaagguuggccaagaacagccgagccuggcccagaacugaaaaacugccuagcuaaccccuagaguuaugagcaaauagaaaugauugcuguauuaagcccacuagauuugggggugguuuguuaugcuaaugaauucagagcugcugugaagaacaaaugggaacaccuuugagcuaccugggcccugccuagcccacaggaagcacucgggaagggguagccaugaugauguggucacucacccacccccuuugcagagccugugcugccagccaagggcagggcagcccuugccuguccacacaccacuuucuaagaagccacagacaauucuuccuuuuuaguuaaagccccaaggagaaguagaacugacauccauaggugaaaacauuaguagagagaaagaauaaaagaacaauugcagaacaguagcauggauuuuacuaggcuccaaguggugagaucaugugcucaaguucaucuaccggaaagaagagaagccagggccuggagagaagcagaaugugcacaggugauccugacaucgccucauuucacuuuguacuuauguccccugggggcugaggaaugacauucugaacacagaaaaacauaccaauucagaagaugcaugacaaaaaauggccaucaauuuuauuuacuguccccaaaccuucaaaguacuugaggguacugcaaauaaaaagaaauauaagaagaacacaaacauaauaaaaacaagggagguguuucauaaacgucuucaaauaaauauuuuccuugccugcugaaggugcaaccacuucugagaacccacuuaaacagaaaagaacuuguugaaaaaauuacuaaacauuacuaaauuacuaaauccuuaaguaaauauuugcaaauuacugaaguacauuuuuuaugugaauugcacuaaacucuuaagaaauuuuuuaaaaauuucaguaugaaucauuuuguaagcagaaggaacuugugauuaaaguaaaucaguuccuuauuuaccuuuuucaaagucuggauuuuauuugcuuagcugauaacuucuuguauaguauagguuaaauguccuaacuuuuuagacauuuuuagauuuaauguuuuucuuaauuuagauccagugucaagaacagugaucagaaagaggcaaggucuagauugaagccccaccccuccagaacacaaacuuuuacuucuucaucuguacuuagaacauagacugucuuuucuuugagccuauggaaaaauccuaguaaacugauuguggucaugagaagagcuacugaugcuuuugcucaaaugucagaaagcaauuacagguugaacuguucugggauccuguuccgagaucagggucagaaaugguuuaugauaugccuuagauguucugugucacuucuuucuggcccaacucugaugauuucagcuuuguaccaucuucaguagcauucugagggcacccaaacucaaugacaccccuggccagggcaggacaauccauuccuuggagguggcccuuaacaaccugggauuggagcuggggcgugagugcuccagucuccuguccuauagguaagcauuucuaggugacuuucuauaugcuucucaaaaaagucuuagcaccaauggcagugaccucaaagacauacccuccuuuucuuccuucuuucuuacuuucuggggcgcuacucaaauaaaccaccugcaccuaugcaucuaugguuucaggcguugcaacugacagguaccauuuacccuugagucauuacaucucaggaaaaacaauggacugaaaagagcacuuugggaagaagcagaaucaaaaaguccagauaguccaacugagacggaaagggagaauuccagagggagaagauagagagagggcauauugauagcuugaagagacagcaaggaagagucaaggacacgggguccuccuggagcugacucaugugugcagggggaaggagauggaaccagaguguaaaaaaugaacuugccuggguccucacucugcaaagccaaacuuccucugguuucauuuccccccaaauggcacacccaccccacagagcugacagacuaucuaccagucuuuccacuuuuugcugccuccaaccuuaaguccccaccaggaagagaaugaauggaugacuucagaaaaggaagauaccacauggggccuggccccacuagaacauuccuucuuuccagaugaacaaaugggaggacugagcagugaaugaggguuugcucggggugggccagaggaaguuuuuuauacuagaaagcugggugaaucauugcuuuaaaaaagcucagaugcucaguaugcaugcucuuuccucucacugcccuauuaauucaugaggcacaagaaaaauaaaaugguugcuguauacuuccagccaagucaaagaaaccucauuucccaaagccaaaacuaauauuguacacugcaacuggcuagaaagccgauacagaaagcagguagagcauuucacggaauacacgugguaaccccgagcugaaaaacgagggcugggagagggccucagagcucucccacacgaagcuggacuuucagagacguggaagaaagaagaaacuauucugaaccuacauuugguuuucuuaaacaaggaccaaaaaccugguaugccauuuggccuugugacuuucaacagaccauuuccuuucccagggccuuguucuauauguaacaugcaaccuuuuaggccuuuaacaacuugagcuuccauccuccuaugacaagauucagauuuaaagcuuggaucuauccacuagcuaaugacugucagcagugacgaaauguguaaaugguacuuuuauaagugaaaauucugaucuccauuaaaaauccucuauuuucauuaaggucaaauuuuuuggcuuaucuucuaaaguaaggaaaaaugauaacgguauacuuaauaccuguuaacacauaacuuugcugaaugaaagagugaaugccaucgugaucccacucaugaucaagccagccaacauucaugccauucuaagcauccacuuucccauuuguaaguuugguacuucuaagaggggaacuaacaccuuuagaccucugaaaucagaguaaaugguuaucuuugcaaugccuaguucugaaccaugcaaacaaggggcuuccuguuauucauucagucucuuacugguagaaauugcuuuugacuuaaaauaaaacaaaacaaaaauaagggcuuuuaucccaugaaaaucacagauguucuacaacccagcauugcccacauuguacucugcacacuaggaaacuagaacaugucgcaggauuccagcugacacaggauauaaucaaucauuccauaaccuaccaauuucuuuggugucuacaagaguuucagacccaccaugccaauagcacaaagccaccagcauccagcaagucaccgguguuguauuucuguaggggaucuggguuuuucccagugauauugggccugaguuggaugguggugguggaguuggagacagugugugcagacagcccaagcccccugacucacaaaggguaagacuucacaucauacucuacuuccagucguucagugcucaacgggcaaaugagaaaacaggauagaccaugcuauuuccaccuucccagccccagucaaaggcaaagcucucauaggugcucuuccuuuuauuugaguucacuuggggacaaauuaauuccagagaggaaaacccaagagugaggcugcugccagcuuuccaggaccuggaguggagacacgcgggcaccucaggaaagcucauuccaggggaggcugguggggagcugggucugugugccagaauccuuggguacugaaggaaaagccuuguuuagacaaaucgcagcugucucagaaaauucaucaaugcuuccuugcccauugccccccuccacaaaaaacuggccgugauguaauaagaaagaucuaauucacaaagcaccuggcacuccagaggguaaugucuacaaagccacgugagcagccagcauaccccaaaagacauguaaauaagccucuuuaugcaaagaagaugcauuagagcacacuggagucagccugccugugccugaaccccagccccaauacucaccaaggaagcugguauuuguaggagagagauuaaguaccagccugccugugccugaaucccagccccaccacucacuaaggaaguugagucaccuccuuaagcuugcuaagccaugguuuccucaucaggaaaacugagaugguaacugcacauaccucacuggguugcugugaggguuaaacacguuaauaaaaaguguugagcagccucuggcacauaaacaagcucucaguaagggucagcucucacugccugcuguugcaacuauguugguuguaugucuucagagaacagagaaaagugcaagcuuucugcuuauuuuugcaaacacuagcagaaaucugacaccaaaaccugacaagaaagaaaauuacagagaaaucuuguuuaugacuauagauacaaauauacuaaauaaaaucuuagcaaguugaacccagccagauauuuaaagaaugauacacaauagccaaauagaaggugaaacuuuuaagauauaauugaccuuuuuuauaggucaaaaaagagaagacuaaaaacuuagcaugucaauauuuuaaguacuaauaguuaaugaaaaagaaaguuguaaucucagcaacccaauugaucaaaaacuucagauuuaacugaacuggauugggccuccuucagaacaaauaaucucagaacaaauacuuacaaaguagacuuacauuagguuguauugcacagauaagagaauccaaacagguucauuugaaggaaaagauuccggucauaaaaaaauuaaaacauaucuaauuggucagaucaguaauuugggaaguuucugcuguaauaaaccaaaguuacugauuaaaaaagggggggaccugucuguuuuaggucugguuagaaacagacccugagaugagaauuuaugaguaaaauauguucaaauauguccccagggagaccaguaagggaguagaggcagcagcaggaucucuauuuaccccaacaccuggaaccuuccgggaggcagagcucuuuuccugugcauuccccagggacagggcgaccaugugacccaccuuuggguuucugggucucugguuucuagguggucagugagugucaacggaauucucacaucucuugucagaggagagcuuggcugcauuuagaaagacuaagcuuuuauaaugaagaugcccgggcaaggaggcacccugagauuacacauuucccaacugugauugucaagagagugauauucuuaagaugaggguuagcagcuccucuccugcagcugacuguaccgugaggucuccugggccacucccacccucucaaauacagccccaccucuccugccugacgguuuucucugcuuaaccccagagagcagccaccucauuuuuuuuucccuuuagagaauugcauucugccuuuugaggggagucacugcaaacagaacagagcucucuauucaaaggccaugggcuuugcaagguccuucuuuaacccucccagagaaaaacugauaccuuggagaagaccucucaauacacagcucuaaccaccuugccaaucggcaggaacccaucagaggcugccacugucucacacagacauuccccuuggaugaaggcaaaucuucaucugggagaagugugugcauagugugcaaaacacaggcucaguguccagacaagcugggcucaaaucccagcuaugauauuuccuggcugcaccguccuggggcugagaaaucuuucuggagccccaguuuccucauuuuuauaauggcucauugugaggcuauaguaggugacuguaauuaccgugacuaucacucagcuucacagguagaccuguacccucaccacccuaagcccuucuaaguggcucaugcauguuggcagccauggcuacaaacaggcuccuccaaugcuaaauaacucaccuuuuccccaacccacccugggcccugagccacacucugauggaccauguacaucuguuccugagacucugagagcucccugaaagcagagaugaccucguuauguccucaucuggaggccaaagcuuccagauggccugugugguuggaggccuguauuuaaucuccucaaaugcuauagcccgugaacugcugcucuguauucuguauuuugucuuagugaggaccagaaagaagagugagugaaaaagagaaguguggcugagucacugagaagccagaagucaccuugucugugagguggucacagguugucgcagaccccacugauguuccuccagauccccugcccugugucuccaccugcugacaccugcauuuuuucaccugaggacuuuuucuugucauaaaacugcucugccccugcaaacaacaggccagaagugucaagaucuuaaugccuucaggagcagcccucaaucaacagcugcugggagcagguggauaaaggccccagacuccucaccacgcaggcagaagaaccccaaggagcuugcucuguggacccaggguuccccagugggaguaagcccagcugcccauaguuguggcuggcuugacacucuguccuuuucuccuguuuucuuuucucugucucacuuccuaauauaucccccuaucuucaccucccaaacaaacuacagguacuuuacacuugaauucuuaucucaggguuugcuucuggggauaccuaaauaagacaugaguguuacuugggguuauuuuaaagagcccauagcagagauuauuucaagcccauaggauuacagcucacacuccagcccuaucaagggccugcaaacuugggcuacugcagaaacccauguggacaaaggacugcucuggcaggaaagagauucuggcuuugaaugagggguccagggaggaauaugcaggcauggccuugguccacugucugucaccccugaaggcacagacauaggcuguuccucagugaugaguuccagcaccaacagacuuaacucacuuuucaggccugaucccauacagcaagaugcaaucaccaggugggggaagcauuucuccauuucugauuccugaugguuucccuuuuccgggagauaaggaauuagcauuuuucuccaaaccccuacauuguuuacuaguuuuuaacacuacuuaaaaauuacugguguaauauaaaacaauaauugaaagagugcucauaaaguacagagaaagauagauauacccaucuucuauccauuuauuugcccaccauccauuaguuuauucaacaaagauugagauccuaccacacauccaggcacugcugcaguuacuagguaugaaucaaugaauaaaaagucauuccaggccgggugugguggcucacucuguaaucuccagcacuuugggaggcugagguggguggaucacuugagcucaggaguucaagaccagccugggcaacauggcaaaacccccaucucuacagaaaauacaaaaauuacccaggugugguggugcaugccuguauucccaacuacuccggaggcugggaggaucgcuugagccugggagguggagguugcagugagccaagaucaugucacugcacucuauccugggcaacagagugagaccuugucucaaaaaagucauugcauauuauauguagaaaccuaaccuaauuccgguaggaggacuaagacaaccagcaacaaacaaauaguauguccggcuaggugcaguggcucacaccugucaucccagcacuuugggaggccaaggagggaggaucacuugaggccaggaauucgagaccagccuagccaacauggugaaaccccaucucuacuaaaaagacaaaaaauuagcugagcaugguagcaugcaccuauaaucccagcuacuugggagguugaggaggagaauugcuugaaccagggaggcggagguugcagugagccaagaucaugccacugcacuccagucugggugacagagggagacucuguuucaagaaaacaaaacaaaaaaauaguaugccagauggucauagguucuauagagaaaagcaagauaaagaggacagauaggguguuuggaguaguaggauauuucuaaucaggugacauuuaagcacagacaagaaggaaauggggagugggcuaugugccuauuuaagggaagagccagugucaacgcccugaggcagggauaagcuuaguguguuucaaggaacagaaggaggccacugaggcuacaaggaagaaagugacaggacacauguucagagaggcagcaacggggucagaucuucuagggccuuagagguauuauaaaaaacuaagcuuuacaaugagaugagaagccacuggagacuucugagcaaaggaguguaagaggaggaguguaagagguaaagguggaagcacggaaaccaauuaugaagaaggcuauugccaaucaauaaugaggcaaaagacgauggugacuuggaccaagauggaaccaauggugauggugagaacuggcuggauuaugagauacucuguaggaucagccaacaggguguuugagaaauagaugugguguaugagagaaaagggagagccaagaaggauggaguuacuguuuccuacaaauggaacaggugucaggaggaucaggaacucauuuuggacaucuuaagugugagaaauguguuagacagcaaguggagaggccaaacaggcaauuugguacccaacgcuggaguucaggagugagcucugggcuggaggggaaaauuugggaguugucagcauguccaugauaugaaguuaugagacuugaccaguucauccagggaaugcguauacacagaagaaaagcauucucaggaccgcacccugaggcucuccaauguugaaagguuggcaagauaaggagaccccaacaaaggaagcagaaaaggaguggcgagugagaagaauuggggugaggaguguaccacagcacaggagaagaaaaguauccccagaagaagggagugcagaagacuugaacaggcuaaaauaagugucccaauggcugaggggcacgugaaaacguguuuauuagucauaugggagaugcagcucuaaaucacaaagaaacacaauuacacaccagaauggcuaaaauaaaaaugacugacaauacugaauauacaaggauggggaccaacucaaacucuuauacauugcuggugaggguguaaaaggcagaaccacuuugaaaagcuauuuggcaguuucuaauaaagcuaaacagugacccuuugagccagcaccuacacucacuagcauuuacucaauaaaugaaaaaaaacaugcacacgaaaacugguauaaaaauguucuuaguauccuuauucacaaaagauaaaaccagaaacaacuucaauguccaucaucaggauaauggagaaaacauauuguggcauauucauaugauggaaaacgggaucucuuccuuacaccuuauacaaaaauuaauucaagauagauuaaaaacuuagauguuagaccuaaaaccauaaaaacccuagaagaaaaccuaggcaauaucauucaggacauaggcauaggcaaggacuucaugucuaaaacaccaaaagcaauggcaacaaaagccaaaauugacaaaugggaucuaauuaaacuaaagagcuucugcacagcaaaggaaacuaccaucagagugaacaggcaaccuacaaaaugggagaaaauuuuugcaaucuacccaucugacaaagggcuaauauccagaaucuacaaagaacuuaaacaaauguacaagaaaaaaaacaaacaaugccauccaaaagugggcaaaggauaugaacagacacuucucaaaagaagacauuuaugcagccaaaagacacaugaaaaaaugcucaucaucacuggccaucagagaaaugcaaaucaaaaccacaauaagauaucaucucacaccaguuagaauggcaaucauuaaaaagucaggaaaccacagaugcuggagaggauguggagaaauaggaaugcuuuuacacuguuggugggacugucaacuaguucaaccauuguggaagacaguguggugauuccucaaggaucuagaacuagaaacaccauuugacccagccaucccauuauuggguguauacccaaaggauuauaaaucaugcugcuauaaagaacaugcacacguauguuuauugcagcacuauuuccaauagcaaaaacuuggaaccaacccaaauguccaucaauaauagacuagauuaagaaaauguggcacauauacaccauggaauacuauguagccauaaaaagggaugaguucauguccuuugcagggacauggaugaagcuggaaaccaucauucugagcaaacuaucacaaggauagaaaaccaaacaccccauguucucacucauaggugggaauugaacaaugagaacacuuggacacaagaaggggaacaucacacaugggggccugucgugggguugggggcaaggggagggacagcauuaggagaaauaucuaauguaaaugaugaguuaaugggugcagcaaaccaacauggcacauguauaccuauguaacaaaccugcacguugugcacauguacccuagaacuuaaaguauaauaauaauaauaauaauaauaauaauaauaauaauaauaauaacagaaguagucguuauuuguacuaauagaugcugacggguccagaaagaagacugaaaaaugacuacuggauuuagccagguguaggucaugacuguccuguacauuaccuguugguaauacagcaagucugaguacaaucgagucucuagccacucucuggcccagcgaaccuuuucucuuuuucuuuaguuguauacagacauauucucuuugucucagucuuaggccauggcagccucugagugacuuucucaucucuaagaagggaccucccugaccauuuugagauuuuccucugaggcccuggauaucucgcccugguuucaauuuuucauuuucauacagauacccaacgaucuuguuaaaaugcauauccugaccccggagggcugcggccugagauucugcauuucuaacacacucccaggugacgucaccaugcugguucauggaccauauucgaguagcaaggguauaaaugacaugauuacacuuccaaauaacacaaaaagaccaagaaaauaaaagagggaaugccucaagaauaaauagaauugugcuguggcuaccacauuaacagaaauaucauguuuagacucgggacaauaauaacuaugcugggcugguugaauugcaguucaagccuggguucuauuuuaaaaaggaagaugccaaacuagagacagcacagggagugauaaacagaacagugaagaagggccuggaaauuauauauaccaaauggucugaaggacagggguucuggaacuuggucuuuauugcauggauugaccuaguauggagcuguggcaccucuguugaaggacagaaauccaaacacauugacaacaucguugaaauggcuucauuuugugaaaauaagaaauacacgucagugaagauagauaaggcggacagauaaagaucaucuuauaauugagcaggaucugacaaauacugaagggaguagacucacugggcaguccuuccccaguucugcuacguaucucagggauacacacucacaaacuaccucucucaggucucugcccugcugacucugcuggugcuucccaauggccacucuucccuuccucccaauaaacacaacucugacucugucuagaguagcaaugugcccagcugagaaaauucauuugccaccccaccuuguggcauggugcuggccaaugagauauauguggaaaaugucaaguggagcuuuaggaaagcucuuuaaaaggaggcagaccuuuugcccuuuguccuucuccuucuugcuuggaaugcagcuguaguguuggaagcggaaaccaaaaagcaccaucagggaaagcccagccuuggaguauggagaugaaaaccccuaugaagacaggcugagaggaaagacagaaggaaugggguuccuguggguaccacacaggugcauacuagcccugaaaugcccauuucuuauuuuauuauuaccaaagaaaaauaaaagucucacaaggaucagcugcuaaaaaagguggcuuuucuguuacaugcagcccaacauauuccuaacugauuuuaaacacagacuugcuugggagagcaggacaggcucacuaguuaugcucaggugccugaguuacaacaaugccagaggccaccacacaucacaggcagagcaugggggcaguggaagcccagacugucuguaagccuggccucaaaaggaugaaaugacagcccuggcaagcuggauggugacggacuguagccguacauucacauucucuguuaaauuccacgggcaucuguauaugucaauuccccaauucagaugcugguagaaacaucccaugugcaacugacacagaauaucauacaaacaccucaagaguucaaagacuuuugucaauaugcuuguaauauauccuucagaacaagaaggaaaccaguugaagguaaaccgacuguagcaaacaauuucaaugccccacccaaugcuccuuggacucccuuuacaugcacacuguggcuucagucuucguuuggcuccaagagccagaaccgugggucuucuucugcccuuaagcuauugaagccccacugucuacacuucaccccuggguggaaagugccuaggaccacuuucuaccacuuauuccucccuaaguggcccuuaaccaaugacugguguuuacgggagaacaaaacucagcuuccuaagcuggagauggaacaguaccuuggcguaacucacaccucugaucccccuugcagcaucaggcugaggccacgcucugagggacccugccugaguuucaguccugcccuguccugcgucucuccacucccuaccugucuucccccggaaacacauccuuuaugaaccacuugcaugugagcccucaucucaggaucugcucagggaaacccagacuaggacacugaaguucucgauuuuugaaaauuuuauuuuauucgccuuagcuuaguagucuuucauggcuuucuuuucaagagaugcugugcugcuuuaggaagauuuaaaauccaagacuccccccuuuccccuuaaaagaggaaauuauuaaauugcuguuuugcaguuaguuagaaaaaaagaaaucuagagguuuaacacauguuuucuaaauuccccccacagauucacucaagucuugcggcucugggaaacguccuucuuaauugauccuugucguaacuacagcucuguugacauuucuaaagcaaaacauagccuuccuuccaaacgcagugaauacacaaaugaagcuuuucauauacgugaaagcugagccccgcggcggaauacugaagccgccuugugauuugaaauggacaucugcguuucuccaccacuuccucacugccgacugccgcaggaagcgcccagccugucucccaggcaguuucacucaaggcugggcucucccugaugcaagggccacagguaauccaggugaggaaauacaaacacaggcugggggugccugcuccccgccaccuucucuuguccucucaaggaggaagggaagggccugcagaagcaacugagaaacacugaagggucucugaggaaugccgaguuuccaucugauaagcggauggggaagaccaacaaagcaagauaaagagcuugcuguuguguuagagccucgagugggcuuccagccaggugaggcuuuucuaccuggcguuauacaggaaguucaagguaaagucaccagggggcuuggggcacuggauuaaagacaggaagggggcggaaaagacuuauuauuuucuaaguaucggcauccacccucagggcucucuuaccagggcaagcagcaaguucauucaucaucuuaauggccaggccaagaugacuauaaacaucuaaggguugaauuuuacuugaggcuacuauuaacuugacaagagacaccagagaaagcagaacacaaugaaaaucagucccugcgcugaaugaaagcggcagugaaggaaggcuguaaucugucccagcacugagggaugaggcucacuucugccuaagaaccauucuguugcucaaugcuugguuucccggcuguaacacaauuugcuuuguucuccugcccagaugcaguuucuguauggaaccuucugucuaaaaacaggccaaagcacucccucaaauaaagguauacaaacacauaaauguuuaaguccuuccugcucuauccagauuagcaaguggaucuguuuuaucaccuggugccaucuugagcgguuugccuugaaagugaagagagaaccacuccugaaagaaagggaccacccuuucugugguaaagguagauauaaucugaagaaucacuugauaagaaaaacaaacuuacaagcccucgaugccuucugucauaaaaaauuagccacugaaagccuugaaaguugaccuggugcuuuacugccuccaaaccccaacuuggaagaccaguuuaauuuggaacucaaauuauacuccuuagaaacagcaaaaaugagcuucccuucgaacaucaucaccccucccacaauacccucccauggaggaaauaaggaccuagggccuauccaucuaucucagucucucaaggagaucagagacaaugcaacaucuuauuagccaaauucagugacuuauggccaaccgaugccagguacgaagcacauuccucacgagcuuacagugcucugugcgcuagagcaugaucaggaguagaggaucuggguucucccugcugaguucacaaucaccccucuuccucacuugucuuucuuccagcagucccaacacugagucucugaccuuccuggccugucagcacuguuucuuuguucuuccucuaagaugucucuagccucuguucuucguucucuguucucucagucaagaccucacuuacugccuaccugauaaaaagucugaaucccauaccgcacuccuccagcccuuugggccagaugccucccugcccagucugaaagagucaggaccuagcccccugccauuguuuuuggagggcauuauucuccucauuaucuaaacuucgcuauuauguauuacgugcaucacauauuugaacaauuauauaucuugguuuuaaaaagucaauaucccuaaaccaaaaacuccaauacuuaagcaaaugguaaguaaauggaaaaaaaaaaucaacaagcauuauuuuaaaaaaaucaggagucacaaaagccaacacagacauuuauugaacugaccuauauuuacugcuucacauuaauuuucauauaauuuuauuuucuuaaguacaagcaacucauuaaauuaaaaaauguucaguuuaacacugucucuauuuuuuuuuacaguauguagacacacacacacacacacacacacacacacacucucucucucucucaauccuucauuaagacaaugacugauaauuuuuggcuuaaaaggaagaguuaucacccccugacauacauucuauguuuuauauucuugccuuauuuuccucuucccccucagcauuuaaucuuggucugaaguaggugaucaguauaucucuucugaguaaaugaaugagcuauaaaguauaagcucauguguggcagagucgggacuaccaugguaguacccaucauauacaagugggacuguacaugaugguguaggacucauuuaauccuuggcacaaucccacuuuauagagaaagaaacugaggcacagagagaagacccuugagccaaggccacacuggccacaagaaacagaguuggaaucucaacucugcaucugcuggucaccaaagcuacacuuucccucuauuucacacugguugccuguuauuuuacuucuagcagcuucuaaaauucaaacuccaguuuagcugcuucuugcaaucacugugaaguacaaauauuccagccagcaaauaguuuucaaaacaucaugaguucuaaaaauuccauggacacuacauuccgguugacccucuccacuccucuccuuccccagacacucggacacuugaagccccaaacucucaucucuuugacuaauuuaucuguugccaaggggagaacaugaaacacaguaaggcugcagacagacuaguucuaccagaaaugcagauccggacuagaacauacggaaaacagccaggcuggaggucacaggcugguggccugcaggcuggagguggucacuggacauguuuuguuuggcucauacgauguucagaaaacauuuuaauuagcugccaaagucauaagaucucucgguuuuauuagaaaauagagugugcugggccucacucccaccuggcaaccacugaaugcugcugugagccugcugcccugugggugaagcuggaacccuccaucuucccacugucuucacugcuuccuccugccccacccugguccucuucacccacauaccacaccugccucacccaacuccugcacacugugagguguaugcuacuagaucuuguauaagaaccucagcgaggcucuaucagaccaacccacaacuucuaggagucuagaaagugaggugcucagguuagagauacuucuaauccugugggccucucuggcagaggcuggugagcccugaccacauuacuugcacucucagggugcuccagcccacuuccagcugccaggggcuauauuacggcaucucugcacccaagagcauuuuuccaaaaccauguaggucucuccugccaugcauaugggagggcaggaguacuggagaauauaaauagccccaggagaccucaauucuugacacuuggggaaaggaguauaaaacccccagcucccuuacucuuccuaguguugcccugcaggaauaagccccauugcccacuguaguaguugguuuaacagcucacuuuucauucacugccuccugccuauauaacuucaccucccuaccauuguuucaccucccuacuauaucacuucaacccccuaccauuauuucuugcaucucccaaauaaagaaauuucccugaauuccucgccaucugggagacccaaaccaagagagcaucucacacuguguguaagagucgggccagggugccugcccugcuuguucucccuucucuccuagcauggccuccucuaucacucuguggcaagcuguugcauccuguuugcacccaaaagucagcugggagcccucaugcaccuggcuugaagcuuauccuuucauguccaggucuguuuccaugcaugccauaacagucaauaccaugaagauguacacauaaccccagccccuugaguuuuucucccugccuaucccuggucacaugaggcaugcaugagugcagaaauccagaaugggcuaaaaacaaaacagaaugagguggggaggggagauuucuuagaaccuaugagugguaaaguccugacaggccuguaacagcaggcaucagauuucuaaaauguccugacaucucccugccaccagaaauguuacuggcccuuuguucaacaugggcagccucuuuccauccuaccggguucucuccugccccuccuccuuugcucucuucuacccucucaucccugcuccaaccuagguuccuccuucaccagccaaauaaacugacucauuccacccacccuagcucugcaauguaggaaucagcugacaucagauccuuuggaggcucauccauguaccuuaagcacuuauccaaggauucuguccaacauggcacuagccacugugguaaugacuugcuucaccuugucauaucugugcuucaaacaacguuucagcaccucuguagagcagcuggcaccuugugcuuuaauugcuuacugacaugccuuuggccccaauaggccaugagcucccugggagcagggacuagaucuuugugucuccuuguggcuggaacagucccuagcauuuagcaggcauucaacaacugcuguccaaacaaauucauggcuguuugacaaaggcaagaagagccaaaguccuuugugccaaacggcuccagggcaaaaaauuaaaaugaggcuuuaccuugacuccagggccauagagcuguacaucuccagggacaccacucacauuauauucuguggaggugucguuuacauggaacccagugugaauggugacccuggugugaugcagugguuaucuauucuuccuuaugcuccuuuuuaaccaugcagcaccccccggccccaggagcucccucucacugcucccacagggcaccccaggaauugucacucuguagugaggcuuugcugguuccuugcccggcaggcaacacggugcacugggccugccccugaggaaacccaguugcuggccauaauacccugugcucuggcuggacagcacacgccagccagcagaguagccaccaacaaauuaagcccucuuuuauaauguguuuucaaguuagcuuuauuuaggagagaaaaaagccagcagauggucauccauguguaccccauguuuuuauaagcagccuucccucaaaggaaaaaauaauccagaauaaaucuaugaaaguaguuuugcauuagaagacagaaaaauccauugcaggggauauuuuguauucagucuuagaagcuaauacauaacuaauggacugugugaugacagagaagauagguaaccuuggaggccugggccuugagucucuguaacuuugcacaaaaugaauaaucauccauccaccuacccgcccacccauccacccagccagccauccacucacccauccacucauccacccagccagccauccacucacacacccauccacccagccagucauccacucaccugcccauccacccacauacccacucauccacccagccagccauccccacucaccuauccacauaacuauccacccacucauccacccagucacccagccagucaucuaccuaccuaccuaucuaaccauucagccacccacccacccauccauccauccauccaucuauucuguggacagauccugugcagccaggugaggagccugcacacgggcucccuaagcugagauuuaaggacauaguaguucauuaaacaaaaauggggggugggggugauuccuggguaaaggcagcuuugguauuaaguggcgacugauucaagugaguaugugggggcauggugagccaggggucuggggagaaaggcaggcaggcaggaccaggcucaggacggccucucaugaggagcugaggagucugaacuccuuccugaagaaagugaagcagaggagucacaaugucaacuuucuucucaaauuguuauugguauaacugagauuaugggauuauuuuuauuaaucuuuuaaauuaugcauuuaccauggcaauacuuuuuuuuacauuugcuuacuauuguaaauauuuauaaaaauuguuuugcuucauucuaugcuuauuuggcuguggcacacuuuuuauucaacuacuuuuguauucuugaguaguuuaucaguaaauaacuacuuuucaggaagcucucaugguuacuauagcagauguggcuagcaccucgcucacauuccccagaaccagccacaguucuggucaccugaagccaugccccuccaggucaaaggcuucccacaucuuucugccugaguugcuuccuggccccaggcaguguggaccuacuuagagaaggcuggaagugccagagaguucaugcccagggaaugguucuccaugaugaaugacaggagcugggggaucgguccuccagcagcuuccucauccuggagugaaguggaugugagguuuguuacacacagucucuuggagggucugaggaagacaagcccaaggugccuacggcaguaaccugcuuauaaaugcacgccuuccugucuuuccucucuuuccugucuaaacucaacacugagaucgcccacccccaaauaaacuaccuguaccuguaucauuguaucaggguaugcuuuuggggaaauccaaacuggaagagguaauagccuaugaauucucauauaucugaguauaucuuuauuuugacgucacaauggagggcaaguuggcuguguguugaauuuaaaauucacaauggaauauacuguucuaauuuuggacauuaauguuacagaaaagucuguagaaacugguuucuuuguuuucugcuaaguguuaauaguaucauuuucauauccuuaaaauuaaaaauuucaugaagcuauuuguagacauuaaaauguuuuaaauauuuuugccuggugucugcugcacccauuucaggaaauggagauccuccuuugcugucuaaggaauggcuucuguuccaauuauucuggaaccauuuucucuuugcuguuuuccaguuucuaccuuccacaauauaguccucaugucauccuuuuuuauugcuuuguucuuuuucucugaauucucagagccucucaaaaacaccuccgcaucauuaaaucaauuuucuguucugcugauucugcucuuuccugacuauaacauauuuuaauucugccacugauuuccugguuucauuguaacauuucuuuaucccauccauaacauuuauuuuugcuugccucccaguccauuccauuuucauacagucuauuguucuacugucugaucuuccacuuuguucauuuuuuuugacuuucaucaaaaaguagaugcucuguaaaauuuacuuuuguuuucuauuaauaaucuuuuuaaaacuuaugcuuucccucuguaucuuagucaugcuuuucuuaguuuacccauuagaauauuucacaggcccauguugguccuguuaggccuguggguuguuaagcagguugggggggcucuccuggugccccucacuagccacuggguccugucagaauccuacccggugcugggugaugccauuuacauccgcuguuuaucaaccuugcagcguggcuggaguccuggaaggguaguuucuguuucuuuucccuuccuuuuccugccacccugagggucgucuugcccaucugcguuucuggcuggcccugccuccacagcagcuacaagauaccucccugcuccaucaccacucuggagcuaacacucaccacgucccgaagagccugaugcuuugucaaguuucugucgaacugaaaccuaggguuccuugugacaaagguuucaaagguugcuggaauucaauggcaaagagaucaaaaugaugugcucccauuuuucccauggccagcuacaguggccaauggcuuguaccuguggccuucccaggcacauugucuuugacuuccuagagccuccuuguccagcaugcuugggaggcuacucaccacgccugcgucccuccaguggccaaugacgauacagggguagaaaaugaugcuguccccagcagcuucaaggggggacaauucugcagagugauuuaugcuccagggcuuccccaccucuucccagcccauaaaucagaccaaggcuagcuuugacccgacagcacaucccucccagcccauccccugccccucccugcucccucgccccucuucuccugagagugcuccuccaauaauucacacacauugugccucaugcagugaagaggggaugcggacgagaugcaaaaagucccugguguauaguagguggucaaaaaugugacuucacacccucugaaaaguuauagagcuaaggauaugaucauuuacugguacuaaucuccauaaaagacauuucucacaauuuuacuuaauauagaaacugggaauaaccuaaauacagaauaagaggaauuuuuaagguaaauccacaguauauccauaugguagaauauuaugcaaucuccaagcuaaaaagaaaagcaugguaaagggggagcaaagcaagauacaggaggcuagugaguuuauaaaauaguaagacuaaguccuauauacugacagaguggggucagcucugagcuuucuagcagccaauaaagagaaugaagccuagucagucacaagguaaaaacaagccaaaauucucaggcaaagggacagcuauuucuaagucuggaaauagcuuaaaugaggcuggaaggaaauuucucgcauggguccugagugagagaaaucuguguaauguaaugagccaguugccaauuacaucuuuucaguuaccacagagaugaguuccacagaucaaauccccaaggaagccccuuucccccaccuaccaacccacccugcacagggagauggcaucacagcacaugcgauucuguaaaagauacuguguguguggccagcgauacuugaaccauacagauacuugguucucucuugacugggcuuaauccagcgguaauuuuuagaauauagaaaguggauggaaagcacaccccuccugcaguccuugauugcuuuuguggccucccucaacccuggagcuccuaaaagcuaugaagcagcagggaaucugagaugacuucuuggaaaguuuuggagugccucuacuguugguggcucugagcauuucagcuguccccuaagcugggcaggcuuggcacaaaccugucaacacuauugaggccacagaauaugugccugaacaaacgccguugaccugcucaauguaugcccagugcucaucggugggcagagugaagguuuuccacagaaagugauuuugguuccauuuuaacauaaagaacaaggcaaccccguucaaugcuguaaauauuaaaaagcugcaagcagucccagcugaacagcuaucagcaguuagagcaacacuggguagagcagagucgacuuuuguccacuuguucccccuuguugucugcagggaagccuguucacuuccucugagaggugguacacucgggaugauuauggguaggggagaauaccagcacuguaccuuugagucaugcuauauaaacuucacuucauucaaauuaauuuacucuaaaaaaacucacucaauuuguggaaauaauuuaacuaccucaauucacucaaauauguuaggaaggccaggggcggugggucacaccuguaaucccagcacuuugggaggcugaggcaggcggaucacuugaggucaggauuuccagaccagccuggccaacauggcaaaacccugucucuaccaaaaaauacaaaaauuagccaggugcacaccuguagucccagcuacucgggaggaugaggugggaggaucacuugaacucaggagguggagguugcagugagccaagauuguggcacugcacuccagccugggugacagagcgagacuugucucaaaaaauaaauaaauaaauaauccaaagcacaggccaaagcagugacccucuacuagaaacaucaaguacaucauacauaauaacuaacacgacaagcagugaucugcccuuacuuucacaacuacugaccuaaaacuggaauucucuagaacaugugugugcuggagacagcaacuguaucaucuccaagaaggggccagauguaaaaccauagggagaggauuccacaagagagaagggaugggagacuacauaaauacagacacuucucuggcacucugugggcauuuacggcugcuucuuuggcuauaccaacauguuuucuaagcccaggaagaaaaaaguucuaaucauucuaaaugauaguccacagaaaggauuagugcuuguagaaucauugccuauuccaggcaauaaugaaagucagcaagcgcaccagauggaacaacugcucuuuuuacagggaugcccuccuuaccuucugccacauguugaugaagaagagcucccgggaaacauugaaggacacguuggcaucauaggcaucaucuccgagguuggagauagagauguuuagggagauguucuucacagcccccaaagcuagauacaggguuuucucauccauacuguaacgaaaaauagacagcaaugaaugcccugaggccuacacuaauauaacaugaggcacaggggguaguugaagguggggggcagaaaccgagaucagaacuacaaguuccaggagccccauuaacuagccauguguccuugggcaaucaguuagcucuagggccucagcuuccucauguaaagcacaggguucuaccuugccuaacucacuagacuguuuagaggcucacaugaaaucuuguacaucaaacuucaaaaacuauaaggcacuuaacaaccuaagcgugggauucauuuguacaugaauucaugcgguuauuucugagugccuaccaugugccagccacuacuccgugcuagggaaguagcagcaaagaaaacagaguccugguagcuucagggagagagaaaacacacauagaaagaagcaaauaugucugucagauugugguaagaacuguggagaaaacuuacaaaggguaaggaagauagaacaugccagacuuacaagggagguggggugcaauuuacaauaaggugaucagggaagucucacugaugaggugacuucucaguacaaacccgaagaaagaaggggagcaagaaacacgguauguggggacuagcaaaggagaaguccugaggugggcgugugccuggcaugugcagguaacagcaaggaggucagugcagcuggagaggagugauaaagagagcaggaaggauugagcucagagggacugagggaguuggggcagcagaucccacagggccuugagggccagcacagggaccuugguuugacccucggaagccccuucagggcucugagcagaggagcagcgugacuugacguuaguguuuaaaggaggcucgcauuggcuaugaugugaacggucuguggaguggccaggagaggaacagggggccugaguaggaggcucuugugacaauccaggugugagaagaugaacgugaaggccagggugauggcagcugagggggugagaaggggucauauucuggacacauuucaaaggucaugccaacagauuuuucucauggacuggaugaaggguguuaggaaaagaggagucaaggacugcuucaaggauuuuggauucaauaacuagaagagaaaaguugucauuuauugagaugggaaagacuggguugagaagguucagcagagaaaauccaaaugccuauuggguuuuaaaggagauuuugaggcagguggaugcaugagucuggaguugaaggaggggucugggcuaggauacauuugggacagacuagaaacgaucacuaggaaaugaguauagauagaaaugaggacucacauuuaggaguugaagaugaggaggugucagccaacaagacuggaaaagcauggcuagagaaggaagaggaaaaucgagagaggagucauccacauggucacagaggacagucucaagaaaggaaggaucaauuuuguccaauauggcagacaggccagaacaaugggaauaauuagaacuggccauuggaaucagccuucuggaggucacuggugaccuugauaagaacugcugaaguggcacgaugggaggaaagccuaacuggagagaguuucagagauguaggaggagaacaaauggaagcaaugaggacagacaacuauuuggaggaguuuuucucuaaaggagaacagagaaauuggaugguagcuggugggggaagugggcuccagggaguuuuuuugcucuuuuuuauuaagaugggaauuaucauagcauauuugcaagcuaaugggaaugauccauuagagaggcaacaauuaaugaaaacacgacaggcaacaauugcuggggucugaugaaugacuguucucgccuggcuggaggugagcugaagaugcauuaguagaugggugguaggaacaugcgggaauuccucugugauugcuucuauuuuguagugaaauagaaguagggugaaagacugggaguuggaggagaaagaggugaacguuugagaggugaggagauggagggaaaugggggcccaggacaggggugagugaacggggcuaggaugagaacggugauaaggcugaggcugaagaugacaaggaugaagaugcaugagagacugaugauuauugugugaugcgaccuuugaacaaaauaaauccaugugaguggccaguuuuaaucggauaaccaguuaauggaagacguaauuaaggauauaaggguuuguauaaugaacaguuguuauuuuuggccacucagcauccugacauccucguguuuugggggaaucucaagauagguggggcggcacaucagcagaaagggggcagacccucucuuuccccucuucuugaucacuagggugugggcacuugccuaagugaaaucaugugaucuaagggugaucaaguggcagcgaugugagaacagaugcucccacccagggcuacaaauuuugaggguugcacagagacaccagggaucaucugaaguagcuacagaggaguaaagggcccagagguggaacccuggacuaagacuugccuccucuguuuccugccuguguugguuccccagccuucuugucuaugcucugaaccaccccacauccuuuuaauaaauuccuuuucugcuuaaauuaaccagcauacguuuuucuuguuugcaaccauuaauacagcuaauacaccaugcaaaagaagagaacucuucaaaaucuccauaggcaaaaauacuuugaaauacuaauuucuggggggguggaauccucauuacccauccgugaagagaggaccucacucuccugcaugucuggcacaucaacaagaauaacaugugcaaugagaaauaugauggccuugcuuuggaagcacgggcucugaggauccaaacaagaugugaaaaauuaacuuaagagcugcaaauucuugaacggccuccaauaaauuaagacccugaucucaagcuauuguggcaauuauuuauuauuguuggccauuuuaaucuuaaacaguggauagguuauuucuguucuucuguuugcuuuuggaagauuaaaagaauaaaccucaggcuugaguuaugagagagugcuaaccuagcuuuaucuugagaaggaaguggacaggcauucauaaguaguccugacaucagacaguguccaagguuuccauggaauauuuggcagggagacaguauagaugagcccaggaccauggaggaggggcugccuccucauuccaguuuaguuguucaugugaucagcuuccuuuccuuauauguaaaggguaagggaucaggccagggacaucuaaacuucugccaauccccaaaccuugggccucugucacuuaaucacacagcaaagucauuccugggauuucaaagucaagugauucaaacaaggcucugugauuaagggaagcagccaggcaacuuccagggcagaaugugaacucagauuuuuuuuagaggagucucaaagcugggguuucauucuuucuccaaagcuaaaaaagucuuugacuaaaacagcacaucucugcuuccaaaguuauuuuuagaaaugaaaugaaaaugugaugugccagcaugauauuggguguugucaaauaugucauccuucugaaaccucacaacacugagaaagggucuugauauuaggcccauauuagagagaugaggaaauugagaugaagagagagaagacgcugugcugguaugagaacccagcaacuccuaucccuucaaaacucauuccucuccaacauaacccacauucuccagcccccugacuaucauguccccaggggauccuuccugaucucccugccuaggugaaauaaauccucccauuaugagccccccaccccccaugugccccaucaacccuucauggcacuuaucgaaguugugguuaugcauuuguuuguggggcuuuuugguugaggacugucuauccccuacuagaaucuaaacaucagggguaggacccuucucuggcuuugcuuaucguugaacuccuagugacagaguagugccuggcacauaauuucucagggaauaaaauuccuugaauaucagaaagauucuucuucaauaaauaacuaagcaccguggaauguucagcauaaaaaccccgugccugauuguuuucaucuuucagcaggacugucagagagguuggucucuccuagcagguguucagugaacacuugaaugaaugaacauccaugacauccccacaacagaucaucagcucccccuucacauuuuacagaugaagaaguugagccccagaaaggggaacccacccaacugaggucacccggccaugcagggucugaguugcaacuagcagcacaccuccuuuggcaugaagguugucccagccauggcucuaauaucaacuccaucucagucgggaagggcuuuggcaagaaaguuuacaaacaccugaaaggaacaggacuccacaaagaccaaccucucugacaguccugcugaaauaguaaaacgaucaagcauagaguuuuugugcuaaacauuccaggggugcuuauuuauugaggaacaguguuucuaaucuucaagaaauuuuauucccugagaaauuucccuuuuuauuuuaauuugcuugugcagucuuuuaaguggguuauauuacuuuguacauggaucucuuugcugugcuuuuauaugaaaaucauuauuaguagucaacauaagauacaaaguguacugcuucuauaaagcuuaucuuacagcauauauauagccugcugaaaauauauugcucauuuguuauuaaaaauccuacccaaguauaucuuauagcagcuggcuuuuuuuugacugcguuauuggguuuguacuuaaguuuagcaccaauucauucacuauacucaauggaagauguuacugaugacaucuuggcagcugugucaagccagaaaaucucuguagaacuuguuuucuguccucauucaucacuguacauuaggauuaccauucaaaguuccuuguuggguaaaugcaauacauuuccauaucaaccacauaugcugaaucacuaaggcaacuaaagcaaaaauuuccucuucuauccagauaauuuuuuggauggugcuuaauaauauucuguuggaucacuuagauuuuccuuaagucuuagacauaaaaaccaugaccuuuucuuuugcugccaucauaaaucuagccugaguaaaggcuagcacaaguguuaaucaaaugcauccaacuauauuugcauuaaaaaaauucucauuacaccaucauuauuauuaucgguauuguaucuaccaaccacaacuauauuuaacaaugaugacuaggauaauaguauagggcagccaagucuguccauccguccauccuucacuccuuccuucuuucucuuaguuguuuauccaucuguuacuuuuuaaaaacuauuuuuucccacuucaugacuauuaggauggcaacuaucaaaaaaacagaagacaagaauugucaagaauguggagaaauugaaacccuugugcacuguugguaggaacguaaaaucgaguggcugcuuggaaaacaauaugaacauuucucaaaauaauuaaacauagaauugucauauaacccaaaaauuauacuuuuggguuuauuacccaaugaacugaaagcaggaacucaaagagacauuuguucccccauguucauagcagcacuauucacaguagccaaggguagacacaacccaaaguguccauggacagacaaguggauaaaccagauguacuacacauacaauccccaguuuucucaaucauggaaaucauaccaaaaaggacauugugaagcagauuuuauucuuccuaggagcaauaucauaacuaggggcagcaugcccucaguaaggauucagcuuccaaaaaaaucacagauacucucaacaauguaucauaaaaucaaugaugcaaaucauacauguaaauagccccugcaaugugaaaucacaaacaaugcuucccauucuuaaaaagggcagacaucauaaaaucagacauggaauuugacagcuggaagggggcccauuugggucaccauuuugcagauaaaggcagacaguuaaaugacuuccccaaggccacucagcagacaagggcagagcucuaaccccugguccagucagugcuccuuugccuuucccauugcuccuaaagcauauaaaaaugcaacuaaauaguaucaauguauaugaaacauacuuggcuauaagauuauaaauaaaauuguguuuauuuccuuagcauuuagaauauuuuagaauacugggagaauauuuagaacauaaggugucaucucuuuacaaaugcuacugaggugcuuaacuuuucucuugacaauuuucuuugaaauuuguggaggcauuugagaugacucuagaugucuuuagccacucucaugggcaaccuucuuucuggguacuuuguugacaacuaucaaagcuuuucaauuuucagaguuuaaaauuacaaacaugaguaaaccauaaaaccaaaauugcucaucuguugucuuucuaugagagauaugagcaaaaaauaccaaauaaauugauuauaacaugaagaauuaagagacgguguuaauuaagcuacagggaauaagugaggacugucaggcaccuccugaaugcaugcugguaaaugaauuacccaggaaauaaaccaugaaguugauaagaccugccaaaggaacaggugaagaucaaggggcaagagaaacucagggaaaagauaucacuguugacugaaguuauuacaugaagcuuccagagacagguagcaauugagccacaucugaaagaaugauccuaaaacucacuugcuuguaaaaugcucugccuauugaugggcagaaaaacagggaguacauuccagccagagagaaaaauaaacaugaucagaggaugaaggugggcagaaauaacauggaaaggggcaggagaaggacacucuuagcagaaagauuagcgagaggcaaguagauauguguagggcacauccagauucccuuaggucuugaagacaaagauuugauguugaucuucuaggcccaugaauuuaaccaaguuuucuugagugaccaacuuaagauacauuauugcaaguaauuugacaauaauaaaacaccaaagugaagauauuaaaaaauguagucagcuauaagugguuccaccuggggucuuaucacuguguaaccugcacagacugcaguucuaucuagucaguauccccaucucuuugucagagggcuuuuuucugcaggccaggaaagugccuaagaauuaagccucugacaugcucugcagcaacccucaaugacugaugggaacugcuguauaauuaccccagcucccuugccuauugagugggacaacucugaaguucaugugcuagaccagagcugccccauaugguugcuacagauaacauguggcauuugagcgcuuaaaauguggcuggucugaauuaaguuuaacauacacaugaguuuucaaagacagcagauacucaaagauguaaaaaucuccacaguuguuuuaauauugauuacaugcucaaauaauuacuuuugggauauacugcauuaaauuuguuucaccaguuuuacuuuacuuacgauauaauaugguugauuugugauaaaucuuuaaugauacauacuugcuuauguuacugcuugugaaguagacguccaggggaaauaaauuuggguaaaaaugaaaguaaauaguuuugggccgggcgugaugacucaugccuguaaucccagcacuuugggaggccaaggcggguggaucaugagaucaagagauugagaccauccuggccaacauggugaaacccugucucuacuaaaaauacaaaaaucagcugggugugguggugcacaccuguagucccagcuacuuaggaggcugaggcaggagaauggcuggaacccgggaggcagaaauugcagugagccgagaucacaccacugcacuccagucuggcaaaagagcaagauuccaucucaaaaaaaaaaaaaaaaaaaguaguuuuuaaaaauugaucauauuuagcuccuacaacucacuugcuuauaaaaugcuuuagugaauauugugaaaugcugaaaaaaaaagcguaacauaugugugcuuuucuuucucaccaaguaauuuugaguuucaccaaaaucugauguccaaaguuguauguugugcaaaugagccucauucauuaccugugauguggugggagaaaaaaguagcaagccacacagaucuagggaauaaagaaugucagugcaggcgcccccagaugcagagcuggagacagguuugaaagcaaguuguuuauuccagaggugguuccauaaaacaccaguagggaagggguagagugaaacacagaaggacaggcaaccagcaaaggcagcaacaucaagccagucagcucccugagcaccuggaacuuaaucuugcuggggagcucugggaaacugugcaacacaugagcagaacagaguuaucccauuugugggaugagggaauauuuacguguccacucuagucagucauugguugagggcuacugcaaaggcggggggcugcacaucuacucccaguaccucuggcaagauacuugguaggcagaaaaggcaaagagauauaguuacuaguagcugcauaccagcauagcacauaaauauaaaagggaugcagccagcacugaucauuccugcuacaggauccuaugucagcuuucugaauaggagaaugguccagugagugaggccugucacuggcaggagaccagaucaguuaaucugaauaucucugaauuacaggggcccaagcuccuucuggaaaggacccaaggcucuggacaaacccuacccaacccuugggauccacauucuguucacuuuccuucuugcguaacugucacaaggagacaucccaggugccauagccucaauuucuacugaugugguucaagucccaggccucacaguccagccaaaugugggugugggugaccaaagacaccccuggccccagacugaccaucaguggguugcaccaggggagcuguaccaguucucuaugacuggcaacuguucuuaaagguaggugugcucaugcugugcagguucuuaacuauuuugaacauugccccugccauaaacugguauaacuuaaaggaaacacacaagauaccacccuuguugaaucugagggguguauauuucugaauuuccccagugcaauucacuuuggguagacucacuagggaccaacugaagaagauauacaugucagcaagcacaaguucaugagccucugucuauagggcaugcacuccuguaagaggcugcucucagcuuccccaccuaggaaggcagcugcuauugcauuuccaagguacaacagcauucaggcuauuuugucccagaauguugguaugguguuuacuccucagccucugcucaccucugugggcugggagcuuuuacaguuaagucuacugccauaucugagaguuauuccaaaguccccuggauuugucacagaagaauuugcauucaaagugccagucugggggccucuccuucaugacacagguaacuguucuuuaauaaucuacgccaaauaauauaaaagcccauucucaaaaccacaacauuucuaugucuccuaagaauaaugccgccaacaucagccuuuagugguacaaugccaggguaaaugccuucaugaaaucuguaaacaaacaguauuaugaaggcuaaggccauguccuagaaagcaaauaauaaaaacuaucucuguaauggagcuagaaaaauacacucauuucaugaauauguauuaugagaucaaaauuuagagacucacggauuuucaaagcuucaagggaucucagaauucauuacagaccaaccuccuccccauuuugcaaagacauugaggacuaaauaagguagacaacuuaauaacuuauuuaguaacuaguggcaguaccaggauucaaacccacuauguauuagucagaguccagagaggaaagcagaacccaugccagguaguucauagaagggauuaaaauggggaaccagguacaaaggugugaaaagaaccagaagagcaaacaagguaagauaaggaaaagcugagaucagaagcaacugcugacacccuuagaguuggagggacugagggaggagguguugugauugugacugggacugggacugccaagagggagcuaagacgguggaggagaaguagcuacugccagagaugcugcuuaaagugaguggaguuaaggagaaacacccugacuuuucuccuccucccuuucuccaaucucacaccagugaugccacuggcugaacuucccaagaagcuuaucugcaagggagccugggaaauguuuuuuugagucucacaggggaaagguggggaauggauugaugugucauguuuucagauucucaguccauuacucucagcuuggaauagguuguaguuggagcucacugucaugugugagaacucuggacaaggaaagccuaaagugcaacgagguacuaaaauggagucgguuuucaugcaaugaaagcuccgagauuucucuuuccuacagggauaggaaacuguuucugucuugcugucccauuuuaguuagugacugccuauuguuuucgauuccugcagauuucagugaaacauggaauuauuuagaauaugaauaucaauuuucacugcugugaaaaucauuaaaauuuccugauuuagaagauucuagagauuguggcaaauauuuagggauuuauuuuacuaaccaagaaagguauugcucuauuuuuuguuguaaaaaaaaaaaucaccaagaaauacuaaaaaagaauauuguacccaaaaagguucaauucuaaauauauuagagaaaaucuaauuuuauuuuauauuuuaaucuauucuagaauaauaaaaauugguauuucuguccaacuacuagucuuguccugugguuauccugcaacuugccccagauaaacauagguaauccccugugguuuacagccucagcccuaaaccaccugcucuagcccauuggaugcuccucaucccaacaagcucaacauccccuaugauacgcuuucuucuguucaaagcuuaccaccuuaucugacccuguccuccuucucaggugugccuaucccgccuguauuagccuguucucauacugcuaauaaagauauacuugagacuggguaauuuauaaaggaaagagguuuaauugacucacaguuccacauggcuggggaggccucacaaccauggcggaaggugaaugagaagcaaagucacgucuuacaugguggcaggcaagagagugugugcaggggaacuccccuuuauaaaaccaucagaucucgugagacuuauucacuauuacaagaacaacacaggaaagacccgcccccaugauuuauuuaccucccaccggguuccugccacaacaugugggaauuacgggagcuacaauucaagacgagauuuagguggggacacagccaaaccauaucacugcccuaccuuggcaccacucagcuucuucuccagcaguccugcccuaguuucucuaaauacacaaccuaguagucuggcccagcuccagcugaacccuggguugauacccuuauacagcuugucccagacuuccacuagcaucuaucuggauacuugucugcauucaaauacacuugaaaaaaauccaaacagcaacauuaauuaaguucugcuuuuguuuuaaauccauaacuguacguggcuuuauguucauauuuauauauucaaauacugcauaaaccaauaauauuaaacagaacauucuauauguauguauacauguuuuaacuuccucugggagugaguuacuaugccauguaguuugaauugugcuuccccaucucaucaugcuuuagaaaucccuucuaaucaggcaaaacagauccauaugguuauuaacuccagagagagaucauagugcaccccuguaacgcaccucaauuaaaauuuacagugggucagggaaaucauuccugggacugaauuucugguuugaaaaacucacuuauaggaagccagaaauaccuccaccucccucauagguacccaccugggccaguuuuaugcucaaaaagugagagaaaaaagcauuuacuaagaugaucugagccaaaauagugguuucccuagcaacaacauucagauaauuaagguaaauauguauuacuuuaaaaaaaauagcacguccaugucccugcccagcugacuuuggccccagccauguagugguagaaucgauauuugcuucaaaggccauccucuuucuaacaaggcaaauaagccagucagugggccccucccugucccucaaggcagcucagucucccuccuccugccucaucuguuuaacugugaaaagaacugcugguucccagcuaacagaggaauucaaauccucaucagccuugacuuuaggaguaguuuccggaaucacuaaaucuuaggacaucuggaacaaaucagguucacucacuguaacaacuggauuaaagacaaagaauacuuuagggggcagaggaauucccaagaucugcaggcugcucggagguccaauguccuaagacagccccggugugcagcgauguaugacuugacccggcaagggcccgcugcuacgaucugccacaugugugcugccuguuacacuuggccauugcacagaaaaugcaagcaguguaugugcauuucaucaaagcuagcggggcagacagcucaagaaagcccagguuagcagggccaucauagucccuugacaaguaauucugucauggccauaacuuuucuguuucuagcucaggaaccaaauacggccauaaauagucacaagcaauggaauauauugaaauuaugaaucuccuagauuuugaaucuuuucuccugggaggugagguagcccuaugggaaaggggagagcacaaauguguaguuuagcaauaugcuuuaaaaaaaacauauuaaauaaaaagaucuggagguaaaucuaaugcuauaacucugaaggagggaugaauguaaaugguaguuugaaauaucugcaauaacucuaacuugauuugacaauaccugugauuucuauuugggacagagucacagguccugguaauauuacuguagucuguuuccuacauucauaauugaauaugauguuaaauuucagugugaaguuagugaaaacaaaaugcaaucauuuccuuauccggguucacagaucagcaagaggacauagacuccagguuaagaacaccuguccuaugggaaggugagugguagggacugaguuaaugacccuaaggggaggcugugauggacagagggaaggagggauggcaggcucagccuaggacagcaggaggaaaggugagcaugguguuucugaaggcauauaagaagacauuagaaacugugguugacuucauucaccucaauucuaccaccucaggacugacaaggagccaccuuuaagccuggcgguuuagaugagaauuuuuuccuucuuggcuuaggaggugaaauuguucuuuagcaccagaaaaaaaaaaaaaaguuuuaacauuuguauuucuuuuuuuucuuggaaaaaacacaacuguuaacugaaagaacagcauuucuuccaguucaaaucucauuaucacagaaaacuuucuuaaaggagaguccagugcuccuggugagaaaggcuuaugacuguaacugaacaucaucuguccccuuaugcaguaaggacuguaccugucuucaguuccccaccaguaaggacauuuuguaugaaagccauuucucucaagggagcccccuuccauucccuugggucuggaaaguccucuuuaaaaacaaagccucaguggaagagguguccagagcaaucucuaaagacacaaaguccccuggaccagccugaaggggucucccacacauuacuccacaagucugguuuuuaaauauaaaaauaacaaaauccucugcaauuccaagagggcaaauaaaaagccaaugagcaacuguuuuuuuuucucucccacuaaugucugauaaauacauuggauuugauuuccuuuugaaacuuggaauccuaaaaagcaaucagccugcccggacaggagaucuaagagcagauaaauaaaacaugagguucuaccgcaucucaggauaggcucccuucccuggaagccagagcuuguggcagagauccagggaucuguuggcgagccagggaaccaggcuggggcagggacagggcaggaguggaccaaggcugugggcacagggggaaucuagccucaaccagacaccaaggggagcugugcagcauaaacugcaccagggaguuaauccacaccccaaaucagccagccauuggcuaacaagucacccucccaggcagggcaagggugacuuuccagaccaaaggacgggccacugugagcagcuugcagccagcacagcagcugggagcagugcaccugcacagcaagggaugugggugugacaccaauggcaaccacccagccucgucauuuuuggaucaagaucaccuggaauggagucagggaagcaagcucauaaaaucuagagguucucuaccugguaccuucccucucacugcaauuucagcaaaaugauuuacggacaggucacguuaaacccaagucucacacguggcucuggaaugcagucagggaaacaagcucauaaaaucuagagguuuucuacaagguaccuucccucucacugcaauugcagcaaacugauuuaugggcaggucauguuaaacccaggucucaccguggccagugacuacuggggacaaagcgaagccacagcugccuuuggcuuuucauccgugaagagccacagggcagccuucuuguucaccugagguuauaucagguggcucagaacaaacuugggaggggugcugaugagagggugugugcaggacaacaagaaaaguauguguuggggaagacugaguucagacaacaaacaacugcgcugcuucagaauuuggcuuggcccacaguaacaagccugugccgggaugggugagucuaggauuauuggcaagggaccaacacacacagccacacagaauaaacugcaaaaaucuuagcaaggaaaccacacauggcucccugucugcuccaaguugagagaagggagggauucggggcuacauucucuucauagauccuuuccuugcguccagucacaagggaaauagccaugucauugugccugcuggaaagaugcuuccacauaaaaccuccaauggauggcuauguuuggaagccaaggaaaacacugcccaaaaaaauuuuaucaggcacaccugugagguagacucagccuucccgggugucucaggaggaaggccgcuaugagcacguggccagccucuucuaugguugccacaguuacugccucagugccuucacugucccucugagcauccccauccucucaccaucuagaaagucgaagcuggaaaaucucagccagugucugcucaggagggaaggggcugucccugaaauaugguaucuguagggagagcuaucuguugcucauguauggugggcccugaaaagcuccccucagugcuuugagucugcccaacagagaaaaacguccuuggguggcggucccuacacuuggagccucgcauucaggaaacugcaaaucaaaugcuuucugcaauaggaggaauuuccaaaacuuguuuccaccuaaagacaggccagguuccccaagcugcaaugguuauuuaaagugagggcccaugggucaaauugcuagaauaucaggcuuuggagccucccaccagguguuucuccugccucugcuauuuaauuuuuuugaccucagauaagugacucuaaucccugucugucagcuuccuauucugcaccagaaaugcucuggcuccaaguacacacauaaaaucccccaaccuggaagaacuugugugcugggcuugucucuaccccacaucaaugccugaguuacuuuguaagacaauugaggggcaucccagagucauggguugugcuuacgccugagcugcgcuggagccagggcuccuaagaaacacagaguucugcugcauggcuaggcuuggcccacgucacucccaggaugaugcagggcucagggaucuuauccucucugccuguggacgugcuguggacacaucccuuaucugccuuugcugcuguccucagcgaaugggaacaaaacuuggagcccuauacaugguucauagguuugcuguaaagccaaaugcccuucugcaugugugcaauaauauauuguuaugcuugcuagugaaggggaaaaaaggguccagacgaaugcaauagagaauaguuaucauaguacuggagaauguuggguguuuggcaaaacaugaaaugaaaguauuccuaggaagcuaaugggaagaagccuccaugucaaaaggugauaugauacuccuguuggaauuucagaauaaauucaucaacugagagucuuuaagaaagcggguacaggagauaucauccaugucccugccauccccucccacacuccccacccugaccccaaugcuuuugcugacuuucagcugccagugucugcauuuuuguaucuaagggccuuuucccauagcuagacaaggaugcaagugccagggagcuaacuguccccacccaccuaacccagaguagcccucaaccagugaaucucaggaauugggguacaaacacuccagcuccuucacuucucagauauagucauuccaagagguacguuucccugcaggacaaagugccaaucauccacugugggagcaggggaugaugcacugauugacagccucucuggaucacacccuuugccaugugacuuugcagcuccucccaucaggaagcagaguuuauuuccaugcgacccugugacauuugcuuugaucaacagaauguagcaaaagugagaauauauuugcucuggaacuaggccucaugaggucuagugcacugcugcucuccauuuugggcccuggccacacuguaagaguaauccugggcuagccugcuggaggaggagagaccaugcggaggaacgccagcgaaccacaaaccaacagccaggcacccaaccaacccgagguugccugcagaugcaagagggggcccaaaugagaccagaagacccaaacagcugagccuagccucaacagcuggccacagaaucaggagcuaaacaaaugguggcugguuuaagucauggaguucuggggugauuuguuacagcaguaaguaacugauauacaagugcuauggcacauccucaccgcaggcuucccuguguacuuccuuacuucuucauuuccugcacugcucacucaauuauuugcacucaaauccuugucucauggucugcuucuaggagaacucaaccucagaccauguagagugcugccucccuugugcuuccggggaacucccucauauucccaucgugaucaugacuauaguuagugauaccuguuuucaugugugucuccccuucuagacugggagcauugugaugcagcauuaugugucuauuuccaccaggucuggcauacccauagcaagugcuccauccacauuugucaaacgaaugaacaccguagcauugugucaccucucaucaggugaacagaagcugggcucucuggaagggcaugucacccuucgaugucuuucccagagugugacugucccuuacacugcuccucaccuucccuggggccuaaaucccacccuccgccagguaacucccacggaagacacccacauguccauucauccuugaugcguggcugggaugugaggagaggcaucugcugcccccuccuagaaagcccacaucaggcugggcacgguggcucacgccuguaaucccagcacuuugggaggccaaggcagguggauugcuugagaucaggauuucgagacccgccuggccaauauggugaaaccccaucucuacuaaaaaauauaaaaauuagcugggcaugguggugggcgccuauaaucccagcuacucaggaggcugagugaggcaggagaaucacuggaaccugggagguggaaauuguagugagccaagauagcgccacuguacuccagccugggcaacaaagugagacuuuuucggaaaaaaaaagaaggcccacaucagagaaacggcaaacacuuguucugaggagggcaaggaugagcaaucugucaacucuuauucaaaaaguuccauuugguugagcauuuugccuuucuuucaagaauauaccauugagaaauccauuccuauagccagagauuccagaaacagcaaccauuaaagccagcuaggccaggcacaguggcucacaccuguaaucccagcacuuugggaggccaagguggguggaucaccugaggucaggaguucgagacuagccuggacaacauggugaaaccccaucucuacuaaaaaaauacaaaaauuagcugggcaugaugguggguaccuguaaucccagcuacucgggaggcugaggcaggagaaucgcuugaacccaggcggagaagguugcagcgagcugagaucacaccacucuacuccagccugggugacaagagcaaaacuccaucuaaaaaaaaaaaaaaaaaaagccagcuacuccaaaucaacaaacuucugcauuuuuucuucagagcuggugcagacaaugaaggggaaaaaaauuacacggcuaauguucugacaacauuuuccagguuucugaugaguuccuauucaccuucccucauauaauaacaauaauagugaugauauuacauuuuaggaaacugcuggcaugccagccguaagcucaccauugaaucugaggcucuccaaggagagaaaaugcaaccuacauagauaaagaaugugcugacucggccaggcgcggugguucaugccuguaaucccaacauuuugggaggccaagaugggaagcucgagaccagccugaccaacauggagaaacccugucuuuacuaaaaauagaaaauuagccaggcaugguggugcaugccuguaacaccagcuacucgggaggcugaggcaggagaaucgcuugagcccgggagguggagguuauggugagcugagauugugccauugccagccugggcaacaagagcgaaacuccgucuaaaaaaaaaaaaaaaaaaaaaagaaugugcugacucaaugcaaggacugccacugacccagcaggacagauugcuugugucuccaggaggaaaagcuauugaacaaggccuccaggucagacagcacauggggagaauggaggggagggauggcagcuaucuuugcugguggauuuuuugcccaucuaccuccucucuggauuggggcuuucaaagagaggaagacuuuuuacccaaggucucuagccuuaguaccucuggucuagagccagcugauagcugaacccagagacaacagaagccaauguacaggaggagagcgcgauguagaaucagacauuccaagcuuuaacuuucccauacaacaugagccuugagcaaguaaccuggccuuccugagccucugcaccgccucaguaaaaagaguauaagaauauuuauucucaguguuguugaggauuaaaugaaauaauaaugcuaguuuucacuacugaguguuuccuuauaugcuaagcacuuuuagaagcacuuggauauguauuaauuaauuaauaugcaaaauaaccuuauaaggugcugcuguuauuuuccccauuucacagaggagaaaacaggcagagauguuaagcaacuugcucaagguuaugcagcugguaagauacuucagugcuuuuauguauauggaguauucagugggguaucuagugcuuggucagugcucacuaaacaagggugucuuucccuucauaaaacaggacaaacuucacuucugaccuaggcugugcaguugaugauucuaaccauucugccacuuuugagaaggagaacaauuuguuucaaacucuaaauagcucucuggguuuggggauccuccucuggaagacugguuuucauggauggagcucucaucccucagcuagccaacaguuuugggaaaugcacuucgccccaccacccaacccccaugguaacagcacuaucaagguuacaaccauaggacaauuauauguugccaccagaugauucuggcuuuacagauauccugcugugucuuuccaucucccuuaaaaguccuuauuuuaucggaguuggcuagccagacagcaaugaaauguuccacugauuucugauggaaugcaucaaaaaaagaauuuuuuuaaagcucacuugccauagucuuuuucuuuaucauaugugaugcuuucuuagguacugugaguauucaaaaagacaaaacauaguugcauccuuuuacaaauggaauuuucaguccugcuuaauagaaacuuuuaaacaaguuucaucccuguuccuggacguuuugacaauggccuguuuuggaacuggacucaagcccauuaaagaucaugaacuucuaauugaagaguugauuguuuuaagagaucacaggccugccagaauucaugcucuccagagaggaaaauaaaaacauccaugaauccuggucacagacagcauuuccuauggcuugaucucuggccacucugggugacacaaucacucccagauguccuucccucugucuuaagacaaaggcuccucagucugguggguauucagaggccuccagccacaacaccauggaccaacugucuacacagucaucagagaaaucuuucucugugaccccuuugcuucgacuuuucguacagugaguaaggucacggcuaacaggagagcuaaguucuaaagacaucacggaaagcaaaaauuguguccaaguugcccuugugaagcccugggaggggggcaccaugguggaaaucagcacaacaucucucauaaguccaacccugaaaaggcugcuccugcacugagaugaagggcagcugccccacagaccuacccaaggcagggaagcaggaacuguuaugguuggagagaggagcaaacucaaaacucaagcuggaacguacuuucacugagaggaauagaggguaaaaugaccuauaccaucucaauguucuccucucccuuccccacccuggcuccuggagugugcccagcugcauuauuauuauuauuuuuuugcccccggucacccaggcuggagugcaguggugccaucucagcucauugcaaccucugcuucccaggcucaagugauccucccaccucagccucccgaguagcugggacuagaggcgcuugcugccacgccuggcuaauuuuuguauguuuuuuuagagacggaguuuugacauguugcccaggcuagucucaaacuccugagcucaagcaauccaucugccucagccgcccaaagugcugggauuacaggcacagccacugcgccuggcccccuggcuguauucuuguuagguuaaaagcacuuacacuacaacuuggcuguacucccacuggcuucaagaugaaguccagacucauaaguguuccacaaucugguuucucucccuuucuccuucccugucucucacuguguucuccugacugccuccuucauuccagacaccugcagaucuucaugggaguccuguucuccauacuucugcucacauuuucccucugcuuggaaugcgugaguccucauuccucucaacaccaccucuuggaagcugcuccagagcccuggaguaacccaccuagcacucacugugugguaccacuaucucccagccucuugcucugcucacagcaggagagcagggcucacauacugcucacuucugcagcccagugccuagcacuugccuggcuugaacaagaaaggagggcacauuccaucccagacaagaaugaaucaagagagcucaaugauaaccaaagcaguuuaccucugcuuggagccacuaugccuuugccaaccaaauucagacccugguuuccacuagcacuuaacugauuguaucuucccucacauugucccuggcucugaagagugaacauccaaaggucuggauaaaucccauauaacugaaccacagguuuguuaucuaaguaucaaugaacauuucucugaugguuccugugagaacagcuaugggcccaaaaguacaacgaagguuucuuuaauggaggauucggccaaaaggcuauuuugagaggccagggguccucugagaaauaacccaaccuaagaggcugagagcuucgguccaaaggcauuguuucugagguucagaaaaucuucucacccagucuccagaucucaugucugaauuccagagagacggcauugcaauaaagacugaaauagcccugauaacaacaaggcaucaggauaagagacagggcuaccuugcuguuuauauaguauagucaauugcauuaugggucccaagucuucaccuccuccuuauacucaggcccuuugcuguguggcuuuguaauuccucucacuaacuuccugucccuugacuuuggguuuggccaugugacuugcuguggccaauagaauaaggcuggaggaaaagugcaccaguucugagcccaggccuuaagagucauugcacauuucugcaugccuucuuguaccucuguuaugcugugagaauaugcccaggcuuguccacugguuccaaagaaaaaaugaaagacacagggaguagagcugaauggugucacccaagccuagaaccuacccucugcugaacccagaugcauggacaaaucagccaagguccagcugaguccagccugggccagcugaccugaaaauccaugggaaucagugauugcuguucauaucaucgaguuuuggggugacuuuuuuauucagccuuuuuuguggcaauugguagcugauacauauggggggacuggguccuggccaccacacuaguuguucaagcauuauugauuacugggcccacagaggauaacuagcucugaccacacuugaaaggccagacuggggcaguggaggcagcuuuagccaccaggugcuauacugagccuugaauuuuacaucuuaauauaagaaaagcacaauucaauagagauggauuugaucauccacuaauggguagcaaaagcauuaggacuuugcuaacuuaauaccugaccuuggagcaagugaacauuuucccaccacaugaaguuuuucuacgauccaaaauaaauuuccagcauuuccagucugccucaagacaaaacaaauccauauauuuuuguuucuuguuauuuuuucccuaaaacacuuuguggaaggccuauuuaaaauuaaaauuaaugagcugcaaauuuaugaaacuucuuuaaagucaguuccucuaauaaucccaggagguccuucguacuaaugugaaacaauucuaauauccaugccaugaguuuuaaguaauuuuguaagcuuggcaaaacgugugcuauuuuaaucuaccacuauugcccuaaguaaaaguaaugcuaauuaauauuuaagugguuuggaggacuauuugugugugugugugugcguguguguguguguguguguuacaucaucuuccuccaguaaacucaaacugaagaaaaggaaucuuaguauuacuuuccuuugaugaaugaaagaucaugugccaucauaaguuaaaauguacuaguguacguccauacagaaaccccaucugaaagucaccaacauaaagaccaaagguagauaaauccaugaagaugaggaaaaacuagcacaaaaagguugaaaauuccaaaaaucagaaugccucuucuccuccaaaggaucacaacuccucaccagcaagggaacaaaacuggauggagaaugagucugaugaauugacagaaguaagcuucagaagguggguaauaacaaacuccucugagcuaaaggagcauguucuaacccaauucaaggaugcuaagaaccuugaaaacaggcuacagaaauugcaaacuaaaauaaccaguuuagagaagaacauaaaugacccaauggagcugacaaacacagcacgagaacuucaugaagcauacacaaguaucaacagccaaaucgaucaagcagaagaaaggauaucagagacugaaaaucaacuuaaugaaauaaagcaugaggacaagauuagagaaaaaagaaugaaaagaaaugaacaaagccuccaagaaauaaugggacuaagugaaaagaccaaaccuacauuugauugguguaucugaaagugaugaggagaauggaaccaaguuggaaaacacucuucaggauauuauccaggagaacuuccccaaccuagaaagacaggcuaacauucaaauucaggaaauacagagaacacuacagagauacuccucaggaagaccaaccucaagacacauaaucaucagauucaccaagguugaaaugaaggaaaaaauguuaagggcagccagagagaaagguuggguuacccacaaagggaagcccaucagacuaacagugaaucuuuccgcagaaacccuacaagccagcagagagugggggccaauauucaacauucuuuaagaauuuucaaaccagaauuucauauccagccaaacuaagcuucauaagcgaagaagaaacuuuuuuacagagaagcaaaugcucugagauuuugucaccaccaggccugccuuacaagagcucccgaaggaagcacuaaacauggaaaggaaaaaccaguaccagccacugcaaaaacacgccaaauuguaaagaccaucaacacuaugaagaagcugcaucaauuaaugggcaaaauaauuggcuagcaucauaaugaaagggucaaauucacacauaacaauauuaaccuuaaauguaaaugggcuaaaugacccaauuaaaagacacagacuggcaaauuggaugaagagucaagacccaucagugugcuguauucaggagacccauuucaugugcaaagacacguauaggcucaaaauaaagggaugguagaauauuuaccaagcaaauggaaagcaaaagagaguagggguugcaauccuagucucugauaaaacagacuuuaaaucaacaaagaucaaaaaaacauaaagaauggcauuacauaauggugaagggaucaugcaacaagaagagcuaacuaucaucaauauauaugcacccaauacaggagcacacagauucauaaagcaaguucuuagagaccuacaaagagacuuagacucccacacaauaauagugggagacuuuaacacuccacugucaaauauuagaucaugagacagaaaacuaacaaggauauucagaacuugaacucaguucuggaccaagcagaccuaauagacaucuacagaacuuuccaccccaaaucagcagaauauacauucuucucaguaccucaucacacuuauucuaaaauugaccauguaauuggaaguaaaacacuccucagcaaaugcaaaagaacagaaaucauaacagucucucagaccacagugaaaucaaauuagaacucaagauuaagaaacucacucaaaacugcacaacuacauggaaacugaacaauggccuccugaaugacuacuggguaaauaaugaaauuaaggcagaaauaaauaaguucuuugaaaccaaugagaacaaagacacaacauaccagaauugcugggacacaccuaaagcaguguuuagaggaaaauuuauagcacuaaaugcccacaggagaaagcaggaaagaucuaaaauugacacccuaacuucauaauuaaaagaacuagagaaguaagagcaaacaaauucaaaagcuagcagaagacaagaaauaauuaagaucagaacagaacugaaggagauagagacaugaaaaacccuucaaaaaaaaaauaaacaaauccaggagcugguuuuuuuuuuugaaaagaucaacaaaagagaccacuagccacacuaauaaagaagaaaacagagaaucaaacagaaacaacaaaaaaugauaaaggggauauuaccaccaauccuacagaaauacaaacuaccaucagagaauacuauaaacacuucuaugcaaauaaacuagaaaaucuagaagaaauggauaaauuccuggacacauacacccucccaaaacuaaaccaggaagaagucgaaucccugaguagaccaaaaacgaguucuaaaauugagguaguaauuaauagccuaccaaccaaaaaaagcccaggaccaggcggauucacaacugaauucuaccagagguacaaagaggaucugguaucauuccuucugaaacuauuccauucaauagaacaagagggacuccucccuaacucauuuuaugaggccagcaucaucugauaccaaaaccuggcagagacacaacgaaaaaggaaaauuucaugucaauaucccugaugaacaucaaugcuaaaauccucaauaaaauacuggcaaacugaauccagccgcacaucaaaaaguuuauccaccacaaucaagucggcuucaucccugggaugcaaggcugguucaacauaugcaaaucaauaaacauaauccaucacauaaacagaaccaaugaaaaaaaaacacaugauuaucucaauagaugcagaaaagggcuucaacaaaauucaacaccccuucaugcuaaaaacucucaauaaaccagguauugauggaacauaucucaaaaaaaaagagcuguuuaugacaaacccacagccaauaucauacugaaugggcaaaagcuggaagcauucccucugaaaacuggcacaagacaaggaugcccucgcucaucacuccuauucaacauaguauuggaaguucuggccagggcaaucaggcaagagaaggaaaaaaaggguauucaaauaggaaaagaggaagucaaauugucucuguuugcagacaacaugauuguauauuuagaaaaccccauagucucagcccaaaaucuccuuaagcugauaagcaacuucagcagucucaggauacaaaaucaaugugcaaaaaucacaagcauuccuguacaccaaaaacagacaaacagagagccaaaucaugagugaacucccauucacaauugcuacaaacagaauaaaauaccuaggaauccaacuuacaagagaugugaaggaccucuucaagagaacuacaaaccacugcucaaggaaauaagggaggacacaaacaaaugaaaaaacagucugugcucauggaaacaaagaaucaauaucgugaaaauggccauacugcucaaaguaauuuauagagucaaugcaauccccaucaagcuauaacugacuuucuucauggaauuagaaaaaacuacuuuaaauuucauauggaaccaaaaaagaaucccuauagccaaggcaauccuaagccaaaagaacaaagcuggaggcaucaugcuaccugacuucaaacuauacuacaaggccacaguaaccaaaacagcaugguacugguaccaaaacagagauauagaccaauggaacagaacagaggccuagaaauaacaccacacaucuacaaccaucugaucuuugacaaaccugacaaaaacaagcaauggggaaaggauucccuacuuaauaaaugguguugggaaaacugguuagccauaugcagaaaacugaaacuggacccuuuccuuacacuuuauacaaaaauuaacucaagauggauuaaagaguuaaacguaagaccuaaaaccauaaaaacucuagaagaaaaccuaggcaauaccauucaggacauaggcaugggcaaagacuucaugacuaaaacaccaaaagcaauggcaacaaaagccagaauugauaaaugggaucuaacuaaacuaaagagcuucugcacagcaaaagaaacuaucaucagagugaacaggcaaccuacagaaugggagaaaauuuuugcaaucuauccaucugacaaagggcuaauauccagaaucuacaaagaacuaaaacaaauuuacaagaaaaaaaacaaccccaucaaaaaguaggcgaaagauaugaacagacacuucucaaaagaagacauuuaugcggccaacaaauauaagaaaaaaugcucaucaucauuggucauuacagaaaugcaaaucaaaaccacaaugagauaccaugucacgccaguuagaauggcaaucauuaaaaagucaagaaaacaacaggugcuggagaggauguggagaaauaagaaugcuuuuacacuguuggugggaguguaaauuaguucaacuauuguggaaaacaguguggcaauuccucaaggauuuagaaccagaaauaccauuugacccagccaucccauuacuggguauacauacccaaaggauuaugaaucauucuacuauaaagacacaugcacacauauguuuauugcagcacucuuuacaauagcaaagacuuagaaccaacccaaaugcccaucaaugauagacuggauaaagaaaauguggcacagauacaccauagaacacuaugcagccauaaaaaaggaugaguucauguccuuugcagggacauggaugaagguguaaaccauuauucucagcaaauuaacacaagaacagaaaaccaaaugcugcauguucuuagucauaagugggaguugaacaaugacaacacagggacacagggaggggaauaucacacaccggggccugucaggggugggggguuaggggagggauagcauuaggagaaauaccuaauguagaugacagguugaugggugcagcaaaccaccauggcauguguauaccuauguaacaaaccugcacguucagcacauguauccuggaacuuaaaguauaacaauaaaaaaaauguccuaguguaggcacugguucauaauaguauauucaugucauuucauccaaacuuaacucucauaguuuuaaguaagggauacacuaugcauuuugaaaaauaacuaccaaaacuagugacuguuuuucagaaaugguaauaaaacuaauagagggguuucuggccccaaggcuaaaacagucuuucagaaggaacuguuucaaaaggaagccauucugugaaaugaggcuaaaugaucaggaccagcaccuucauccuaaaugaagucuaaaauaaaagguuggcaaagaggaaacagaaggccgcuguacgguucaccuuuagccuugggggauucaugcagugcgggaggaaacccugaaacaauaaggagacuaucugcucacuuggaucagggcagccugccccucuccuucagcccucuccugccacagaaauguuacuuguuaaaacauacacuaguguguguguguguguguguguguguguguguguguguguggaggcaggagggcauaaaccuuuauuuaauaauaggaugaaucauacauaugaaauuguccaaaaguucaaauauuggcaauuucauaugauucaacuuaauacaaucagcaagcauaaaauagccaccccucaaauacucauagaaauuagaaauacaagcuacauugugagauauguggaauugcaaucaacacacaaaaaaaccuaaacaaucuucccaacaaagcuuuuguuauaauuauuuuguaacauacauuuuuuuaaaaccacagaauauuacuguaacccaucaacucuguuuauccucuucaguggggaaaucugcacauucagguuugggaccuggggucaagaaaaaggagccugagaacaaugcucugaaggaaacaccgacauaccuggagagcagcaguuuacccugaagcugcaggucugcggcacaguccucugaacggcaauuccuuucaaaaacagucugugagaaagacaggagaggaagguuagggcaggauugaguggcaaacgaguacacaguggccaauuccuuucuugcaaaucagugggaauuccuccccugagccccucagggcuucuacucccaccuccaaaaagccagcucuccagcgugggaagggguucuuccaagcuccaaggaagccuaagucaacugugguuuugauuuugucagugcauuacuuauuugauucauucccuagucuacugaagugcuucuccaagcaguuuuuucaagagagguacguggugguggauguccuuucagucuuugcuugugugagacugucuuucagaugcucuuagaugaaugauaauccaguugaguaaagaacucucagauuauaguuuggucauuucccccuauuugcucugccuuggggaugcaggaaauuuauauaugaaauagguucugccugagcaaugggacuguauugaauugucaguauuaacaggaaaaggcaaaggcaauuaggccaucaggcugagggaaucacaacagacugggggagauucuuuccaguuuguugguggggcagccagcaguuaacagggacacagugccuuuucucuaaccaagacugggccucaacagccaaagccccacccagcccuuacuggggccaagucuuggcaugucaaaacccaaauauuuccagagagcuugcuggcugugccugggccugggccuaucuguggaggcuugccaggagaucagcagcagcauuuggagagggguuagggcuuucuucuacgguccauggagggcuuguuagucuuccccucaaucugucucaaccucucugacauuucagaucuauggacaguagcuuccccaaguuccagaugacagagacucuucacuacuguuagauggcuuugcucauuucaguggaauuuggagagaagagccuguugacaacuuuuaguuguaauuuacucauuauuaaacuucuuccuugucacugcucauguucgugaguuuuuuccccaaaauguaguuccagguuauuucuucccugcccagagaauaaguccaggcagcaccucagagugucagugugggcgccagcaaacgugcuggccaacgaacagucuagacucgaccagacagaguaauuucgccuaugaaaauucauauuccccugccacauuuccaaaagaaaaaagugucccagccaacacucccuuccuugauuaucagggaaaauaucauggaagucuugggaaaaaagaggaaauuccuguguucuuuuggacacuacuggggucaaggagagagccaaauuuccaggagauuucaauauauuugcucuuucuuugccaucuuaacuaagaagaaaacaggaggaaguggguguaaggauggcaugaacgucucaggcaagaugaaaggugggcuuuaugagcuuugaggacagagggaaggugccaaagggagcuuccccaccacacuagugaaacuucagcuuagagguccccagcugacauggccccuagggaagccuugcacaaacuuugucuucauaauuucaccuuuuuuuuuuuuccuucaagaccccacccucuacuauauaagccucaggucucacaaaaccuggacuggccccuaguguacaguccccucaucacacaugccuuuccugucucacaggcaagacaguccaacuuugugaggcauggagaggugaagggguagagguggagguggagauggaggugaaagaggugagaacggaagaacaggaugugaccuaaauccaucuggugacaugcaggcugccagaucuggcaugugcccuccucaccucugucacccuggcuuucucaugccagcuaucacucugguuguccuuacaacuucccacccagggccuccccacaaguggauccccagauuccuccagcugguucaccuaguacauguccucucacccuucaacaagcaaauccagaccacuucucugagucccugggcaaguucaggcccaucgugagcucucacaguuccacacacuuuucccuccuacugcucaucucaaucauaacuaaucaauuuuaucauuacauguucaaugguagucuccccugcuaaaaugaugucccaagaggauugcagggggcacuguacuggucuugcuugccucugugccugcccuuagggccuggcauguaguugcugcuuuaucaacaccgaaagaccacacauugcucugagagacagagugaccacucaaauggggagccaaaugguggaugccccagcuuagagccaauaccagcacacuguucaucaaaaccaaagcuccaggccccuaaccaaaguacugucucuuagccaugugagaugcaaagacuucucacgaggaauugguugcuuuguaaagacucauuuuccuuguccuaacuuuuccuugaacucuacuauuuccugucccugaaacuggcuuuucuagcugucuaguccuccagugcugcugaauuuccauccaacaaaggcaagcacugaguuugacauauacacacacacagugcguguguguauaugcacacaugcacauguacacaaauaucccuacagguuauaugagugcuuguacugauaagauaaaauuaagcacaaucauggaaagauaaaauacuaguuaagaaauaaggaaauucaaaguguaauccuauuuuaauuguauuacauuaagaaaauugacuuuucuucccuccaggacucaguuuccucauuuauaaaaugaaaauaauagcacucgucacugucccauaaauccagauuagcauuuagccagggguaggagcuugcagugauagcaauuuugucuuaggcacugugcaucacuauuuaacauuggcaaaugagagcgacaacagugugacugagugaacaccaugaagcuuaauuaauggaugguggggcuggguguggaugguggggccaggcaugguggcucacaccuguaaucccagcacuuugggaggcugaggcgggugaucaccugaagucaggaguuugagaccagccuggccaacuuggugaaacccugucucuacuaaaaaugcaaaaauuagccgggugugguggugggugccuguaaucccagcuacuugggaggcugaggcaggagaauugcuugaacccaggagagagagggugcagugagccgagaccaaccauugcacuccagccugggcaauaagaacaaaacuccaucucaaaacaaacaaacaaacaaacauuaauggauggugaaauaaggagacaaagaauugaugugaauuuaccucugugcagguaaauuauuuuccaaaaaucaaugcaacaauaucucgaugauggcacuccuuacaaugugacuuugaaacuacucccauagagagguggggucuaaugcucccuuaccuggaaucuggguggacuuuuggcuacaguggaagugacacuaugugacuucugagacuaggucauaaaaagcaauagagcuuccuccuaauuuucuuggggcauuuguucuuagaauuuagccacucugcaagaaacacaagcuguccaugcagaggcucacaggagacacugacugccacaucaacuugcaggcuacgugagucaccaugacagugaaaaccucagagauguccuccaaucccauugaguugccccagcugauagacauuauauggaacagagagcuguguugaucaagcucugccaaauugcaaauucacaaaugaauucacaaacaauuuucccauuuucuugcuguuacugauuucuaguuucauuccauugugguuggaaaagauacuugguaugauuucgaucugaaauuugcuaagauuuguuuugugaccuaauaugugaucuauccuggagaauguuccauggcuacuugagaaaaaugaauguucuuccacuguuggcugaacaguucuguauaugccagcuagguccauuuguuacacagguccaguuguucaagucuacugcuucuuuacugauuuucugucuagauguccuauccauuauugagagugggguacugaaaucuccuauuauuauagugcuaucaauuucuccuugcagaucugucaguguuguauauacuuaggugcucugaugcugggugcauuuauaauuguuaugucuuccuguugaauugacccuuugucauuaagaaaugaccuuugucucuagagacaguuuuugaauuaaagucuauuuuguugauauaaguauuaaccacuccugcucucuuuugguugguauuugcauggacuaccuuuuuccaucucucuguguguccuugaaucuaaaagugagcuucuuguagacagcauacaguuugauccugguuguuguuguuuuuuuuaauaaucuauucagucaugcuguaucuuuuuauugggaagguuagucuuuuuacauuuaaaguaaauauagagacagauuuacuauugccauuuuggugacuauuuucuaugugucuuguucuuuugucccucuuuuucucccuugcgguuuucuuuuguuuuguuucuuuuuuuuuuuuguaucgauagguuuugauuccuuucuuuuuuuauauauauaacuuccauagguauuuucuuggugguuaccaggagcuuacacgaaauaauuuguaacagucuguuauaaguucacaauguaacuuuacuugcauaaaaacucugauuuucccucugcuccccccaaguuacaugcuauugaugccucaguuuauaucuauuuauauuauguacccauuaacauaauuuaguuaauacuuauaaugguuuuuaaaauacuuuugucuuuuaacuuucuucauagacauaaaagcuauuuacucaucaccuuuauaguaauauaguguucugauuuuguccauauacuuaccuuuaccaacgaguuuccuucuuuauuaugcucucuugugcuauuuaguguccuuucauuucaacuugagaagcacagguuuacuggguauaguauuguuggcuaguaggguuuuuaaauuuuauuuuauuaauuuauuagagacagggucucacucugucacccaggcugcagugcaguggcaucaucuuggcucacugcagccucuaccuccugggcucaagcgauccuccuaccucagccucccaaguagcuggaacuacagccacaugccaccaugccuggauaauuuucuguuuauuuuuuguaaagacaaggucucauuauguugcccaggcuagucucaaacuccuaggcucaagugaucuuccugcuucagccucccaaaguguugugauuacagguaugaggcacuguuuccaucaauacuuugaauauaucaccccacucucuucugaccugcaagguuucugcugaaauauccacaucacuaaucaucagggaaauucaaaucgaagucacaaugaaauaucaccucacaacaguuaggauggcuacuauaaaaacgacaagagauaaaaaguguuagugagggcauggagaaaagggaacccuuauacauuguugguaggaauguaaauugguacagccauuaugaaaaaaguauggagguuccucaaaaaaaauaaaaauagaacuacuauaugacccugcaauuccucuucuggguauauacucaaagagaaugaaaucaguaccucauagaaauauuugcauuuccauguucauugcagcauuauucacaacagcuaagacauggaaucaaccuaaguguuugucaacaggugaauggauaaagaaauugugguguguauauauguauauauacuacacacacacacauauauauauacacauauauaaacauacaauggaauauuauucagccuuuaaaaaggagauccugccauuuuugauaacauggaugaaacuggaggacauuaugcuaagugaaacaagucacaaaaagaaagaaaaauauuguaugaucucacuuauugcggaaucuaaacaaguuaaauacacagaaccagaaagugaaacucugauaguuaccaggggucggggaggggguagggaguagggaauggggagauguuggucaaagguacaaaguuuugguuagguagcaugaaaaaauuuagagauugaauguauagcgugaugacuauguugacaauauuguauuauauacuggaaauuugacaauaaaguagauuccaagugcucuuacuaucaaaaaaaaaaaaaaacuauguuaggcaauggauauguucauuugcuugaccauaguagccauuucacuauguaaauguacaucaaaacaucauuuuauauaccuuacauacauuaaaaaacaaugaaaucaaauucaugaacaaaauaaauguuauuuuaagcuacuaaauuucagaguuuguuaugcagcaauagaauaccagaauacucagccaaccuaauggccuucccuaacuugggcaaugcuauuaacaaaaaugggcugcacaauccaaucccugccaaagucuuggcuuagguaagaccuuccauaggcuaggaaugcaauuguuuaauagguaaaaaaacaauacaccauggaaucaagagaccugagucacgcacuggggagccugagguugaaacucagugccuguguucuaguccuggauuagucucuuugggcaaauggccaauuuguuuccuaaggaacugaaaggcaucucucuggagcaggaggguggacagacuaaagccuuggaauacuagaugacaaugcaguuucaaaaaccaaguagaaaugacuucuccuugguacaaaguacagguucuccaugaagccaauggcccaaacuccugauuuuccucugagggaacaaucccaauagcuccagcuugggccuuuaaaaaaaggccucagccugauuuuauccacauccuccuaaguccucuggcaaacacaagcuuggcugcuucaaucagacaaaucggaacccagcuuggaagcagucucuuccaccucccuccagacuucaccugcuaguuggccaaagcccugucuaguuauuucccuggaagaaguuuuuccagcaaauguaaacagaucuaagaagccaucaucucuuauuccucccuaguuaaaggagguucaaaccuuucucucgggagacaacuguuuccugucucaggcuucagagagcugaagacuggacauccaguggccuccucagccucauggacucgauuucucugcuggcuccuuccucaccuuggucuucaucucagguuucccuggagaauacaguugucuuugaaaauauuuucuccagcuucucacuaaauccuuacucuacuucuuuuagaacaaggcuggcaacuuuuucugaaaagggugagacaguauauguuuugggcuuguaggcuauauggucucagucacacuacucaacucugcuguuguagagcaaaagcagccauagauaauacauaagggaaugggcauagauguguuccaauaaaacuuuauuuacaaaaacaggcagugguggauuuggccuaugggcuguuuguugaauccuguuuuagaauauuuggcuauguuucuucauuuccuucaggccaggaaaaaaaagauuucaaugaauccagcucaaguugcauuuuccucugagucagaguaaggacgcuggggcuggcugugcuucucuuacagugccauggucaccaaggccagggcagcuuuggggacaugugauucagaaauagcagcucaguguccgcuccuggcugagggugacuucagagaggaugucaucuaggugcuaaggccuugggaaggguagcucauuucucccacccaaaucuguaccagaaaaucuucacuucugaucuaacaggaaauaggauucuuagccuaguccagcuaucauguucagaggaggaucaguuucuuggacuuggugauauuugcuuuuaaaaaauacaauuauugacauggauucaacacuguuuauaggguugauaugacaaccaaaucccaugcugaggccuaaaaaaaguagaagaauuggacugaauaaucccacaccaagaagagcaaacaagaaggcuauuuuuaagcugauuugaucaaugcauuuuuuuuuugagaugagucuuguucugucgcccaagcuggagugcaguggcacgaucuuggcuaacugcaaccucuaccuccuggguucaagucucgugccucagccuccugaguagcuaggauuacaggcacguaccaccaugccccgcuaauuuuuguguuuuuaguagagaugggguuuccccguguugccaggcuggucucuaauuccugaucucaagugaucugcccgucucagccucccaaacugcugggauuacacgcgugagccaccgugccuggccuagcaauauauuucuugauaugcgguaugacuuagcagaaggucucugccccuauggugaagcauccugucuggaugacaggagugacauuucugaacugguguuccuucuauagccccacacaaguuuccagaggcccuaaucauguaauucauguuuauaacccccagcaccuagcacaguauuuaaauuuuuuuuuguauucauauaaauaccaugaccugaguguaagagguuucucccucccaauucuguuucaaugggcuguuuucccagaauccaaaacugcccuucauguggcacguuauaagagugcaggaauuucagcuccauucagccccaugccuaaacgaaggaaggaaaaggcucauugccucuuaaaaucaaggcauacacuguugcuuucuaaaacauucauauccucaagaaucaaugaaaggcaaaucguucaugaaauuaaagcugaggaauccuucuaucucagggucuguacaaauuguccuuccagauuuugaaaccauggaaggauaaaaaaacccucuugguuucccuuuaaauacaaacccggcaccaauuuugcuuuaugguccuguggaaaaacuagaaaugacaaguucugcuaucuuggguguuuuuuuuacuccauggcucugcaguuugcagaauuauccccucugcccaaaggcaacauuuuuaaaaacaugguauauauucaugggauacaagugcaguuuugccacauugauauauucugucauggcaaagucagggccuuuggugcauccaucacugggccaaugcacauugcacccaacaagcaaccucccaucauccacccagcuccaacuuccccaccccuccauuguccaucaucccacaaucugcuucuauguggacacauuauuuagcucccacuuauaaacgagaacaugugguauuugucuuucugugucugaguuguuucacuuaagauaauggacuccaguuccauccaucuaaaggcaucauuuaggcaauccaguucaaccccugugauaacugagcagggcugacugcuuggugaggcccuggccccaugggacucccagcccagugcucuuccuggaucugccugggacuagguggccuuuuaugggacacauuucaugucucucuauaaucacaacuuuucauuucagcucaaaacucucuucuagggacuuuugcaccccaggacuagaaauucuccuuuuucacccuggaauuuuuuguguucuauguuucauuuuucuuuuuuaguugcuguuaauuagucagaagaggcagaaaacagcuaggaaguucaaauaaaggggcuggugcugucagagaaaagaaaaaaggaugccagccacguuucuaaaagcugcuaaaccagacaugggcaggcaacugggagugagaaaaaaaaugccuuaaaaccagagaggaucccagcaagacuucuccccaucuaucugcaagaacauccccuaaauaaggcuccagguauaagugcacacagcaagggccuuguacuugauuuccuaaauuaucucauaagauaagaaaagagaggcuaacguuuccuccccagccagacacuguccaccggguguguuuaaacaccucucaccccacacauacuuuugcacaagguuuucaauaggacaggauaauacagaagaaaacucaauaagcuugaagaguuugaggaaaccaugauuuucuucuaaaaaggguuucagaagccuagaaugcauuuuccccccacaaauugcaaaaauaaaacauaacacugaaaaagaaguuuugcaaauucaacaggucacuucaggacauggucuaaccuuugaugaguccccucuccuuucccguugggguuaaccuuggagaagaagccugagacagacagauaaggccagacuucuccacuggucagugagaagggugaauuaguuguuuuucucacacauacuucaaacuagaugguuuucacauguguucugccauggugcccucuuugaaaagaguauuuacccagaagcugauacccauaagaguaggguugaucugggucaaacaacauuggagggcaggagccuuuuccucuaacaccccuuuccccuccugcugagccaaacugcugcccugacuccaagugugcaaucugaaaucccccaguuugcacggucucaggagccugucugguucugacgucuggagugacucuucucccucuccucuucuacucucccacccucuuagccuuccauuccuucugcagagacguuuaaauauaauaaugaaaauaaaccuuagagcuguaaauaauggcauguuaagccagcugggcaccucagccgggaaacuauuaccuaauguccaggcugugcaaacaguggauuuccauagcaugagcuauauuccuauaugcaugcauugagggguguggggugggaggagcuguagugacgauuuccagcacaauggagacccaaaguguauggcuucaacauaguuaaaaauuaccauuagacuaaaauagcucacuuuucacuugaaagacaacaaaguaagacuucucaacaaagccgacaccuuuucuuucaccagcuguauauccuccaucuugucuuuugaaaaguagucacuacaaacauaccgugguauagauaugucacugcaaaucacacaucaugcucucuugcccguggggaauucccagagggauuacagaacacauuucuuuuaauuuuauagcucugcugaaucugcuagugaagaagcucugauaugaugcccaauuuuugccaaaggaacuagccuuguguucuuccagaagggcucuuucaacuauuuacuauuuacuaagcauccacuauaggccagguucucugccagguguugcggaucaauagcaaauaagauaaaauagaucccuucccucacugggcuuccauucuagagagguaaauacaauaacaaguagacgaaauaacacguucuguuagaugucacgaaggaaucaaauaggcagcuaaggccaugcacgguggcucaugccuguaaucccagcacuuagggaggcugaggcaggaggauuccuugagccuaggaguucaagaccagccugggcaacauggggaaacccuguguccagaaaaaaaaauuuuuuuuuuuaaauagccaggcgugguggcacacaccaguggucccagcuacuugggaggcugaggugggaggaucacuugagccuggaaagucgaggcugcagugagccaugaucacaccacugcacuccagccuaagugacagaaugagacccugugucaaaacaaagaaaggcagcugagucaggaaauacaggguagugggagaaugguucuuugaggaggcaacauuuaggcugagaccuaaaaaaugaagagcuggccacgggaaaagcauggcaaagugcuuucuagaugagguaucagcauaugcaaagggccugaggcaggcagaggccugguaaguuugaggguggugggaaugcaguaugcggguggcgcuggcgaggcaggagccccacuguacaggcucucgugggccuuagcauguguccggauuuucuucugagggggaagggagcuccucagcgggaggagguuaugcagggaugugaccuggucuaggugacaaaugaugguggccuggccuagggaauggcagcagagauggagaaaagagaagggacucaugcuaucugggcucaugguggugcggcuggcucccgaguucugguuauauggguccuccccagaucuucucccucugcgacagacuaacaggcaucuuugggccugacacgugagggccagacacccuaaagauccagagagguucaucugagagccugccagaacccuuagaccaguguucuccaaccuuuauggcaccagggaccaguuuugugaaagauaauuuuuccaugaacgggcgguggagggggcgggaugguuucggcacaaucuagaucccucacauguguaggguucauguuccugugagaaucuaaugccucugcucaucugacaggaggggcgcucaggcgguaacacucgcuggcccgcugcccaccucaugcuguguggccggacugguacugauccaggaguuggggacuccugccuaagauggugccauugcgucccaccggggagcccacccacgggccugcagagacgggaccccccucagaggaaaggauguggaaaggcagcagagcaccugcuuccucagagcccaggucagaccugcucccaugacggccucauccucuccucacaacaccaggaagccggcuucccaggaagggaacagcaggauccagugcugccucaucauuuccgggcuucucacauuucccucauguaaucccaccaccacccagaggcaggcagagcagccgauggcacccccagugacaggugaggaaacaggcucuaaagggugagugcucugggccagggcccugaucucacugcacagccugugcuccuuccccagagagcccagggaggaaagaagccccgggguucuggaggugugggcuguauugugugucuauuauuuucuauugcugcaguaauaaguuaccggaguucagcugcucaaaauaacacaaaucuauuaucucacaguucuguaagucagaggucgguggguugucugggucugcuccagguucuacaggccgaaaucaaggugucagcuggucuggacgauuaucuagaggcccugggggagaauccacuuccagcuuuguucggguuuuuggaagcaccugguucugugugguuguaggacugaggccccguuuccuugcagacagucaccuggaagccucucccagccccuuaagguuguccacauucucgucacaucacauacuccaucuucaacaucagcaaaggcaugcuucaagucucucugaccuccuauuccgccucauuccucccaccuccagcuggaggaaguuugcugcuauuaagggcucgugugacuagauuggacccaccuggaaaauccaggcuccucuccccauuuggaaguccaucaccuuaauuacaacugcaaagucccuuuugccauguaacguauccaaaucacaggcuccagaaauuagggcauggacaucuuuggggggccauucugccuaccgcagugaaagaccuggaagcccugcuguagccaggucucuuugggggccugcugaugaagccugagaagaguuauaauuuucagagcgcuauucuguguacagggauugaagacagggccucugucaucaccauugguaugcucagcugaggaggagggauaaaggaccuucaggugaccaguccaaggacagcauugcucccuucccagcacacggaccagccaggacuucccaugauuguuucauuuaguuccauacccucuguuucagcagcugagaccaacuagcaauuaauuaggagucaacucucugggggguaucacacagacuccccagggacucaccugcaaaggccccugcaacaagcucuuucuuaacuggccuccccauacccaggcacaccaaucucccugaggcacaucuacgaucuccccaaacugcaaaauaugccauggucuguccaccguagaaucacauccaacuccucagccagugaacaaguggcuucagacugcaugacugaaucuccaguccagauggccucuccccuuucccucacuagauauucagccacgugagagaccuuuagcauccaucagccccuccauucccugaggacccaaauccuacuccaccuuuaaggcucuggccaauucuccuuuucuccauagaacaucuucuccucagccagaaguggccucugcagugaaauucuuacacacuaaucuaaaucucacuuuguaaauuauuccuggacugucugugacuccaaugaaggcagcaaugauuuauuuuuucaucgaggucuuacauaaaguagacacacaauugaauugcuuccagcuuuauagucuuuuaaaauacuccucugguuaaugaaaaaaagguugucuuuuuccugcuaucaaauaugccucccuuucugaugagacagaugcaggucuuugcuuuccuuaaauuuugaaggugcaaugugugcccaucaggcuguauguacggaggcuuguagcauucaagcuccaccguccccagagcgcccagaaucccaauccaaucucagcauuagcagcaaucccacuauucacucaccagagccuagugccaaagcccuauccuggaacccgucuucucccaggacuauguacccuauagagggaaggcuuggucuccugccuguccugcacauuccuaacucauagcaaaaagccucagauuaaucaguaagccuguacuuaacauguacuggucacuaucuccauguuacacacacagucugugcagcgauuccacuuuaauuaggccaucagugggggcagaccccaacucuaaaaggucaucaugauuugauccacccuucuguauaguccuggguaccaacaugggcucagugaagagaucaaggcauuuaaaguaguggaacccuaauguuaucuggcaacaugaccuagagaguucugaugaauuuauuccuuccuaugaaagaggugagaugcucugugucaaacuguuguguauauauacacagguuaaagaucagcucugcuuccugcagugggccucacucucagaaucuuuccuccuccucaaacugagccaacaucuggaagauuaucuuuuuuuuuuuuuuuuuuuccccauaaucaggaaaaggacaauaagaaagaacugcucucccagaacuucucucaggcuccuggacaaucuucccaaucuaagaacaauuuuuucuuuuauuuuaauuucaaccaaagaaucacaugguuagaaaaauaauaacccccugccacauaccucgccauacugaguccuccucuccaggggcaaccauuauuacucauuauuacccacguccguuuauguuucuuuugaugauuauuuccauaucucuagaaaacaugcugauacuacuacucguugauuuaucagaucuagacauuauuuuacuaaauuccuuccaugauagacaggaauuuaucucacauaacgauccccacuccuucaccuccauaauuuugaugggcaaauuauuaguuuaacuccucuacuguaucaguucucauacuuuagcugcaugagaaucacccagccaucuuguuaaaacacggauugcuggccgggcacgguggcucacaccuguaaucccaacacuuugggaggucaaggcggacagaucaccugaggucaggaguucaagaccagccuggccaacauagugaaaacuugucucuacuaaacauacaaaaauuggccaggcauaguggcgugcaccuguaauccuagcuacucaggaggcugaggcaggagaaucacuugaaccugggagguggagguuacagugggccgaguuccugucacugcacuccagccugugugacagaggauucuuugucucaaaacacaaaaacaaaaacaaaaacaaaaacauaguuugcuggggcccaccccaucagcuucugauucagugggucuggggugggcccaagaauuuucucaaauugucccucuuugcagaugacaugauuguauauguagaaaaccccuucgucucagccccauaucuccucaagcugauaagcaacuucagcaaacucucaggauacaaaaucaauguacaaaaaucacaagcauucuuauacaccaauaacagacaaacagagagccaaaucaugagugaacucccauucacaauugcuucaaagagaauaaaauaccuaggaauccaacuuacaagggaugugaaggaccuccucaaggagaacuacaaaccacugcucaaugaaauaaaagaggauacaaacaaacggaagaacauuccaugcucguagguaggaagaaucaauaucgugaaaauggccauacugcccaagguaauuuauagauucaaugccauccccaucaagcuaccaaugacuuucuucacagaauuggaaaaaacuacuuucaaguucauauggaaccaaaaaagagcccgcaucgccaagucaauccuaagccaaaagaacaaagcuggaggcgucacgcuaccugacuuuaaauuauacuacaaggcuacaguaaccaaaacagcaugguacugguaccaaaacagagauauagaccaauggaacagaacagagcccucagaaauaacgccgcauaucuacaacuaucugaucuuugacaaaccugacaaaaacaagcaauggggaaaggauucccuauuuaauaaauggugcugggaaaacuggcuagccauauguagaaagcugaaacuggaucccuuccuuacaccuuauacaaaaauuaauucaagauggauuaaagacuuaaauguuagaccuaaaaccauaaaaacccuagaagaaaaccuaggcaauaccauucaggacauaggcaugggcaaggacuucaugucuaaaucaccaaaagcaauggcaacauaagccaaaauugauaaaugggaucuaauuaaacuaaagagcuuaugcacagcaaaagaaacuaccaucagagugaacaggcaaccuacagaaugggagaaaauuucugcaaccuacucaucugacaaagggcuaauauccagaaucuacaaugaacucaaacaaauuuacaagaaaaaaacaaacaaccccaucaaaaagugggugagggauaugaacagacauuucucaaaagaagacauuuaugcagccaaaaaacacaugaagaaaugcucaucaucaguggccaucagagaaaugcaaaucaaaaccacaaugagauaccaucucacaccaguuagaauggugaucauuaaaaagucaggaaacaacaggugcuggagaggauguggagaaauaggaagacuuuuacacuguuggugggacugucaacuaguucaaccauuguggaagucaauauggcgauuccucagggaucuagaaccagaaaugccauuugacccagccaucccauuacuggguauauacccaaaggauuauaaaucaugcugcuauaaagacacacgcacauguauguuuauagcagcacuauucacaauagcaaagacuuggaaccaaccuaaauguccaacaacgauagacuggauuaagaaaauguggcacauauacaccauggaauacuaugcagccauaaaaaaugaugacuucguguccuuuguagggacauggaugaaacuggaaaccaucauucucagcaaacuaucgcaaggacaaaaaaaccaaacaccgcauguucucacucauaggugggaauugaacaaugagaacacauggacacaggaaggggaacaucacacaccggggacgguugugggguugggggaggggggugggauagcauuaggagauauaccuaaugcuaaaugacuaguuaaugggugcagcacaccaacauggcacauguauacauauguaacaaaccugcacguugugcacauguacccuaaaacuuaaaguauaauaauaauaaaacuuuaaaaaaagagaaggaaauaagaaauuuaggaaaaaaauaaaauaaaauaaaauaaaauaaaauaaaaacaauuuucauuucucacaaaaucccaagagagguugaugcugcugguucaggaaucacacuuuaggaaguguugcucuacugaugaccucugcaauuuuaagccaacagugauuuccuguuucaucaaguuuugcaaucucuugacucaucaauuuaaaagauuaagauauuaagaaaacuuaucuuauucuacuuuuaccuuuauauaaucaaguuuaaugacauuugcauuuuaugcuaucaccauagcucugauuuuggcuuaauuauaaauauugaaaaccaauaaauagugcuaauuuuauuaugguucaugauuauugcucacaguugagccaagacaagugucaugauuauacauccuccucuacaguugcaaaguuaaaguccaggaauauucaacuucuacuucagauagaauauuucuaggaucaacauucuucuuuauacucuucuacuuacucaaaauccuaccacauuuuaaguuuuuguaugcuguguuuccauuuucauuugucuuaagaaauucuuaaauuucccuuugaauuauuucauuaacccaauggucauucaggaccauguuauuuaauuuccacguauuugugaauuuucugaaguuccuccuguuaauuauuucaaguuuuauaccauuguggucagaaaagauacuugauauuucaaggcuaaauuuauuaagauuuauuuuguggccuacuaugugauccauccuggagaguguuccaugugcaguugagaagaauguguauucugucgcuguuggauggacuguuguguauaugucuguuagacguauuuauucuagaguguaguuuaagucugauguuuccuuauugauuuucugucuggaugaucuguccauugcagaaagugggguacugaaauucccuaauauuaauguacugcaaucuaucucucucauaagaucuauuaauauuugcuuuauauauuuaguuucucugguguugggugcauauauauuuacaauuguuauguccucuugcugaacugaucccuuuaucauuguauaaugaucuucgucuguuuuuacaguuuuugacuuaaagucuauuuuugacuuaaagucuacuccugcucuguguugguuuccauuugcauagaauuuuuuucaucccuuugcuuucauuuuauguguguccuuacaggugaagugagucucuuauaagcagcauauaguuaggucuuguuuuuuguuuuuuuuuuuuuaaauccauuuaaccacuccaugucuuuugauuggagaguuuaauccauuuacauuuaagauaauuauugauaaguaaggacuuacuacugcaauuuuguuguuuucuaguuguuuuguagauccuuuguuccuuucuuccuuucuugcuaucuuccuuuguggucaagugauuuucucuagugguaugguuugguucuuugcuuuuuuauuuuuauuuuuguauuacuauagguuuuugccuugugguuaccaugaggcuuacaaaaaacaucugauaguuauaacugguuauuuuaucacauuuuaauuuguuuuauauuuuaaccaugacauagagacggucuccaacuuauaaugguucaaccuacgauuuuuugacuucacaauggugugaagguaguaugcauucaguagaaaccauauuucaaauuuuuuauuucaaaagcuuuucccaggguagcaauaugugguacaauacuuccugugaugcugggcagugggagugagcugcaggucccagucaguuauaggauuaggaggguaaacaacugauagcuuucuacagaacaccaugccugcuaagccaucaacgaguguuaauaccgcaguggcuucuaccagcuauucuugagacucaucagaagagagagaaauggaugacccuguuacacuaguagccccauaauccagcaguuaauuuuaguucaaauauucuuuagguccagugugcuuucagcuguguguguuaauggugaguacccauacaaccauuuuguuuuucauuuucaguauaguguucaauacauuacaugagauauucaacacuuuauuguaaaauaagcuuuguguuagaugacuuuugcccaacuguaggcuaauguaaguguucugaacacauuuaagguaggcuaggcaaugauauucagcagguuagguguauuaaauacauuuucaacugacaauauuuuuaauucaugauggguuuauugggacauaaccccaucgugagucaaggagaaucuguacagguaauuaucuuauuucuauuuuucugagaggucuugaaugcuuuuauuuuuuucuuacccauaaaagaaacauauucaaucugcacuauauacugaauauuugccacuugcucaucauucuauugcuuagcuucauucuucuggaaguuaauugaucuccucuucucaauagacuuggcugcuuuuuagacuugcugcaguuaucauccugggauuucuugucauuagacuuuugagaguuaguuccagaguuucuuguaucccacaucuugcuccuucugguugucauuuuuguuuuguugaaguacaagauaauuuccuuggaagaguuacuagggagguaaacuuucuggguucuugcuuaucugaaaagugacuuuauuuuuaccacauacuuugauuguguggcugaaaacaaaauucuaauuucaaaaucauuuucccucagaacauugaagccuuuauuucaucauaguuuaguuucuaaucuugcuuauaaaaagucuaauggacuacucagucugacucucauucuguuguaagcugacuuauccuccaugaucaacauuccugcauucuuugcccucgaaacauuuagaauuuucccuuugucuuugaagcacugacauuucaaaaugaugugucuaugauaauuuugguuuauugugauuguaaauuguuguuuacaccaauuuuaaaaaauagucucccucuuuaacucugaaacaugcuauucuauuauuacauaauuuucucccccuucuuucucuuuucuuauuacugguauucuuacuuucuaguauucuuauuacuuggagauauaggaccccguaaauuuauucuuuagcuuucuuuucuacuugucuuuuagcacuuccauugggaaauuauuuaccauugucuucuaauacuuccacugaguuuuuggugcugcaaauauauuuuuaauuuuuaagaacacuucccuugccuuucauuccucccuuuaaaaaggaacagaaucccauccauuagaaaaugaaaagaauggaauauauuccuaaaucuccuugggucuacugcauagacauuaagguguugcauuuuuaaaauuuuuuaaaauaaucucuuauauucccuaaaucauuuguuuccuuuuaaguuaguuauucuccugguuuauuuuagccuuuccuuucaugcaccaaauauuccucaaucuuggguuuccuugguuguccauucauauuucaaacuaagguaaaaggacugaguagaaaaucugugaaaguguuuggguggauugugggagagaaagcuagcucuuacguuggugacuucaaaugccagaaguaaggcuuucuuuucucugagaacgaggccgcccacacuaucuuaaacaguuuauuuaacacuuuagagaaggcgaugccuggcugcuugcuauucugcaugccugaagccuguagggguggggacaauggugaaaagucaacucuaacccuucuucauaccaaccuucacauuucacugaccucccucaauaccaccaccacuugcagucccacuucuuacucuggcccccucuguaacuguuggccuggcuguggcugcagcuucucuguucccuggguaggcaggaagccagcucuuccauguacaguucaaguucacccacuaacacucuuccauuuacuucacucauaccagaaaauuacuggacucuuauuauuagcugaugcccuuucuuucacaguguuguccucccuguuccgaucuacucauuuauaaucauugcaaugggguaccagaaggcacagacaucaacauuugugcuugguuggccaucuggaaccagaagugaccaagaacaucauuucaauacuaaucugucccuccaucucuggcuuugauugggcugcuuaaaucuaaaaaugucaguaaagguuccaagaugcuuuucacuaaagaaaguccacaucugugccacugacagacuugcaggaaugagagauagguucacuguggaaaguauguccaggcuagcaagaugcuggacaggguagaugacuaccucacugggucaauucagaaacaaauaagcacagaggacccugaaauucuucccaggaccccgagucuggguaacuuccguaacccaaguauggguaaguuuaucaguccaguaagauuugaccuuagaaagcagaauaauucuagaacuagagaccaauuauguagaaguuaccauaauaccaugcuuuacuguguccccaggccaaccucuucuccccacuucccugucaggaggggaccuaggucuguacuucccagucaaggcagaagccaucagcuuccugcccugccucuucaccuuaucuucuacucuucucuagccuucuccacaccucagaguaaggccagcccaucuacucugcccaccugcuuagacaccacguguccucccucacucccccagggccuguuccaaguaucaauggccagugggacuuacaggccacucuccuggggcacuuguguugugaaagaagguucguguuuuaaaucaaaaccucuuggcagcauuccccagaggguguguuuugauguguagugggcacugugaacuguggcccaucuccuggcugauguguguguaggcugcuuauggcucacaucugcauucuucucuagagaaccauccucagcugaggggaucuccuuucaaggaggguuacacuucccuucccccccacagccagucaauggcugaaugauauggggcacaaaagggaagccccucuugccucaaggugaggacaacucuuugguguaauuuuuguuccagagucccucagccagacuuuaucugagaccacaaccauuuugagcccccaugccuuuccuuuacagguuuucccuaagagcacagcaucauuagaccauguguucccaauucccuuucucaggcucugcuucuagggaaccccacuuaggaugaugggaaagaggcuuugggagauaaugcgaugccuugguaaaaaucucagcacuuacgugaacaccuggauggauaucucaaaucccaaacccuucucugugguucagucuacaacucuaaucuacaaggcaugggucacaaucugcuaguuuuccccuacacuuacaguggucugaagcacugugaaaggugguuccacagcuuugccccaacccugccuaggaggcuggguuagcccacaguuuuuccugaucuuccacaggguucugaaucuguggugaucuuggguuucaagaaaagauuugaaacagacuugggauugcagauuccuugcauauuccugcaccgcacucagugcugcacgccucagagcuggccagcgcugcugcacaaaaucaggcacaggcucacuccuacuucauacgagugauacacccaucgcacuaaagcuucucuacacagccgcacaucccagaaucugaugaguguggaccaccuguacuugccccagugcucugguuuccagggacucuuggguugagcauucuguaacucaacugccaauucagcaagcuaccauucuugcuucuucaccucacucauucucccaccaauaaaacauucauuaagcaccuacuauccaccaaucuaagcucugaaaacagucuaggaacagaggcaaguucagggaccaaguggccagccaguucacgaacucgaggggauuguaacuucuaacagccugagaauugucugaaaguguuuaagucccacaguagucacaaguaaccccuaagacuguuuauuuuaucauuuugcagaucagaaaagggagacccagagaggagguguguccuggcugcggucuccugagcagccaggcccacggcucucucaacuuuugggccauuauuucugcucugugcagcugccaccuugggugcugaguaugagcuuuaagguucugaccugauucuuuugggcaaucuuuugucccuuuuuccagcggagaacuggugucagaggcggcaguucccucuccuccucuccagucacaugcucacugaggcuguaggcugcuucaaacacgaucgggcugaugacguccugcacccuccgcugaaacaauaaacaaauacgugcauuaacuacuaauccuggcugacagucguagagcauuucacaguuuacaaagaccuucuacaugaauugccucauauaauccucacaaucacccucgugagguaggguuuuaugacuuucauauuuuaaaugagguaauugaggccuagggcagcuagugucuuguccaaggucauucuguugaugggugggggcucuccuucucuaccuugcauggugcuaaaucaucuucucuugagcauauggaagacauuacuuuacucauccuccaaauauucuuagaaaccaguuggcaaaugggagaacaucugugcucacucugcuaacccuuugcauucaguguuucgaugaccacaucucuuuugcauugagauaaauauggauuuuguguuagggcagggaauccaaagacugaguggcccagcguuaucccagaauuagacaucagcggaggcaaggaugaaauucugacuccuggcccuguguucuuuccuuuggaauccaagaaucucaagccccaagggaacagucgauugacagucacgaugggaaaggaagggaggagagcaaacaugcccugaacauaugagaugccagguacugugcuaggugcugcaaggagaugagaaacacacccacgcccugugagugaaggcuuguuauccuccauuauacagaaaaggaaaggggaaaugaaaggcucaguuccccagggcacauggcugguaaagauuuucagucacaucuguucagcccuggagcucuuggcuuuucugcacacagcgucacugccuccuggggacucuggcccccacaaucucacaaguuagaguuagacgcaggaguaaagcugguagguggucccacauucugagacagugagcucggcgggggugcgugugggcugcuccaaggacuuccaaguggagcagggcaagucugagacgugucaaaggaaaguggcucaaacagccgagucccuggggagacaggagaguggcagcagggaagaaugagaagagaagcugggcgggcaggcugaggccaaccucagggccacaagugcagagaugaggacuucauacuacucucugugugaaguuugggggcguuuggagcagaguagcacuguguucaaagaaguagagguucuaaaggccccaggaggcacacggggaggaauuugcucccaccccuccccgacacccagcccccuuccccagaggcagaugugccugccaguuuggggguacuuagguauccauccaguccaagcaucugcagcacaugguggcaucucaugcugcacuuugcuuuagucacuuagcauauauucuggaaauugucuaugucaggaacaccuucuuuuugaugacauacagcaugucacuauauggaugcccuugcugaccaauguuugggcucaaagcuaccugaacaagcaaauggggagcagcccauccacaaacuguagcagcauucacccagauugguccuaugaaccucaguucccuaggacugggguaaauaagagucugaaauuaaauagacugcaugggacaccaaguuaaacaaaguuaaagaggauuuuauucuguuuuguuuguuguuuccguuuuuacugccacugccuccaaguaagcggugguaguccuacguguacggggccacagaagcuuguguuucuucagaguuccucggggcugcggggggagaggaggugaguagaaugcaugcagagacacuggagggcagacuggaaaucucccgcagcagccccagagaggagacggccaugaugaaguggaguggcaagggcaagagaggcagauauggccaugccuguggcugcugagcugugaggcaugggagaccaggcaaaggggacagaugacucccggggugggagcccgagugacuggcagaugauuuuuacugguguucaggaaaacauucggcugggaauagauucaaucauucagcauaaauaaaacacaggacuucuccaagagagugauaggggagccuuuggacaaauuguuuccagaaaacgccucuugaacuccagauaucggggcagaccuuugauacucaugucccucugggagcaaagcacacaaccccaggauccagauccucccugcccgcugacucugcuaaccagaauuugaagacugcccgcgguguggagaaggaugaaugaaugcaaucuuuauguguuuaaaaauaaauucuucaguguuucccuaaggcugacuaucuuaagguuuugcauuuaaauccuuaaugaugaaauaagucaguuaugauguuguuauucuaggggaggaggugaagauggggguagggaaacagaagucauuuacuauuuccuggcuaccaaauguguuccagagacugggccaagcucuucacagacacugucuuucuuaauccuuacaauaccugagcuggcagauuauugacccccaccuuccacuuuuuuuuugagacagagucuugcucuguuucccagaagugggacaaucauagcucacugcagccuugaacucuuaagcucaagcaaucuuccugccucagccuccugaguagcugggacuacaguuggauacuaccaugccuagcuaacuuucauucuuuuauuucuuuuauuuauuuuuuauuuuguagagauggggucucacuauguugcccaagguggucuugaacuccuggccucaagugauucuucugccucaucuucccaaagugcugggauuaaaagugugagccacagcaccagccauugccccccguuuuauagacaagaucacagaggugcagaagcucaaauaaaugucccuccaucccaaagcuagcaagugaaaccagaagcaaaacuacuuuucuugcuguccauaaaauacuauuuuaaaaccaccccaacuacaucagguucugacaucauccuaaaaaauuacuuguuuacauaacagcauauagggugaggggaaaaauguuucacacacaaggaugaaugggaauaagugacaaauaauuaagaaauaggggcuugaaguaagggcuguuucuaaaugcagccauucaagccaugguggcugaggagggaaaccugagucguggcauaucuuauuuuggaugaguaaugcauuuggacauguaggggugcgaaugcugcuuccuggcaauggcugccggaaccuauuuuaauuaagaagucugaaaagcagcuucuuauuacaugucccaguagcucugggcagaagggacccaaaccacacugaggcauggguggaggcagaggagggugcagcaauuagaaacaggccaacacccccaaaaggacagccccuucuucccacacugggccuguuuuaucugagcugcaaaggaaaaguagcagcacaauuuagcgguuuccuuuucauuuuuggauaugcagcuucccugagcucagcacugcaauuaagcagagaaacuccuuaggauggagaaagaggcuuagggcucuggcacagaccauagucgcugaaauuuuacugcuuaaaaaaaauaacgcuacaaacugaaaauucuaaaauugaagcuucugcaguucuaaagcaucuaauaaagugucauucugacagacuaaaaggcaagaaucuaccuuuuccugcuaaaaaucuaugggagucuccugucucugaaaacugaaggaguccccacagaggagaacacccaggcugguggcagaauuugcagcagcugagguuuuauagggaacuuaacauaugcuccaucugaaauuuauugggugcuuacuuuaugccaggcaaugugcugggccacagggaaacagagaugaaagaccuucagggaauaaugagucucaggggaaacagacaagagaugacaacgcagugcaacacauaccaggacaggggaggcuuuggggacccaaagguucagacugagggcuggcaggcuucccagaggaaaugccccugggcacagucaaaagacaguaggacaucaggcagagagcaggggcaaggcaggggugguauagccacauggagagggcaugggcuguccagcggacugcaucugacucccaaaggugggaagucaaguugauaggcagcaauaggguagagaagauucaugcagaaccagaucucagggcacuuugcagguuaugugaucuuaaaagcuagggagagcugggaaggggguagcaugauccuagaggcuguuauagaaaagucccucuuggcugggcaugguggcucacgucuguaaucccagcaccuuaagaggcugaggaaggcggaugaccugaggucagaaguuugagaccagccuggccaacguggugaaaccccaucucuacuaaaaauacaaaaauuagccgggcgugguggagcacgccuauaaucccagcuacucaggaggcugaggcaggagaauugcuugaacccaggaggcggaggugcagugagcugcaaucacacuacugcacuccagccugggugacagagcaagacucugucucaaaaauaaauaaauaaaauaaauaaaaaucccucugacaggggcagggaggccaacauggaggcagcaggaggcuguguucuagaaaggucccuguagcugccguguggcaguggacugaugggugcaggacuggggagaaacaggcuaaggaggaggcugccacauggguuuaguggaaagagaguaagggcuugcaccaggacccagcagcagagauggagaagaggggaccucaucugcccagccaaaggaagacacgcauuucaauucgggagaaauaucugagugacuugauucccacccucacucuaugacccgaagaaagcuggaccugggaacccuggcaccccuaacuggccaccugaccuagaagccuaccuaauugcugcuugucuccauuaaaaaaaaaaaaaaaaaaaaaaaggguuuuuuuucuuccuuagcuaaccagcagcugccgggguaaauuaaaggaaaacaggaaggguuggccccacuuuaaauuuguaaauaaagcagaaggucagcaaauaagcaguuagcauuaagccagauaauuaguuuagggaaaaucuucuaaguguuuuuaaaagaggauucaccaaacaugugaucuuuuuauccccuccauccuccauccuuucuuacuauuucucugcauccaacccuacuuucaccuaugauaaucuuguagacacuccuagaaacgagaaaucuucagaagugggaugccuuuuccuuuaucucuauacucauaauaaauaagaucacaguuaaaauguuauaagcuacuuuaaaauuuucaucagcuugaagacucuuuuaaaagaaaacaggauuuugcauuuccaguaaugauagaguaacuuacugaaaccguccucccacggacaacucgaaaagcuggacacacacacacacacacacacacagacacacacacacacacauacacacacacaccccuguuuaaaauuaucauggaacuuauguuugaaaugccagguucauuuaaaaaaauuaaaaauauauaaaguuaucagggaacuaacuaucaagacagccaggacuucagaguauagggucccaaagagaaggaaagaauguggagguaaccccaacauuuaugggcacuuuucccuugagguguuuccagauuuguaagcagugugggaugagaggcuaugaaacugaaagugaagcaguggcuaaaaagcuaaguucuugaguuucuaagcugaauuucuggaagucuuaugacucugugaagacaaaacuuaagagcucagggcuaauaacgcaaugaggacuugaggggcgaaaaucccaaacagaaauaaguauauugagguauguuuacuguacgccacaauuguccucaaggcaucugccaauucuacagcagcacggggcugugagacuaagaaaccaggcagaggacagugguuaaggugcugacauauuuuacuggagauugaacacagcagaaaagacgaccagugacccagaaguuguuugcuuuuuaauuuauaggauugugaaugaaaucacacugggccucaguguauucucucaauaggaaauauccagaucaaagcauggagaggaaaaaggaaggaaaauucagaaauaaacauaacagacauacaggacacagugcaagguauaacauauuuguaaucagauaauaaauaauauuuauaauuauaaaauauaccuuguauaaugacugacauacuguaggcaagcaauaaauggugaucauuaccauuuuuaaugcauuuuuuuuuugacagaguuucacucugugcagugcaguggcgcaaucucagcucauugcaaucucugccucccagguucaagugauucuccugccccagccuccagaguagcugggaauucaggcacacaccaccacgcccagcuaauuuuuuguauuuuuaguagagacgggguuuucaccauguuggccaggcugaucucaaacuccuaaucucaggugaucuacccgccuuggccucccaaaaugcugggauugcagauauaagccacugcgcccggccuuuaauacaauuuuuuaaauggcaacuaugauauuaaaaucuauaaaaagcucccuauuaugaaauaaauccuuauuauaaacuguaccuguagcaagaaccuauuucccagagaauaaacugaggccaaguauaguuucauuuacaauccuauaaauuaaaaaguaaacaaggcugggcacgguggcucacaccucuaaucccagcacuuugggaggccgaggcagguggaucaugaggucagaagaucgagaccauccuggcuaacacggugaaacccugucucuacuaaaaaauacaaaaaaauuagccaggccugguggcgggcgccuguagucccagcugcuugggaggcugaggcaggagaauggugugaaccugggagguggagcuugcagugagccggggaaaaaaaaaaaaaaaguaaacaaacaaaaauuuaaauuaaagccaaagaagaaaauucuaaaauaauuuuaaacaaaacuuuaugacaagcacagcugacuacaacagucuucuaagacagaacuucaaccagaaaggaagagacaaugcuugaacuguuugaacuaguucaguuauaaauauugacuugacagagcuccaaaaaccaggugaauucaaagaacuccagaaauucugucaugagagcaggaaauaagugguaagaaaaucaguguaccuuguuucugaaaauuucucaaucagauuagagauuuuaauaugacuauauauuaguuuauaagcaauugcacauauaguaauggauaucaucauuagucugaaauguauaacccuuuggcaagcaucagugcucaggagggucaaaaaagcaccaauuacucuucaauuaacauauuugcaaaaauuguucaucuaugaaaaucacauaaccccacugaugcuuuuuucucuucaaagguaaaacaauauguagcuggauauuugggaaugguuugauuuugcauugaaaagucugugugugugucgggggcugggguguuaacuguggcuguaggaacuggaucucagcucugucuugagcucccugggucuccuggacaauacugaacaugcucuuguccaaaagcauggaauauagcagcaguggccagguaccggcauccaggcagggccagggauggcaggucuguggguaugggggaacaacgaaagagugcauggacauuuuguuaauucucuggaggaaccucaauugguguauuagucuguucucaugcugcugauaaagacauacccaaaacuggguaauuuauaaaguaaaagagguuuaauggacucacaguuccauauggcuggggaggccucacaaccaugguggaaggcaaaaggcacaucuuacauggcagcagacaagagagaaugagagccaagugaaaggaguuuccccuuauaaaagcaucagaccucaugagacuuauucacuaccauaagaacaguauggggaaaaucacccccaugauucaauuaucucccaccaggucccucccacagcaugugggaauuauaagagcuaaaauucaagaugagauuuggguggggacacagccaaaccauauaauuugccuucugccaacacuugguugcugugugccuuaugccuggcaucaugaggcauagggaagcugagaagagaaaaauaggaggagugugagcaaaaaacuguggugcagagaaggugcccuuacaagaaugguggcaauccaaugagggaagaauagcuucugacccagaguggguagaagugcaagugucaagaauccuuguagaggggugacccugggaguuccucaggcugauggggcaccuucucaguuggugaagauacuauggaggucuaauaaacacuagacaucugaggaagagaggugacaggaccaggcaaagcgacaacuuugaugucagccaguucaaggucagaggggguccaagcuccauuucuugcaaacugcaaccuuggccacuuuacuuacucucucugagcuuguuuucucagauguaaaaugggaugacagaaucaaccuugcaugcuuguugugaagauuagagaaauggaugucaagcaccuuggagagcuccugacacucuaaaaaagccaguugccccuacaacaccaucaccaccgccaccugagaaaggucuguggggcaagaucacgggggaggggcagggagggacuauggacagggaaggagagcaggcuggaaccaggucacgggaccucagugcccuagccgcuacaugcauugcuuaugcccacaacuuucucaggagaacugcccuugggugacaggagccaucuccuccagcgaagccugcaagugacgcccugugacaggcagaauccuaaaaugaugccagugacccaugccccuguauaaucuucucccuuugaggguaggaaggacuggacauaugaugguucucacuccugugauguuacauuaaauggcaaaggugaggggaguuugcagauguaauuaaaguucugaaucagcucaauugagugaaucagaaaggauggcgugaauuggccuacucaagugaccccuuucacagggaggaauagcuucugacccagaguggguuggagugcaagugucaagaauccuuggagagcagugagcuaagagacuggaaggcugagcuaagagacuggaaggcugagcuaagagacuagaagcagcaaaaagagucuucugcuagucuugaagaagcaagucacccugggcuccacagcugcaggagugaauuccagcaacggccaugagagccuggagcaagaccccaagccgcauaaaagaucuggcuggcaccuugaguacggccuugugaaacgcuaagcaggccaugcucagacuccuaacugacaaaaacugugagauaguaacuuuaugcuguuuuaagcugcuaaauuuguaauuuuugaaguggccuagaaaacuaauaccugccccauucccuagcuggcagaugcagcaggauaacaccccaucccccuugcugcugggugggauaagcucugcuccagagcuucugcacgggaucaggcugaggcuagacuuuuccugagaccacauccuuacucaacauuuuuuucucugucccuuucuguuuuccucacuucugagagcacucccccaauaaaucucuggcaaaaauccccaucucagauucugcuucugaaauccaagauaccauguaauaaauuccauacuuaauuugugggcuuaaaauuccuaaagaggugagaagagcuggauacagugcuagggucacccuagcacuccaggaugauguggaccaggcagauccauaucaguaguggagaggcauggggaguuacaugcagagucucauuuugacacuuccuugccauuaaguucaacuuggaguuuuacuuuguccuuuuaaaauuuauucuuaaaaauaacagcgaagacggccaaauaggaacagcuccagucuacugcucccagcaugagugacacagaagacgggcgauuucugcauuuccaacugagguacuggguucaccucacuggggagugucagacagugggugcaggacagugggugcagcacaccaagcgugagccgaagcagggcgaggcaucaccucaccugggaagcacaaggggucagggcauucccuuuccuagucaaagaaaggggugacagauggcaccuggaaaaucgggucacuccuacccuaauacugcgcuuuuccaacagucuuagcaaacagcacacgaggagauuauaucccgugccuagcucggagaguccuacgcccacggagccuugcucauugcuagcacagcagucugagaucaaacugcaaggcagcagcaaggcugggggaggggcgcccaccaucgccaaggcuugacuagguuaacaaaguggcugagaagcucgaacugaguggagccuaccggagcucaaggaggucugccugccucuguagacuccaccucuggggguaggggauagccaaacaaaaggcagcagaaaccucugcagacuuaaaugucccugucugacagcuuugaagagaguagugguucucccagcaggcagcuugagaucugagaauggacagacugccuccucaagugggucccuggcccccgaguagccuaacugggaggcauccccgaguaggggcagacugacaccucacacggccagguacuccucugagacaaaacuuccagaggaaugaucaggcagcuacauuugcuguucaccaauauccacuguucugcagccuccgcugcugauacccaggcaaacagggucuggaguggaccucuggcaaacuccaacagaccugcagcugaggguccugacuguuagaaggaaaccuaacaaacagaaagcacauccacaccaaaaccccaucuguacaucaccaucaucaaagaccaaagguacauaaaaccacaaagauggggaaaaaacagagcagaaaaacuggaaacucuaaaaaugagagugccucuccuccuccaaaggaacgcagcuccucaccagcaacggaacaaagcuggauggagaaugacuuugaugaguucagagaagaaggcuucagacgaucaaacuacucugagcuaaaggaggaaguuugaacccauggcaaagaaguuaaaaaccuugaaaaaaauuagaugaauggcuaacuagaauaaccaaugcagagaaguccuuaaaagaccugauggagcugaaaaccauggcacgagaacuacgugacgaaugcccaagccucaguagccaauucgaucaacuagaagaaaggauaucagugaaggaagaucaaaugaaugaaaugaagcaagaagagaaguuuagagaaaaaagaauaaaaagaaacgaacaaagccuccaagaaauaugggacuaugugaaaagaccaaaucuacgucugauugguguaccugaaagugacggggaaaauggaaccaaguuggaaaacacucugcaggauauuauccaggagaacuuccccagucuagcaaggcaggccaacauucaaauucaggaaauacagagaaugccacaaagauacuccucgagaagagcaacucuaagacacauaauugucagauucaccaaagcugaaaugaaggaaaaaauguuaagggcagccagagagaaaggucggguuacccacaaagggaagcccaucagacuaacaguggaucucucagcagaaacccuacaagccagaugggagugggggccaauauucaacauucuuaaagaaaagaauuugcaacccagaauuucauauccagccaaacuaagcuucauaagugaaggagaaauaaaauccuuuacagacaagcaaaugcugagagauuuugucaccaccaggccugcccuaaaagagcuccugaaggaagcacuaaacauggaaaggaacaaccauuaccagccacugcaaaaacaugccaaauuguaaagaccaucaaggcuaggaagaaacugcaucaacuaaugagcaaaauaaccagcuaacaucauaaugacaggaucaaauucacacauaacaauauuaaccuuaaauguaaaugggcuaaaugcuccaauuaaaagacagacuggcaaauuggauaaagagucaagacccaucagugugcuguauucagcagacccaucucacgugcagagacacacauaggcucaaaauaaagggauggaggaagaucuaccaagcaaacggaaaacaaaaaauggcagggguugcaauccuagucucugauaaaacagacuuuaaaccaacaaagaucagaagagacaaagaaggccauuacauaaugguaaagggaucaauucaacaagaagagcuaacuauccuaaauauauaugcacccaauacaggagcacccagauucauaaagcaagcccuuagugaccuacaaagagacucagacucccacacaauauaaugggagacuuuaacaccccacugucaacauuagacagaucaacgagacagaaaguuaacaaagauauccaggaauugaacucagcucugcaccaaguggaccuaauagacaucuacagaacucuccaccccaaaucaacagaauauacauucuuuucagcaccacaccacaccuguuccaaaacugaccacauaguuggaaguaaagcucuccucagcaaauguaaaagaacagaaauuauaacaagcugucucucagaccacagugcaaucaaacuagaacucaggauuaagaaauucacucaaaaccgcucaacuacauggaaacugaacaaccugcuccugaaugacuacuggguacauaacaaaaugaaggcagaaauaaagauguucuuugaaaccaaugagaacaaagacacaacauaccagaaucucugggacacauucaaagcaguguguagagggaaauuuacagcacuaaaugcccacaagagaaagcaggaaagaucuaaaauugacaaccuaacaucacaauuaaaagaacuagagaagcaagagcaaacacauucaaaagcuagcagaaggcaagaaauaaccaagaucagagcagaacugaaggaaacagagacacaaaaaacccuucaaaaaaaucaaugaauccaggagcuguuuuuuugaaaagaucaacaaaauugauagaccgcuagcaagacuaaugaagaaaagagagaagaaucaaauagacacaauaaaaaaugauaaaggggauaucaccaccgaucccacagaaauacaaacuaccaucagagaauacuauaaacaccucuacgcaaauaaacuagaaaaucuagaagaaauggauacauuccucgacacauacacccucccaagacuaaaccaggaagaaguugaaucucugaauagaccaauaacaggcucugaaauugaggcaacaauuaauagcuuaccaaccaaacaacauccaggaccagauggauucacagccgaauucuaccagagguacaaggaggagcugggacuauuccuucugaaacuauuccaaucaacagaaaaagagggaauccuccccaauucauuuuaugaggccagcaucauccugauaccaaagccuggcagagacacaaccaaaaaagagaauuuuagaccaguaucccugaugaacaucgauguaaaaauccucaauaaaauacuggcaaaccgaauccagcagcacaucaaaagccuuauccaccacgaucaagugggcuucaucccugggaugcaaggcugguucaacauacgcaaaucaauaaacauaauccagcauauaaacagaaccagcgacaaaaaccacaugauuaucucaauagaugcagaaaaggccuuugacaaaauucaacaaugcuucaugcuaaaaacucucaauggauuagguauugaugggaccuaucucaaaauaacaagagcuaucuaugacaaacgcacagccaauaucauacugaaugggcaaaaacuggaagcauucccuuugaaaacuggcacaacacagggaugcccucucccaccacuccuauucaacauaguguuggaaguucuggccagggcaaucaggcaggagaaggaaauaaaggguauucaauuaggaaaagaggaagucaaauugucccuguuugcagaugacaugauuguauaucuagaaaacuccaucaucucagcccaaaaucuccuuaagcugauaagcaacuucagcaaagucucaggaugcaaaaucaaugugcaaaaaucacaagcauucuuauacaccaauaacagacaaacagagagccaaaucaugagugaacucccauucacaauugcuucaaagagaauaaaauaccuaggaauccaacuuacaagggaugugaaggaccuccucaaggagaacuacaaaccacugcucaaugaaauaaaagaggauacaaacaaauggaagaacauuccaugcucauggguaggaagaaucaauaucgugaaaauggccauacugcccaagguaauuuauagauucaaugccauccccaucaagcuaccaaugacuuucuucacagaauuggaaaaaacuacuuucaaguucauauggaaccaaaaaagagcccgcaucgccaagucaauccuaagccaaaagaacaaaaccggaggcaucacgcuaccugacuucaaacuauacuacaaggcuacaguaaccaaaacagcaugguacugguaccaaaacagagauauagaucaauggaacagaacagagcccucagaaauaaugccgcauaucuacaacuaucugaucuuugacaaaccugacgaaaacaagcaauggggaaaggauucccuauuuaauaaauggugcugggaaaacuggcuagccauauguagaaagcugaaacuggaucccuuccuuacaccuuauacaaaaauuaauucaagauggauuaaagacuuaaauguuagaccuaaaaccauaaaaacccuagaagaaaaccuaggcaacaccauucaggacauaggcaugggcaaggacuucaugucuaaaacaccaaaagcaauggcaacaacagccaaaauugacaaaugggaucuaauugaacuaaagagcuucugcacagcaaaagaaacuaccaucagagugaacaggcaaccuacagaaugggagaaaauuuuugcaaucuacucaucugacaaagggcuaauauccagaaucuacaaugaacucaaacaaauuuacaagaagaaaacaaacaaccccaucaacaagugggcaaaggauaucaacagacacuucucaaaagaagacauuuaugcagccaaaagacacaugaaacaaugcucaucaucaguggccaucagagaaaugcaaaucaaaaccacaaugagauaccaucucacaccaguuagaauggugaucauuaaaaagucaggaaacaacaggugcuggagaggauguggagagauaagaacacuuuuacacuguuggugggauuguaaacuaguucaaccauuguggaagucaguguggugauuccucacagaucuagaacuagaaauaccauuugacccagccaucccauuacuggguauauacccaaaggauuauaaaucauguugcuauaaagacacaugcacacguauguuuauuguggcacuauucacaauagcaaagacuuggaaccaacccaaauguccaacaaugauagacuggauuaagaaaaugugacacauauacaccauggaauacuaugcagccauaaaaaaugaugacuucauguccuuuguagggacauggaugaagcugaaaaccaucauucucagcaaacuaucgcaaggacaaaaaaccaaacaccgcauguucucacucauaugugggaauugaacaaugagaacacauggacacaggaaggggaacaucacauacuggggacuguugugggguggggggcugggggagggauagcauuaggagauauacuuaaugauaaaugacgaguuaaugggugcagcacaccaacauggcacaugaauacauauguaacaaaccugcacguugugcacauguacccuaaaacuuaaaguauaauuaaaaaaaaaaaaaaagaacagcacaaggucuccacaaauaagucuuaaggcucagaucagccccaggccuccucagggucauguuuugcccccauuuuuagagccacucacaaaauaucuuugucugaugugugugaagcacugagauuuacaaaaggcaaagcucagaaagaaaagggcugggauuaggacuauccacagauuaguaaugagcuccucaacucugaauugcuaauuuauuacugcacaucacauaaauggucaacuucuuuuggcuuguuuuacuacugucaaccaaaagcauaucuuaaaccagaaguucuuaaccucgaagagaauucagggcaucuguggauuuagauagaggaaaagaauuuuccuucuuuauuuuuauuaaccucuaacugaaauuuagcauuuccuuccauuauaaaauguaggcaucaaaccacaaaaguauuagaaagaccugugacucuaccgucgauagaaaucugagauauuacacacuauauuauaguuguagacaccuugaaauauuguuuaugcuuaacaguacucaaaaugucuguagaucuucuuauuucaugcaucaagaaaaagcugguauauuauuauaucauaaaguggucuuuaaaaauuuugauaacuccauuucaguauaacugaauuucuuuguaauucuauguauuuuauucuauguauguaaaagcauauucugagaaaggauccacgugcgcuucccaacggccaaaggcguccacgcacagaaaugguuaagaacuuuugucuuacuaguaaugccuaaugagagagaccauccucugguuuuugaaaugcuucaaaacugcagaaacauuauguuguuucagucuucauagguuaugugaacucucuggucucagcaguuaaaaauauaucauccauuacauuuuaugacagguucagggccugggcugaaaaucaccccagggccccugggguuuuaagaauuugguccuggauagauguuucggccaaggcagagcaaagcugcuucagugcucagaguuauaggaaagcaucuguuuccccgugugagcccauaggaagggaagagcgcagagagugggcucucugggcuccaugcaguguucucugcuuuuacagaagaauccugaccuucccagggcaggccugccacuucaugagcccugagaggguauccagaaagcugagaagcuuccccuagaccuuaguggugugugaaaauccugaaccaugaccaaaaugaagagagucaaaacacugaccccacaagauuuccaaguuacucaaaccacagugggccugucuucucagcuugggggcuaacugaaccagcacaauuacccugaaugauuugcaguuuagagagugaagaaaguaguugcucccaaaccuguaauaaaaaaggucaucaaaauuccaauacuuucaucaaaacucauucuuucuuauaaucuguucuacucuccuucuugccaccccauuccuacugguuuuaacaaggucacuaauggccaccauauuggauccaagggacauucucucucuguccucaucuuucuugacucccccaggagauggcuugcuccuccuguccccacugcuccuuauccuucugagaugacaucuaaagcaauaaauggcauuuacuggcuaacauauuuauccccaacccccagaauuagacugaacucuuuggugcagaggccacucacacucaucucagcauguccacccuuuagcacagugcauagaacagaaguggacauucagccaauaggaaggcacuggugcauuuugagaccaccauuccuaagaaaggcagcuuuauucaauagacuaacccuacaccuacagucaauauacauguauaaacauuuuauuaaauauuuaccugaugcuuuacuuuuuuuuugcucuacccuuacuuccuuucaguguuuacaucucacaucucuuuacuguuuuucuuuucagaucuucccucauuuuuaaccuuagcuauuuuaagcaucuuuaagcucaaaagaaauggugucauaccuauccacaaaacuuuauuaaaaccacuuaauaaauaccaccuauuacaucucuuaccuacagcauuuggguuuacuggauaaugugagauccugaugcaauaacagagacagacacugagcuccucuuugcgggaaaggguggaaauacuggcagauggaugacugagugagauuuccuuuuguuccuuucagcaucugcacucguaauauuuggauucagcuaacauugauugaucaccaaugugcaugacugggcuaccugcuuuuauagguuaucugauauuaucucgacauagguauuauuuuucuccaaacacugaaccucgggcucagacaaacuaagucuauacuuguaucaucuuagaguuugccaauaugaucccaggagauuguuuaagcuguuaggauuuauagcagaacacucugaaccaucauuacauuuccagagucuuugcaaguaggaaguaaaaagaacagaaaucauugaucauauuuccuuuucauuucucccucuucuauuuugguaaguuuuauuuccuuuaccaccucaccauuagauggaaacuuugaacaaauuuaacaugaacuaugaguuuuaauuaaacaauuuagagaaugaaaaaaauaaucuuccucugggguaaauacaauauuaaguagcucugcccucaaaaauguaaaaucuaauuuaggagacacaacaagccauuucacccagccagccauucuaggucugucccucuuuuuccccaaaacaaggcugcuuauuccuacuuauccaucuugccuuggaccucucaucccuccccgucccccagccagaggucaaggcaaaucccagcauuuccucccucaugacauuuucuccaugugccucugucacccaguaauaaucaguguuggugccacucauuugggcauucacuucagacuguauuuuccauagaugcuuguaaaguaucuccgacuccacaugcucuucugcaacaugaacuggcuaauucucccaucaaauguaggguccaauuccccaaccuugaagagaaugcugggggucucaggcccagcuaagcccaggcuucuaggccaugcugccaaggugacaggcaugugaaugaagaagcuuagacauggauucaccagcccccaacuguucaagucucucccagcugagguccuaggcaucauggagcagagaccagccauccccaaugugcccugucccgaauuccuugcccacaaugucugugagcaugauaaaauugcuguuguuuuacaucauuaaguuuggagugguuuguucagcagcacuagauaacuaaaaacaaugcaucacaaauuauggauuuaacagugucauggguggggaccaugucauuccuugauaaaucuuucacugugccugucacaagaaugugcauauaaguguuaaaaaagaaacucuacuucagucauucaauagacuuuuauuuagauuguacucugagcagggcagagugugaugagguuuucaaagguaaauaagauacugucuugcgucauggggagcuuacaauuuuucuuuagauaagccaagaccuguuugcaaauaguuccaauacaaaccuaaaaagacacaaagugagguaaaaauucauaggaagaagaaacccuucccuauuaaaggguagaacauucuauagaagggcaggugugaggggcagcagaugagagugggguaugugaggagaaugacugugugaguguuccugauggaagaggcgggcaagcauagagcauggcccgucucacaggcagggcagacagaggacaauggugugauucucaugaagaaugugauguucaguggaagaaggaucagaguaugacaccacuuaauuugggcgagucacacauuuuggggauguugacccauacuuuacugcagcaugacacagagggcagaggcucuuccaaacacaaaacaccagcuuccagugcaaggaaucuggaguucugggguccaucaguccaccuagucccccaccucccugagacagauaacacuaggucuuaauagccuccacuucaaggacuaccuuaaucugaaguuucagagaaaaccucaaagaaacaacaacaacaaaaauccucuagacguauaaaacacaccauaaaagaguugguccugcuuacaauauaaaacaguauuuaugucuucaacuuuaugucacugaaacaucuaguaaaagccuuuuauuggaagagagaagugucuccaagaacuuuaaacacagcacgauuuguacugaggacaaacucaucuaaaaugauucacaaaugccaauguacuaucuggggcccaaggacaaaccuguuuaaaaugauucacacaguuucagugaagugucuggaguccaugaaccagcauucuuuauaaaacuacaaccaaagaugaugaaaacaguuuuguuuguuuguuuuguaaaucuuacuugguugagucauuuuccacuaaaucuauguuuguuugcauugguaucccauaaacucacuuucuguuaguagaaauagcugaauuuuauguuccugaaauaguauucauguguguuuaugaucucuuugaucuuaaccuuuuaaguggguaaauuauuaacacuuuuuauauuggaaagggaaacauaaauguuugagguuuuuauaagucacuaucuucccuaaccaagguaaaugugaccacagucuuuaaaagcauauucuggaaauauagccauaaagaguacacagaugcccccauccacacccagagugccuguuuaugugcagaucagcucaaaccaggcugcgcacaaagaugugcccgguagaaaaagcccuggcugcagaucggaugcucaccuguaacugaaaaucccugcuuggcuuucucgugucuggccaucccucacaggaaugaaaguagcuuugaagaauggccauuaauggugaagacggaguuacccccaaauuaaaaaugguuccuauucaauuugaauuguuaaagaagaaccuucgguccuuuugcaggaccacaucuaucagguccccgcccccugaugucacucugaggucuaggcuauuucugggcacgauguuguuucuacaagguucauugggcuuugcacaacucauuacugugacagauggcaccagacauuuuaaccccuuucuucccuguaaaaguuauauucuaaaucuacaccaugcaaaaaaaccaagcuacuggccaugagacauucaucuguuaucuuucaagggucuuuugccauguagaaugucaauuacucccucuuaugcugaaugcuggugccuuaaucugagaggcaggacccucuuaugcugaaugcuggugccuuaaucugagaggcaggacuugcccagacacuggauuccagaagagaauuacaugccauucccaauuaacacccauccuaccaugaagcuugggcacacugucaauauuuuuuuccucacuuguagauagaaaaaaaguuuuuuguucuuacacuguuucccuaucugcacuugaguaauguucaacuuuuuccuccaugaacaacugaguuacccaauuucuaaacacaaauccaagcauccuccugagauaggaugauggauguauuagcucauccauccacccaacugccacucaucaaaggccuuccaaaaacacucauguuccuaaggaaauggacaaacacugagaguuccuugcugaacauaaaggaagccacauuagccagguacgggggcacauguguauagauccaguuacucaggagacugaggcaggaggaucccuugagaccuggaguucgagguuacagugaacuaugaucacucuauugcaccccugccugccugggugacagaguaaaacccuaucucuuuaaaaaaaaaaaaaaaaaaaaaaaggagccaugagcccugcuauuguuauggccccucacacaagccaagaugugucaagaaaccauugauuuucaagcaucugugccagagggaugauauuaaacaccaagaguaggaagugacaaauacucucacugaggacuugcuguucuccacagucacagcugagggcccaacgagaucaaacagaagaaagcccaugcucggaguaguggucauugaggggggcugauccccucuguggacagccuucuaaugacccccauucaacaucaccauaaucucauaccgaggacagcggugaaaugcugagauggcaaaagcaaucccccauaacuguccaacacaaaguaugcaccacagcauucccucaaauccuggugaugaucuucauggacguuaggggagucugugagcucauggauccauaggaccccuggggcucagaguugggguuuuccaugagagaaaacauccuucuacagcugugcuguccaauacagcugugcucuuuaaauuuaaaugacucauaauucaauauauuaaaaaucaguucuucuacccugauagccacauuucaagggcucagcagccgcgcaguggcugcuguacugaacagggcacacacagaacguuuccaccauugcagcuccguuccagugaacauuuuucaguuggucucucugggcaccuugaggcccucuuggaugacagggcagcaaaacucaguaucugcugagacaccacaaagaaaacugcauuugaaacaguguauuuccucauaacauaugaauucuaaauaacccauacuaugaugaaaaauagacuugcuuuguucaaagccauauaagacuuaugaaacuuuauccuaacaauguugugguacagggugcaagaauacagcaaucugccggacuagcgagcaccacugacuggugcugagagcauguggccuucugccugcagggcaguuucgugggucucccucuggcauuccucacacucgcagcaugucacacaugcacacuauaucauacucaugcaccaccuacagauggagaacagagacaugaagcuuuaaaaaaaaaggguuuaaucauuucaaguuauuaccccuauaaaugcccacaccaugugauuuuuaaccagccgcccucccuuagagagacacugauggcaguaaagaaacaaaagcaucuuuuuagucucggacuguaauaacauauuccuuauauaggggcagcugagucguuuucccaacauugcaggagucccccuccuuucaauaugaaucauauuauagcucagauaagcauauggcccaaguuuauagaggacuuuacgaauacuuauuuguccuagaaaccacaugagaaaauacuuguccucauuuuaugaggggugaacaguugagaggcagagagauuaggaaaccugcccaaaguugcauaggaaugaaguagcagaggcagaauuagaauucgcuccagucugcugggaggacagggcauuucuugcaccucagacucucugcuugcucuccugcuccuuuccuguccauucuccaaacaagacccagugugaucuucuuaagguacaaguaaaaccacaucccccauugcuggaagccuucccauggcucgucaaaugaaacccccacugagcauggcccaccaggccccucagggaacuggcuccacagacuuucccacuaucuccucccacucuccccgcucauccuccaaacucuagucccgaggcucccuacuacucuuggaacaccauuccugccuccaaaccaugggcauuugcuguucccucugccugcaaugcuucccugaccaacacuuagcaguacugaccccuucucaaacaugucacccuggcuauuccccucauagcacucguaacaaucaaccccuaauuauuuauuuauuauacauucacuugcuaucauuccuauuagacgguaaggucugugaagaguacucaugucuauuucauugaccucugaauagccggcccaucaaaagcuucagaaauaagcugaauaaacuaaugaacuugauagacaacugacaugccuuucuuaggccucacccaugagccuuagaacuuucauggaaggggagaggaagccucucugaacaucugagaaccucugcaugauuucccucaacuuucugaaacuauuaauaacucucccuuuagggucuuaaaggggugagugagaaauacugaacccuacaaaggacaucugccaaaaacuacauccuuuggguuccuguucgacagugaguaaagaaaagagaagggacauucaguaaaggugaaucauaauucaagacuaagcacgugauuucuacaccauucccaaaagcaacacaaggcccucaguguggaaacccuuccguuaaagauuugcuucuguaagguuuuccuaaauguuuagcucaugugucugaucucacaaggaacuuguuuucugcuacccuccaguuauacacaauagccuauagauucccaugaacugcuuuuaagacccacccaaagguguggcuucuaaaauucacuugaugaauggaaggaucuaucucuguaauugaguuuaacacaaaguauuuugaaggguagaaaacuagaaaaacuagaaaaaugugucugacuaaaugggagauucgacucaugacuacuuaguuagcaucucucuaagccucaugucuacacuucacugucaguuucuccccacuccuucuccauuuaaagcucagauacuuucuaacuccagaugucucaaacaacaagcuucucccugucucugccaaagggcugugcagugugaugaggagcagggguuggaggaaccuugaugaugucuuacaacagaaccagcaucugauagaagugcuugcccauccguauccucugucugcuuccuggauaaaauagguagccugcuuuucaguuccaucauaagaccuaagaaagacuugagcaguuaggacugggcucagcacaccuugaaugggaauguagcugcuucuuucauccagcagugggcacccucuuugcccuuccccagcccaacaagacaaaauaauggcagcaggguguggaggaaagagcagggcuccaggucagaaaccuuggguuggaaaccuuugggugaggaauugaaccuuucugagccucaguuccuuccucuggcaagggaagagauaugugaaaggaguuacaucucaugaugaugucuggcacacuggguauagggggguccaucacuacguguuuggugaagcaagagcucuugccacauggcccuuugucugauuacuuuuugguaaggaaacuuagagaugcuccauuuaaagcuuaauagcaugccucaguucucaggaaagaucacacaucccuucccuauuauaaccugacgggagaaccacuucuguuggguaggggaagcacagucauuccucaauguccauggggaacugguuccaggaccacccugacaccaaaccccaagaacacacaaguccuugauguaaaaugguguagaauuugcauauaacauacacacauccuccuauauacuuuaaucucuagauuacuuauaauacccaauacaauguaaauaauauguaaaucauugcuauacuuuauuguuuaggaaauauugaaaaaagucuguauauguucaguacagaugcaaccauccauuuuuuuggaauauuuucaccccacaguucuucaaauccaugaaugcugaacucaugaguacaaagggcagacuguacugagugacuaaaccccauucgauaaggccuagaccuuaaagauacuugaguggcugaaauacaugauucuccaugaaguaauaaaggaauugaaaggcuaggguguagcgugcuuagugacuuuggcuguauccagaucauuauaucauggguccagagcaagacaugccaucauugggggugagugauccacagggaaauucuagguuagguguuccacccucacagaacauuagaggguagcagccaaaaaucacaagcuuugcagcaguauagaccuuugccccagcucugccaaacaauggcuguguggucuuggacaacuuauuuacccuuuuugaaccucaguuuccuccuuagcaaaaaucagaggaaugguggcacccaugauauagagugcugguuuugauuaaaugagauaauguauacgaaacaccuaaugugaagcaaggucuugguaauacaaaaugccauuauuaaacaaaaaacuguuauuuacaaugacaggaugaacccauucacucuguaacugaccucacuuugaaaugaucaagaaaugcaaaaaauaaaaauuaaaaaaacuagaaaaguauaucugauuuaauaaaaauaaauaaaaaaauucaaaugaauccuuuaaguaugaugcuuauuguggguuucugcuugauacauuucauuaaauuaaggaaauuuacuucagucccuagaguuugcugccuguauuuuagcucuuugguauaugugccucuauuauuacaauacaguggccaggaaccucacuguuucacccaguuuuauaucuccuauucauaaaacaguuacugccuuauaaaaaguccacagugaauguuaguugaauaaacugaugggauauaagaacaaacauuuuuuuuuuguuuuguuuuguuuuugaacaauguuuuggagauauuuucccauuuuuagaaaaauaaagccaucaauuuugauuuuaagauucuaauugcuaugguuugaauaugauuuguuuggccccaccaagucucacucugaaaucugaucuccaguguuggaggugggucugaugggaggugcuugggucauggggacggauccauugugaauggcuuggugccauucucuagguagugagucaguucucacugugcuccuacaacagcugguuguuaaaaagagccuggcaccuccacuccccgcuugcuuccucucucaccaugugaucuccacacgauggcuccccuucuccuuccaccaugaguagaaucagccugacgcccucacccaaagcggaugccuggcaucaugcuucuuguacacccugcagaaccaugagccgaauacacaucuuuucuuuauaaauuacccagccucagguacuccuuuacagcaacacaaauggaucaagacacugacuaaaggaaaaaauacaaguucugauacauaugugagaauuucauuaaagcccaugcugaugguguucaaguuugauugaugucagagauaaagacuaauacugcucauguugaugaggcguggaagccauggugucugaaaauuaucaauauucuuucuggaauucucagaaaaaugucuacauguaaguugcuucuggagaucauaugaagcuaccucaggaauaugcugcuucuagggaauuaucaacaguucauggaguguuuaacagugaauucagauguuuauaccccaucuccauuuucccuaguugcccucugggaauaacaccuggggagacaaaggacucucugcucucucauuagcuuuauuccuccugaccucuguguucuuugcagcugaaggagcucuuuuccagagacuugcuguuucuguucacauugcacccuucugcacccauggaacagauaaggucugguuuaagagcuguucuguucagcaaagaugucacggagggagaaauaggagucuccaauggaagguggaggcguggcagaaagaaaggaaccacuguucccucuuuuccauccaauaaggcuaggagguacgagggaaaggagucuagaaucucacaaagucgcuggugggucuuuaaaggacugggguggggaagagagggaucccaaagacccaccaugguccauggggaaagccacacccuaagucucccuuccacagccacgugacugauguccagggacacuucaaugucuuuaugccauuuacuaaacuagcauuugcauuuuacuauauccuacucuuuucacccaguaauugcagguuaaaagaagaggauggagcaggcuauguagccucucauuccccacacaugugggaauguguauaugugcacacaugggguuggggguuccugucauugccuguggggcuccuaggaaggggugcauaccgaugggaggaggauguuguaggcagaagagaaagagugcuuucugcccauggagcuccaguggggagaugagacugauccacagaccacuuuaaggcuggcucugaggaguuguagaucacagugagucaugaagggaagggaggcauccguaagggcuucuugagauggaggugacagugucauaucucaaugcugaaccccugcagaugguggccacauccagccaggcccccugcucugccuggcuguucucuaccgcgggcccugcaucguggagcccauuccuucuccgggccugcuuggaagaauggaaaaacaaagaguauguguggggcuagggaagaggccaccuuggcucgaguguagcacaggaauaggccacagaggaauaggacagcagguuaaacugagaucauuagggaaggggcuugacaucccacuuaagaaucuauaaccagaggugaugggugguucucauaguuuucuggacagguaaugaaacugaaguccuugaauaugggagaaauaccuuaauuccuuauuccucuguaucucuggcuccuagaacagagucucguauacaauaagugcuuauuuuuuauugacuaaguaauuucuaaaauuauuguauuuauaauguuaggauguuaaggaggucuugaggaaggcucaguaaugagaaaggaugaaaugcccaucuucuguuuacugaaagccucauuucauagugacuucugcaaggauaagagucccgcuuucccacauaguccauuucccuuucccaaauuuccaguauagcugacuaugcauuccuuacugcuuuacgaaucucaacuccugaguucauauuauaccauuacagaggugaugaucuccccuacugccucagggaaggguaaaccuacagagacuacauuuuccaaacuaaauaauuagaaugcacaaucaguuuaugagaaacaugcaaaauacauaaaauguuauuuucuacugagaauuuacuaugcauuagguacaugugcauuuaccucaaaaugaucuugugagauagauucuaucaguguuuucauuuuauagacgaagguuaaguaaagaaucauggcuugagagccccaugggacuccaaagcccaugggcucaguccacugcauaugaccacaauguucuaccugucccuacauaugugucaugaaaagaugauacaguagcuccucccaucaucaggaagaggcuauuuucccaucccuugaacuuacuuuggccaagagaauguguaagaaaugacaucaugccacuucugaagcccaugccucaaaaggccuugccuacuuccacucucacuuguagaaccuccuaaccauguaaacaagcccaggccagccugcuggaugaugauaggcauuggcccagccacacugucaccucagccaacucuaaaacaucugacugagccagccuccagccagccugcaagcugaacccuaacacaugagugagcccagccaaaaucagccacgccccacccagaucagcagaacuauccagcuaacccagagacuuauacacaauaauaaauggcuguuguguuaagccauuaaauuugaggaagguuuguuacucagcaaaugcuaacugacacacuaugccgugcaccuaugcacuucuguugcucagggaaagaacugaauccuuccuauaagaaugagguucuuagcagcagccauuccugcuggcuucucagucuuaaggcaacucugcuucucaccacauuugcuuucauuccgugguauucuuuauuauaauucuugacaaauucuuuccagaugucugcaugaaaaguaacaaaggaaaggcaucacccacugggcuuaacuggucacuggugcagcccuccccacaaacccacggauccuuuaaaacacacaugccaaagugucccagccuuagguucaaguggggagauuccuggugggaaggacccucagagacuucugagcuuccccuacuucaguugcuuccuccucagcccaccauuaugaaccaccuuugguugugaaaaauaaaguuuuguaagcagagggggcuugacacacuuggggccuaaggguaggcccucugcuugugaaugaggggcaaaaucccauagagcagcaguguaucucagggcuaauaccccuggccagccaaucuugaccucucucacucugaccucauucugugccaagaucuuccugaccccccugacucucccacuggacauugauuaaucacuacugucucccaagcaucuuaaagaauaccuugcacaucauaggugccaaauaaauguuuguggaauaaaauaaaucucucccuuccuacagaaauuuccauggcuccccagugccagcaaaauacaauuagagcucccuggcaccauccccucccccagggcagagaggcuucugcccaccuuucagcacacucucccaccucuucacucacacagccuuugaacaugcucuuucuucugccuagaauuaucuucccuucauuugagcucuuuuuaaucuuuucauagucuuuuuuauuucuauaccugcgucauaggcagaauuauuuacccucucaggaugguauagugggaaugagauguuauuacucuuauguaauccugacuacccagugagauaaauuuuccuagccccauuuuacagauaaagacauuaagccacaaaguguaaaauaaaucaccgaagaucacaugauuagugacuguugcaaauaggguucaaaucuacaucugccucuguguuaggaugaucuuaucaagggcccaauucugccuucucgugcuucucagucuccacgugaauaugcccaggcuggccuguuggacagugagauaugcauggagcggugcugaguugccccagucaccccagccaaugccagucuagauaaccaacagcuagcugaccccuagcuauaugaacaagcccugcccaaaucagcagagccagcuagccaagccacugcuaaucccagcugcacaaacuauaugcuuuguauuguaugccacugaaguuuugaguuuguucugcagcauuauuauuguaacacauaacugaaauagacuccaaugcucacuuuucucacuauauaccuuauuuaaaacacauucauucaccagucauuuacugaguacuuacuacggacaggugcaccucauaggucguaggugggaaagggaagcuauguuagacccugauuacuauguacaauagagaugaggaaacugugggaguucuaccucguauccugccuuuucugcagccugcccucuucucuucaccuccaccauuagaccaccgcagacuucuuaccuggucucccugccuccacauuuaucguuucauaucugucaccuauccugcagcuuggcugaucugcugaaaugcaauacugauugcacucucuugcacacccuuaacccuuagauacugagguuggcccuuucucccuggccuccuggaugaaaccuugagcaggucccacuaucucuuggaucacucuuagaucaugaaaagucuuuccauugcuuuaaucuccagaauaaucccauucaguaucaaaaugaccaguccugcguauuagugaaaaacuccaaauuucauuuaaaguuaaacuuccucgccucuuccaacuuggcccuacuucaggcuuugaagguugcuagagggugggaagugggagauaaaaaagcugcagucacuuccucucacccccuuucccagcagcugcuuagaacaccuuuugaggggaggagaggaggggaggagaagccacaccuaguuggaacuggugucuuuggguguuggcuuuucucuggccauggcagcuguuuaaagcugagucgcucuagagacuucuguggcuuuguggcauugcacgcugaccucccuuagcuugguggguauuccagguugacuuuuuuucaggcacacugaagguucccuggagcuuccugagcauugggacacuccccugcaacucccaagagggaacaaggucuccuccgcuggccccagaccccuuguguuuuggguauggucccaucaccucucccuagggucaccuaagguacaaccccuuuuaaauagcuccuagccagcuuucacccugagaugcacucauauguccuccuccgggggagcaggacauucucagggcuccauuaacuccccuuuaagcuguacaucaacacacaucuuugugcucuccaagacucuggaagaaagucaggcuagcucucaggagcuagaccugucuggucuccuccuuucucugggcuggaggaagaacacccuuuucucuccuccaaggggcucaggucggaaaacaccccccagcccaucagccuucuccaaaaacgccucucuccaaugucaaacuuccugggccucucugaugucaauccuucuguaccuucgauguugauaagggacuaaggguccaaaacugaguuguagccuuucucuuuucaaguccuaauaaguggucaagcaucuugacucaggauuuagaaagacucaccaccucuuuugcacucagggaaaaccaacaagagaaugucacaugugaguaucugguuauacuuuaauaguaacauguuucuuuauggcagguaucacagcaggaaggggacauuuguucacaguuauuugauuuuuaguggaacuuucagaaggguaaggucuaugucugcuuuuccucaucacuguauuccuagcaccuugcacaaugcuggcuccagugggugcucaguaaaugcuugacugaccugaugaaucaaugaagaaaccauuuccaaccaggaagcagcgguuugaccuuccugccaugcugagacacacaaauggggcuucuaauggccucucgggccuaggcacagagggagacaaacacacaaggucggcgguccaggcugagggcuggauugccuucugcugccacacauggggcaaagagaauguucauaaaaacuggguggcaggaaacugccccaaagcuuucuuugugcauacauggccauccugccuacaaacccaaacaccacgccgggaaaggaauggaauggagaagcagacuuaacaaguuguuggaacauggaggaaaagccaagugaggucaaggggaucugagucaaacuccacuguuaccagcauucccagugccaccucuaauuacuaaaauaaagggauuacauagcuggauuuguuuugcaguguuuaugcuguuccggcauuuucugaauuguaugcucuggauagggagaacagguuucucaacucagagucuguuugcuuucaauuuugguuguuugcucuguguagcuuucggacucccaucuggucccuggccaccggaauccccugccaucugcacuucuuccuuguguggccuuuucuuccuagauuuucuucuuccccagccugguccacagguugccaaggguacugucugaccuggugguggagcuggccauaggagagcugcugacacugcccagcuaccuggaaagcugaggugggaggaucacuugggccugggcugcugaggcugcagugagcggagacuguaccacugcacucccgccugggugucagagugagauccugucucaaagucaaaaaaaaacaaaaacaaaaacaaaaacaacaaaacaaggaagcggaucuuccaggagaaguaacugggaaauucuugagggagaugacuagggagaaccagaaauuaucaccacucugguuucuacucacucuucaacaagacuuaauuuuuaaaaauuuagcugggugcaaugguacaugccuguagucccagcuacuugggaagcugaggaaggaggacugcuugagcccaggaguuggaggcuguagugggcucugacugugccugugaauaguuacugcgcucuagccugggcaacauagcgagaccccguuccccaaaauauauauuuaacacccaccauauggcacuuauuaagugaaguguuguaaguacucuauuaagcguuguuagcacuguaucaauguuuacucauuuaguccucauaaugaccuuaggaagguacuguuaucaccauuuacagacgggaaacugagggcugagcaguucagggaccugccuaagaguucagauucaaauccuggccauggggcucccaagucugugcccuucaccucuguuaugcagccucucagacacuucaagcuuuauuuggaaguuaaaaaaaaaaauacaaacuuccuuaacagugaccccugccuaaaaaacucuaucugcuccucacugucaaauauuaguccuuacuguugaguccucuccuuaugcuuuaccagaaggaaaggaagaggcagaggagcuugcugagagcaaggggagauaucagcuagaaagcaggccauacucucccucacucugcccugcuucccacagacagagaugugaguccccuccccagcuccacuugcuccugguauaaacguacauuaaugaagacugccagucaggcaggaauggggccagaccccuaucucaacaacccccacgugaaaagccuccccagaucccugcuccaaugacugcugcugacccagagcucagauggcccuggaacuccgaucccaggcucccuggcaaccuugucacccuuggccccacguguggcagcagcagcgugggugagcccaguggcaaaguggccuguggcugcagcccaaggugucacccucagcuggcucucccuuucuggggaggagcaagaggcagccugcuugccccuggucagacuccugagucaugccaguuucgagcccuucugggcaucauauccuaaagcaaagaggccaaggccaaggagagcagaggaaguuguguccacacgaggacagcaggcauccuucucaccugaaguggaugggccaggacaccaaucugcugccuucccuuuccccgcagcuuagagagacaauacccaacacagaagaggacucuaugccuggggagacaucgccacuggaugccguggacugaauuguguccuccaacaccacauucacauuuuuaagcccuaacucccacugugaugggccuuucaggauauaauucgguuuagaggaggucauagccuucaugaugguauauaagaagagacacuagagagcuuucucccucucucucccugccaugugaggacauagcacgaagguggccgucucuaagccaggaagagagcccacaccacacaccaacuaugcuggcaccuugauugugggcuuucagccuccaaaacugugagcaaauuaauuucuguuguguaacccacccaauuuaugggauagucagcccucuguaucuauggguuccacauccauggauucaaccaaccacagaucaaaaauauucaggaaaaaaacaauaaaaauaacaauacaacaaaaaacccaaaauacaguauaacaacuauuuacauagcauugacauuguuguagguauuacaaguaaucuagagauaauuuaaaguauacaggaggauauauguagguuauauacaaauacgaugccaccuuauaucagggacuugagcaucuaugaauuuugguauccauugggaauccuggaaccaaucucccaugcauacugagaaacaacuguaccuuuuuuuauggcagccugugcaaagacauggggcuacugauuaugcuuuuuucccccugguuauucuaacuacuagcuuuguauuugaaaacagauugguccaauuucaucaggugcuaugguuucaggcuauggaguacagcuaccaaacaguuuuucuccacuauagcugcaagggguuggcagaagggacucaaguucauucacuacuguuucuccucauuccugcauucacaaaacauucuuacagcacccaccccugcugggcacuugacagaugagccuucccucucagcaucguccaucuuccuguuaacuccauugccuucagaggcaccauccacccuguucuccaaaccagaaacccaagggguccuuggacuccuggcuucgucccccuacauauucucaauccacccugcugacuugaccucgccguuucccaaguacacccccuccucuccaucuccuaccacugauauguggagucauucccaagguggugcccagccuggacccacauuucccagccuccucugaggccggcuguggccaugugacuaguucccaccaauggaaagucgguagaagggaugugggucauuucuaggcuggaguguuuaaggggugggugugccuucuccacugcuucuuucuccuccugcccccaggaggcagaaauccuggagguccuaaggaauugcagcagcagcaauggaaagcaacugcagucccagaaucaccacguggaggaagcuaccuucaacgaggaauagccuuauuugacugacacaugagcaaugaacaaacaucuaguaggucaaguaauugaaaacugaggguuuguugcagcaguuagcauuguguuaauacagguauacacaggguuaccuuuuucuuaauggaggcuaauaagcauguuuaaguaaaaaacugguguaaagggagaugucucaguccauagagggaugaaagagacaggcuggaggaaugaaaggguucucuaccaucucagaauaugggggcguggggagggaaggcagagguugcacccccuccucagcccaccccuauccacccaugacuaaguucagggcuccaaaacccacucuauauauuugccuucuuuuaaaaccccaggcaggcaaauguccaggcccucauaaccuagaaaaacaucccauccuuugucaaaguaauuccaugcagacccagacaaggcuucugaggagaaacccaaggcgcucaggcugggaaucagggguagaaacauggcccucaaggccagugcugcuggggauggguuagaauguagagacagguuccacagacagccaagaaggaaagugccagagacauuucccuaauccagccaaggcucaagcagugaggcucaggcuguuggcuaagguccacagacaggcugauaggaaaggccuaggcuuugugugcaaggaaagucuggacccccgaggucuacagcugaggaggaggagacagccccaaagcagaucuaugaauccaaccccccagagaaaucuuccuccugacuccauucuaaaugcugccaacuccuucucuaucacuccagcuccccagcuccccaacucuggcagccacagaggcgacuugaauauacagccaggggggcacucaguccacugcaggaauggcuaagggugggguacacuaggguccccagaugccaaugggauuuguuccaucccaguuacauaaccucccuacuucagccaaggucuaaacugaauaugaaaauggaaaaugcuccagcaaauaaauuccagggacauuaggcaaaugguccuuuuacauaaacaauagcuuucguuuucacacagacaugaugaaaaggagguggggaaaaaaugaggagaaagggauccuucccagaucacaaagcuuauccucagcagagcccagcaccucuguuuaccccaaaaaucgagagcccuggagcccaggggcaggagggguggcauggaaguuuccuccaggccagcacugcccaguggaggcagacucucccaugggcagggccuccccucugcaggacaggguggggcagagcaggacagcagaggcgaggacuuccugcaucugagccacccugauaacccccagggcugcgcuaaggacaugggguuuccacuggcagaguuccuccugaaacaaagcugcagggugcccugcaucuauguggaguaggggugggacaguaggcauaucggcuggaggcucugacucaacaggaagcccucugacccagaggccacccucaucucugugccugggagccagggguaaagcaugccuuagcccucauccaucccccacuagggcccacccacagagugggaaagggggacaucugaacuuuggcaaagaacccaagagagccuuccagcaccagacaaggccgcccaagccagugccaaggggcaggguggguaucucuuggagggugucuggacugaggucuacaccacaguuauaagcagaacaagggcugguguggccguagcuaaauauuugggcuuggcuacaccaugcacaggaacaaugugucuucggacugagcugugaaaccccaugggagagccaugacugggaauuggucagagaacaagaacccagcccuccuuccuguuggcucccucaugcacacccucacacagcucuacuccacccugacucuccacccagcucuggaauaucuuccucucaucuuccuguccucugucccacugcucagcgggauaaagccagccaggagaacagggggcuaggguggccugaggacagcaugaggcuccauggggagcagggagagcccaguagagucaaggcucaugaaaggguggccacaaccugcuuuuucagaaaugaagcaagcacccccaggcugccuguguccugaacucccaaagcaauguaacuccuuuuuaaaaaggagcuccagaauacuaugcaucacauccuuggcugguaaugcagcugggacuugagggaguggacccagggcacaccucuaccuguuaggggauggcggcugcagguagagaggggugugcaacauggaugggggcagugagccuggggcaggaagucagggaggacuaacagugcagaggcagccugcgggcccaaggcgugggaggagaugcagaaggucaugucauuuguccccuccguacuuugcaaugaguaaaagccaaguccuuucaauggucuacuaggcccuacacggucaggccucugucaugucucugaccucgucucuuaauaccuacacccucauucugcucuagacacacuggccuccugacugucccuggaacaacaggcacuccugccucagggccuuugcaccggcuguuuccgcugccuggaaugcucuucucccagaucccuccacaugguucucuccccuuaccuccuucaaguucuugauuaaaaaccucuuucaugaggccuacccuaaccacccuauuuaaaauuacagcccaccuugggucaaccaaaccccuuucccuuauccaccuuuuuccauagcacuuaucagcuuucguguuuccauacucuauauuccauauguucuauaucuccauguuaauuauguuuaugguuuaucucugccucuaccugcuaggauguuagcuccacuauggcauggaauuuugcuucucuuguucacugguaagucccaugcuaccagaauaguacuugcacaugauaggugcucuaugaauauuugagugggugaaucagugaaugaacgaauggcagcgucuucucagugggguccaggacaccuggugaacaauaguagcagcuccagucacaguggcuacaauucgcugauguucccuuugggaaagccaagugcuguaugaagauuucuacaaacaucucaucuuccaccuacacaacucuaccuacagauaccauuuuaucuccaauuucuagacgaggaagccaaggcuccaguugaacaaaaaucaccaagcuggucaguggggcugcuaagauaugcaccacagccuguuuccaaagcuacagcuuuguguaaacaucuucuguaauccugucccugcagcagagccuguguacguaacuacagucauccacucagacccagccuuggguccucaugcuccagaaugccacgaggaugaugcucagaaaggcaagagcaggacagggcacuugcuaggaaacuaaggacccccagggcuccagccaucacugagauuuaccagccaugcucagucucccuaaaaugacagaggugggucauauggcuuccgccgaagucccuuucauccucugacuuggcagaaaugguaucacccuggguaagacccaggcaagaggggcccuuacucugaaccccauucucaggagacccuccugguuauuucuuugcaaggggcaaugaguuugugagaccaaggucagucuccacaucucccucuugcagauaugcucugugugcccaggacaacagaaaucccugccccaacagcccuaaguccuccuucaggguccauguugggcucuacuccaggguuuguccccugcacuguaaagugcaccaugagugaguguacccuaccugagguccaagggcagccucuguggggaggggguggacgaagcuuggauggguguccacacacgcaugcacagaaggcccauugccaugcgggauggagucagauggaaagggaagugggggggugggcugggggcuggcucuccccaagccauccauuucuacacuaaacucugagaggccugagaaaucaaaauucaaccuagggcuuccaaguuguuauaaagguauauuugucaagguaggauggaacacaguuuacugaacaguuaccuugauuuguaaucuuuaaauauuuagauauucgcuaaguggaccuccauuuguacuccuguaccaucaaaugacaggaugaauccagauagaacucaaguuucuaagaggcuguaaagagcaaagccaagaaacaagagcugaucccucucccuuuuucacugauagcaggaagauuucccaaggagagaagacaacaaaugagggcuguuccagcuccaauucugccacugcaugccacucuggaugcuaacgugggccuggguccgggcaggagaguccguuuaacauaaaauaaugaaauguuguucugguucuaauguugcaaggaugccucaggccugcuccgccuugacugccuggugacccaggcaaguaaauuagcuucuguucucucauaaaacggagaacauaauuccuacaucacaaaacugcuuugaagauuggaaacugcucaacacauaguagguucucaauaaaugaugguuauuauuauuauuagacuuuauuuuugcaccccuagcaaauaaaugcaguacucaguaccuuguaggaacuggugaauguugaaauggaugggugaauggauggauggguggguaauggguggguggacaaauggagagauaaauggugaauggguggguggguucuugguuugguuuuuugaaggauauuacaaacuauucagcauucagaaaucuucccaucugauaacaauugauucaacauugucgucaaaauaccauggcauaaaacucccuuugucuuucaggaagaaaaacaauaacaagaagcuugaaauucauuacuggaguuaggaccugaacuuaacuguuuucucccaaagccugugcuguaaggucgaaagcaaacaguugcauacucaguucuggagaaugcauguuucggggucuauggcccuaaggucucaaaugcccaccauagccuaaucucuguccuggggcauacauaccauuuuuaauauaauaauuauugguucaauuaauugaggcuugaauguuacuagaugcuauuguaaugcaaaaugagaaaauagauaugcuacuuucccagauacauaaugcaacauaugcuaaaccagggaugcugaaaaaucagcuucaacccaaggcauccccaaaaaugagggaaacaugccaacacuaaaacaugugggcaucacagcucucaucccuccaaguccuugggcuuauauuauucauucaacagugucauagauuuugcaaaagacagaagaaaggguguggauuugggauggaaaggaagaaaaggagcuaaaugucacaaacaaagcaaguguuggacaacagaaaaauggaacaguccacauucugagcgaacucagcuuugccagcaagacauuuccucagugagccucacaggcaauaaccaggugacccguaaguuaaaaggcagcccaggcugcccagcaacucuaauuaaaauucaauaacaugauguuuuccccaauacaauaauuaauaaaguuuggaauuuuccccccaaaauucucauagcacaaucacaaugcauuugauacugaaggccgcaaagccaucugguaucagaguaauuauaaauuuucuaggcauggcuuucugcagaacugcugcagaaacuugaaaugccaaauggcauuccuaaaagagacuucgugaccuguaagaaagcaaggccagcauguccuuuuuuaggagggaacaucuguguuccucuccagagaucaguuagucagagcuucccccugccuagagccgucugucagagaaaguccuuugcagagcuuucuagaaacaccucuuucaugauccaggcauaggguaaaguugaaagaaucuuaucaagaagucauguagugguucucaaagggugggcuaaaggcuguuugcuuggggcuuucauguuuauaacaugacgguuucuacgucuuugcuucugguaucaauuagaacaucuaaaaaaaucugcugguaccuuucuuuucauucaauucugguaaaauacuguuggcacaggcaauauuagacaaaacaagcucagaaagaauauauguaaaaccucagcaaccaguuacaguauuucuaaaugugacaugcucuugucugccaccaucaccaucaucacucucaucauggcacgucuccucagucacagaccagaacgugagaaucauaagcagagcccagugcuucccaaauaugacucaggauacacguugaaaacagauucccaggcccaacuggaucuggaucaaugggaaucucaauuuuuaacaaaauaccaucuucacuagcgaagcuugggaaauacaccaugguucuuaaacucauucaguaaauuaaaauugggggggcccccuucuuccugcuuaagaaaaccaaauacacugcucuauggagucaggcauauuaguguucaccaccccuucgcaaauaaaguaaggcaauuacuauuguuacguuucaccuguaguuuccuuguguugagacuucuuuagccacaaacauucuucauguucccuucuuggaauguaauauggcauaaaucacaucugggagauaaaacccccauaauugcuagagaaaauguuguacuugaaagaaucccucccuaauugucccaacgggcaugcuaagaaaucccaaagaagaaaaguaaaaccuuauuuauuugaauucgcucuaaugaauuuacugugccagguucuugggagagggauggugguuggacaaguuauggggaaagagggagggauucccaagcugacauuccaugggcucuucaggcuagaagagaagugaccauuuagugauguagaggccagaggagaggaaaaacaaggaggccugcuaaucaaccaugcacuuauugagcaccuacuguauccaugaugguccuggccagaagcagauguuuccuucaaccagggagacaaaaagaauucacugaagggacuauuuacaacaguaaggggggucaguuuaaaagagaccccuguggcaaagcagggagccauuaaugcccuaggucggaaggagcaagguggggaguggucacuggaaccccuaaguuauuagaacuaaccaccuggcagaagcuauggccuuccguagagagccauggucacuauggcuggccacucuuccacccucuuuuuccagugcuccccucugacugaacccaacuaaaaggcagaggggaaggucagccucccaagggcacaaagcaggagggauaaugguggagaauggaucuggagaggggaaguagagaauagccaacauagccacuaagggcuagauacucuaugcuguaugcccaaccuuauggucuucaaauaauuacacugccugugaucgacuguauuauuauuaauaauaauauuauuauuauuugagauggagucucacucuguugcccaggcuggagugcaguggcgcagucuuggcucacugcaaccuccgucucccgaguucaagcaauucuccugacucagccucccgaguagcugggacuacagauacaugccaccaugcccagauaaauuuuguauuuuuaguagagaugggguuucaucgcguuggccaggauggucucaaucucuugaccucaugauccaccugccuuggccucccaaagugcugggauuacaggcuagacugcauuacuuaucagcugcccccuacccaccaccugguacuccuacccuuugucauugacucuaagguuccucucacuagaggcugaucuauuucuacucuauuuccccacucuacugauggauugggccucaugacuugcucuggccaauggaaugagggcagaagugauagugccaguucugagccuaccccuuaagaggucucacauguuucugcaugccccucuugaauuuuugccaucaccaugagaagaaccugccccaguagccaacugguucuagaaagauaagagacauggagaacagcuuccccagccaacgugcagaccugcagcagaacuguccaaccaucccacagauccaugagaacauaaaugcuucuugaugugugccauggaguuguggggcaguuuguuauguggcaauagcugacuaauacagucagucuacccagggaaauaagccaucucauucuguaacagaaguuacagguuaucuagauucaagggaaagcaugagcacaacugauagaaucaaguccaacaugacaaugagaggucaguaguguccagaagggaaagagaaaacauguagucccaaggcuaagacaugaaaccuguccugauguggaagccuauucucagugauuauauaaccucucagaggaauggaugcuugauuuguuuuuuaauuuacacccagccuuguuccaacaggauuuaaggcugcuuacaauaaugcucacaacaaaauaagugagaaaaguagagaagcaaggaaauuauggcaugugaaaccaagggaucaacaaaucgaauccaaguccuccugcuagacaugaacuacauaguugccucugagcuucugcaaagcuagugcaaagauagaaauaagauugggggcaugaguaagguacagaugaaccaguaauucagaagaaggacagcuauuuucuggaacugagaucugacagacaugucuuucaugaggccucauaagacauuggguuaugucaugaacaauguccucaauggaacccucaacagaaaauacauuaaacaugcugaugaugaugaugcugaugaugauagcaauaauagcuaaugcuuacagggugcucaucaugcacaugcauauguuuucuaggugcucaacauacaauuuauuuaaccccuuucuuauuauccucaaauaaaauacaguggcuauuucucaucaugacccacaggugagcuacucugggaggacaaggaccuaugcacagcagucuggggacaccucuccagaaaagaaaucuaaaccaagaauauauauuagagcaacccaggagaauccagaaauaaagauuuguaaacaaaguaucccaguuuuccaauauuggcaauuguauagguuaacacuuugccaggcaagcaaagugggacggugaggaagacucagccugcgggccacuaguuuucaaccucuggccuacaaacuaauggagggaaauaacuucacgcacuccaccaaaaacagaauucauuuccaccaagguuucaauaaauauuaaagggcaggagguuugaaggccuacugguugacaaguuuuaagauggugacauuccaauguuguuaaguauagaggcuugaggauugcuuaggccagaaguggaacagacaucuucuuuuguggguuguggaacaguagaagacauaauuccugacuagaaaugggacaaagaggguccaaaaaucagccaaucagucuuggagaagucacacuguuauuucuccaacuacagguuuauuccuucaacuuaaugggauuguacagaacccacuaagaccagauaguuagucuacccccaccacuccauggacuaacagucaucaaaugugccaucaauaaguaacaucaccacuaccauccaaaauccugccaccuaggcagucacuacuuacucuacugagaaaaacaaacucuccuuccuuuucuuaagaggaaauuuggaaugggguuggagguaggaagaguaagagcagaaaacaagaaauaccauauacauuuagccaucuuccuccccuuaaaagucaaucccuauuuggaaauguuugcugccccuucuuaaacaagacaaaugaccucagggccagagaaauaaaauccccugcccaucuugacucaacagguucucugacaagcuaaacacagcugcacuucaacugcuauuuuuagauucuauaaauucuggccuccuuuuucucuugaaauaugcuuuagagacuugccaaacacuuuuaucuaggcucuaacuccaugacaauaauuucaugaguaugaaaucaccacuaugguguuuguuugcugcuauugucauuauuaggaauauacucauaaaacacguggaggguuucuuucuccuuggaggggaggcugccugccucuaauugcugucguagucugaauuauggacaggaaggggagauuuugccaccaaacugauuuccuuuuuaaaaaguggaagaaaaagaaccagaacaggggcugcuuaccuccaggacaguguuucucaaagugguuuaagacccagauuuccaggugaacaccuccuaccagauguauccaauugaauuuuguggaagugggguccuggccccaccuguaauagucaugccacuacagcacccagcuuugagaaugcugcucaguuccaaagcccaucccaagucccacucugaguucgcuuucacuuuguucugacaauuaaagcagacggcugcagggagggcaccgaagucaucuacgguguuaacaagguggauaucagggguccugaugcuuuugagacauugucuugcuuuccagaucuugcucaaaacugaccaacuugauucuggaagcugccaucuaaacagggcagauaauuggaacacaaucucuucaaagcaagaaauagaaccgggucugucccacugcauucagcauccaacauggccuaagaacacgcauucucucuuuccuccagauagucaugaauccagccagccagccaacaucuugugggugucauccccaugcacaguccugggcuacacugucaaacaguccucaccaaucacgcgcucaagacccaaccuaagauccauguuugaguguucucuuucccucccuuuuucacaucuaagacuucagcuacuccuagugucuuuaccuccaaaaguucucaagaaucacugcuuccgucuguucccucugugaccacacuaguccagccgucuuguccacuguucuugccuccuagcugggcuaucugcuuccacuccagcuccuguccuccauucacuccacaggcccacagugauuuuuugaaaauaucuacaauaucaggucacuucccugcuucccagagcacuguaaauaaaauccaaacuucuuaguuuagccuauguagcccagcacacucugcucuucaucccucucgcuggguuuuccuucacacauuauuuuguucaaucuuccuaacaacgcuuugaagcaggaauuaaccucaaguuccaggugagauucuagagagucagagaaguaaagcaacucguccagagucacagagccaguaaugguagagucagaauucauacccgugucuuuuggacaccaaaguccaaguucuuucuacucaaccucuuagcucauguuaaucaaauucaaaaacagaaauacagcaggaagccccuaggauuccuuauuacuguacguauuuccaaaggucagaccugaguugauuuagaauggccauacaggagcacauccaggauaaaaaagagaaaagguaagaaagaagaaaaggagggaagaggagaagagaaaaugaggaagaauaauggaugcucuggcgaacauuuaaaaaagaauuacaaaacacagcucaaacuuccaucugcugugggccaaagcccuguuaagcuuccaaugcuagaggguggggccaacagugauuuuuccccuuucccuagaaguugcagucccugguuacaucaccucucccaagacuuagcggacaaagugaaucagccagucacauaguaaggcucaccaaagacacuuuccgacugagaagucuggcugucagaguuuccuucccuuccagagcaaaagggaaagccccgccuuccagccauccacugauuuuucuugugguggaacauaaauuuauguaacuagauuuucagaaggauucccuguccuuuuacaaacaugaaguacugacacaaguuuucucagacaucucccaucuuuccacagucaguucaaacuugaaaaaaagagugaaaaguggcauuuuucauaaagauuucuccccaacaaucuacugauacugacuaguggugaaacccuucugucuuguuuuccuaauaucuggaaucagguaguacuugguauguacuucauauguaccauacugcuaauuuucaugccuagaauuacuuuuccaacauuauugauaacuauuagauucuuuaucauuaaaaacacauuaaauggauaauuauguaaaagcucucugggaagaaguuaaccuuuuaaaaaugcuuaacaagaaaucauuuauaacugcauauccauggugagggauaugggaggcaagggcugaaucugaaucaauugaacaaagaugggcuauaacuccaacaugugggccccuggcuugauacaaagaggagaggauaagcuccuggcuuccaaauggccuaggaucugauaggaggguuagauauuauaaacagaauauuuggcagaauauauuaagguucacacaugagguucuucauauauucuagaccauggcagagacuauaugccuaaccaauauccauucucuacuuuucccuuuuaaccaaacucaacuuuauuccaaucuacaauaugccuaccuaaaagacauuuucuagucuccccuggagaagagguggucaagaagauacaagcagaaaccauaaugugaggcuuccaggaaaacuccauaaauaaagacaaauuagcugggagauaauuuucuuuuguaaucuucucucuuccuucuuuuuccuaucuggaauuuggaugugauggcuggagcuccaacagccacauugggccauaagguaacuuugaaacuggaagccauguucugaggaugguggaacagaaagaggaaaggauccuugauccuugaaguccauggagccaccauaccaaugcugaauuacuucggugugagaauaaaccucuacugcauaaacuuauuuggguuuucugcugcaugcaauuugacuuggcuugaaagagugguggcaccaugugaccauuaggagaggagucaagagaaggaggggcucaugagacggcuucccugggacuaugcacacugcuggggaggccauuuccuggauaccagaggacaaguucucaaaacuucucuugggaaggaugauauacuaaaucaugauggaggggacaagccuccuauccuuaacauuauuuaacuuccacuaaucaauuacgaaccaucucauuuggcuucuuccucuucucccucucugcuugcuccccuuucucagcccuaggugacuggcacaugacuauacauggcuaaaccuuacaaggaauaggaagcaaacaucuuaggacuuaccuucuuucuucccucccaucaugaugaaguuuucccuguagcccucuuggggaccuggauacagaaauagcucagacacaggagccugcugagauuaugacuuaugggaggcagauuucucucaucauuauuuuguuuaaggccaaaaggauuccaaacaaaauuccugagcccaucuaaauccaaaucagaguggugguccagggccaaugggagaauggucucucuugcccaguuaguagauguaagcaagcaagacuguugaagccgagggaccacuguggcauggccaagccauggggagaaaaagaugggugaaaggaaggaacucccuaagggaauggcaagucaagacugaagauggacagcugcugucuuccuugaaaauucauccaaaagcugacuggccuuuacguuucccaccaaaaagcagugggucauuccauaucccucuaggaaugaagacccuucugaaggaggcaagcuucuccaccccuuaccccacacuggccuauaaggcacauaaauccuuaugaaaugagcucauccaaaacuucccagcaacgaacuaaaauuuagcaacaucaugcaguacauuuaaaacuuccaaaaucaaaccuuucuuuccaacagaaacacaaguuuucaaagagcaaauggaaccacaguagagugucuuccccucauugaacauuucuuguaccucucaacugcagccucccaccccccaaaacaauucuuucuagaacuaaaaauaucaaacuuuauuaaguaucaguuccucacuaaaaaccauguuugggcuugagauuaaauagcaagaauucuuuaaaacuacauuauuuuuuaaaaagcaaauaaugaccaagggaaaaagaaucccagauuuuuccaauacaacauaaagaugacagcaugagauaauacugaagcccuccaggaagaaagaccagcacacgaaucauaaagggcucuauuucuacuccaagugacgcucaugacuaaauaaaaauguguuucuguuuccacaaaucuacuuaaauuucacauguucugcgcacuuagccaucaucacacgggaagaagucacagaguuucacaguagauguggaaauggaagguuuuauuaauugcuccucuuguaccacaaccuaauuaaaaacagaacaaaaacaguucagaaguuucuaaugcauguaaggggguugaaggaaggcugguuauuccaaaauuaaagaagccaccagaaagaacuuaaucuuuccagccaucaucuaugccacuuuuuuaugccuuuuaaggguauguuagaaaugcaccagaagauggcugggaaaacccauuuggaugauacaccagaagcagcaauagcugguuccacuguuaguguuugggcuuggagauccauuugaugucagcuaugaaggugccaacaccacucucagcucagaugaggccaacagcaucauuuggguuuuaugauuguauucacucaaugcccagccaggauuccuuuuauacucaagaaaacucaaacaauuaacugaggcucaaggcauucccacccaagaaagaaacuggaaguggggcagaaaggcugaagggcuuggccauauguaacuagcaaacaugggaauccccauucaucccacaggguggugucaugucuguaccacaggaaggaaaugacuucuguggauguggcccucaucuuucugucuucccugccccacugaccaccugugccacaucagaggaacagagcccaaggacuggacgaccccaaggauggguccugaggggaaaggaucagccugugucagacuggaccacaugguguccuagccacacaugacugugaaugagcaaggugacuugauucuaccauuucuguuucacucuauuuucauuuuuuaaaacaagaauugugguuggagguggagugugguggcucaugccuguaaucccagcacuuugggaggccgagguagguggaucacuugaguucgacaccagccugagcaacauggcgaaaccccugccucugcaaaaaaugcaaaaaauuaggcaggcauggugguggugcgccuguagucccagguacucgggaggcugagggaggauggcuugagccugggaggcggagguugcagugagccaagauugcaccacugcauuccagccugggcgauagagccagauccugucucaaaaacacauuaugguugagaccuccaugcuuggcuguggcaggcacagcaugccugucaugcuccauggagucuucccccucacucucuucccaccucaaccuuuccaucaggacuuuucuaagcaaaaagugagcccagggggaauguuuccugaccacccaccucacacuguuguaacugaaaucucucauaacaaaaugaagaucccaacauugacauauaaauuauuaaucaaaagccuggcuuucucuuguuaaagaaaaauauauaucaagacucuucauucacaggaagugcaucugcaggaaaguuacgcguguuucuguuaaaaggcugcuccaagccaaggccaaauucauccuuuucuccucucaguuccccuagcccugugugcccagcugcaagaaggcgcuggcccacauuuugucauuaccagcuauguccucccuggaggaugacgcccuugaggacaaggacgcugaccuguuuaccccugugucucuggagaccaccagcauccagggaagaauuaaagccaccugaagcuccacuggcuccaggcugcuggccagugagcuuucccgggguuauggccgagcccuucauggcuucuucugagaaucaucaguuccaaaagcauccuuuuacuugacucuggguuuuguuucuugagacugauuuucagaaagucuaaaauuagccccccuaaaacucaauuaugaaaaccuugaccuauuaucagaaaaauaaacguuuggaguuguaacggcugguuuccacagugcucaaagcauuuugcagguagcccuauuuuuggcaagcagauacuccaggguggaugaugcacagccaugcagccaugcaucuguagccauccuuuuucacgugggucacugucucccuucuaccaggaugaccugggcacucaacaaaacagccaaagacuaagagaacugaguacugauuccccagucaacacaaauugggcuuggguccugucuuggugcucucugcuuauaacaccuugggcagagcugcuuuccuuucuuggccucaguuucuucauggguauaugacagcacacacuucccagggcuguggugaggacuagcagagacaacuuggguaaagagguuagaauggugccuggguauagucagcacucaguaaacgcuaguugucaucauugaugcuauuuuugugacugucacuaccuuuauuuacucuuaaauaggagacagcagagaaagucaaaguuacacagcagccucaacaaaacacuaguaggugaggccugauggaauaugcuguuaaaugcccgcugaaggucaaccagugaucugggacuccuccuccuugcggcacucugcagaccccugcagcccccaaaccagcaaacaggacaaucuagaaucugcuacugccaagcaggaaugcccuaggaugaguggcaccagcagcacagggcacggguaccuuggggugagaagcaucuguggucguauaaacuuccucaccaccaagaugcucaccaacggacaccauuuuaucaucaaacacugaaaugcaacuguguauagcugcucccacccuauuacccuugacucaaggggccuucagcaaagcugccuccaaggaaauauacucuguacacagaugaaaaagacccuugaaagcaauuccagggcagggucuucuggaagguucugagaaugaguuccagguccagaagucugggugaagucauucugauccugcuggagccccaaucccgauauggaccugcucucccagugugaccucagaccuucaccacccggaagggcugagcacagccccacccaaagaaaccccccuucugcaaagaagaaacacagcuguggcgccugugaccuuaagugguuugcacagucaauauuccccacucugacgggaaauggcugugaaacggcaaggaacuuuccaaaggcucaauaagaaaucaacuguggggcuaaaaggagacaaugcaggaaguuuaggaaaagguaacuacaucccagugggaguucaacagcuuuauagcuuauugguuaaaaccauaaguuuuaauuucagauuggaucuuaauguaacaauccuuggcugcaagaccugcaugaauauggaauaacaggaaagaauaauaggaaaaaaaucagcaaaggugacucuugggacugauauuuuauuacaccacacuugauccuaacccaaaggucagaaagcaauaggauuuuacucucuacuuaaccuggagcuucuccaaccauuauuuaaaguuggacguucugaagauaugaagcugauucaaaaauaaaagaggguuuauuuugguggggaguggcaaauaaaaaggaaauacacuauuaacagucuuaaaagaaauaucuacccuaugaagaauaucagaaccaaaaauaaacuucacauaaauguaaaauaaacuuuuacaaccaaucuucuccugguguggauuuuuuucuuccuauccaacuuaaacauaagcaagacaggacauugacugggaugaacuuuucccuuuuuagauaguacauggaacuuuuaaggccugagcuaaauauaaauaaaucuuuaaaaggucaaauuuucaacaggauaagaauauaauauggaguccuaggauucccaugugaagugauuauccagaagagccauuagauuggugcccugcucauucugccuaguucagagauagauggaauauuuguggggugaaugcaugacccggcaucccuuguccuuguccacugcugccacuguguccacagugaccuaagccucuacucaggaucuucacagguggcuccccguaccuggcacacauggcucauauucucuucuuucaauguaaaaauauauuuccuuccuugaagcuauugccagaucacagaagugccagacaaccgcacucucucggaaaucucacuaggaaucagguugccaugcucugaggaaacccaagucagcccaggcagaaagaccacauugagaggccacacguagguguucuggaugacagcccaucugaggucccuguccuaaccaugcaccugugggacacgugggcaaagacaccccaggggacucuagcuccugugguugaaucaccccugcugaggccccaaauaucauggaacacugagucugaauaacccacagaauccaugagcaaaauaaaaugauuauuucacagccccaaguuuuggagucauuuguuacagagcuagaguaacugggacaucaucucucaguaaacagaaucacgaaucugaaugagaaccccaagugaaaaaccagccagggguuuaaacacacugggaacaauguggucccugaagcagaagaugaaguuaaaaucccagcucugaguguuauggcucuuuuagaauuugucuagcagguuuucuggucuuuaccagaaaagucuccccuauuccuccacaaaaaaaaaucccagcucugucauuaacugccuguggagccugggccagguucuucucugaagucuccacuguacaaacuguaaaaugggacuaacagaagcuaaugagaccacuucagggauuaaaugggacaguuuaagugaagugugaggccagauauguaagguauuguuauuaacaucacaugugagaucuuaccaaagccuacacaucuucauuuuacagacaugauuuaugacuccaucaugcuuuucaggcuuauuagaaaaugagagugagaggugaugaugaaagcaguaacagguaaaaaauuaaacgaggcuuaaagaauuuuagaacugugccauuuuccucccuccagcugauuuucucuagaauguacacuguuagcaucuacaaaacauaaccuugaguagguaggaaacuaaggauuguaguccuuaaaaagcauauacauaaauaucacacauuacaguaugagacgucuuuggaugucucagucuuacaguaagaacuaaaauguauugccuucuaucuguaagugacagguccaauucuaacugcaugagcuauauuaucuuauuugguccuuacagcaauccuacuaaauaaguuguaguauuaucccaacuuuagaggugaggaaauugaagugcagggaggucacaucacuggcuuaggaucacacagcgaugaugugacaaaacaaggauucccaauccaggcauuccaaagccaggccaugcucuuaaccaccccacaguaaggccuucuugcggucauuuuccugaagauaaaaugugaacucccauucaguucauuuccuaucuaauuguugggaacuuaaaaaguacucuuaauaauaauccugccacucaagcucccucgaagaaacaaagggaaagacagaaaagacuuucaccagaacacaggaaaaaaacaagguuuucuguugucucuaacacacuuggugugugaaugacacgcauccauccucagagaccccugggcauguuuacagggcaggauccaggagguggcagcugaaugauaaugguccaugucacaugguuuggauuccgcugaaauccugagacaaaacucaacgggcuaccaaaauaauuuacaaaauccccaugauccccacuagcccagaauucauagagcagacaguucaguucccuccuuucuuuaaccaaaaaugcagggucauaagcugucuuuuggaauuucugagacugagggcaagcagaagggcaggaugaauaaaggaugacagcuccucagauggugagacacgauggacaaggacuccucccuuccaugcuccccugccaccuuccagccccaaguaucuccuugccuuccuagugccuaagaaagcagaaagcggauucccuccccaggauccagaccuccuucauggucuagauuacuguaucucagaguguggucccaggaccagcagcaucaauaucuccagaaagugcuuugaaaugcacuccuagucccaaccccagacccacugaaucagaaacgcugggguggggcccagcaauuugugcuuuagcaaguccuccaggugauucugaucccugcaaaaguuuaagaaccacuggucucaaaugaaagcuacaggccugaaugaugggaccacaagagggcucuaguucaucuuguccagccccacuuccagcuaauguccagacagaaugucuggccucuugaaucacuucccacucaauacccaccuaagaaggcccagccuuuuuguccaauuguccuaucuuaaucaucauuucauucauuaaacauaaaccaugggcagcauggguguaguuuugugagacuccgagcuucccauaagcacagcucagauuuugcacucucucuccaucucuuggacaacuagugugugauacgcugccuccaguagaucucccugcccugaguuggacccuagccugggaacaacaacucuggguaggcaguauugcuaugcaaucccuccugcccccaaaaagggccucugcugagaugccucccauaagggacuauucauugggcuuguucuuuucuucuaaauuaccacuccuaaagggaaaguuccuucucagaaaaagugggucauauguuucuggccugaugggccucagugucuuaagcaauuggagaauggcaggcuuaauuuauaaaaggcccacuguuucuggauauauuccuaccgugcaauacaaacagccucaucugagcccugauuuagaucacugaauuugggcuuuuuauuucugcaugccucucaucaauagguucucauaacuuggauucucauccagcucuacuucuguacuauuuuuucuaauguuuucucaucucucuacucccugcaguuauucuaucccauuauuauuucccuucugcaguuaaaaagaaaaaggauuaaaauaagaaucucuguauuucuggaaacucucacaugucaaaguuugcaauggugaaaggugcaaauguucccagugguccucacccaggucaaguacagaaguagauccuccuccucugggaaucucacauacuccuuuauuagaugaauaaugaaauacucucaagugagucugauagaugagaccagugggcaacauacuggaaaaggaagccaccugcuagacacaggcaacccaaaucuauccacuuccagcaauaccaagccuaucaguuguucaaaauaaaccuauaagacaaccuggucccaaaacuccucuuugcaguuaacgacggcauuauuccccuacuccugucccaaagggucccacccagcugagaugcaguucacgaaucuuuuggacacucaauauuuaagaauagcaacaaccagaauaacccacaggacucuaaagcuguccaguaaaagcugccaaccacuugagaggugcauccuacuggguuuuugcugcauccaugagaagucagccaaggccagggguggccaaaccccgggcagaaaugccggggcucugagggaucaaggcagcugcuuuggcgcauagcaaaaucacugaccaacccuacgcauuucaggggagcugggcucucacaguugugugaucuucagauaguuuaaaaccucccacuaacauuauucaaugauaugcauucucaaggcagcugcagaaguacacguugcauaucccuuaauugaaauauaagggaccagaagucuuucagauuuuggauuuuuucagauuuugaaauaucuccauauaauaaagagauacuuugaggaugggacuaagggcuaaacuucauauucauuuauguuuauauacaccuucuacacaugaccuauaaagguaacuuuauacaauauuugaaauaauuuggggcaugaaauaaaaguuuuaacugugacucaucacaugagguaagguguagaauuuccacuuguggugucaugucagcacucaaaaaguuucagauuuugggacauuucagauuucagauuuucagauuaaggaugcucaaucuguaccaacauucugucaacagcaaaguaagcuaguggccaagucuaauucagcuucaugcucagccauuacuuugcacccagagaccuacagucuuucauaccaagguuuaucaauaucuccuuuacacauaaaggccaugccacaggaccuuugcaugugcuauuuccuaucccuggaauguucucuccuucccucaacucuacccccaugauaugguuuggcuguguccccauccaaaucucaucuugaauuguagcuuccacaauucucacuaucaugggaaggacccagugggagguaacugaaucauggggacagguauuuccugugcugucuucaugaaagugaauaagucucaugugaucuaaugguuuuauaaugaggaguuccccagcacaaguucucucucuugccugcugccacccauguaagacaugucuuugcuuucuaccaugauugugaggccuccccagccacauggaacugugaguccauuaaaccucuuuuucuguguaauuuacccagucucagugucuaucagcaguguaaaaauggacuaauacaguaaauugguaccaggagugggguauuguugucuuuaucagcagugugaaaacggacuaauacaguaaauugguaccaggagggggcuauugcugugaagauaucugaaaauguggaagcgacuuugaaauuggguaacaggcagagguuggaacaguuuggaggguucagaagaagacaggaaaugugagaaaguuuggaacuuccuagagacuuguugaauggcuuugaccaaaaugcugauaauaauagggacaacgaaaucuaggcugagguggucucagagggagaugaggaauuuguugggaacuggaguaaaggugauucuugcuguuuuagcaaagagacugguggcauuuugccccugcucuagagguuuguggaacuuugaacuugagggagaugacuuaggguaucugguggaagaaauuucuaagcagcaaagcauucaagaugugacuugggugcuguuaaauucauucaguuuuaaaaagaaaacagaauauuaaaguuuggaaaauuuguggccugacaaugcgauagaaaagaaaaauccauuuucugaggagaaauucaagcuggcugcaaaaauuugcauaaguacugaggagccaaauguuaaucgccaugacaauggggaaaaugucuccaggggaugucagaagucuucauggcagccccuccuaucacaggccuggaggccuaggaggaaaaaaugguuucaugggccaggccuggggucccccugcucugugcagccuagggacuuggugcccugugucccagccacuccagccauggcuaaaaggggccaagguacagcuugagcuguugcuucagagggcacaagccccaagccuuggcagcuugcacaaagucaagaauuaagguuugggaaccucugccuagauuucagaggaugcauggaaaugccuggaugcccaggcagaaaucugcugcaggaguggggcccucacgggggcccucauaaagaaccucugcuaggacaguguggaagggaaauguggggucagagccuccacacagaacuccugcuggggcacugccuaguggagcugugagaagacggcccccauccuccagacccuagaaugguagauccaccaacugcuugugccaugaaccuggaaaagccacagauacucaaugccagccagugaaagcagccagguggggugcuauacccugcaaagccacagacgcagagcugcccaaguccaugggagccuaucuuuugcaucagcaugacccagaugugagacaugaaguaaaaggagaucauuuuggagcuuuaagauuugacuuccccgcuggguuuuggacuugcaugggggcauuuagccuuuaguuuugaccaauuuuucccauuuggaaugaguguauuuaccuuaugccuauacccccauuguaucuaggaaguaacuaacuugcuuuuaauuuuaaaagcucauagguggaagggacuugccuugucucauaugagacuuuggacuguggacuuuugaguuaaugcugaaaugaguuaagacuuugggggacuguugggaaggcaugauugguuuuggaaugugaugagaugauauuuggaaggggccggggcggaaugauauggcuuggcuguguccccacccaaaucucaucuugaauuguagcuaccacaauucucacugucaugggagggacccagugggagguaguugaaucauggggaugggucuuucccaugcaguucucaugauagugaguaagucucaugagaucugaugguuuuauaaagaggaguuccccugcacaaguucucucucuuugccugccaccauccauguaagacgugccuuucgcuuucugcuaugauugcaaggcuuccccagucauguggaacugugcguucauuaaaccucuuguucuuuauaauuuacccaaucucggguaugucuuuaucagcagugugaaaacagacuacacaucccaaaucuucauuaaucuagcagacuccagccccuuuucuguggcucagcuccucucucaaacuaaugaaagcagaacccaggaaggcgagcauuuuggcaacuacaucaacauggaaugucacaugacucauaguguaaucaaugucagccacaaacucuaacaaaacaauugauagaaucacaggauuuuuaaggaauaagacauucagggaauacaugguucauguuccuucucagugcuggggacagggauuccauggcucuugcuuaaaucucucuggugacaagaaacucacuauuucaugagacagucaauuccaaagaacaagaugaucagccacaagccagaggcaaugaccauaugaaauugguccaguuuagaucuuucuccucuguagccaagcucugcugaagacugcagcacacccaccauaggagccccagcacuuaucccaccuggccuugccaaaguggggcuaaugguaguugaaaaauagauuccuaaucuugaguugagcacucuuuuaaaagaauguauaguauuaaaccaauaacaguuuccuacuuuugauaauguacuauguauauguaagauguuaucauugggaaaagccggguaaaggguaccugaaucuuuccauagaguaguuccccucauccucacaaguuuuaaacugcaugcuauucugaguagugugaugaaaucucaugccauacugcccaggaugggaaucacaccuuuguccggcacauccaugcuauuacacuacuacccauuaaucccuuacuagcugucucaguuaucagauugaaaaaacagcagauaaaggguucaggacuacccacaguuucaggcaucuacuaggggucuuagaauguauucccaauggauaaggggggacuauuguacuauuuugacuuuuuaugaguuaaaacuucuuaugaguuauaacuucuuaugaaucuuaaacuauuucaagauuaaaaguuauagauauagagagacagagacaauaggagccagggucacugcccucaaggcaugugcucaugguggaacucuugggcauggacauagugagauuuuucugaggucuuuaucaucuauaagaacuaucauacuaaaauauacaaccaauuccauuaccacucaaggguccccaguauuucuggcgaaacaguucccaacgucacucccaacccagucagcaaggguuccacacuggggucccuagaccagcagcaucacgugggaauguuacaaaugcagacucuuaagguccaccucagagguacagaaucagaaucuauaaggagugagccuagcaaucuauuugugauggggcagggagagcaauauaagauguaucacuuucaccauuuucaaguguccaguucuauggcauuaaguacauuuucauuauucugcaaccaucaccaccauccaccuccagaaccuuucaucuuccgcaccugaaaugcuguacccaccacccaugaucuguuuaaacaagcccuucaggugauucuaugccacccuaguguaagaaccacucuacaaucacaugagguaggggaacuggcugcauagcauauauggcaauuaucuuucuguaucuuugaccuccguggccuugucuucuuacccauugcuugucuugagaacacagagugaucaauuauuugccugaccacuaacaccaccccagucuaggacaacacuauaggaggcaugugugcuugcaucugccaaccuagcuuuuaaucagaagccaagguaacacuccagggucccuaaaaaaacaggcaagggaaaguaauggacccacaagaagcauaaaguauuugcuaagcacccucuggggcguucagguaaaugagcuccauuaauccucauuacaaucccaugcugccuccauuuuacagaagaggaaacugggaaccugacauaagaaaugugcuucacgucaccaggcuggccaugcagagguggaagucauacuccaguuggauccucccucacuacaggagagccacaggcccucaggucagcacuuacacuauacaggacuucagaagcccaagaucaggcccauuuuguucaaacccuuuaaccucaccucugcuuuuaaucccaacucccauuucuacuccuuuccuaaggguugguguuucagaaugucuguuaaucccaugggcuucuuuuagccccuuucuccagguagggaugguuguggcuguagugguggaugagccuggcugggaguucugcugugggcuccaaagcucuucaggguaagccccagggcucagcccagcaucauguuugcaugcacaggcauucaacaggugccuguugaauuaaaggggcaaguauauccaucuugaugaugugucacaauuuuuaaaaauacacccacguaugcaguggcugcuuccucuggucauagauuaguaauaauuuaaugacaagggaggaagagaaaggaucacauuuucuuccauuaagaccagcaaucaaucaaggcuguuaaaaauccagcuaaauuuagcaugagauaugggcuuucagaaagucuuccauaguguaggaggccaccaaaaauauaacaaaacaauuaagucacaacaggacuaauggaagucuauaaauggugaggaccccagagaucagaacuagggcuugccauaucuugaaacaggucuuaucgaugagaaggaccuagagaaaaaucucuacauaugaaacaucacuaaguucuuccauuauuaaaacaugaagcugaagaagaguuucuacaugaguagagagaaaagguauaugaaggcauaaagccaaguuauucauagaaaacuaaucuauaucauagcaccauuuccuaaaccucaggagaaaaaugguguuccguggucaaguacauuuaggaaaugccaaacagugcauccuccuugcgugccugggcuucuaaagcuccaugaaguccugcaauaaaaagccugcguuaaauucaauuauguuccaaaauuaauuugaauucaaaauuuuguuuuguuuuuugacauaaaagucguuacuauccuuugaaaaaaugcuuugggaaaugcugguaugaagaauaauauucuuuauguugucaagugacagggaucugggucucaucaaggaaggacugucccauaaaaaugaucagcuggagcacugccacugccacacaagaugacaaaaacaccagggacugaaauaaaaagguaugagaaaccaagccacacccagugucugcugccuaccaggcaggacuucagaugggugugauggaguuacagggcagcauccaggaccaacccaacaucugaggggacauaaauggcuguaacauugacccagcaaagccacggcuggaaucuguccuccagaauuaauaguuaggugacccaagaugcucacugcagcaugguagugacaggagaaaaugagaaagaauuagacauuccauaacuggggaugaguaggaaaagugcuggcacauccagaauggggaggugggauuauccacccacggacaccuuugcucagaguuaagcaaagugugggcugagugccagccgaaccaaaucuccugagaaagccugguuaaaaauguacugcuucaguccaagauuucauuaggacaauccaaaauuuaggggguugaagggaguugcuggcugcucccucugaagccaaauuuaaaauguagauaggcaaucucaugugaccaaguguuuccagcugacugucggguuauaugaucugacagguauuagucuacccaugauaaccaacaaacagaauuguuuugcacaacuguuugaaacuauccuggacaacacacaaaaauuaacucaaaauggaucacuaaucuaaauguaaaagauaacauuguaaacuucuaguagaauaucuugagcauauguucauuuuggaaauacuccagcuucuccuaacauucagugaacauuuauugggcaauuagucaaugucaauuacucugcguggugcuggggauauggagacaaaugaaauaguuccugaugccaagcaucuuaaaauauuuucugaguucuuuaugguuuuaucauuaauaaaauuaucccaaaccucuuugaauucauguauauuucuugccagacuaccuugguuguaaccuaaguuucuggacuguuuggcucauuaauuaaacaagcaaggauacaucugccacaugccacauuucuccaacacagcugauggaaagaaggguaucaugcccagggaaguauaggaugaaagaggaacaaaugucagauucaggagagcuauggaauaaacaucacuuuuaaauccagaccaauauauaacugccaaaauggcagaagaauccagccagcuaucgcuccaagagguaggauuauacugaccaauuugaggaaacuggcuaacaggaaagaaugaaaacaaccacugaaccuccgugccgugggcaucuucccuaccacugucgcugaugaggagcaaaacaaggguuugaauuucuucuuauuuucccugaucuuucggggcagcggggagggggcaugguuagaaaaguaucuaaaaggucaacuaaagaggaauaaagguauaaaaccaaagaauacggauaauucaauaguggaauaaguuccaaaaugaacuaguaacccaaaggaacucaggaugcugagucuggaggaaguaggcaguggggauggggacagacagacagauaucuguaggugcuccggggcagaaauaggaggggagugugugauuacauggagguagacucugguucagccuaagaaagggcuuucagguugcugaugccauccaacgcuggaugggcugccggacacagcagagucugcccacaaccagaaggccagagcuaagggaugccugucacggccccgagugccccauucguggcucucugcucugagaauaggaggagacccaccagcacaacagcuguaagcagaagagcugaaggauggccaguguugcauuucccaggcauucuauacagguggggagcauuauuuguggcacagaggaaauucuuauucccugacuucaacacaggaagcacaauagugcuugcuuacuucaucuaccucugcacccuccaaaucccugagaauaauaacagggcugagagaugaguccccggaaggcuuguacucgagccugugcaugaacugugggccaccucuccaggcaugaccccaguaauuguuacagugucauaaaaagccacgcggaaaguuugaucagcacaaggucaccagaaaaacuguacuaaaacgccagcugaaagcaaugaugcugaccuugucaguagcugaauggcaaccccugugaucccaccaggcuuucugaaaugcuggaaagauuuugcaggccgucaucaccaugcuaauggagcuugggcucuagaaaccccaguuuaggaaagucagaaccaugcuucuuaacuuuuguaagugugaaagcaaccuuuauaauaccaaaauauuuaccagaaccucaggugauaaaagguauacuuuuacuuauuaguugauucaggaacugcauauguuuuaugaauucacucaggccuccuuacgacaaucccaaggucucccaagagauuaggagguucgacacuagaccugcacugucugauacggucaccacuacccacgugugccuaaugagaucauaaaauggggcuaauauucacaccagacuucaaagcccuaguacaggaaagaaggcaaauauuucauuaacauuuuauugauuuuauguugaaauaauaacauuuuggcuauauuggacuaaauaauauacauuuuuaugcgcugaacuguguucccccaaaauuccuguguuaaaguccuaacucccaguaccucagaauggggcuguauuuggagacugggccuuuaaagggguugauuaaauuaaaacgaggcccucagggugugcccuaauccaaucugaccggaguccuuagaauaggaggaaauguggacacacagaaaccccagagauaugaguacagaggaaagaccaugcggggacacagggaaaaggcagucaucuacaagccaagaagagaggccucaggagaaaccaaaccuguggacaccugauccuggacuuccaaccuccagaacugugggcaaauacauuucuguucauauaaaccacaagucuguggucuucauuauggcagcucuagcaaacugauauauguuauugaaauuaguuuuaccuguuuaacuuuuucaauguggcuacuagaaaaaaaaaugcucaucaucaccggucaucagagaaaugcaaaucaaaaccacaaugagauaccaucucaugccaguuagaauggugaucauuaaaaagucaggaaacaacagaugcuggagaggauguggagaaauaggaacacuuuuacacuguuggcgggaguguaaauucguucaaccauuguggaagacaguguggcaauuccucaaggaccuagaacuagaaucaccauuugauccagcaaucccauuacuggguauauacccaaaggauuauaaaucaugcuacuauaaagacacaugcacacauauguuuauuggagcacucuucacaauagcaaagacuuggaaccaauccaaauguccaucaaugauagacuggauuaagaaaaugcgggacauauacaccauggaauacuaugcagccauaaaaaaggaugaguucauguccuuugcagggacacggaugaagcugaaaaccaucauucucagcaaaccaucagaaggacagaaaaccaaacacuacauguucucacucauaggugggacuugaacaaugacaucacuuggacacagggcagggaacaucacacaccggggccugucgggggguggcgggcugggggagggauagcauuaggagaaauaccuaauguaaaugaugaguugauggcugcagcaagccaacauggcacauguauaccuauguaacaaaccugcacguugugcacauguacccuagaaguuaaagcauaauuuuaaaaaaaaggaaauuuacaauuacagaugugaccacauuauauuucuaucagacagugcugcucuugaguuuccacuguagggacaacaccucaauucugggcagaaggaagggaggcaccacugccuuggggccccccuucaccuaaaucaagugucucacugcuugccaccaggccucccagggagccagggagcugccuuucaacacaagguaauggcuccgugugguuuuccuuaaagguuacacagccuugaaccauuuccugaaauuguuugagucauucccucauucuuucugacauauuuuaaguaagcuggacaggcacgugcaacagaguguaucugagccuccaaaauuaccaucuggcagcucuuuguuauuaaacaaagaauuaacucacaaaaggcuaacaagaggcagcaaggacaccugcuuggaaauuccagcucaguggauuuacagaggacucuucugaugcauuugcguauuuuucagugggcugagcuuagcacuuuaaaagcaaugccucauuuuauccucacaccaacccuuugggguaaauaucugaccccugcccuuucacauuagauuuauacccaaggagcgagauuauccagaaagcaaucccuuauuaaaugaccucaaaaugguuaugggguguauaugugugugugugugugugugcucacauaguuucauccaucacuuuuccagauucagaaaaguuugauuuauuacaagagggaaaaaaaucucuccuuucaaguucaauacguuaacucuuuacucauccuuagaaauggacagcaaggaagaaacaacgcuggaaccuacuccaucauuuauuugagaaauaaaguguuuuggggguccuauucccagggugacaguguugaaugccauaagcucccugcuuuaaaauaaccuaugcucugguacagaagauaaaacacaaauauccaaguaacacaaauacagguggaaagaaggugcuaagacagcucagaugugagggagcucagcaccagaaggcccacagcccacccuggggagaacggugagaggaggguuagcagagaggaaucgcaggucagggugguggaaagucagcccaggggaaaaagcucggcagcuggcucuggaaauggaguacguuucacacaggcagagccaggagucuggaaggcaugggaaugcuucacuugccaagucaugguauucagaacggaugccccagcagacuagcuccugggaggcagcgguuauggcuuacgagucuccaucugccccgggcccagcacagugucuggcacacaaugagcacucaauaaauagggugccauccaaaucggaacacuugagagugaaauagagaacuauuaaugauuaugcugggacaacaggcauaaaccaggacugucccaggcacaccuguacauaggacacuacaucacugauguguguagaaacagaagugaauugaaaauagagaagcaaggggugggagggacaagugugggacuaggccaaguaagacagugccccgaaugcaggcaugaaauaaccugagcuguuggaggacagggcccagucuuuuuaaucuuuguuuccccuccaccagacacagagcuguguacccaacagguacucaacacaugcuggugggcugaaggcauggaccagacuucaagcucuucagaagagguuuaagugacagucauuguuuaaacugcagaggccacagacaggcagggaagaucaaacagaagugcagagaaccuccaguccccaggacuccugccugcccuggacucacagacccacauugagcuuuccucccaccucagagcacggacacacgugcacaggagcggcugaaaagugcaaccucguccaagaccaggagaaaccuagcaccaauccacccagaaaugggccauccagaauggaguuuucucuuucucagacuaacuagguaauaauaaugagaaaagccaucaucuuuugcauucaaagucauagaacuaguugguugcuggaugggauucaaacccaagacuuggcugcuuaccagcugugagaucuuaaauaaauuaaaugcucuaaaucucagaucccucaaugguaaaaugagauuuuauuuuauuuuuauauauguagauauaauucugauacaauuuucuguauauaaucacauauuaacauauguaauuguauucuuuauaaggacuucauguacauguaaaacauguagcauauaguaaaugcucaauaaaagauagcuauuauuguuacuguuacaacuuaauuucuucuuuuuauuuacauagcccuuaauacauuuuuuuuaaaagaagcaacucucugucacccucuucacacaaaucuccugggaugcaugugaauaaacuauucauccaccauuggacccaccauuguuccaacucccaugaacuggggcuagggcugucuugugaaaagacccccaggcuaccuauggauggcugcuucgaagggguggguuuccucagccugggcgcuucccuagcucucuguaggugacagaauccuuucugccgcacacagcguacucacuacaaucaacaaauuccccaucugcaaaacagaagucaccaaggaggcugguggcccacaguaaccugucagggaagaaauauaggaggccaccauuuucucacaaaaugcaggaaggacccaugcaauuucuaagcuggcuucucguauucuguuugccccaagaaagcagacccaagaaaaggagaaggaaaaccacuuuaaaauuuucugcuuaauaagagcuuguaccucaagagcuuccuggucucugagaaggggaaauagauuucugacauagcuguguccaaaaacacugcagugaaguuuaaaaaaacugcugaaaagucaagcucagucaguugacugcugacaacacuguccuucaagcaauaggcagagaaugcagaagaaauuauagcccacaccacccuccuauaaggggcacccccuccauuaacacacaucagcgugggcuggcgagcugcacuaggucacauaaagucagugcugcugacucaagccuggccccacguuguugaugaggagcacucgcucucacggucagugugaggagagaggcaucuggccccuccgaggcccacuugcuucugauaccugcaucaacugccagcugguggcuuuguccguuuuccccuguaacuuuugguaucuaugucuucgagcuccuugcuuuguggucuauggaccagcagcaccagcgucaccagggagcuugcuagaaauucaccucagaucugcuguaucaggaucugcauugaacaaggucccagguucuucgugugcacgcuaacgugaggaguccuugucaaccagcccgugaagaugacugagaggcucuggcuugcucugguccagagagaaagaacgugccagcuccgagagcugccuuaccauuugcccucuucucuucccacauuucuuauuugcuccauacuuucuauuuucuucucaccaucugcuucuaaucauuuuuuaaucccccaaaaaacuaugaaacgagucuugaccccuuccaaaugcagaggcaguuagaaagaggaaaagauuugcaggguagagcagaaggaaaaaggggcccaguguuuaccagaccccuacuaagaagucaguauucugcuccccauuucagcugaggacacugaagcucagcaguaaaggugaagcaacuugccugagaccaugugguugaucagagcaagaccugguccacccuggccuggcccagccccugccaugcuaagcaggaagagugcuucaguucaugugcuucacacauguugaguugaaagggaaucuuuccacccagcacuagcaagagcaucaggaaggagggcuuuucuacgcuaaaaggcaauauuguaauaugucccaaaccuaaaaugccuucccuuucccacugagcaauaccacuuccauccucugcacugccaccuuuuaucuaguucuaugccacugaaaacagaaaacaucacauccaagauggugacauccuuugaaggacccacucaacuuggugaaccauccaaccuucuucuguucuguuucccccauuguauauggggccuguauguggauauaaacauuugugugugauuguuccaaaacacuagagggagagauuauguuccaugguacacuugcaacucagguuuuaaucagcaugucuaaguacaacgugaaacagucaaugugaccucaaucuauuauuuguauuuccauuuggcuguguggcuugaucugugugacuagugccuugggaggcuccaugcuguacuguggcaggagcugugaguugucuguccagugucugucccucuccuucuuaaaaaucaaacuucaauaucugcacuguccaacaugguagccacuagccacauguguuauuucaguuugaauuuauauuaauuaaaaguauagaaaaguaaaaagucaaugccuuauuggcacuagccacauuuuaagugcucacagucauauguggucacuggccaccauauuggacagugcugauacggaacauuuccuucaucacagaaaguucugcuggagagcaaaacucuauagugauaggauuuauaagaugucuagcugguacuuagacaucuuccaaccucuuuuaaaauauggauggucaaugcguuauaagcagaagucacuggaggcucuuuacaggggccucagaccagauuauaaagagccccuuugcaugucccacuucuuccugcaugaaaaacacauacaauggcuggagccccagagccauuuuagggguaggaggaaaagaugcucuuaguguuggaguguccacagcucagcccuuggucccccucucuucucuaucuccccucacacccugggugaucucaucaaaucuccuggcauuaaauaccaucugucugcuggcgacucccaaauugauacuucuuacucagacuacuacucaaacugaagacucauacauacgcauacacacuuaaacaucuaccagugugucuaaaaacaaacuccagaucuucccccuuucaaccugcucaccugcaccuuccguugaaaacaccaccagugacaacuccauccuuuuagguacucaggcugaaaagcuuggagugacccuugauaucuuauucccucacaacugacaaucaaacccucaggaaaugcuguaggaucccccuucaaaaugcacgcagaauuugaccacuucucacaauguuaccacuauggccccaguggagccacccucuucccuggguaacgcucagucuccuaaccccguuccugcugcucuaccgccuccuacaggccuucccaacauagccgccagcaggggccuguaaaaauggaaggcaggccaggucaccacccugcccagaucccucacacacucccaucccccucugaguaaaggcaaauccuucccaaggccuaggaagcccaagaugacccgcucacaaccaucacugccacucugaccucuuugcccacacuggucucccugcuccuccucagacacaccagacacucagacacuggucugagcccuccuccaggaacccgcugugcuaacuccccagccuccuuccaugcuuugcucaaaucacaccucgucagugaggucacccugacccccauaaccccaugccugcacucccaaacccgcuucacugggcucuauuuucuuucuuuuuuuccauagccucaucgccuucuaaugcaccuuaauuuucuucuuauuauaucuauugucugucucccccuacugggauauaaacucccagggggacaaggauccuugucucuucacagcagagcugagggccccccagccuacggcauaauagguaugcaaugcacauuuccugaauaagugaaaggucagagaacauccucgagucacugaaccaacaucagcaacuucucuuccucuagaagagagagaaauuaucuugaugugcuuaagccccuguccuggggucucaauuccugcaagcugaguggaauuccugucugauaccucugugaagaccaaagauauuauguuuuauucucagacagcaguaagaacugggaacucccugcagacaccaugguacucaaagcgcuacuaaugacccaaaugaucaccuuccccagaguugaaacuccccugugcucccaggagcagaggagagagguggugagcaagcuaucguacuuucauaaucaccucucucaaugucuaaaagcucccuuuuggggauggcaacuaacuuuggaaaaccacuuuaaaggaggaguuaaaaauacauaccuucagugauguuggauguauauguuuuuaaauauauaggacacaaguauucugugguauuccugcagaaaauauacauccugaaucuaaucaugaugaaacagacaaacugaccuguacucuucaaaaaugucaaggacaugaaggagcaaggcugagugacuuuuccagacuaaagagaugugacagccaaaugcaauagugcgggauuuucuuuugcuaccaaggacaugaagauaacuggugauauuugagugaguucugcagauaagcuaacaguaauguaucacuuaauuuccuuauuucaauaauugugcuaugguuacguaaaagaauguccuuguucucaggaaauaucccugauguuagggauaagggggcaucgcgucuccgacuuacucucaaacagguaagaaguacgaauagauagaaaauuacaaagcaaaugacauuuagggaaucugggugaagaauuuacgguauuucuuugugcuauccuaaugacuuuuuuguaagacugcuauuauuucaaaauaaagauuuuuuuuuuuuuuuuuagauggagucuugcucggucuccuaggcuggagugcaguggcacaaucuuggcucacugcaaccuccgccuaccagauucaaacaauucuccugucucagccuccagaguagcugggauuacaggcacccaccaccaugcccagcuaauuuuuguaauuuuaguagaaacgggguuucaccauguuggccaggcuggucuugaacucccgaccucagauggucugccugccucagcaucccaaagugcugggauuacaggcgugagccaccacaccuggcccaaaauaaaaauguuuuaugcgaaaaacguguguguguguaacauacacagagagcuggaguacaugcaugcacacacgcauacgcccaagagagaaagagagcgcuauuugucaaaaguuugcucaaguccaauacuuccauaauuuuuuacgccuacccacuuaacuucaggccaaucaaauauuuacugagaaaaugacucucucauuaaagagucuaaaaauauuccccuuccaaaaugagaagaaaagaggccaugauauuaauacuaauacguugacuaaaaauaaugauuuucucuaacaauauaggcaugaauaaaaucuauacuuuuauaaaauaagaaauaaauaauaauuugcugguacaaccacagaauauguuaguccccuuaucccacgcaaugaggcuucaggggccaggcuuccuuucuuuacaaggggucaucuaaaacagacuuaagcauacaugacagaggaauaagugugacagucugagacaugacgggcccucagaaaaccuuagcuggcuccgaaucuuuccucaaaacaggaauucucugcaccgacgcgucacugccaccuuuacccagauccagcuguagcgaucugcuuuugcaucuguguccuaucuuauugugacacacagcacgaagggaagcuggcucccccacuuccccugcuugugauucccacccaaacacgacuuucauuaucagucuugccuugaaagccacucacuccagccucugcagccagcccuggaugcccagaaaguuggcccauggucuuaugccuucacgaaaacauaguguggcuguguccacacggcucauccgucuucauucagaggcccucuugggccugucacuuggaugugucucggacaccaaagcucuguguuggaggauagagauggcaagggcuuuuuccacaucuggagucuguauguccgggagguggggaggucuggcgaggcagcucuuugggguagacugagggaccagcuacuacucaaagagugauuccaaggccuguugcuccuugagccauguggaucccacuuauuggaacagagaauucuccaaaugaccuuaggaauggaugccgugggaauggguggagaagacaaaggaaagaauagugacacaauuugggccaccuugauauguuauuucugauuaaagcaauggauaagaaaagggcaggaccagcccuuaggucucacaugaucaaggcacaaagcaagaaaaccagauuguucacagcuaguucacucuguacuaauuaagacuaaauucaguugcaggagguaggaaaacuuccagagcuuaaacaguccugugggagguaauaacccccaguccccuccaagcaagcccaacagucagcaauucaugcgucuucagaguacagagaggcugcugugcaucuucagagugcagaggggcuggcgaacagaaucccaaaugugcacggaaugagggugaaaaauaagaucucaauaaauuuaaaugaaaucuuuuccauuguuuuaaauggaaacaauuacacuauccaauaaauccagucaaaauacagaguaccucugaaccaauguacaaacauaaaagcugucgucuggugguuuaacugaccccacaaauuuacuuuccuauuauucaucaacuuaaaaagccacaggaaacaagaaagaaaaaagacucugauaaucaaacaucuguguaucaggcaugacuugagugauaugaccaacuuauuaacaaacaugcuagaagcccaauacucaccaguaugcgauauacccauggaacaaacaagcaccuguaccuugugaaucuaaaauuaaaaacaacaauaacaacaaaaaaacccucaacauauucaguugugugcuggagcuugcugcaguggguuuccaaaagccaacuguuaaauuuucagaaaguuuaugagccaggguuguuaaacacagccauuauuaaaaguuaaauugaauaaacuuaaaaauaaguaaauuauauuaagauaaauguaauaaauacucaacacucauaacuuccuaauuauuuuaccauacuuuacuaucaucuaugcucuuaaagauauuuagagcuauuggaaauacuaaacaacugugugcuauugugcaucucuuccuaacuccacauucagugaugucucauugguagcuugaaaucagacaugauaagaauauuuacaccagggaaauuugcaaaaugcuacaaaagucauguccccucuuuccaagagcuaguuguuaaacauuagcagcacaucacugcucuagaacauaaacccccaaaagcugucaccucugggggccauaugcuuaacacagagaaggucccaggacucuauuaugaagaggcagugaagucucucacuaguucauagccugagucagguuacuuaaccucucuuucuucauguaaagccuguagaagaguaucuggcauauaauaaguacuaguuacuaauaguucuagcuuguauuuaugagggguguuacaauguagugguuuaaacccaagucuuaggagccagacuugcggguuuaaauccuaccucugcuacuugucaacuguaagguugugagcaagucccuucacucuucuaugccuugucuuugaaacaguaagaugaggauaaaaacaguaacuaucucacauguagugacucacaguaaccagcacauacuaaaugcucgauuaguguuagcugcuuuuaucgcuauuaccugaauauuaugggaauucuuuuaaaaucauuuucaaaaggaguuuaauuacuacauucuuuaauacuaauuccuguauuauuauaccucacuuuuccccaaacacacuauuaucuacuagagaggauugcagagaaaucuugcugcuuccaaaauuugaauuaacuccuagaguaaaaauggaccaugauaaaagugaauaaacaaaccauggaagaaauuucaaaacaggaaugacuagaaggugauuacuuugaagggaaucaugcuuauaaugaauaucuaaguucaagguuugaggcagaagggaucuuuauaaucacaucucaaauauaaagacaaaaccaauaaaacagaacacauuaucaugugugacuucaaagaauaccaguguuaaaagggcaucaacaguauauauuaauagaugaacccaguguaaaugaauaacuguaaauagaaagucaccucuuaaaauaaaaauuuuacccauagcaauugcuacaaacugcaucucacauacuguacaaauaagcuuacgauaaccacugaagugucaaugcugugaccauacuuacauauuuaaaucagcuccauuucaaaaaaggacuuaaggcgggcaaagccuuuggauuagaauuuuugugccuuccuuugcuaaucacaauguccucuguggcaaguguccaaaugcagaagauuaagagcccuucauugcacccaagaaauaaaucaauggccaaacagugcucaucggagauaucagcucccaugcugaacauucaccacacccuuucccuucuugauucauccccaguuuguucuccagcuaugcacaacauggccucccagaggagauggucaaggcaacccacacucagugagcugacuuccagcguggucuccaaagcccagcuucccgguuccuuagugccaucugugugagcagagcauaucgcaugagcagcggcuucacaccugagcuggaugaugaagguaguuucccacacaucaguucuaugcaucccaaccuuccccucuuuucuugcccuaguuuccagcaccccuuaccaaacauucaggccaucuaugcuaccuacagaccaggagagccugccaagggcacaaagccaacugcaggaaucaagaaaaaucucccauuuuccuugggcacccuauagcugagaggcuuguccucuguaggacauauguccaaggucaccuuagagagcaccagggccccuccaugcugcccucucagggguccucagccaggauacuauggaucuaggggagagaagaggagccucuucuggagaagcaaacuaagauaacuagucuacaagcaucagaucagguuagucuggaacugacauauagaagaccaccuggacagguuaaauaaaucaaggaauagugaaaaagaacuacugaaaaagaacaggaaagcucuauaugcaccaauauggaacaaucuccacgaaacuuuuuuuaacaaaauaaguuugauugagauauaauuuacauacauaacauucacuaauuuuaggugugcacucuguuaaguuuuaauaaaugcaaccauacaaccgcuacaaccacgaucuuagaauauguucaucgccccagaaaguugucucaucccucuuugaagucaaucaucaucagcccuucccccaaacccuggccgcugaaaaccaccaaucugcuuucuccuuaguuggccuuuuccagaacgucauauaaaugaaucauccaguagguagccuuuugugucuggcuucauuuacucaguuuaaugcuuucaaaagucauucauguuauuguguguaucauaauaacauaauauuguuauugcugaguuguauuucaucugguacagcuagauuuugugcgauuugccaaaaucuguuccuccauucugcuguuggauguuuuaaaagaaaaaguaaguuuacuacagugugcacacaguauacuacuauuugcauaaaauaaaaggagguacacacacagauuucuauauuuauugacaagcuuuugaaagacacguuaagaaaauggaacugugguugccuuugggagaaaaauaggauagcugaaagacauccuuucuuugacaacuuuuauaaccauuuaaaaauuuuaacuauacacacuacugauucaaaaaauaaacaaauuuuaaaaguuuucagaagaccucauaucuaagguuggcguccccuuuugccaaacccugcaacuguuuuuuucuuagcuauuucuuugauuucucaagaugacccggagauuuagcauguuauuuuccagauaaagaagaaacuuuugcuguuuuucuuucuccucuuucucagaguucuuauuaacuccaacuuaaucucccuuucuuaacuaucuguuucuuaaacaagaaaaaaaaaaaguuuugaucaccucugaaaaccagcauccaacacucuaaacccacagcauguaaugugauugaagccauggucccaaggcauuuuguuggauaugaaaauggaaacaggccaaaacaccugggcagaucccagggugugaucucucaggagaccugguggccagggugaugucccacccuucgccaggccaggaugagcaucugcccacaaaagcaaggaaggagcugcagccacuuagguuucaaaguuccuugaaaaauccuucaggaacauagaagaacaaucuuaugaacaucugcagcuucucagaaaagcugaugugcauauucccucgucuaguguagauuguuuuguuuuguuuuuaacaauaauaccguuauuggccuucuugacagugucugacacaugguucuguucaaaaaaaguucccuaaaugccucuagagggugucacugauccucacaguagggaaugacaucacugccccugcacucugccugggcuucucugccaucccugcaucagacucagaacuguugccaucguuucccugguccugaagagccugcuuauuugccugucaugcauagguauuugaucucacaaaaggccugugcucucaagguauuguacaggauuagaggaugagcacagcugucauccagguaagaacacauaaaccagaaacagauggaguaacaacaggacaccugcauuuauucuuuggcacacaccaugcaucccaaauucucuucuccaucaucucaagccaucacuucccagcagucaguccagacagaggcaagcaggccccacuccauaucagaagccuuugugaccccacacuccagcuaacccaauuagucacuccaacaagguucugccugacaaguauccccaaagcaggagucaggcagcauggaacaagcuccaagaagucaggaagaugacaguggcauccccagggccuaggacaguagcugccacugaggauguccaaaaccuguggacugagccuugaacaacagcaagccuucagcaggcaggauggggcaaggcacaucugaucaaagcagagcauggccagggcuucccagacugggcccacaagguggauuuccauggcacauaggcaugacucuguaaaacaacucucauauuugaaaaguuguucccagucaauuccccugcaguccuucugguugcaucaggaagaaaguuccagcgcggugcuaguaugucuuuaagccuucccuagaacuugaucauuucccuuucuaacacaugaauggagugggcgcuuuaucagcaacuuugacaaacaaugaaauccagcuagaauucuaggacacuguugugucuucaauauauuuauuuuuacaguuacuuucuguuuuggggacauguuagaugguuuucugcuuauagaaagguacaaaguuucuguuuuaaauuauuuuauuugagaccaaaaguuggcugauuuaaagagaaaaauaugaaagaaaauaucacaggcaguaugaguuuaagaccaaaaaaauguaaaaaucaugcaggugguagaugguucuacaugaauaugacacaaaccgggccucugacuucugugagcauaagaaccaaggcaaagaaguguaaggagcagguuccaggaggaaaggggcaggucaugacaagagcuggggcccaggggaugugguggcagaagaugggucuagaaagguaaggucaggcagggcauggagagcccgaugcugaggggagguguugggcuuucgccugugacugugagauccaccagaggccuccagccugacuggcuagugggaggggccccauccccaaaacugggcuggucucggggaagagggaagauaagccggggugugugaacucugaggcagagaagccaaggaaguggcuggagcugccucagcucugcugaccacagugaggccgugagaaaguaccugcccuccccucaggaggaugugccuuaucacaaaauccuauacccuccggaggugcccuccaauacggugaauggaacaaagucugguacaagacaguuagccuggaaaacagguguuagccugugcggucuuccaugauaaagucacuuaucaccauauauggcaagaaaacuuccagggaaaaggagagggagaaaaaaaaagauuggaauaggcuuaaagaaaaaaagaaaaaaauaccuaaagauagccuaaacaaagcaggcccagccccucaugcuggccccacugucugcuagccauauggugugugauaagccagaaugcuuuuauuuaucuucuuugauuuguccauaaagccgagagccagcuccacugagaaagcuccacuugcaguagagacugcauccugcucuugaccccugaccaacaccccccaggccccaguuccugcuccaggagguggcccggcugccacuccccuuccccucauccuugcuuccugccucagcuuccauagcuguguucccacagccaguaagccggggcggugccugcugccuccucuguggacagcuagcuaggccauuagcacucauccuacgggugcacucugccauuugcccaguccucugcuacagcccagacaguaacugccagaaauaaacauucucaugguuauaaaguauggcuauaaaguaucagccaccuugaguguaccuuggcaacaauguugccucuugaaccauaaaggucucagagacaugugucuaucugguguauuucuccgcucccaccuccuugcaugagaaaauggccaagcaaccacuguauccaaaugacucuaggucccaauucacugaagcaggccugcucuuuugcucucccuagaaugaccaaaauaaucacgucaaggucugugcuggaucugcacucgagagcccugagcucagccuccaaacucuucuaaccaucaucucaaucucucuucuuggcagccagguuuugcuugagugaagaaaugccacuuguuggguagaggaagaucagcagaguugaaucugccaacaggaugccaaguuaaauuuaaauuucagauaaacagcaaaauguuuuuaguauaaguauaucccaugcaauauuugggacacacucauacuaaaaaauuauucauuggugaucugaaauucagauuuaauuaggaguucuauaguuuuauuugcuaagucuggcaacccuagauaucagaaaguagcaggaccaaccccuugcgcaacccugauccuucccaguaacccucagggccaccauagaaacagcccuuccucuggccugcacuucacuauugccacucuacguggcaucucauagccaguacccuugguaacuaggaacaaaggauaacuucucagccaaagcaagaagcugcaaagaaaccuaaaggaaagguuuugugaacagaccuagcaagaagaggcccgagagaagaugcccuguccccagcagguauaaaaacaccaaucacaggcauucaaaggccugacaguguuugcauacgagccuguacugcgcagccucacaccccaccaaaggcaccaacaagccaauguaaucuaagacugacggggcggggcuguauggcuuaacaggcacaggagcagcuuuauaaauggccagcaucccaagcccucaggcagcuggucugggcaggccccugcaggaguccuggcagaagacacagcccagccccacugagaagcaucugaggggcauggacucaugggcucugggccauggguguguggggcaucucucuauacacagcccugaagcaucuagaagcagcuguuauucuucugcucuggcacuaacaggaggacacuucaucucuaaucugcagacuuuucaaacuaucagucagaaauccaguggcuaauaaacaauauuggguugagcuauaugaaauuuccauuuuuguaagucaaaaagaauauuggcaauuauauacagcccaaccaaauaauaauaauuugguugcuuucuauuuaucagacaccauucaagguccuuuaaguaaauucauuguguaauguuuaauccugaugaccaccuuucaagguaaggacuacuguguccauuuuagagaugcagagacugagacagggagaggucacaauuauguguccagcuggauacacacuggaucuaugugucuccaaaacccaugcucauuccacccaccauguggccuggauuaagugcauucuuccaccuccuccgcucucugacccugcccaugggucagugucuggccauuccugcagcaucaggcacugccaggucuuccacccugccagcgccugcugcaagggccacucuguagcuaaucaaagccuggccuccugaauuagcagcaaaguguauuuaacaaacaauuucaagaggagaaaaacauuugcaaguuuauuuagagugcgaggggaaagguugccaaaaaaugcauccuaaaauaaauagaaaguagucaagggggaagaaucuaguccaaccaguuuuaaaaugccuuaacugugaccaugagcuaauuuguaguagaccacugagaaaggcaucaggugcagugugauccagcaucacugcagacccagaggcacaugcuuccaaggcucuccucugaaaaggcuaccaagccucauagaggggagaggaugagaaaccucucaaaagaacaagucaaagccagggaccaucacuggucuccuagaccaccacgaccccccuuaaaggcugaaaucaacacaguaagauaaauaaaagggcugucagaggccaacuuuaaaagaaaagaagaaauggauaugcuccucccugugaaauaaaauuuuggaagagcacacauaauacauaauaaaaauaguuuccaccagcuccaagugaacaucugcagagaucaaaguuugaggauaaaaaggaggagaggacugaccuucacaugggccacauagugacgacacgucuccuccauguaagucagcugcagcuucucugugaccugacccauggucucucccagcagcacaaaguagacccugggcaucuggcccuucuccuuuuuggccacgucagccaucagaacauaauucaggccugccaauaaaugagaggucaaaaugucagaaaggaccgacacacugugaugaggccaccucuuuuccuugucacaggaucacaugcacaucucauaugauaccuacccuuccauggcaggagacugcagccccaagcagagacuugcucagaaagcagcacacagccagggugcucaaagaaucgagagagaagcaugauguccucugccuuucuaaugacucuccuugugucauacuucacggcucucccugauuuaaaccucaugccaucaugagguaucaacugagccagcaauaugcccauuaacaagguguacccaacacagguuaguguccugacaagcaaaacaucaugacaaaccuacagaacauuaccagaagcugcugaaauuaucaaggcuuuguguaauacugacuucuauaaagcacaugguuuaugcccaacacaagggaaccaucucgucugauaauuuuaacucaucucaacaaaguugagucgugcucuauaaucaguacauggaccagaccaugugcccgccaucguuuacugagcacuaacuauaggccaggcaccgcuaaagguagaggggauguaucaaugaacaacgcaggcauaaacuccugccuucagguaguuuacaugcacaggaacccagaugaaggcuggaguugccuuuauucccagguagccgaguguggugaucaaacauuuuguagugccuauccuuucaacaaaacuaugaccacgguagggccuguacugagguccucuccugcaaagaauaacucacccccauaccugaauguguaugccagauggcagaacuuuuguaacacagucuugaauuuaaaaaaaagaagaaagaaagaaggaaaaaaaagaugaucacaguaucaaaugcaggcuagauaaaccuggaaggaucuaccucuguuauuucagagucaauaaguaaauagauagguauguauuucauuauagaaauaugacuucagugucaauacaccuauuuuacugcuuuucugugccagaggucauccccuccguaacccuuuuuauuuuuuaacuguuuuggggauucaaggaaauauguuauuuuuaaagugagagaacaggaaucucugucccuggaaugacaaggcaagauggcuaagcaacagaaggcagaugacccagcccugcccugucuccacacaccugccucuuagaaucugggggcuuugcaucaguaacaaguagccccgagcccacuggcauuuaaguaagugaagucaggcauuagggaaggcuccggcuuuuaaugacaucaaugggaucagccaccaggggagguaugaacaggcagagaggaaggugaccugaaugggcauucugcaccugccacagggcguauuuuugaugcuucuaauggccucccugggccucugccaucucagggaucuugccaugccgagcuggcaaauuccuagucagcagagccaucugccccaacuuguuuaacgccagcaaacaguugacuuacaaggcaaggcugugucaccagaagggaucugagaccuggaaacucucaggaggugccauuauuaagaagaaaauaaugcauacaggaaagugcucccacacagaaaacacuggcaccugugcaagugucacacaccaacuccaauggggacaauagcaagaaaaggguagauucagacuggcaaagcuuugaggcaauccuggagaccacuaagcucaaaaaccuucauuuuuuaagaugagggaacugaggccccaaaagggaacaagacuugcuccaggccagagggccacccaucaaacagcugaaucuaggacucccuuaaucucuggugccaggcuauucccaccacacuuguucuugcugcauguuguacauuacuugaccaaaaccucccauuuuuuugaaugcauggauagcagguccaaacaagugcagagaucuacaacugaacucuagccaauuuacuuucuacugaucacaacuucccugaacaacugcccugaaguaagaaagauuacauuuaaaugaagugaauuuccaaguucgcuuaagcaaagucauggcuacagauacacauugcuggaagacaagccagaggccacaguugggugaaccaaugugguggaggcagcugcugagcagacucuccucgggguccccugaccagccuccuucccaggugaauggcugccuucccucaggaagggagacaauggagagaacagcgagacuggacuaucuuaccagagaugaacuagcugagcucagagaaaaccuggguggaaaggaacacaggaagauggaacugaugguauugcucccccacccauauccucuuggcuuuuaccauuucucugcuguccggcccaaauugcaacugccaguaccugcaucucuucuccugagggcuuucucuaguggcucuguccaugugccuggcaagccaggagugccagggaacucaaguccccagagcagcccuccauaaugcagggccccagcucccuugccccuugaugugggguaauucuggggcacggucuacacugacugccaggguuccccagcaggacugagcuccagcugcccacagugguaaccugcucaauaagacacccucuauuuggcugcucugauggcuaauuuuaugugucaacuuggcugggccacaguacccagaaucuggucaagcaccaaucuagaugucacugagaagguauuuuuuuauauuagauuaacauuuaaaucaguagacuuugaauaaagcagauuacccuccaaaaugugggcaagccucaucuguugaagguuuuaagagaaaaagacuaagguucccaaaaaaauaaacugcuuuuagacugcuuucagacuugagcugcaacaucaacucuucccugagucuccagccuacuggccugcccccaagaauucagacuucccagaccucauaaucucacaacccaauuccugaaaaucaaccaacuaauccauuucuuucucucuccauucuguuucucuggagaagccugaggccugcaacugccuuccuuuccugucucacugucccauuuccuuacugguaccucuugggaucauuuguguaucaaccacaugcacucagauccuugacccaggcucuguuuuggggagaacccauauuaacacaggguaaguaaggaaaagcaaauaaauucaaccugcaacgugugccaagcacugugcuagauaauuuacaaacaccaacuuuacuccuccaaaguuucaucucacugcagaaguacugauccggaaguacugaucucuugcaacucaaggaagagagaaacaacccacaguucacagaaacugagcugaggacaaggcaacugcugcuccucuccagcggggugugugcaugccagcacauuaaacuuucagauuucucuaaaauguuaaaacauacaaucacagacauaccgcauuauccaauucaccaagugcaaucauucuggaagcauuucaucucuagaacugccuaauuaguacuuuuccuugauuuaaauuuugacauuuuaaauuaccccaaaggaaauuacuucuacaucagacugucuccucuagaagaaagcaagagucacaacgagagacccugccugaggaggcaagaagaaaugcugaccacucauuccaaagcccugagcggaacuggcaguuuuaccagcacccacugguaaagggucugguggaaagggaagcagaggacaugucugggaagcagccgaucagcugcccgggcuccgcggucagggcccugggaagguggguggaucaggcuguccaaguugcccacagccggccaugagguaagccagccuggccagccccugucugucccugggaggcugcuaguucugauuagggccugcuccaacagcacauuucacaucuuuagguuuuuccuucuggcagcuugugucccugccaugucgaaugaugucauggugauggaaaagcugaucagccccgaguaauacuuucagccaccucccugcccugcccccggcugcuucccgaggagccccccugcacgggccugggccaggagggagccagcugucucucaucaacucuagcucuggucucucccagcaaguuuugauuaauuccugcucuccgucagaacaagauuucagcugugaaauucuaacaaauucuccuucccgaguuucaggcuaaccauggaaacacaggagcacugggucagagugcaaaaugcaaucacucagagagcgccccuuccugguuuucguuucacacucuggugaaagcccagaacugccagcuugauucccagccuccagagauugacaagcaaguuuaggcuucagccuggccagugaguagguacaagcaccguccacgggugaggggcaggguccccuugggcaaagcauucaccaccuucaccuaugcuagccaggaggcuccaaggggccacaggcuguucccaggccaagaaugaagugaugaauaauacuauuagggacaggaagaacuccuauuuuaaagugcuuuaugaaauacguuguaaaccugcuccuggaggagcccacagucggagugagaagucugugucugucugugucccagugcuaagcacagugcaugccacacaaggggcccggagcucaucuagaaaagccagcaagagagcagcugguuguuuuugucccgucugccugccccccucccacuagaaugccagcuccaugagggcaaggacuuugccuguccugcucacugcuccgugccccaggauaagcagggugucuggcacucuguaggaccuuaauuauuauuguuugauugaaugacccaacagggauucagcaacucaauguaacuggaugcuugcugugcugguuuaugaagcuguuguccucagcuccaacccacccuucucuacccugcacugugacacuggagcugggacccugcaaaccucacuuguuuugccagaggcuugcugugaggcucugcuaauauggagcaucggagggagccugcaaggcuggagagggcaaaggaacucgcuccuuccucccugcuuccuauuccuagcagcuuaucccagcaacaguuucucacggcagcuggccccaacagcaguuaauuguaguuuucaauuuuccccccauucucccagagccagccucauugcacucccucagagagaucagcagcaccagcccccuccucagagguucagguccuagcuccgcagggccccuucuccaagcucauagguucugauaaccccaaggaagugguuaacccgaaguauaaccuugaacagugguucucaaauugaacccaucuggaggcuuguaaaaacacagaugugggucccaccuucagaguuucuagucagaauuugcauaucuaaugagaucccaggugaugcuaaugcagcuggucugggaccacacuuugagauccacuggugcagaccuggaggcggcagcugcuuccugcaguuacucccaggucguccaugaccuguuuaacccauucccagugcuaaauuuccucuguuaaaauaacugguaugguuuuuguuuuccugacuggacucugccuguuucagaggccaaggcagauucaccuccuacagagaaagucuguauuuccuacaguauuuacagaggcuacagcagcuugugucccgcuaaugagcugguccugaacacucccaugaccaaguaggcacuguggucucccauuucuaaagcaggaaauaaagaggcaguuggugucccuucucuguacauaggcuugaacccugccagguagagaagaagaaaccaaaggcacaagacuaacaucagcugcuuauggcucucaaaaccauccucagagagcaggucauguagcugaagacagcagcagauaaauaccacagaagauaccacuucugacagcaguaccuagcccaccacagguaucuguguauugcucugcccaaaugcagccguccugcuaacaaacucagcccaagauaugcagacauugagaggugccuggaaggccugcccagggcuggcacucauucaccaggcauuccauggacaaagucaucauccacaugguuccucugcagcugccagcacaaagaguaggaaggcugguaacccagugucucagcuguggguuccugaggcagaggccuggagaugacagaguuggccagcacccucugcugagcuuggauggaaguggaggguaucuguguccuggaagugcccaucuuuccuccaucugaagacugaccuuccaaacugugcagagccaagaggcugccuuccuugcugaauucuaggacaccucacccagagcugggcccccacaguuaccugaccuuucaccuccaccucauuuccuaucacauuuccauaaggccugcccauuuuucccuccccaaacucuccauuucacugccagcacauuuucuggcagauuucuacauuucucuuucuacugcaaagauugagauaugaaugccagagaaagugacagaaacaugcuggggaugaauaauuuucugcauugccuuauuauauugagauaucaaaauucuccaguuaccauccccuuuaagccugauuaucggggaaacacacccuuagaguguaaagggauguuugacuuuaucuaugaacccauguggcagauggaggauagggaagagaaauuaaugggaggguacacuggugcugaaugggccccaccuaaugucagauauaagccagguugcuucgcauugcccacaagguacaguacaagaugccauccaacugccagccucuuccacuuuaccccaacacuucuggggcuauggcuaagccuagaccuucauucuaauuaugcuuagcagucugugaaaggcucaugcuagauggggccccagaaagagccacuggucgggaacagcaugaggaggcacccacaucuccucugcgcucagcucaugaaccuucaaaucagaguuugcucuaccacuugucucaugcucugaaucacucuugcucuaacuugcaucuugguuucuucuucucugcuucagcuaugccaauuuaccuucacuuucacaacagcgauaagugaacguugucuaacacugcuucaaggccaaaauaguagaaacucuuuguaacucccuuuagaagcuccaugagggcaggacuauaucuccagugccuggcacauguggauacauaauaagcaugugucaaaugaacauacacagaaacuauuacucguuugcccuuuuugagaguucuagaauaguucucauucuuauguguaucaaaauuaaucuucauucuuuaaaaauguuuuuuaacagaguccaacuacgugaugagcuggcacuggacagaagacagacugcuuaauuauguggaggacacacgagucccagaacuaucagaaagcuuuuuuccuuaagacuguaguaucuuaaacaauuauggagguggugagaaauaguuguuagaaagcaaaacuaaguaucauaagauccaaauucaacuccuggcuucaacaauaucugugugaucuugagugagcugcucuuucucauugagcugcacaagaaaauguuguuaauccucccucacuaaccaguucccaaguuuuaugguaugguuucauucaauguugaaauuucuaagcucuuuuuaaaaaaugauaaaauaaauauguuuaauaguugagcuuauucaauauaccugaagaucaagagaaauugccaaugagacagccaagaaggaugaacauauuaaauaagguagaacauuugagguguggcugaggaaugaacuagcucacguaaauauuucugcaugagugggcgugugugcacacaugugugcuccacagcagugcuucucaaacuuaaaugugcacaggaaucuuguggggcucuugugaaaaugaagauucugauucagaaguccaaagcggagcccaaaguccugcauuucuaacaaguucccagugaugcugacaaugcuaggccaggggcuacacugugaguagcaaaaggagucacucaugacauuaaaaauaucuaagaacgucaguagguucaggucccuguuaguguuuuuguuugccuggaguuuuucuuucuauuauuaaaucagccuuuuaaauaaaaaugaagcaccuaguaauaugcauaaagcuccagauucauuuccuucaggugaucacgugcucugaauuccaaucaacacugguucuaucuuguucugggguuuaauccagucucuagagcugggcuagcaaguugauuuuccccagccagaaaaauggcagggacaguuaccagcugucaggacaaugccugccucuuuucaauucugagcugccaaagcagcaccccucuuuuagaaaccuaagccucuguaacaccagcauccgaaucccaccauccaucuuuggucuccaauuccauaguaaaugguauaaguccccugacaucuggcugaugcuacaagcucaauaaggagccuccaaaguccugucacuucugcuuucuaacugcucgaauguucccuaagggccaggcuccgggcacuauaucuccaccagucccauaggaccugugguccaaugaggcuucagucuagcccucauauuugcaaaaagaaugcuugggguccaacauuauuuguccuagagcuggagguugugugacauuagaaacauguugauaagcaggaaauagaaggggaggaaccucagagggaaaggauguccagccugugugccugcugccugcaaaaccagcugggaggaacagcgacagggaacaucggaaauaucccacuagcccacuccagcuaaacggguauccugagcccugacuugguggcucauuaccaaucucuccuggaacguguuugccauggaagcugaagcagguggugacguucaggcaguucacaggcugcuguccgucgugacacugaggcgcugugauguugauggagcccgggaggaagauggagacauccaccguaaugacaggccuugcucugcagggcaagagaggaaggugacuuagucgugguaaggagcagcucucagaaccaaacaagaacuagaccaacaggauaaauccuaggccuucaacccagcauuuaauuaaagcaugaaauaucccaagagagaagggcuaguauguucugugagcauuuuuuucugguuuuagaaggggcauauugccuaguaaauuaauaguuagcgucccaauaauaaaagcaaguuuguuguuaauaaaacgcaucugguugaagccauaaaugaaccaccagaugcuggguaauuauuuaaaauuuuaccaauuaaguaccaauuuccauuuuauuagggagauaagaauacauuuaagaggauuuccuauagcagaugccaugauucaagaaauagaugcauacucagggauucccucaagcauuugcugccauuaugagcaugaacugcaauguuguagccccaugcaguuggucaaaccuccugcaucauuuaccuccaccaauucauuggguaauuuccuaaaagaacuugauaaguggagucccagcugguaauagcaaagugcuucagggcagaagaaaucaaccugcccagucuuaugaccaaaugaaacucaauaaauagccauacucuccucccugccauggaccaucucccagugcuugaugaauggacagcaccugugggcuccccaaggacaucccacaaaaacaaagaguaaaucacaccauucugcucccacugcagacaucugcucaggcagcauucaccuaagcuaccgcucaaccuucuccccuccaggccucacaaagagacccuuuuaccucuaaggagcccuggccuucacaccacuggggugacauaacaagauuaaggggcauuaguagcuugagaacaaugaugccccuguguacaaugaucccucaaagagagcccagggugauagggcggaugggaaugaugacccacaccaacuccaauggaagaaagcguuaaggaaaaucugggugaacaaaggaagugaagagacacgaggcacagauagggugaggggacuccacugcugccaccaugcugggagauggggucaacagagaguagugauaacagaggcaguggaacugcgggacuuccagagcaaaucuggccacaggacaaacggaagucagacaauagcagugccugaaagaaggccaacaccuuagucuuuccauuuucuucuggguucauccuuauaggauacuagaaauaaaucggaaaguggaucucuuaccccuggccagugugauugugcagaugccaauggacacccuauaaaaccccgucgaccuuucaacagccagcucaaauguucccacccugaggaagccuucucuaguaccccugacaggcauccucccucucugugcuuccagcucuguacacacaccucuggcccccacuuacuaaggugaacagucauugucuauuuccaaaccugccccaccauccugcagcacccugcaagggcugggauccggugaauucauccucucguucccauaauaaaugugcaaacacccuuguuaaauaaguacaaauuuuacuccagccuaggagacugaaaaccacgaguguccaaagccucacagauggacagaaguaccaugaagagcuggucuccaccuugccuggucccugacgcgccuggucaugguacagaagaaaagccuagcccgccccaucauccccaggggccaccucgucagggaggaggccgaauccuccucucacaaaagagcucugcagaagacagugcggcaggcaggaaacagacgugggcagcccagacacagugaccucaguggaaguuggaaaaacaguauccuuugaaauggaccacagggaccuucacagguacaucuccuucccacagcugucggaucaguucccuucaaccuuuuuguuucaacuccaaguauuguuuuuggaugaagaaaagcccagaaaucuuucagaggccucucugaucgcuuccugugaccuucaaugggagagcaccgugugccuaucacccugacacaggaccugccccggagcuaaucugagggaagcaaacuuccugagggcagagcgggccagccacacuccugggggcaggggagacugugucucacaguccugccuacaaaugugccagccucugagauaaaagcaaaggagcacccaaggacagcaccacaagcgcuuucagugcuuuuuuuuucuuaagaagcugguagcggccgggcgcgguggcucacgccuguaaucccagcacuuugggaggcugaggcggguggaucacaaggucaggagaucgagaccauacuggcuaacacggugaaacccugucucuacuaaaaauacaaaaaauuagcugggugugguggcgggcaccuguagucccagcuacuugggaggcugaggcagaagaaugacgugaacccgggaggcagagcuugcagugagccaagaucgcgccacugcacuccagccuuggugacagcgggagacuccgucucaaaaaaaaaaaaaaaaaaaaaaaaaaaaaaaaaaaaaaaaaaaaaaaaaaaaccugguagcuggaacacuucucccugagggcugacaguucaaauccugucacuucacuucaagguaaauaauacaaccaguugggaugcccuuugacauguugcucaaggugccuuggccuucugcaaggcaaggacagauaaagagccuucaccccuggugccacuggugccauuguuagguuacuaagccagcccuggggccaccuaucuccagggagcuaauuugaggucauauaguugaaagccucagccagguuuucucuuagcugcagcccauagcauuccuaacccacauaccucuggccuccugcccuuaggaggguuaggaacgaugggcaauauauaucuaugugugcuugcacaugcguggucuccuagcccucccugcuuuucuagucccacccaaaaccuaaaguaacucaaaaucuaacaucaguuaggccaggcugagccaagccccuacuuaacauagccagcugaugccuccaggccuucacugcugcucagcugaauccugggacuuuaucaacggcugccccugcagacauccagccugcuggccccucagacaugcucagcaaccccuuugccugccccaccuugcuuccucucuuaggggcuccagccugucuuugaagccuucccugcucucccugauucccuuguccuccuggaauagaccaggguggucacccucugcuucauccucauccacaucccaaacugaaccucgcccugaccuuauuccuaucuuggggccuggcucagaagaugagagccccucgcccccagcccauguaccggaacugaaccuugcucugaccuuauuccuaucuuggggccuggcucagaagaugagggccccucgcccccagcccauguaccagauuccaucacucucaccaaccucauccccccaucccucaucucuggagcagccucccauccucccucuugucucuucaaccucuccaggacccuuggguguaggcacaggguuagggcaucaggguucacauagaugagggugaagcugagggugaccaccucugaucucuuccaagaggguaagggacuugggagaccagaaaauggcucaaagacguucuuggccuaaucacugaucuagagcuucccguccuuaaaacaccucccugaacuaccugcuggucccauuugcuccuuugcagccaagcuucuggagaagcagucaagagucacuguccuucuuguuucuucucucacccacccacugccaucuggcuuuugccccaucacuucucuagagccaccacagccaagggcaccccugaccucccccugccaccuccaacaagucucaggccucacucugcuuggcccuuccugcugacuuugacaccacugccugaccaaguaacccugccuuagaauccucacagcaccuaccaccaucuggaaucaccuucccuuuuauauuaauaagaucugcauguccuuggucuccucacccauaaaauggggauaacagccccacuuaugucauggauuguuaagaagacuaagaguugucauguguucugucaacaagaggauggaugaacaaacucaaggauauucagucaauggagugcuacucaguaaggggaaaaacaagcaacacaccaacaugaacgaaucucaaaugcaucacacugauuaaaagaggccagaaacaagaguccauacuguauauucccaccaaugugaaauucuagaaugggcaagauggaucuauggugauagaagucagaacagugguugucuaucaggagagggguaugaccagccagaggcacaaggaaacucucuggggugacagaaguauucuuuauugugguggggugguagucacacagcguaugcaguggucaaaacucauggagucauacucucaaauuggugcauuuuauugcaugcaaauucuaccuuaauacagaaagaaaacaauaacaaagaaugaacacaaaugaagugcucacacugugccaggcaugcgguaggagcuuaccaaacauugguugcauuauuauucacuugcauauggcucucuggcuauaaucuaaggucacaggcuaggucagguuucccaucaaauccccaggaucugaugcauggcugcaucucaacaggucaaugcaccuuagcugaaugaauaagauaauggauuauugugaccacaacauccuugcaugcuacucuacagcugucauggcccgaccacucuucuugggccuuccaugcucuuauucagggcagggcuccccaggcuccucuccuaggucucuucucuugauaugugcucucccuggaguucuucuugaagaacuuuacauuugucccuguugagcuccaacucaccagauucaacccuccauccuaggcuggagucuggggucucccacccauuguguaacugccucgcuuuacuuuacauccauaugugagcaaacuccuggagaaggcugucccucaccaugaagaagagaaaaagaaaauacccuuuggauuaagcucacagcaggaagauuaaaaaauacaagaaugaugagaaagcagagucuauaugauggaccuucagccagauggccccgguuuuaagagggccuguugggucaggcgcaauggcucacgccuguaaucccagcacuuugggaggcugaggugggcagaucacgaggucaggaguucgagaccagccugaucaacauggugaaaccugucucuacuaaaaauauuaaaaaauuagccaggugugguggugugcaccugugaucccagcugcucaggaggcugaggcaggagaaucacuugaacccaggaggcggagguuguggugagcugagaucacaccauugcacuccagcccgggugacagagcaagacuccaucucaaaaaaagaaaagaagaaaaaaaaaaagccuguuuucaacuguaaaaguugaggaguguguuuuauuugagaagaauccugacaaaccaaaguaagaugcucaggauaaugaagagagcaaagaugacaucaugaaagcaccaacuagagcaaccagauucacaaaucuaaccucaaucauuuggagccacaaaagcuguuuuauccagaggaagcgcugauaaagaaagugaaaauccagucacaugggaaauaauuacaggaaccagggaggccuuaucuuagugaagucaccacuugggggacacaauugcccccuucagauacuaaaggguugcuauauaaaagacacaagacugagaagcagaauuuuagggaggcaaauuuaacccaauuuacaucaaacuugcuaagauuuauuaagcaguuaaaccaggcacuguucugaacauuuuacauguacugcagauaguccccgacuuauaaugguuuaacuuaugauuuuucaacuucacaacggugcaaaagccauaggaaugcagcacacuccuugacuuaccaugaggcuacaucuggauaaacccauccuaaguugaaacuaccauguuuugacuuagaauggauuuaucuggaaauaaccccauccuaagucaaggagcaucuguauugcuguccuggccaacagaggagaauccugaaacagaaaggucaggggacuugcccaggaaacucaccuaguaagggcagagucagggcuggaacccggccaccuggccccugaguucacauucaaccucaaggcucuucugccucuuuaauaauucaagauuuaauguuacccggggcaagcugguucccuuagaaguaacugggcucccacucauggggcaucucacucaaacaggaggcuguguagcccugcaguggagaccagcagaagguaccgcugaauaagaaggaucugggguguggaacuacauggccucugggaucccuuccagcucugagauccuauuagucuauuuuagaaaguucugccaucagguuauuaacaaaaccuaagaauuggcucccacuccaaaguguaauucugccuccucugacucauacagcuagaaauacuuggagaggguucacgggugguggcggcggcccacuggccuuugcaggagagaugcagacugcacgggccucagcaagcucugggccucagcucaugucccucaccucugcagccaacagggaaugacgugcugucuaacgggcaggaggcucccgguccccaggguguuguggacugacuggagguacaaaugcaggguguacagaugaagagacagaaugaacagugcuucccagcacccgcaggaaauuauaaaauauuuuuauggcacauuauggaagguucuuggccaaaagcaaauagcuuaagaguuaggcuuaagaguuaggcuaccccaaccccuaccuuaggcuuaagaguuaggcuaccccaaccccuaccuagaagcucccaggauguuaucaucucauaccugcaagccauucaaggccacagcuagaaacucugggauagagaauaauuagaaugagaaaauaagguagcauuuccacuuacuaagcaccuccagccuacaaggaacaggacagaggaaagagcccaugaauggugaauggcuccaucccucacccugaacagcacaauucaaggagcaagaguggggccucucaccugagaagaaccacgcugucggacaugaaggcuccaacagugacaucugaaaaugagaaguuuacagcguucagaaacuugcugaagcccauacacaaccgcgcccugggaaugcgcucacaaggauggagacccagccuugaggccggagagcccucagacgaccacugucugggcuauacaaugaucuuguaagaauggaagccacacucucugacguggcagccaaucccuacgcaggcuacuggggccuugaaauguggcuagucucagucgagaggugcugugaguguaaacuacacaccacauuucaaagaccuaguacagaaaaccauuaacuaccucacuaauaacuuucauauugauuauauguugaaaugauaauauguuggcuauauugggcuaaaaaaauuaauaaaauuaacuucaccuuuuuuaucauuuuauguaauuacaggaauauuuuagauuacacauauggcuuauacuucuuuucacaucagugaauuagagaaagacauaccuagaauucagugacucuuggaaaaugcucuagguucugaagaacauggaauugucacccuccaccccucacucuaugugaccugaguaucucaugguaucccugucuguaaaaugaagauaauuauccccagggccuucuucaaaagcugauaauauuucauuacauuuaaaucagaaaauauuuauuagucauuauauaauauucauuaaguacccacuagauuuauaguaaauauuuauuaaauauaugaaaucagauauuuaagucaguaaauucauggaaauacuugguaagcuauaaaccaagacccugguuuaacugguaauguuuauuccuaaauaacuuuaauuuaggaaguacuuacucuuccagugguucuaugccuuucucccuaccaccccaacccggccauauaaaucccuggcccugggguucccacuacuacuucacagaaccaaguaucugaguccaagagggucugaaucuguacaucacuaaaugcacugagcaucuauaugaugcccucauuagggaaaaacaaauggcaaauccaugaauuauaguguuccuaaaauuucuccacuuggguguuguaucaauuuuguucuucaauagucuuuaaauuugcuauauguuuaaaaauaaaagaaccugaugaauuugucaauuucccuuaugaaaaacacaagaucagaaauucagauccauugugaacugugaacaccuugcucaccucacauuuacagaaaaguagcugaaccacugggaagcauggauccccgugcacugcaggcucugggcagccccucacaaugagucucagcauccuuguuuauaaaguggggaaaacacccuauccuacuuaccugcuggggucacugcgagaugcacauugcauguggaagcauuuuguacauauuaaaugcuaaacccauauaagguauuauuuggggauggccacaaauuuuccagaacaagaacugcuuucucaaacuuaaaaaggcccacaagggucuuucuugggacaaaagcuucaacacugacuucuuucuauucccuuacuuccuccuggcucuguugucuugaggaauuuccaaaacuccuaucuguacaaaaauacacaaugugguguccucauacaagacugcguuaguuuucuuaaauuuuaguggaaagaaauauuucucaaaagcaagaugacuauaaaauuuagagaaauguuuccugaauuccaugaccauucuggauuuuuucaaauucuuacuguuguuuccuuaccuuaccccacuccaucuugaaacaccugaagaaccacuacuccaccacccaggcaauuugaccuaggccagauaucacuugggguuggguuugaaaucauguaucuuuauccaguuagccacaaccaccacaggcaauaauuaacucuaaagccaagccagccagcauugaauggugaaggucugcuuuguccacacgcaagaggacuugguuuucuuuuaacuccaaaucuuucuccaucauuuuauuucaagaguaggggcagggggcggugggggugcugcucuuuuucccucucaagaguaagaagccuuugaaugugguuaaauacaaaggaaaacaugagguuucacuauucaaccauuuuagauguggccagugcuuuuuuucuucauuagaauuaccgccccagaaaccacuacacaaauccacccuccuggugcuaagccauucagaguagaucaguuuaaaaccccaaaauaaauaucaacauuauuuucaccuuaaaauugaacaccaggcaaaacacccuauucuauugugugaauuguccuaauccuaaauggaugugaugauugcuaaccagacugaaaauuauucuacuucaugcauuuaucuucauuuaucucaugugccuuuaaagaaaaacagcuuaccaggauagccauuuccauccauaucaaugccucccgauauggacugaccaaacauccggagcacuggauuuaucuucugcccagacaguuucugaaacagauaauagggaaauggagucacaggaaaagaccacagucacaaauaagaacugugacugcuuuauuccagcuucccuaggacacuuggucuuaaaguuguugaaagaaaaaaaaaaaguaauccuaaugugaucagcaagucuuuagcaggcaguugaaggccacacacuccuuuauuauuacuugucuuggccaaacgucaucauuuaaaauuuuuucuaaguucuguguuaaugaaaaaaauccaccuagacuaccaugauaauguuuugacauguugaaauucaaaauggauaaaguuuaacuuccauuccuaaugcagguucuguuuguuuuuacacagguguagcuggcugaaauucuaagaacauauuuagcuuguaucuuucuucccaaauauguacuaaauauuuaacacucugcuccuaagaggcacacauuacagagucuuucccuagacagacagguaauuaacauguccagcuggaaaagauggccauguggaaacuaccucuccauccagccaaccagaugaucuauagauucuggagcuucacagacaggagugaacaguuuuacccaguaaaucuagaacuccaugguccugaacacuucuuaaacuguaggaaaucaaaagcacucagcugaagaagaugcccugcccuccccucuagaaaacagcccccucaaccaaccagaguucacaacuucaccaugggacacacuagcaucuaugcuuacuuuauauguuuuuuaaaaacaaaaaacuuucucuuuuuuuuuuuuuuaagagauagagucuugcucuguugcccaggcuagaaugcaauggcacaaucauagcacacugcagccucaaacuccugggcuuaagugauccucccgccuuagccucccaaguagcugggacuauaggcaugcuccaauauacccagcuguuuuacuuuuuuugucagacggggucucgccauguugcccaaggugguuucaaacuccaagccucaaacgauguuccugccucagccucccaaggaacugggauuacagccaccacuccuggcugugcucacuucuuauucaucauuaaguucaucacauauccacacaggcagcacugauucaacaauauuuauuguacaaacagccuuugucacacugaagcugcgcaucaacauucguguggcgcaguuccucacaaagauacugaacuucuugaaucagaaaagucccaucuucuggggucugaccuacuccuucugccuuuaucugcauggucccccaggggaggcucacuuccugauguccucacuguggaggacaagagaaaugcuuuguuuucaaaguacaauagaaccagguuuacagcuaucuaggggcucacuuugacuuucuuuccuuauccuucucuuucccgagucauccugcagagaagucacgaaggcaaggaggggggaguuuucacaggaucuacagauggaggcacgagagaugcccccugacccccagcagcugauaacugcaaauaacccuccuagaagugaucagagaaggcugcuugccauccuccguuaagccauccaacaggaaauguccaagcaccaaaguacaaaucagaacacuguaggaaacacugaagaaauguuucacacuaacaggcaaagcccuacaucccacauggcucugucuaaacaaacauguacgugugucugcacauuucuuaaaagccacguuuugaagcagacccucuuggcucugaaguccaagaacucuagcagcagccugccccuggaucuacauuucuaagguaugcuguggcugggacgaggggcagagcgaaggggugguccaucugggguggugaugcaggcuuaaguuaucccacagacaucugcaggccauuaugcuaaaagccaagaagauaagucugcccagugcuaauaacccuaaaugaaaaccaggagcccuggaaaccuccacuugaccagguuucuaugcaguguccccuccagcaagagaaggaucauaggggccgccauaugcccagagggcucucacauugggaaaggcacacaaggaucuuaaaauaaacacucuccgugguaaacucgagagagaguuaaagagcaauguggaagaaguguaggcccugaucucacaauuuacccagcagaaauaauacaaaucugggccaaagcaaagugauuccauugcccagaguuguuucugauuccuuccucuaguucacccacacaaugccugcucuguccaggaccugggccugcaagaaucugccauuaaagaauuuuuuuucuuuuaaaucucugcccuuaucauaugcauauuagcagcuugggaacguacagucauaguugcuucuuucuuuuuuuuuccuuaagagcccaaaaccacuucucuuugucaaagcaaaggagccagccugcgugcugacaaaggcaggcugguccagaugcuaucccugcuucccacuaaagacgcuccacgcuaaccacaagaguuauacugugguucucuacagggauuccacccagcaaccaaacaaaacacugggagggccccggaggaggggaagcuggggucucucacagguugccucacugugugauuagcuuccgagguccaggaaaacaagcuucccggaggaugcguggagaaugacccugaccgcugcccgagcacggggcuccuugggugacuuuuagcuugucacccugggaagagcaucccugccgcagccuagggcagcucuugugacucagauguggcccccaaacugugcccaaagcucucuuccuccugccuugugggcugaaucaccgaaguuuauuaaucuccuguuauguacuucuaaugaaaagaggauggucuggauagauaaaugccccucagacuauguaugccucauggcaaaauaguuuccauauucguaaguuuuccuacugaguuuccgagcguuccuuuuugcaauguggaguugaggauggugguuacgauaacaaguuucaggcagcagacuggcaaagauucuguggccauacugccacuuaugaccuugggcaaguuaaauaaccuccuugggccucguggauaaauaaaugguggauaauaaacagacccaucuuacauggcugcugcgaggauuaaagguaaagaaagggcagaguaggcacccaaaaaacagucccuccucuucgcagcgccucccaaagcccugucuccugcaggugaggcacugagcucagcaggaggccaguagagaggggaucugaggcacgaaugacaaccaaccaacccuccacccuuaacuaguuuaucucuaucugccaaggacaauuauucauguagaaguuguacuugcauuuaccugcugccucuuaaaauuaaaauacaaauacauaugaguaggaaguagucagcauguaguaaguguucaauaaauaaauauuuguugauuggaaauuucucaauguguguccccuucugucucugacccacugggagaaagaccagagccagugccacuccacaggcagacauccacaaauauccugacaaugcuucugcugagagcaugacuuccuuuuuucccaugggcugggcuugacaccaucagcaagauugaacaccaagcugauacggcaaaaaacagaacucaccacuuccauguucccaaguauagggcgcaagcgcagaguccuaacuggcuccugguuuugaggccagcugggacgacagucugugaucaguuucaggccccuccaccauggaccauuuuucuucuagauuauauauuaaaacauauuccuuugccuuagcauagacgguugacaaaguagucaccaaaaagagaaagcuuccuuuccuuucuuaaauaaauggcuccaacucugaguaagaguugaaaauuaucuucuuuaggcaaaaugcaucccugaguguuagcgaacuugggauucuaagaaugcuuuuuuuaguauuuaauaagcaauauuaauuguaucuuucacaaaaggguaggaaggccaaggcaagaaaaauguuuuucuuuguaccuccagggcauggugcauaaugaagguuccauacauguuugcugaaugaauguaugaacaguugccauaucacucucacacuaauuaccauugaguacugagggacuaucccaccggcaucaccaugauagauauagaccgccccugcgaagucauccuccuugggugcaccaauggccacaucugaggguaaaaaaacagcuauggguuaaaaagccacauuaauaauacaagugcagcuucccuaauucugguugucaugucugagucccuggauaccagaaauuauugguuguugauuguucaagcauuaauuuggggacaagaucccucagcgggaaaaaaaaaaaaaaaaaguaggccagugugguggcucacgccuguaaucccagcacuuuggcaggccaaggcgggcaggucgccugaggucaagaguuuaagaccagccuggccaacauagugaaaccccagcucuacuaaaaauacaaaaauuagcugggugugguggcacgcaccuguugucccagcuacucuggaggcugaggcaagagaaucacuugaacccgggaagcggagguugcagugagcugagauugugccacuggacuccagccugggaaacagagugagacuccaucucaaaaaaaaaaaaaaaaaaaaaaaaaaaaaaaguacagugaaaacuauagaagcugacugagaagaauuuaguuccaaaaaaguuucuaccuuaugcucguaagaaaaaccacugacccauccaauaaaagaaaugcaaauauaaacuacgugccauaauuuccaucagggagaauuccauagacaauggcuauuguguaacugagaaagucugagguccuggauaaaggaccauuccuuauuauuauuugauaauaaauccauuccuggauaaaggaaauauacagaagggcauucacuucacacacaagaaauaacauuacucucacaaacuggcaacuccuagaacaaaaccuagaucuuccuaacuuuuuucccuugcuucuaacaaagucaugugucugcagaagugaggccaagggggaggaaaaugaagcccacuguagccagugguaggagguaucaaagacgucuggauggcuggccugggcaaggguugccccaccuccaccaccacaugcccuggugacaugguugcucugccucccgacgucuguaugcuguguaugcagcgaggugaagaggcucaaacaagccagagagagaggccaagaggcugugaggaacacugcuguccaaacagaccuaggcauuagguacauaugccuccaugccucccaagacacacacacacacacacacacacacacgcguacacucucaaaagucaaucuagcugcugcuauaaucaggcagaagaugucuggguuucuaauucucuccucacucauuuccccaucaacaugguagagcaugauggagcaucaaaggcucagaaacaaggagaguugauggcaggaugaagcuauucaaacuucuugccauaagaagucccaaauggaccagccccaagguuugcuuccacugcaaacaacaaagaacacugagcuggugagaagggauuaugcagaggcaaaacuccagugggcuggaagcucagcccugcgugucuacagggagagcaccucuaaacguguccuaucuccccacagcacauugaugggccuucgaaggggaucaguagacccaggagcaugccacuagagauggacagucagcgagcaggcugccccucugaaacagagcagcgugcugcaccuggaggggcuccgugcaccaggagcacucacucaccugggaacccaucauuguccagaucguccaggcuggcaaugcucucuccaaagugcgcauuguaggcaccauccccagucagagccagcugcuccucgagggcucccugggaaacaggauggaggagaaaauggaaaacaaaacaaaaacaaacagaacaaacaauaaaaaucaauaaaaaaccagaguuugaaugcugcccugcuagagcacacucauugacaggaaacaccugggcagaauuacaggaacccaaacuucucucuccugcuggcaaaaugcgucccuuuuaccugcuuagcaggauggucucccauagccugagaugcauuuuugagggaaggagaaugucaugguagccaaugacuacacucucugccuuguccuaauacacuacacacaagcaaaccucccuacccaccuuucccccaugugcucuccacguccuuaaggcauagcacuuuuuccccaauguuguuuuaaaaggguauacauuuuucuauuuuuucuuuccugugccuuuugguacaaguuuauaaaacuguuuugcaaagugcauauaugaguuaucuugauagagggagucaugguucagaaaauccaagcacccagucguucuuggccagaggguggcugugauggcagacgucacugugccuauuauucaugcauggcucagguaugaauuuccugagaaaauacuaaccaacagagggaggggguuaaugguguacaaaggcaggaaaagucaucuaacuugggggaaaaagucauaccuacucucaccccaaaucacugacacaugaagaccagagugauacaaugcaaucugauguccugagacaugagaagauguaugcauuccccagugcagaggcagucugggcccacuauauccuacaggccaucccacgagugucuggcuuuuaucaugaccaagucuucuuuuucacuauaaacacaauuuacaccuugaaaacagucaaggugagaugauuucuuggaugaaugaaaccuccaccccaaaacacaaauaugcauuaauuucuuucuuucaguguaguggggaagaggagaggaacaccagcaacugauugcuccuauguaccagguacuguacagccagcuccucauucaaaucacacaaugacuccauaaggaagaucuuaugaugccucucacuuuacagaugaggaaauugggccaccaauuucaagccauuuguccacaucacacaggcuaggacauggcaaaaccaagauucaaacucagguccaccuugcuccaaagucagaauuuuuuccacuacuccacacugccuuccgaucuuuauucaaauggcugauguucaacagaaaugagaauacucugguacuuagaauaaccauacaacaucaagaaacacugguuggcaggggagggugugggugcaucaugcccaguggaggccugggggaguucuugugcuucaagaguccaccuucugauuuagacacacagucuggcuguuggaccugacuccuacacaaaugucucagucuccugcaaauacaauggcaggcaccacugaaugcccacagcacucauuuauuuaauguccccuucauuucucccugcacccugcccugacuuccuggaaugucaguggguaugcaggugccaagaguuccugcaacagguaccaauaagcaccuucccucccagauauuuuauuuuuuuuagagacagagucucauuguguagcccaggcuggagugcaguggugcaaucauagcucacuaccaccucaaacuccggugcucaagggauccucucgccucagccuccuaggcaaccaccacugcaccuugcuuguuggcuuguugacuaacugauugacaaggucucacucugucacccaggcuggaguacaguggcaugaucacggcucacugcagccuccaccuccugggcucaaacaauccucccaccucagccucagcugggaccacaggcaagcaccaccacaccaggcuaauuuuuuuguguguuuuuaguagagacaggguuucaccauguuggccaggcuggucuugaacuccuggcuucaagugauccucccaccugggccucccaaaccucccugguuuuagaucugacuuccugaagagccugaaaaccucagacgcaacauaaggcucuaacaaucccuggcucuccuuucacugcuuccuuccuuucuggcaucugcccacuuaguuauagcuaaaccucugcccucucccaacugggauaccuagcaucucagccacugcuuaacaguacacuucgauuuuuuuaaauaugaaauuauauucucacuauuuggauaaagauaaaacuaaacaucuauccagagagcuguuauucacauuuucuauguauuuggcauauuucugaggacugguuguacaugcaguuuucaucccauuuuuccacugauuaucuccauaagcguuuucucauguuagagaaaagguaggcggcaccagaauguuuucauugaaccauguuguucuugcugaauacuuguacuugaacacuuguacuuccagauccugaaaagacugcuuucucacuggucuccugcuuccacgaugcacugcugucccccaacccagcccccacucacccacccuccauuagcuacagagggccagaggcaucuuucuguccaugucacgucccuuucaugguucugcagaauaggggacaccaagauuauuggccaggcgugguggcucacgucuguaauccuagggaggccaaguagggcagaucacuugaaaucaggaguuugagaccagccuggccaacauggugaaaccccaucucuacuaaaaacacacaaaaaauuagccgggugugguggcaagugccuguaaucccaguuacuggggaggcugaggcaggagaagaguuugaacccaggaggcagagguugcagugagccaagacugcgucacugcacuccagccugggugauggagugauacuuugccucaaaacaaacaaacgaacaaaaagauuaugguucccaugcaguccccugcccccccaugcugaaaugaguggugaugccaccucacaccccaacccacuugcccagcucugcacugggagcucugcuccagcccacccugccugucugcuaacuccuacuccuucuucaagauuccccagccauuguguccuccucugcuucccugggaaaaugugcauaugcucccagagagguggcauaaccuugagacaaagcaugccagcucuaaagccagcuugccuagguucaaaucccagccccacuucuuagcugugugguuugggacacauuaccuaaccucucugggccucaguuuuuccaccugaaaaaugggcacccuugauaccauguguauauugcauagaaaucucucgcagaaagcaggaagaagagucccugguacauaguaagcacucaaaagacaauuauuaagauucuuccuuggccccugggugucugcaguuguaacauuguauauaacuuuccauuaaugggccauugagcuuauucaagacagauaucacauauuuucaucuccucuggguaacauugcccccagugccggcccagaggggugcucggccacugcuggcuggacaaaugucccucccccacacccauccgcacauugcccaguauuguacucacauuuccucuguugauguagacagugaccugucccucaucccugaucucagaaaacaugggggcccccaccagcaggucagagaggccguccccauucaggucaacugcgcacaaggaggagccgaaguaagagcccaucugcaaccaaguugaguugcaacaaagcauucagugucugcucucacacaaggaugcccucgcuuuccuccaccccauuggcuuuagaaacaucccucagaggaauugaacaaugagaacacauggacacaggaaggggaacaucacacaccagggccugcugugggguugggggaggggggagggauaacauuaggagauauaccuaauguuaaaugacgaguuaauggguacagcacaucaauauggcacauguauacauauguaacaaaccugcacguugugcacauguacccuaaaacuuaauguauacuaaaaaauaaaaacauaaaaaaaaagaaacaucccucagaggcuggauggcuaugcugcccccuaaaccagaaugccuagcaaagagugaaauacccaacuuccagcagcaaggcagggccccagucaaugugagacaaagcuaacuggcccaaagucccccauuccuggaguccuaucaaggggaagauaaauagauugaugcccacagaaugaggugcuguuuuuaaaaaugcaagcugaggacacaaaguuauguuacaaccauaauaaaaaugcuccuuauaucagacauuugacaaggccaagcaaguaggaauaugaaaucucacaacacaagaaaggcaugaaaauaaauguuacauggggaaauagguuauucucuccugguccuaugcacaggugaaagauugguuaggaaggcaugagcugaagugacagaaaaagguacaacuuuuaagacuguuuaacugaugagggaacagagcaagauaauauugacuuuuaauuauagcuuaauuaggggucucaaacccaaauaccaacaggauccaggcaggugauauaacaggcauaagaaaaaaaauuaauguggcaagugacacuugucuuccuugucuacauaacaauagggagugguggagacuguggcaaacuggagcccacaagccuggcuaaaggagcagcuucaacccagcugcagcuaacugccaccaagaggaaugcugacccagagaggagcaaccuuuccauuuuccaaaagaagccaaaaauuuaaaacuuuauuuaaagugccaguguuuuaaaugcucgcaacuucuucguguguaaaaacaauaaacaaauacugugcaagccaaacaaaaguauuuguaggcuguauucuuuccaaaggcugucaguuugcaaccucuacuuuaaaaaaaaauaaaagaagaaggccgggcauggugacucacgccuguacucccagcacuuugggaggcggguggaucacaaggccaggaguucgagaccagccuggccaacauggugaaaccccaucucuacuaaaaauacaaaaauuagccaggcgugguggcaggcaccuguaaucccagcuacaagggaggcugaggcaggagaaucgcuugaaccugggagguggagguugcagugagccaagaucaugccacugcacucuagccugggcaacagagcaagacucugucaagaaagaaaagaaagaagaaagaaagaaagaaaagaaaagaaaagaaaagaaaagaaaagaaaagaaaagaaaagaaaagaaaagaaaagaaaagaaaagaaaagaaaagaaaagaaagaaggaaggaaggaaggaaggaaggaaggaaggaaggaaggaaggaaagaaagaaagaaagaaagaaagaaagaaagaaagaaagaaagaaagaaaagaaaagaaaagaaaagaaaagaaaagaaaagaaaagaaaagaaaagaaaagaaaagaaagagaaaaagcauuauucuuuuaaaauaaauguuuucuaauaaaaggccccuggguugauggacaugaacaagccuuuucuuuuacuguuggaguuuguuggcagcugacccagggaguuugagggagagagguagaggacacuccaaucuauuuccugcagcuaacagggucacaggagggcuuuguaguggccgcucagaaauccuuccccagugauaugccaaggccaucuuccuccccucugauuacccauucucaaaggagaacggagcaggaaaggguugaaaucacagagggugaggaggaaagaaaccgaguugccagucacuauuucaguggccuugccaaucuccccaucugagcuuugguaaaagaaaucaguaagacacaggcaaagacccaaagagccaagcugcuggcugcgcucacuggcugagccccaggggaacuauuuguuucauuccaaaggacuauuuaacuuggcaucuucaucaauguuaaauuagaaaucucuauaugugaaguuuccuaucucaguuuugaaauacaaaugcuucacauacuccguuaauucaauaaaacuucaauauggcaaugacaugcuuugggguguguguccgaugaucagagcuccccaucagccuggaaauguggagaugugugucuguauuaacaucugaacugcacacauguuggugauuucuuaaguguacuauuuggagaaagucaaccaauaaagacaagaaccagguuuuuuuuguuugguuuuguuuuuuuaaucuuuuugcuuuguuucuucuuauaggaagccaggauacagaacuaucugaccaaauucuagccaaacggaagcagaagugaaccggugguuugcugaguuagaacccuccugucuaugugacucuggacauagggauaaaucuaaaggcauccuuugaaagccuggggucauguccuuuuguaggagguaauggagaagucagaaagacaugaaugucucauuucuucuggcaagaaguagaauaaguuguauaaagaaaggucauggccuauuucaaaagcagaacgaugaugacaggguaaaucuaguuggagacacuaguagaaggaagugaaggcaagaggacugugagugaguggcagaaagaaggggugccuauggaauggugcaaagguuagggccagaagagcccuaaagaaaagaaaaagucaaauggcuacgaagccaagaaguugaauaccugggccuuucugucccuucucagggaaccugauguaucuugguaugauaaggacauccaagcagacauucaggccugaaccuguccuggaacucaauggcagaagucuucaggaaguuuagacaaguggguucucaaagguuaaucucauccuccuugcaccacccacucucagaucuacccccaaaaaccugaucaacuugagcauagguucucauccaaaccaagagguuuucaaggaggagagagggcacaauuacagauuguuaauuacucgaaggcaauaggaauuaaccggaccuccccagggcacagacaguaaggaguagggcagggaaggaaaagcaguuugggggggcacagcuacaacugaacauaaagauacucagaaacuccacaauucauuuuaaauaauccuuggccaggugcgguggcucaugccuaucaucccgcacucugggaggccaagguggguggaucccuugagcccaggagucugagaccagccugggcaacauggugaaaccccaucucuacaaaaaaaaauacaaaaauuugcugggcaugguggcacaugucugugguccgagcuaccugggaggcugagguaggaggauggcuugaguccaggaggcagauguuacagugaaccaagaucaugccauagugagacucugucucaaaaaaaaaaaaaaaaaggaauccuuuaccuuuaggcuuucaaacccagguacauuugaagggaagagggagauuguuuccaugcuagauacauucacccauuuguuaucuucugcagaagaucuaaaauguuagccuuaauuccacucauacccuacuugcucuuugaaacucucuuuuguaaaucacaaguagcacagaguuauuucuuuucuaacuuuaagggugcuuggaaaacccuuuugcagaauggcucacagucauuuuccagugcuguugcuuugggguuuuggaaauguuaaaauaacacaagccagcagaguucucgggaaggcagagccauucugaggaaaaaugcaaaaccaaguuuggugaugcauuuuuuauucaaaagauaaugacaauuauacacuaaguguaccuauucggauaguuaaaauugcaaaaaggucuacuugaaugggagaacaacauggaaggauccuaggcuggcguacagcaguucuaacucggcaggaacagaauugaggaggcacauggccuccucccaugucccagacauccuaugcuucuucccagaucccacuaaggccuccaccaagaccuccaaauuacccccacagcucccagccuaaacuugugucccuuagaguagccaagcucagccaaacaguccugcugaucuaagccacacaagaagugcaugacugauaagcucaugaaaacuguugcuuauuaauagcaggacucucuaauuggcuuaauuuuagacaacagggcaguauaauggaaacuuucagaaagcagagagaggauuagggacaggguggggaggacccaggcagaguaaucucacccaggcuaacuuuagggcagcacccugagcuauuucugcuucaagguucuaagaggaaucaggcaaccuguguuuggauuuucuuuguguggcaacagucaccuuggcaaugacaguugagggcugaggauuagggaaggggguaauguugggcuggugaaacaggcucagugagaagcauuuauugcuaccuguacucagaaagaucugcucucucuggagguggagauucguugagaaaggauggaggcagagagacagggcaugcagucacuuugaugacagucugaacuacggacaaucucuuaaaacucugugcuguaacuuggccccauauaacucaucuugcuacagaaugucuccuaaagcgaguaugaaucccaugaauguacagauuacacauaccgcugagaagguaaagacaccaacaagcagacagcacugccauauaaacacagggcacagguagggccuucaaaccaauuuucuaaaaaguacugacucccacaugaucacaucucucaaauaaaaaauagucacuuauaccaagaaccucaccuuuuuaccugaugcuugaaagaucuuaauuaaggugccugaucuucggucagcucugaaaauauaaaccuauggaaugaaaaaaaaaaaaucuaguuaggaugaaaucaaugaucaaagauauuuaucagcacucuccugggaguccuauuuaaaagcuuaagagccaggugcacagcagaugugcuuaugcuagcugaugaucaugaagaagucagcugucauuuuaccagcccugcaaaaaaaaggguccuucaauccugaggcagacaucaccuccacugcuccugaaccacaauacuuauaaaagccacacacaauaagacccaagaagcuuccaaauuacaaguaaacaauucaacucugagaaaaagcuaguauuuuguuucuugaaauauuuccuuuauuccuguuuuuaaaauuaguuggugguauggauuggacuuuauucccaguaagacuuuaccaggcauuacaacagaagauaaagggauagguggagaugaguacuguagacaaagcaguuucccaaagugauuucacguaauauuagagucaugugaucugccuggguaaaaaugaguuucauuugggaaauguggaguuaaacauuaaguaaauucuuugacuguggaacuuuuuagagccuuuagcauguucaugugaacuaugcaucgccacugcaaagacgaucacugacauuuaacuuccuaaauguacuugacuauggaaguucuuuuuuuuggauuacaucucgugggaagagugucucaugagaaccaguguaaauaaccuucccaugagauaaggaacugccaucuuagugugagugcuuuugugcccugacacuagaauauccagcaaaauccugaaggccagggguccuugggaaucaagucuguacuagccccaaucccugggaauguggaauugucagcaacuuugucacuaugaccaguuuccccaugccucucagguggucuaauugaaagaagcauuuuuauguacuuuauaaacuggguccaggagucccgcugucuggcucuaucaauuauaaguaccauucucaacuuuuuaacuuuauaccuugcaccccccagauagccagugagagggguuugcggaggggucaucuuaagacuugacagggacuaugaaguucaucacaaucaucugaaggaaaaacuauaaaacuggaucauguuuucugcaauuagggagaaaagaaagcugcuaucauuagcauagaggcacccgcaucacugugaacuagacguaggcauuuuuaccauuucuacagagaugcccgguagcccgcagccccuccccaagaagacaacaucaaugugaacagcucucagugcuucuuucucuacuuagauaaauucaugcaacucagaaagaaccaccucuuucuugaggugaucgaaggucaccugcuugaucccuccucccugccagcucagggcccugguuuaucugguuucaguuuugaagaaccucuuuccacagcaucaguguuagggaggagggaggcacaugcuccagaaacgugagcagcagcuccuaaccucugcccaggaggauccacagaaauuauccuuagucaagccuagucaacuggaaaguucgucagcucccugaucauccugaccuccuggcugaaggcuccaauuaccaguggucucagcucaucugggcuaauccagaauccagauuccacuucuccaagcccugggagauaugaccagacucuaucacaggucuaccccuaaagguccagauccaaaguucauuccucuguucacucagucuuucccaucagacaaccuauggagcuucuuaaaaauguggguuccugauccaucuguaccuacucaaucuggauuuccuguaccuucaugauaaagaaccaacaagcguaguucacaauucaggccccucagaggucauguuucccaaaggaauucaggcagcccuagauccaggggguggguuuuuuggcagauacuauaguuuagggaaagccagacccacauauuuccaguccagccuuugggcugaaccagucuugggaacccaauguuccuucucaaacacuggggaaauaaauacgagaauaauuuggggcaugaauaaagccucaaagauaucugagacuggaccuagcuccauuaaaucaaagccaaacuugggaaggguuugggauuugaaguuggacagcacuaaaugccauucuuuugaaggacaccauaaggccagggcucagucuuauaaauuacacacacacacauggucagcugugaaaaaccucagaugagagugugcaggaaaucgagagugugaguauacucacacucuaauugagcuuucaagggaaacuuuccaauggaguggggcagucaggggguuccucaucaccuccccaccagccacccaguagaauguucaggucaaugucagcuggcaaaccucugcaccagggacagcaugcuccccucuucugucugaccccagcuauuccacagauguuucuccucaccuugccgaugccuuuguccuguggggcaccuccuaccacaucaaugguggacgggugagagaaguggccagcggucacugcguagccugaacaggaugggcggaaaccaagcacacgguugaaaaagaagggaagggaaaaaaaaacauccaucagaggaaaauguuucucaagcaugcucccuacucuuggaacauaaacuaccaggaaaaaaauggcagcugucaaccuucucaugcugaaauggcucucaucucacaaaaagucauguucacaaggauaucagggcaggaaagagggcuuucugagugucuucuuucggacaaguacuguaugaaauacuauauaucuguuuucuucuuuucaaggcauaguuuucauacgguaaggucauauaucugacguguaaaacucaaugaaugcacacaugagcguagccaugcaaccaccacccagaucaaggaagugacuauaaccacagaaccauaaccccagaggguucccucaugcccuuucccagucaauaugccccacacagguagccacuauucugauuucuaucaccauauauuagguuugccuuuucuugaacuucacucaacauaacaucugugacauucauccacaucguugaguacaguaguaguuucuuuuuauuauugaguaauauccguuauauaaauaugucauauguuuauucuguugcugggcauuuagguuguuuccaggcugggguuaauaugaacaagguugcuaccaacauuuuuaugcaugucuuuagguaucucuuucagucuaaaaacuuuaugaagaaggcaugacuguuucuuccauuuuacagauacagaauuagaaaaaccuguuaaacaacaugccaaagaucacacagcaagacucaaaucuaaucugugccucuaaagccccugcuguuaaccacacucccuccuacaagaaggcaaaagaagcugucaguggguggguggguagaugcaugguuggguagauggauggguggaugggugggaggguggucagugaaaaaauauggaugcaaaaggaaccuagaaacaaaggaaaagauugccuaggcuuagccucaacgucuccugcuuucugagagccuugcuagcaggcugaaagcucuccucuggccagcauaaauccuguacaggcugccauauaauccccaaacuugucaucacccucuaacccuaaagugauuguaaguuguuugaguuucgcgaugacaucauaucaugaucaauucuuccucaccauguggcugauuucucucagacuggcgacugauaguaccuaagaguauucugagugagaucaaagccugaacggauccuugauaaucccugcagcugauaagagccucuaauguguauacaaagagaaaccacaggcucgaagcuucaaaggagcuguucuagaccccaaacccaucauccaaacugggcuuucuucugcucucucuucauucccugauucaauaaauauguguugaguuacuacuauacaccaggcacuauaccaaaugugagacacaaucccacauuuugucuucaaggugcucccagcccagugagaaguacaguaccagugauaggugcucucucagacgcacccacagggaaggcagcucagcauuuagacucugcacucagaaaccacaagcucauacccuaauuuugcuacuuaggagccaugugaccuuggcaagauguauaauuucuuugcuccucaguuuaucuauaaaauguagauaauaauagcuacuucauaagguuguuucagaaauuaaaaagaaauaauacauacagccuggcauaggguaaaugcuuaauaagcaacagcacuaggcagcugggugccuacaggagcaaacaccccagaguagaaggauuguugggucuaugcuaccaggcaaaaaacuuguaguuagaagggaaaaggcaagucaacgacucccuaaccccauuuaacaagaaguucccagugacgcuaugcaaaaagggagucagggccuuucccuguaaguuauguaucaugagugcgaaagagcauugugugucaucauuaggccuuccuaaauuuagcuucgcuuucaauccagaauuauagcauuuagggcauaaauuaaagaaaagagucuuguaauugucaucuacacaagcaaagacagccuaugucuguucuuaaauuggcauggaccuugucccagugucauucugccugauagcuacauuaaauugugucuaucuucuuuccagaagauuaaaagaguuaagaaagcaagagaaauuuuucugagccuuuaauuaaccuucagcauuagguugccaucugucaugauaauuucuaguucuuaucuuucuauuugcuaccaguuuugugaucagaaagcaaggacuccauccaaagggacgcccguggaaaaucaagacuccaucacacucauuucuaccugaccaucugaacuucaacaauugauaaaaugagaaaauaaaauguuuauuucccuggagguucaacugucagcuuuuuaauuaaagcauacaguuuuaauucaguucccuccuugguuuuccucucuaccuuguguuuguggagcuagaugugaagaugcccuggcuaaagauguaagucauuagaacaacaggcgucaaagccaacuaacuccucuuuccaacaaugaagcaauaauuugugaaucuggugggaaucacucccauuuccccuuucuuaccuguucucucccugaguacucacccagguagguguaccgccuguucaugaucacuucgucguucaguuuuaaauagguguuguccguaagguucagcacuuugaugguuccagcccaauaaaaugacccuggagcacccaucaccaccagcuccuaccaaaaagaaauccaacgguaagcagagaaggaagugaggaggggaggaggggaaugcaaugagaaccacagucacaacaaaggagaaauuccucacaccaagaacuuuuuuuuccccagcuaagcaacaaaaacagauuucaccagauucaucagcauuauggaaucuauuauacagacgggauuaucaggacuaaagaugugaagagacugagcaaggugacagaauucacgacaggccaggccccuauucuauccacgaugagaccacacacguuuccucaacuuuacaucaggcucuaacaaggaaaugacaaacagcugacauugaccucaaccacagauucuggggaacaccacucaugaaaagcaguaagcaauaccgcacccugccuggacuccaggcucaccauucaacucccccgaccugaugcguagcgagaggaaacugugcacuaguacuccagggaauccccuccagaccacacucaagacccucucagggacguucuagaacaugguuuuccgaucauuacaguccacugcaaacauggaagaacaaaaccaagagaccagcaaggucaacuaaggaaaaacacaaacuggaagaggggaccacaaggcagcaauagacgguaucacuguuaaaaacagacucaaggccgggcgcaguggcucaugccuguaaucccagcacuuugggaggccgaggcggguggaucacuugaggucaggaguuugaaaccagccuggccaacauggugaaacccugucucuacuaaaaauacaaaaauuagccagguguaguggcacaugccuguaaucccagcuacucaggaggcugaggcaggaaaaucgcuugaacccgggacgcagaggucucagugagccaagaccaugccacugcauuccagccugggugacauagcaagacucugccaaaaaaaaaaaaaaaaaaaaagacucaagaacauaagaggcacagcugucuucagcauuuagaucagggggaaauggucaacagggcugagagcauguuugugccccagaaccaucaccaaugcugacaacaacccuaaguucccagaaaugauuuggucacccaaggaagucagcacagauaucugcugggguuuuccccugggugauacgauaauggaaaucaaucaacauccccuguucucucacucccaaaguuuauuuccuuugcauuuuucaaaauucuagaccacacuguuuuccaagaguacagggcucagguaaaauucaacacuguccacuauuucaaccacauuaggcucuucuccugccacugcccccucagacugcaugccuaggacacucuaaacuaauucuggucuucggaacucccucugaucuuuuuaucuccaucugugcaaugcccucacacuuccucugcuuguguaacccuuucgcaguauucaaaacucaguugaaauaugggugaauccuagaccaaauguugaugagaaaaaaaugacuccauucauaggaaguucuagaaucagcaaaaccaauccacacugauggaagucagaucaguggguaccuggaguaaagaggaggaacacugucugcaaaggggcaugaggaacuucccaaagugauggaaauguucucaucuucauucagacagagacgacaugguauacacauuugucaaaacucaucgaacucugcauuuaaaauaguguauuuuauuauauguauuaauuuuuuuaauuaauaaucuugacuuuuuaaaauuccagaacagugauuaaacacuaacaaggaagucaucacauaaaaacacaaaacaugcuaaugagaugacauuuuacaagcauuaagacgaagcucccauugugcagaggcugugcuggagcuaggaggcaggcugugcuuguauccaucagaggucccuggcuuucaguccuuccuuuccccaacagggaaucccuacuuuuggauuaccuuuauuuucuaaaguuucgacacugcaauaagaaauaaucagaauuauuuuucuaaugaaaucaguaauuuuucacucaacaauguuuauugggcaccuacuauuauaucucagaguucacacuagauauaaagauaaauaaagucccuucguagaucauucuugggguaagacagcaugguaaugugcaaaguauuucagaaaaaaauucuaugcaaacagguuaaaaucaacaaaauuucuagaggaaaucuuucagcuauagacaaaacuccaaagauacuggucaugaaggcucauggggauaacagaugcugugcaggucaagucucucacugcugaaacccaccugaccuuccccugagccuucagaauuccccugcaccccgucccuuggucacccacauauauuucagaaacagaucuuuucagguugaucucccucugcagagacgagcccacgcacuggcagaagcugcuggcucugacaagucccuggaggcuagauccugccgcagagauuuagaauuucugaggacaauucauaaagucaccacugaauucucagggagcaagugucugcaaaagccagaaguaccuaaagaaaaaaaauagagagaggaggauagagccugcaggcaagagggcaaugccuuaaacaauacguguuaugguuaauuuggggaagagccuuaacaaaggauagggcaggaacacagauggaagaaaagccacuagauucucgccggaaaggcuugcuuuuugauaauucaggaggguguagacaagaaaugacuguugaugagcacuucauuuuaaaguuuugagauccuaccccccuugaaggaagcuguugaugauaagccagauguucccagggguaucucacuguuuuauaaaaauagauagcuuucugcagucaggacgcuccacugggaaacacagcagagcauccauccacucauucuuuuuacacucaucuguccugcauaagagaccacgcuaguucuagaaagaguacaaaaaacagaaauaaguucaucagaggagagacuuuuucuccuggccuugagcuuggaaaggaauuuguaaucaguguccaaauauaauacaaagggcacugaagaaccuaaugagcaaccuccucagccccagauguauccucagugcagagcuuucuccaccugcagcuuugcacaggccaaagcuuugagcaucagcacaggccugcaaaggcucuucggaacauugggggcagggaugggauauguugcuuucugaugauuuagacuaacccaggauaaaaguugaaaaauguaugccuaccauaccacugcauccccucucaaacauuauaaacaggguaagauaaaguaauuccugucuucaaaaaccuuuaaaaccaacagcucuuguuuuuaccgcaccacgccacuccgcccccagugcucacaccccucucccuucagcccauacuacauaaaacagggccaagccugcgacccucagggcugaggcugaagggagggacagugccuuccuggaaaucccucauaguuguuuuuucuguucccuauggaugaugcuugugaccuuucuggugcuguucacaagugcuaggaaaaagugacuaauacuuagcuccccaccaugcaggaacagccagugucaaugucacacacacaaaugaaagcuucucuaagcaaaggccaccacuaccuaaaucacauuuguggaaucccaucaauaagcaaugcagcuuuuucccaagaugcauuuauuagcagaacaccuagaggaaccgggguauguaggugggccugggagaagccauauauuuccucuguguacugcaaguuggcaugagcagcugggcaggagugcccgggaucuacaacagaaguccgugcugaacaaacucccacccaagugccucuaggcuucuacagcaggcgugaacgccagcccagcugguccaaauccucucuugcugcuaagcaguaucuacuaccucuguuagccucaucuacaaaaauaaauaaaccucccaggaaauucucucuaauccucaaugucaggcuaaaauucaggugguauccauagcuccgaaggcuuuguuaagcucagggucacugaccuguaggucaagcaggcaccuuaggccaaaauauuuuggggcaacauagcuaugaccagaaggccacagauccauguccagcuugggaggggacaacagcucacagaaaaggcaagcccaaguggcgaggucagcaagagggcagaggaggggagucgcgcuggccuggacccuucaaccacauuuccugcucagccacaaacagcugaacuuccagaaacaaggcaggcagugaguucaaagaccuccuguuuaaggaggccaaaagccugggaacugaagcggaggccaaaguccaaaguagccaggagacagcaggccggggucagaggacagaguggcgcccagaggggcugccuucccacucaccacugcccacccuccccggacacucuguacacccaccauguccccacuuugcuguaccaugagcacagccagcacaugcugacaccccauguuucccucagguucuaaaucccaaagccuggauuucagcaggucuucuguucuucuggucacccugagcuugcacagcuaccuggacuuccccuccacacuccugccccgccgguuccuccuaccacucccugccuccacucagcccaaugccugacuugccagcugcugcggcaaacauaaugacacuucccuccugggaacacuuucuccucggcucucugucaacaucuccguugaguucugaugucucccaucaaucuagcuucuccucccaucuaaagggaggugucucccccaugcccuacacuaagcacacucauccccuaagagagucaugagcaagggccaaaucuaaguuucugccccaggcaggacuccagucccuaaguccaaacguccucuaaaaacaucgcacacucccugugucugaaagcagacuuggcaguuuauaucucccaauggguucuuucucaggcaaccccuuuucaccagaggcaccaccauucuccagaagccuggcucaaacccuccuuccucuaccccacagcucccuggccacccagccccuugacauuuccuucauauucucugccucccccaaucauuuuuauuccuuaagccucccucuacacuguccuguugcuucacggccuccuaccacaucacggccuccuaccaggccucccuucaggcccuuccacucccaaaguucugggcaaacccagcucaaauagccuuucuuucaacacugccaucugccagugugucaccugcuugugaacuuacagugguucccacugccuauugacucaagucauacaauacuagacaggccuguuggaggaacaacagccauaguugucacacaaucuaaauguuugcugagauggaagaagagagugaagucgccacacggcaggauggcauuucaauggggagaggaaaaguuguuuaacaaaccaguaucagaacaaccaacuauauauuuagaaaaauaacguaguuaguuucuaucacacaauguauacaacacaaauuccagaaagauuaaagaucgaaaucuuuuuuaaaaacaaccuaugaaagugcuauuaaaaauacaaguauauugaaaauauaaguauaaaauaugggaguuuguucagcccagacauguguuguagaucccgggcacucuccugcccagcuguucaugccaacuugcaguauacauaaggaauaaccuucuuaagagauaaguuuagaaucuagagggaaaaaaaaaaaaagacugauagauuuggccaaaugugcauguuuauugccaggaugauaaagacaucauaggcaaacuuaaaacauaagaaaaaggcugaugaaaaaauuugcaacacauagaucagguaagagauuacuguugaaaauauguaacaaguuccuaaaaaccaggaaaacaacaacaacaacaaaacagaauaauguacugagaacauaaacaggcaacuuccaggaaaacaaauacaaauggucaauauuuuaaaaggauauuaaaugacauuaauaaucagggaaagugacauuaaaacgagauguuuuuucauaacaaaaauuuaaagucugagugagagaagauagagacagaagcaaugcaggggagugucaacugguaaacaugucugaagugcaauuugccaacauguaucaaaauucaaaucugagugccuuuggacccagcaguuccuccauuagugucucuucuaaagaaacacuuguguacaaggagccacgugaauggaucuccagugcaaugccaccagugggaguccggcauguccuagcagcagcugaaaauaccauguagugggugagguaggagaugagccuggaaagguaugaaggcugggaggccaagggaaggcauuugcauuucauucuaaguaggaugagaagacaccagaaaguccugagcaagggagcaccaugauauuuuuccuguuuguaaaaggugguucuggcugcuacauggggaccagucuguccagaggcaaggguggaagcaagacggcagaaggauuccgcaguggguuggaagcaagacaacuauggcuuagauuuguaggguggcagaggauguggagggcaauggaugucauuguuagagguuuugagggcauaggagguggugggacuugcaagguggcuuagaaguaggagagugaggugagagaacaaucuuuaaauucggccucaaugguuaggaugauuggcggugccauucccagggcauagaacucugucgacugucauaaaaaugauucuccagcgagguaagaaucacugagggugcggaauggggguuggaggguagcaucuccuauuuauugguuugagagugaaaauaaaacuucagacuuucugccuuuucuuucuugcuuucuggaucagacacuauauugccaacugucuauguucucuuuggauuuaaacagcaguuucugaaaggaagguaggcagucuugcuccugacucaggaggggcccucacuuuggaagccagagagcacccuucauccucccuccaccccccaugucccaugcccuuccccagcucucugcucuccuggagugaggaaaagagagagguggccucagggagccaaguccaggggccaggaugaggagcuuuacauuguaauccuccauggacugggaagccucggagucagaaggauggguuucauuugaaggacccuggggcuaguaugcagaaagcacacuucacaggucagaauggaugcaggcugggugauaaaguguucuaaccuagcccauggugaugggugcacaacacugugaaugcacuaaugccacugaaucacacuuuaaaguggugacuuuuauauuaugcaucuuuuaccacaauuuuuaaaaaagcauaauagacauaagaagaccaaucagggccaguguaccuccaggugauggugguggccuuucuagaagcaugauggugauaauggaggcgauuguaauaguaauaaaagcugucauauuugggauguguuuuggaggcuaaaacaacaggacugcagaugaauuagaaguaaaaaguacucuuuuuuuggccugagcaaccacauggauagacagugccagcaggcagucaugaaaguguuugagagaggaggaacugauacgaagggcaaacuuacaguaaguaagaaugacacaagaaaacagucccuaaaaauguacuaccagccaaaagucaugcuacuaccacacgggcacauaagcaugcagguguccuguccuucugaaucugggaaaaggaaugguuagaguuguguguaaaaccaagucucucaggccgggugugguggcucagccuguaauccuagcacuuugggaagccgagacuggcagaucaccugaggucagguguucaagaccagccuggccaacauggcgaaaccccgucucuacuaaaaauacagguguggcggugggcgccuauaaccgggaggcuaaggcaagagaauugcuugaacccaggaggcggagauugcagugagccgagaucaugccacugcacuccagcuugagugacauagcaagacucugucucgaaaaacaaacaagucucuccacuaaggagagaaggcugcuaggaggggaugcucacacgcuucauguaucugcacagccgccaaugauggggcacaaccugacugaaugucaucucacucacacauccccaaaucgacuccuuccccaggucucagagucaagcagacuccuacagaaaucaucaaauagggguagccucgagaugagccaccccaccuccucugcccaguggucucuggccagcuggugcccuccgggcagguagaaauagccuccucuggugugaggaccagaaucugcucccucgaggcucaaguaucugggacuccagaagucccaccucuaaggguugccaaaaucauauaagcaaggaaaugaacacccacaagagaacagaaaugcccagacagcagacacccaccucggugaagaagcccgcuaucccagccuggcaggagccguguuccucuccguacuucuucuuauacucuagggggaaggaaggagagagaagcaaaccacagccaugucaguguaugccagcugugcguggagccagcagagccagccagccacuucccacgagugccgcggcaggcugggcccagggaugccauccagacuggggugaggaaggaaagucucaggaauccaccagaccucaaaaauccaggcucuggugccaucgggaagggaggcugcccagugccccagcagacuuccuccccucgugugcgagaaagaggagcaauagccacagucauuaagugggaggcuagugacaauuauuucauuuacuccagaagggacagagaucccuugcaggcccaaggagcugaaaacgugacccagaaauggaaugauguggccaucccaguguggagucuccuggaagaagaccaaucuucccuaaaagaggcuuuggaugccuccuaccauccaaaaagaaacaagccguccacagaggaccgcaagaagaagggacugcucuggcauucgguuacacuauugcuguguggaaggaaagggggaagaucucuccagguggaaagaaaacuaacagauaagcuuuucuccuccacccccucagcucacaacacugcuacccaacaaaugggggcguucugcugcugcaguuauaauuuuaagcuggcaaggaagagggguaggaaacuuuugacaagugcuuagcauuuuccaggcauuguguuagcugucuccaggcauaucauuucaccggucccucaucccugggaacccauauccccacuuguuaacagguaagaauauugaggcucagagagguuaagugaauugucuaaggucacacagcucuaguaaauggcaaugccaggauucuaccucagcuuggacuuagaaacccauuccuucacuucuguagaccaucaaagguucugcaaagugagugacuaaaaauacccaggaaagugacuggauguuggaaaucauuucauggguaaagucaaggagguggagagauguucacagugacucaaauuaaucacaugugaggcugacauugcuggagaccuuccacagaccacuccugggcacccucaggcuggggcuaccccagugacccuguaccacccccugggcuccuggcaagucucugguaccauuaaaagcaauaucauuauuuuugaaaugcaaaauacaaaggaacaaugaaacuaugauugcaacacagugccacuuccugccguucugagugucuacuccaggcaaggggaaaaagggcccuggggaaauauacagaguaauucaguuucuaacaacacucaccacagagccuaguaacauuuuccaguaaguggccauuaacugacugcuaaaugacaaagaaugucaauugaguuacuccucuuccaugcaggauaaaaucaguucucccgccuuguccgguuauuauaaggacaacugcuagaccugccagaaagcaguccagugacaaaaggaacuuguuuguucccugcagaaucuugcaccagggcugcgagugagacuagugcaaagcaaugaacaaauccugcaucaaauuucauaauagcaagaaauaauacaaauuaauaauaaauccugcaucaaauagcacaacggcaaaaaggaucaaaaugucucaaccuaaacaaacaguuacauauuaaaugugaaaagucuggcaaaaagcauauccaucccacugacucuagagacuaaacacccaauuguaacucuugaaaaaaugaaacauaaaaaggaaauucagaccccaugagcugaaugaaacuauagugcaagacacaccaccaguucagccucauaaauuucugacaugaauaggaauugugugggacucuuucaucuuuuaaagcagucucaaggucucuuuaugacaaggucuccaaaaaaugggagauuugagaacuucagugccuccuccccaaacuguacuugguguggucuauguugggagcaggaccucggguuuccgagguggugacagccucacugggagcuaagaauaccccacuucuggcccaggcugaaggccagcaaggggaagcccuuaaaggcaccccuguuucaggcagcaugaagcacuguuuucaggccagccuccgccuucccaagcugggacugccccaccagaggucugagggccugggacacacauggaagucgguaccaucacugacuuucauguuucugaaacccaaagucuaagcugccuucucaggaugcucuagggcaaggaaucaaacaaugggggccccugacuggcuccuauaaucaaaucuagaucagagagcaggccaugucccagccucccagaaacuucugugacugucauuaaucccuucaagguagaguagaauccaguucuaauccuucuaccaccuauccgaucccugccacacacacuuugggggcaguuguggggccuggcaacucuagucuaggaaaguuaguggguguuauuggauuagacaguuucacauuccacaccuuccacagccuaggccacaagcaugcuuuccauuguuuucacuccuuugaaugcuauuucugugaguuaagggcacuacuauuauuuuaaccugauuccuucauauauaugucaagagggcagguuuagguuucucccuaauccaucuucuaaauguucauguacgagccuuucuuccccaaagaguauguacauaggguuauucuaccauacucguaucuaaaaaacuuaaaaauacaacuugauuuugcuugucuagaccugagauggcaggacagccuauaucacaaagcuaugggaagugagguaggcgcagagagaggcaaggggcugccccacaaacaacauccccaacaagccugggucacacacccucccuccauugacaaguccaggaagugcaggguggagggaccugggaaggggugggggugaccuccagucuccuguguucccaggaagaacuuuuccugcacaaacacaaaggccguggggcccagcaguuggcugcuccugggcaugucuacuuggucuccaaaugcccccagggacauggcccugcagagaggacuacaauagcuagugcccucuccacuacugaacaaaacauuuauccaccucaaagaagcaggggaaaagcaggcuuugccugacagcagcucacaggcacuguaacaaaccuaacccuuacauuuggggaagcuggccagcacgguggcugacaccuguaaucccagcacuuugggaggccgaggcaggcagaucacuugaguccaggaguugaaaaucagccuggggaacaaagugagacccccaucucuacaaaaauacaaaaauuagcuggaugcgguggugcacaccuguagucccagcuacucaggaggcugaggugggaggauggcuugagucugggaggcagagguugcagugagccacgaucaugccgcugcacuccagccugggcaacagagccagauucggucucaaaaaaaaaaaaaaaaaaagcgggggggaagccaaaucugagacccaaaagauaggguugaacaaggggacuuagaagucacuuagaggagcuggaaccagguuguggaacucuuccugccauggguggguuugaauuacuuggccugcauuacaugcuuuaauucauuaagucguauggcuccuccauucuaaaaaugggaguauuuuccuugguuuagcugcugguuuuauuaagcccugucuaaacagaaggcaauucagagaggaaaaaaaauacugguuuccaaauguucacaauccgcaacucaaugcauggagccuacauuaaugaauguaauucaagcagaccaccaaucggguggggucacuuccuguacccuuuccaaaagaccaggauaaaaccauuccacagaaagaucaagauucacauacagcauaacauauauucuuccuaauaaucucccuucauauuacccauuugagaaaguucugucuuucaaagcuuuuuaacacaucaauuuuacaauuauuuuucuguaguuccuuagcuuagcucugaaauaaaauacugggggaaaaauagcuugccagucuuuauucugaauuucaccaaggaguuguuauagcgaauuccaaguuucucuucaaagaaucaguaugucaauauguucagcucucuuauucuuugauuuuccauuuuaaaguuuaacuuccugguucucuuuggcccccuugccucuaguuucaguaaacaacuuucccgccaguucuaaucaguaguucagaucuguuccccuggucaccugcuuuaaccuaagucacccugguuaccugcuccaucuugagucaccccuggucacuugcucugacccaaaucauccugagucaccuguucuguaaccacccuucccaccaaacuacucaccccgccacucaggaucguagucugcucucuuuaaaacagccaguuggaauuagcucagacuaugcaguugaaccccaggaaauaggggaacgacacagcaguaggggcuaccugcaacaggaauaagaaccccugccccuccccuguccaggugugcucucaccauuacuccauccacaagucgcacgcuucaguagaaguaaaaauugccuugcugagaaaauuaaauuuauguucaagugcuauuucauuguggcacugaggaacaagcauuuuguuucuaacagaguggcaaaucuaaauaacugauaauuguacaauacaggaaacaaugcauuugggcagacacagcucuaguaaaaaaaaaaaaaaaaaagggcaauuauacagaaaaaugaagagagaauaaaacuacccucaguuuacaagggaccaccauauaaaugggggaaaaaauguaaauaaauuaaacagcuagguuaaagaggaagcgagaacauuuuaugaaaauaacugaugacuaagcuauggugugcaugaaacacaaagugcauaaagccagaaacuuagaauuaaaugaaagaaagauuuuaaaaggggaaaagaucuuuagggaaugccuaauaacucuaacucuguccauuuauuuacaaauggaauauuuuugcucagaaagagcaagugguuuguuuaaagcuacacugcugauuagccucagcaucaggacccaagagcaaggcucccaacuucugaucugcuucugccacucccuuaugcuucacaaagcacauuuccagugaaaacauucuuaucauccaaagaaaauguuuuauaaacagaugaauagauaaauguggggcacacacauacaauggaauauuauuaaauauuccuuccuuuaaaaaggaagaaaauucugacagaugcuacaauauggauacaccuugaggacauuaugcuaagugaaacaagccagucacaaaagggcacauacuguaugauucaacuuacaugaggugucuagaguauccaaauucagagacaaaguagaauggcaguugccagggacuaggggaagcagggaaugaggaguucauguuuaauggguacagagcuuuaguuugggaugaugcaaaaguucuggggauggaugguggugauaauggcauggcagugugaauguacauaaugcuacagaacuguacacuuaaaaaugguuaaaaugguaauuuuuauguuauuuauuuuuuacaauauuuuuuuuuuuuuugagacagagucucauucugucacccagacuggagugcagugaugcaauccuggcucaccacaaccgccgccucccagguuccagugauucucgugccucacccucccaaguagcugggauuacagaugcaccccaccaugcccagguaauuuuuguauuuuuuaguagaggcaggguuucaccauguuggucaggcuggucucgaacuccugacuucaggugaucugccagucucagccucccaaagugcugggauuacagguaugagccaccacgccuggccaauaauuuuuuaauauuaccaaaaaaggaguuuuguaaucuuuaaagcguucccuuuaccuagaacuuagcaacccauuuugccaacucccuacuucagcagcaaguaauaauacaggcacauaauaauguauauauagacaugcaacuuacuaugcauuaugucaugcucuacucucagaaaaaaaaaagugacccugaacaugggacagucacauuucagugagaaccccagcucagaacugagcagaauucaauuuugggaccaaagcuaaaagacucaugaaauagggagcugcaguggcucaggccuguuguccuggcgcauaagaaggcgaggcuagacguucgaggccagccugggcaacacggaaaccucugaucuauauaaccaaaaaauaaaaauaaaaagacucaugaaauaacuggcaccaaagcauggacagacaaacugcugugcagauacugaaaccaaauguucccaguaagcagccacuccagacuagagcagauuggucuccuggcuacauuuuaucagucugaggacccacgucugcccucuguaccuacugggacuugucuacagaguguaucuauaauugcaaaacugaaacauagcuuaacaagucuauaguguagugucccaaaaauucauaaaauuaugccauugaaaaaaaauaugacuuuuuuuucugugauaggccacagcacucaguaaucaccaagaaaaccaggaucccaacagaacagguagcuacaaagaaaccuacuacacacuuaaaagccgucaaccccuccucugacuaauaagccugugaccuucaucaagcucccugggccucaguuuucucaucuguauaacaaggauaagaauacuuaucugagaaugaugugauuacucaguaagaucaaaaauguuaaguaccuagcacaaccccuggcaccagguaggugcucaauaaauauuaggugaaucugaaucugugaauuuuucugagagaaacaaaagaugcaguuuagguagucuauaauuccacguaauacauggaaacacguuugaaguauaggagacagguuugcccaagauuaaaauucuuggcuccaaggaaaccuggaaagccccagagaggcccugcuggagaccucuggccuccuccuuacagccauggcuguccucuggggccucccucccuuccucccccucagaaucccucucuguuuaacuggccauaauguacaacugcauccucuucucuuuaauuugcucuauuuauuuaaauaagauauguuuauuaaagcuccuuggaaaccauaaaauccuauguaaauguagaggucuuuauuuaauaaaaauuuaugaggcuuguucuugaauuuuuaaauggaucaacuuagccuuuuaugguucucuccaaaacaaaaacaaaacaaaaauacaacaaaaccccaauuccuuuucauuuguaaauggaccuucguugauuuuuaucccuuguggagaccacuuuuaacauuaaaggggaaaaaaaucuucaccuuugaauggguaaucuauuuccuucccuggaaaugaucacuguccuaggaaaugcaaacacacacuagaaauaaaagccagucauucccugauaauagagugguacagaaaucuuuggaauccauaggaaguuuuuccaucacaauuuuaaagcacaguaaaauucagacuucaacaaucccaaauuuaagaacauuuaaacauggcaugaguuaaaguuuuaggucaucuacaaaaagagggaaggaacacuuaccaaccaaauugugccaauaugaucuucaacaguauuugagaaauuauaacuugccaagggcucuuaaaaucauuuuaggaauauccagcuuucuacccuucauuaucuagucacuaaaacaggauauguuagacaccuucugagaauauuuaagaauacuauuauguugcuugaaaauuaauuagaaaauuuacauuuucuaauugaaggcaaugagcagcauucacucucgacugagcacugugguaggcacuuuauaccucacauaccucuuaaguagaucuuaaucuccccauuuuauagaugagggcaccaggcucauggagcuugccuaaggucacuaagucagaaaguaggagcauauagguuuaaucauagcaauaagugaguaguaaagccagauuccacaauuuaggucuaacauaccauggcaucauaauuaccucuugcauuucuuucucagaguuuaaucuugaacaggcuuuguuaauuugccaugcugcucccaaacuauuccacacucaucagguuuuucggucacaauaaaaagacaacuuguuugcagucucacuccugcuaaguuccggcuucuugccucaguggucucaagggcaaaggaugaaagaaaucucuguacuugauuuuaucacaugcauugacuuaacauuucggaguccuaaaauaucauagcuugguuaauaguaauuaauguuuuauagugcuugcccuuuaauuuacaaguaguuuucccuauacaucgucccaccaaagcucucguuuucucacacauucugauaaaaccaaagaacauaugguagguaaugauguucucacaucagacaaacacaaacuaaacugacugaaggauaugcuccaugaguuuauguccuaaauucauuuuuauuucccauuuccucuguuuuuccugguuccaacaggauauucugguagcuuuucccauccaaccagaaacaggaagcaccugagaagccauguccuagugccaaaccagagaccaauuuuuuaagaauucaaaagcuugagacauuuuggagagauccccacauauuuagagucucugcaaccaaaccgaccuuccaauguuguaaaggagcacagcuggcccauauggagacuuaccaugaggccacaguuauagaacaauggguggccuugcugagcacuuucaccugaguuuucucgggagcuccucaccauaacccaaagcgguaaaugcaguggaggcaucacagcaucgacucccacugagaggccaagugacaggccugaggcuaaaggggcagaagugcagcagagccguccucaacccacagccccucccacggucuuuccaccaucccacaagaaguggguuuagaggcagccgucccccuccucccuugcccuguucccaccaccaugaccagucucgaauuuccaccaucccucucuuccauagucucaacagccugcagacuuuaaguggguuucaguuuuuccaauuguaaaaugaaauaaugccaccuugcacuuggaugcagcucaagcccuuggggacgggcuccagcaguacacacuggcaggaaauucucucuccacacggcccucccacuuuuaaaacacccuguccccucucuguuuuccccuguagauggggagcuucuugguagcuggaacugugucacuuggguuuugucuaucuggcaacuaacaaguacuuaagauuaaguggauucuauucccgguacacaagucagucacccuaugaugauuaacaaacacuugcucagaauacaguauguuguacauggcauauuaguauauauaugcuuagcauauauuagcaaguauaugccagacacuguucuaaggacuuagaagcauuaacucaguccucuucauagacccuugagguugguuaggcacagagaacuuaaauaacccaucugagauuacacuguuaauaagaggaaguagcagagccgggacuugaacuccggcagucuguguccagaaucugugcauuggccaccaagcuacucugccucuccauuguguggcaugugaauaacagauuagaaagaaaaacucaggccaucaccucucuggaccucaugaaagacaggaggcuguucuaggugguaucugaaagguccugucaaacucuaaaaucuucccauugucuuuaaccauaaugugaccccuaacguggaacagagaacuugcauuacugaguuucuccacauugaggaaauaaugguggccuuaaaagccauaguaggucuaguuuaaaccacaaaacagggagguggagaugccuaaagccaacagagcacagacaagagcccucucacuacggccggcauccucccagccccacccguccaguccagucuucuagaaaaauacucagcaucuucuaccccucuccucuuacagggccaagaacuacagaaacuuucaauuuagucccccauuuuucuaaggggcugcucuuacaccccaauacuccacaugccagccccauccaucccuuauuucccacccugggccaaugaauggguuagcauauaaaagugugugugcgcccaugggaaggaagauugggcaggggcauaaucauuuugcuaauuucuucaccaguuccauuuaaccaucauuaaguccauuguauuuuugggauaguucagucacccuuucuugcuuugugaggguuguugacuggcuuuuacuucucauuuaaauuagaaacccuaaaaaacaaacuaacagaaauuaccauuaauuaccaggacacaaaaugguuugcugagucagacagaggccagcuucaaaauccugcuccaccauuuauuguuugagugaccuggggcaauucacauacacucugagucuccacuuacuccugucacaggagaaugacaacacagaagcuggccuuugggcaucccaccugucuccccccagcuccuaccaccguuccuaugauguggccugacugccaccugccagcaccucuguccuggaggcuuucccagcccacacacauggcaggacaggaugccagguggaggaagccccuuccccucagcccucaggcaggaggacucuagaugugugcuccacacuggccccagcacccaccccagagacugcacccacucgcccagguaacgugcugaggaguacaucuuccaugggcugccuucccuucccauucuuacuucccccugccucacuggugucuucuagaacaauuuccaaaauaaaauaccuguaaucagacccaagaaaaaaaagaaacaaacauuuuucacagcuucugggaagauuagaugagagaauguguaaagaccucagaucaacacuggccuacugaugauccacagcuacuuaauagaaaguaaugcagaauuaugagccucguggaccugcguacacauggacauugaacuccaccucccucuucagagggcuguccuugugcuugugguauauauagaggaaucaucagggaccaucaugugucccugucacaacaugucaucuucugggaaaaccaaaguacugguccuaugcauaacuaguaugguucaacaaucacugccuccaucacccugcugagcccaucgcuccuucucagccugaagagcugccccaccgguuguuccagaggcuuuuccuuuuucuuccuuaggaaaaaggaggaguaaacuggggcaguggaaacccaggcuugacacaugcuuugcguuucugaaaccaacgaucccuccacucuugauugauuauaucauccucuauuuuuaagaugaaguuuguucuucuucuguuugggacaauacagauauaaacagggccagaguuucauuucccuacauggcccagccagagcugaucaaaugcugauacagaggagaaagaaaaaccaaaggaaggcucacucuauaggggagaggguuugugccuccugcagagaucuugcuggcucuucugugggggacguuucccagagcacccuaccugugucaccucaguacccagaagggucccaguguccauauaguguuucucaugaauccuuuuuaguguccacaaaauuugaaaccuaggaaaacccagggaggcccaaaggcaauguggacauaagccagugagacuucuguccaaauaaaguaggaggggaauuaagaaauaaauaguccagcacuuacagaaggagcagguuccagcuuacccaaaauuaggcugagaaaacuugaaacuacgagcuaucaaacugaagaaaauaaccguguuuucugaacgcuuaaagcucagauucgacugggcuaaauagugacugacucaaucacuauuagugacuguccucgaugcccaggcauuugaagguucuaagucugagaggauacauuuuccuuccaagugccccuuggcgaggagcucuuaaaaccacauucaggaugcgcccaauucuccagcaucugccugggcugcaggaccacaugggaaggaaagucagaccucaaaugucaugaaaugcugaaaguucagagugucagguuucuguccagcuguugcuuuaugaauccugggucuccucuccccccagccucaggacaucuguccacagugcagccagaagcugugugggagccuaaugacugacuuggagcugccuggggcuguagagaucaucugggccaaccacugaauauucggacaaggaaacugagguccagagagagaagguaaguuucccaaggcaacacagcaccuggcauuaccagaaaaccaaggcagcuguuaggucacuuggcugaggcuuggugaauuucggucccugagacuucauaaugcuugguaagcaccgugggcucugcagccaagucaggugaggguuggaaaggccugggacugcugcccccucuguaccugccucuucucugggcagggccuuggggaccaagagaccaucugggagcaaacagugcugcccuaucaugagcauguggaaagcuggggaaauguucagcugguggugcauagaggugggaaggcgggcuuagggcaugagguggguagggggaugaggaaaaaucaauccaugcucaccuucauagcaagggaucagcguccugccuuuggccuggagguuggaggggaugauguagcagaagccaugggguaggauguggucggcuucauaguagauguucuuccagcgaugagcacaggccuaaagggauagagagcaguugagagcaggaaaguuggccccaaaagaucacaaagcagacuccugucagugccagauguuucuuucugugggagaagagaggagcagagggaccagaaagccacaccuucauaacaggcacuuuucugggcaucagaaaacugcaugaacaggaacaagccacugggagccuacuaggagacaggaaauaaauauaucaacaaaugagaauuguagcuaguccugagcauugggaaggaaagaaacaagguuauagaauagagaaucugggagugggaaggauaguuuccaccagaggucgggaaggccugaagcaugaggggaagaggguucugggaggauucaaaggauagcagaauguaaaggauacaucgugagaaaggcucagaggcucaagagaaagaaaggccggucuggagugaccauggugggaaggagauaagaucaaagaggcggccaagguuggaccacagggggacguaggaauggcugugacuucagcagaucugcaaugggaagugguggagagucuuacacaguugagaagcaugauccaagugacaguuuggaaagaccauuuggcugcuugguggagacugcaggagggcaaaagugcaaaugaacaccaggugagagaugaugcaggucuggaccaggaggggcaguggagaugggcgacggggguggcuucagagcugacaggcccaagggacugaaccgauguggagacagcagggaagggaggaauggcugauauucaaccauguuucuacccacagaaacacuucagcaugcaucucauuaacuagaaguaaauguguguggagaguuguuuuuuuauggaaacuuacauacagcaaaaugcacaaaugagcuuugacaaauguacacacucaugucaccaaggcccuagcaagacacagaacaucuccaucucaccagaaaguucccucaugccagggaguggcugguuuugccaggcaggucaaggaaggccucucugaggagaaagcugaaggaagguucauggccaagggucuuggggugcaugagagcuccgcauacuggcgaagaagauggacagaugcauuggccagcucuccagaggagccucucagcacuagggucgaagccacgcaagacaccaugaggcagggcagcucugcuaacagacacuggagcagugccagcagccaggaugcaggccuggaucguccuucugccacacuaaacaugccccugccuucugcuuggacaugacaguggccccaguucccgugcaugucucugcacauccagaugucacugcugugcugaugaagagccgagcugcuuacucagaggcacacacucuacccugcccagcccguuccacuucuccugggcauucacuacucacuucugauaucaguucacuucaccccagccagugaaugcauuuucuuaaaauauugcuuuugaaaauaaucaguuuuuaacaucuugguuugccucccucaaacgcauuguuuucguaagugauaacauuuagcguucuuauggccuaccucugaccucuucugcaauccuggaaggugagcagaggugucuuuagaauucccauuuucuguacaagagcaccauguaucaaagagugcuuugccuaaguggcagagcuaguaagugcugcaaacagcacuggaauccaggaauucugagucuuccuuguuucacuaugaagcauuuuccaucuuaaaacuucucauuccuaccugagaggccaucaaaacccacccccuggggcaggccuggugacuuuauccucuuuacagccccccugccacaugucccaggacaugugaaauaaccacucuggggucgaauggaaugccccacgucaccgagugagugagggggcucuuggggccugguucucccugacaucauucuaugauaagaucacagccuucuaagcucucugcucuucauccuucaagccacugccaccaaggcccuggacaaggccacucucugcccaauggcaaaagaggacacacucagaaugacucucaaaaccugagcuugcccacauucugccucuugucguaugacauuaaacuacagaaaacaaucuauuguuauuuuuucugcugcaaaccacauucacuccucuccuugauauuguuuugugcuaaaauagcagguuucuaaauagacugaaaugauaugaggcagagaacuauaaaaaauauaucacuaaguaaauaaucacuccauacugcuaaauaauugauuuuuaaaguucugacucaauucuuauggcucgcaaacuugaaucacuuauuguuaucuaauuuguggguaaaucaguuauguuuugguuuugcuaaguuuuuggacuuagcaaagcccuuggcuucaaggguugaccauguuuuauuguauuucugaguuggaggggcugugaaaagaggcggauguuuaucauggugcugucugauagccagcugcacacugacacuuauaggaaggcuuugcuguacuuaaugucugguguauugucucauuuuuuaagugccauaaacuauuuaaggggugaucuuggaaaauuccuagaagauccaaauauugcauuucauacuaaacuaaaagcauucugggaggucagagaucaaagugucaaaggaaggauucauguaggaaaacaaugcaaagugucucugaauauaaauuacagaaagagaagacuguguuuagccuugauuaucauuauauauacacacaugucaaucugaccacuacauuuuaaaaaaauuccuagggacugucuccaaagcauuaguaacuccaucaaucucuccaaaugaguucggcugugagggaagaacaggagaaggagagcauucucugaaaacagcaagacuugcucaaacucagauuucaacuaaucauaagaaaggggaaggagggccuugucccacuccaaauauuagaaucugacacauuucaagguauaaggauugcucuuccucccaaaagaggaaaaagagaaagaaaauaaacacuuuauuucaaaggccuuuuuuguuguauggaaacaacacaucccuccuagagguggguaauggcacuuuccgggugcuucggccacaaaggcacaucagucccugccaacccuccuacauucgcaccugccauagagauggccaaagccuuugucaugcauccagguccacagugcacggccacaacugggccuggcugcuaagaauggugugugguggggagcaggaucacagagaggcugagaugccaugagacuccccuaagaagcuccccaaccgaggaggaaguggccaggaggggcauugggaaggggcugcuggggugugaaaauguuauucugaggacguucaccuaaugaaaauuuauugagguauacauugaugauuuauaccuuuuucugcauguguguuacagcucaauaaaaaguucacuuuaaaaaaaaucaggaaacagagcaacagaaguaaaugcaaaaauguacccuguggcuuugaaaaaaaaaaauggacagaugggaagcacugaacagauaaggacagcccugauaauuagaaaggaaaugacaaagagaaccagagaauacugcuucugcacaaaaauaaucuagaagcuuaaauuauuuguugucugagccuuggcaagucugaugaaaaggggcgacauuagacuugaacauuuugaguuguccuccaaagucugagcagcagucagugccuauacagaguuuguucagugguuauuucaagaagugauuccccuccccgcucauuucuuaaaaugucgucugcacacaggaagcucaggaugagagagugagaagggaaggggcuugccucuaauccugaugcuaucuuuacauccaguaucauuuguuucuggggaaaaccugggaggugcaacaguguccauggagcugagaugggcaggcacuaagccaaggucaaccugccagaccagccugacaaucugguccuugccagagcugguugcuggguccaugguccacauaaugccuuuggucacugagacauuucacgccccauugcagcuuucaaauucuccauuuguucuuagguuuucuaucagcaccagacaccacuuucaaaagagcuagcccaccucucccucuucaaacccaaccuuggaauccaauauugugcuccuuggggauacuggucucuugccuacacccccaggcacuucucaaguucucaaaaugcaccugaacaacacauauccuucccauuuuuaauuuaaaaguaaauacuugccucccagaaagcucugacagguaggguugaaacauuaaagaaaaaagcaaauggcuaugagaccuccaaauguaaauagggacacucacuguaucuuguuuuugccugccauuuccaaggaacauuuuacagaauguuuccugguguuuccuucagccacuuagaaucagccaccaagaaaagauggcaacuaauuugguuucuaauuguuuuaacauugacccucagucccuguauuauucaaacacacuuucagaugccauuccuuagagagauguccuccagaugcugagaaugaaaguggguagauuuggucucuauccccaaguggcuuccauaaaaggggacauauggccacaaaauaaauuauacacacaauauaaguaauaagaugauguugaguuccuaaugacacaaaagaugcucagcuuguuccagaaaacccuuaacaggcuucacgaaggaggcagagcccauacaggggaagaaagagaagugccgaggacagaguggggcaggggcagaggggacuuaggacaagccuuuccuagcaagacugcccaugugcaaaaugccaugaggauaacucaacaacaauaaaaaccaaacaauccaauuuaaaauugggcaaaggaccuaaacauuucuccaaaaaagauauaaaaugaccaacaagcagaugaugaaacaaugcucaauguuacuaaucaucagggagaugcaaaccaaaaucacaauaaaauauuaucucacacccauuaggagggccacuauuuaaaaaaaaaaaggaaaacaauaaauguuggcaaggacguggagccauugaaacccuugugcacuguuggugagaacuuaaaaugcugcagccauuugggaaaauaguauggagguuucuuaaaaauuaaaaauagaaguaccauuugauccaguaaucccacuuccggguguauaccccaaagaacugaaaacaagaucucaaagagauauugguacacauuuauagcagcauucaucacggcagccaggagauagaaccaaccuaaauguccgucaauagaugaauaaagaaaacauggugaauucauacaaugaaauauuauucugccuuuaaaaaggaaggagauccggucacaugcuacaacaugaugaaccuugaggacauuaugcuaaaugaaguaaguucgucacaaaaggacgaacaccacacuccacucacauaagaucuaaaguagucaaacucuuaauagaaauacaauguugccaggaaccacgggaaggagaaaaaggagaguguuguucaauggauguaaguuuugcaagauaaaguuuaaagguuuguuguacaacaaugugccauacauuuaccacuacuguacacucaaaaugguuaaggugguaaguuuuaugucauguguuuggccacaauuagaaaaacaaacaaaaggcacaaggaaagcagauggugucagaugcuccucuuugcccagcacccauauacaguggcuuacugaguggaugaugcaauaacuucauaaaacauuaaaaaaauaguccugcaugcaauuaauuagacaggacuauccauggcaccauuauccacaaaugcucuagugcugccuucuuggcucccuuugcuaaaucuucccugugguccucauugcuguucacuguccccagaaaugacuccuuugugauacugaucugugguaacacagaauucugucuugccccucuggaaacaagcccucagccacagagagguuauccuuccuugcagagaggaaauauuuucacaggagcaaacucugacucuaggcucgaugcccuuaagagcaucuuguguuaugcugccacggggccaccaccuccuuuuuguucugaaucaggaccuugggcuacccuuugauuuacagaugagucagcuucuucccuuucuuuccccagaauggcagacaaggguucagccccucuggggcccauuuguccagucagggucaggccaccaugccuggaggaauguggaaguuuggagaggguccagggccagccaugacagugaugaaaggacuggaaaccaaggcaaacagcgggcucagggagccugugcaggaccuacaacggcuuccaggagggaggcccccaccaugcuggcgacagcauccagcugcuuccuccucucccaaggggcccgacaagggggagaugcuuaauugugcugaggacggaauucagauuaacagcuuaugccaugaagaaguuuaacacaaaagugggcuccuuagagaggggacaaaaacacuuugccuagugccuuaaggaaaaccuguuucccugggauaaaauacacacgaaacccucagcuuugcagcaugugacccaaaugaagcccuccauaagcggcagcuaguauuacuuuccccucuugagcuuacgcuuuuauaacaaaaaucuucguacagcuucugauaaaagucaagggcaagagaaagccuaugucagaauaguuguucacucaccaagggcagaggaacugacugggaaagggugcagggguucuuccggaguacuggcaauggggaugcauaaguguacaugcgugaaaacccaucgggcugugcacucacagcuggguguguuaagugcuuuaguauuauaccucauagaaaagcuuaaaggaaaaauugacaaaaacaaaaccucugcaguguuagaaauuccuuucguguugagucuaauaaaacuuucugugaugaugaaaauauucucucucucugcuuuccaauagaguagccaguaaccauuugugauuauugagccacuuaaauguggcuaauaugacuaaaaaccugaauuucuaguuuaauuuggauaaauuuaaguuuaaauaaggacacagggcugguggccaccuuacugcacagcacaacuccaggaucucaggagucucaaaugcaaagacuuuucuuucuaucucccucaaagcaccuacggaucaaaauacagcauaggugcuuuggagguccgauaaauaacuaguuaaaaauaacauuuauuucauaaaauguaauauuauguagagauaaacaggaaugaacuacugauacguacaauggggauuaauuucagaaaauauuauuuugagugaaagaagucuuauauaaaagagcacauacuguaggauuccauuuauaugaaauucuagaaaaagcaaaaguaauguauuauacaaaucacagcugugguuugucucaggugagaggaguuggcuggaaagggacaucggagacuuuugggacgauggaaauauucuauaucucagugggcauaugguuacacagguguguacaauugugaaaaucaagacuguaaucuuaagauuuguguacuguaaauuauaccucaauuuaagacacacacacacaaauaccuauguaaugaaugagauguacaaagcacuuuucacauauguuuuauuuuucaauagucacaucucagcaccuugggacagacauuauucacauuugacagauaaagaaaauaagaagauaagucauuugucuaagcaguaguccagaauaagcaaccucaaagccaugcacuugucaccaugccauccagccuuccuaacagaucauucauucucagagugccacccccuucccacagcacccccaggagggacuuaccaacacacggccaucagccuugggcugucgggccaggcucacccccauccacucaucaucgcggucuucccggcaggucuuuccgcaggacgugccccgauucuucccuggagaaagaggagaagagccagacuuggguugaggagugauguucugcuggcugcuuucaaagggugguccacagcccuaugaggaaauaaggaacuuuccacaaaauguaaaucaacuccaucacuauguacuauacuguuuaauccagacaacuguuuuuuuacauagcaaggcuuucuuuuucuuucuuuuuuuuuuuuuuuuuuuuuuuuugagacagucucucucugucguccaggcuggagugcaguggcacgaucucagcucauugcaaccucugccucccagguucaagcgauugcccugccucagccucccaaguagcugggauuacaggugugcgccaccacaucccacuaauguucauauuuuuagcagagauggguuuucaccauguuguccaggcuggucucaaacuccuaaccucaagugauccgcccaccccaaccucccgaagugcugggguuauaggcauaagccacugcacccaaccacauggcaagacuuucucauggaaagaggcagggccuugauuuauguucugaaguaagcuccuuaauuuguuaugcaccaguaacaaacaguucacaaaccucuuuuucugcuaaagaaaaucacaauaacucuuuauuuaaaaaauaauuagaagaucuuggccaggcaugguggcucacaccuguaaucccagcacuuugggaggcugaggugggcgguucacuugaggccagaaguucgagaccagccuggccaacauggcgaaaccccgucuccacuaaaaacacaaaaauuagccgaagauggucauacacuguaaucccagcuacucgggaggcugaggcaggagaaucgcuugaaccugggaggcagagguugcagugagcagagauuguaccauugcacucuagccugggugacacagcaagacucugucucaaaaacaaacaaacaaacaaaaaacaacaaaaaaauuagaaaaucuuuaugcaaaaagacuuuggagaaagaaaugcuugcagucaugauuauaacaaaauaccuccuuuguacugaugugccaagcacaguucuguguacucaccuguauuaucucacuuaaucuucucaagaccauccuugcgagguagguauauuagucuugaucuugaaggugagggaacugaggcccaagaagcuauaggacauucccaaucagucccagcugggcuuugaaugcagucagaaccaucugauuccaaagaucuuauauuuucugcuagaucaaagugagcuuuuauuuuauuuuuuuaucuuuuuggagacaagagucucaguucugucacccaggcuggagugcaguggcacaaucucagcucacugcacccuugaccuccuggguucaagugauccuccugccucggccuccugaguagcugggacuacaggcaugcaucaccacguucagcuaauauuuguauuuuuaguagagauaggcuuucaccauguugcacaggcuggucuugaacuucugggcucaagcaaugugcccaccucagccucccaaagugaugggauuacagucaugagccaccaugcccagcgcaaagugagcuuuuaaaaacauccaucugaucauaucuuucccuaguuaaaauguaauacccaaaauugauuucaguggccuccccacucacacacagaauaaaauuccagcacauugcccuggccugcuaggccccacguggccuggccccagccugccuugcugcccuccugugcuccacucuccuggcucccucuccagcugcacaaccucgcucugugcuuccaaauggcaccucugcuugaaggcugugcuuccugcaccugcccagcuaacgacuacgcauccuucuaaucaugucgaaaggucccagaccuuucuugacccuccuaucuagauuaaaucaaauacucaccuucccucuggucuuuucucucucaauuacuugucuuaauaucucuuuugcccacuaauuuaugggacuagggauggcagcauccuuguuuuuuuuguucacugguguaucccagugcuuaauaacuauuacguacucaauacaugcuuguuggagagaaggagggagggaaggagggaaggauggaugggugagugaaugaucaggccauccugggaagaagaagagcaagguauaaggguacagaacccauuuccaccacagcaguaauggucacccaccucgagccauguccaguucggugcaucuccggucaggguuggugugaacacggcacuuaaacacagccccaggagacuucacugaagggcuguauuuggaaucugccuuuggugcgcccacaaggacccugcagcaagagaaaaaggcauucugucacaaccuacgauaagaaaauaggaggcagauggcuaaguauucacccaaccacgggugggcucucugagugcucacuuugaaaaucauauuauuauacuuuucugugugggcuugggggagagguccuaaagugaaaccuguuagaucuuucccaggcauauuaaagcuuaaggaggcugaaugugguggcucaugccuguaauccuagcauuuugagaggccgaggcggguggaucgcuugagcccaggaauuccaggccagccugggugacauggcaaaucccaucuucacaaaaaaaaauggccaggcaaggcagcgcacgcuuuuagucccaccuacccaggagacugcgauggaugggugggaacacguacaaccaacaaaagguuccuauccaaaaucuauuuuaaaaacuccucauugauuaauaagaaaagacaagucaacagaauaggccaaagacaagcauagauacuucacaaaagaagauagccaaauggccaauaaaugcaugaaaaggugcucaacuauguuaguuaucagagaaacucaacuucauaccaaccagaaggcucaaaccaaaaagacugaaaaucccaagugcuggcaaggauauagaguaacuagaaccuucauacacugcuaguggcaguauaaaccauuaaaaccacugggaaaacuauucaacaguuccuaauaaagcugaacaugcaccuacccuuugacccaguaauuccauuucuaggacuauaccuaauagagaugcauacauuucuaccaggagacaugcaaaauguucaaagcugcauauguaauaucaaaaaaaaaaaaaaaaacaagaagaaaccuaaaggcccaucagugcuagaguggacagguaaaucaugguacagcaauacaacagaauucuaugcagcacugggaggccgaggugggcagacugccugagcuuaggaguucaagaccagucugggcaacauggugaaacccugucucuacuaaaaauacaaaaaauuagcugggcaugguggcaggugccuguaaucccagcugcuugagaggcugaggcaggagaaucgcuugaacccaagaggcagagguuacagugagcugagaucaugccacugcacuccagucugggcaacagagugagacucugucucaaaaacaaaacaaaacaaaaaaagaguucuaugcagcaaugaaaacaaaugaacagcauucaacugcaaccacagagaugaacugcacaaauacaauacugaacaaaagaugccagauacaauagcauacucacagucugauuccauuuaucuaaaguucaaaagcaggugaaauuuaacuauaguguuagaaggcaggauaaugguuaccucuggagaggagaaagcaggguugcaauuagggaggggaauugcugggggugcggauaauguugucauucaaccucagugacauuauacaaauuugugauaacuguauaugauauggacacuuuccuggauguguuacauuucaguaacaaauagaaaauuuagaaacgcuauuucucuucugucucccucuccuccuccuaccacccaccacacacacagcauggacauuuaggggcaaauaggaaaaaaaauagcagcagugcggaauuauaaaccguauccucucucccacugcaaaacagaaauagaacaguuugcaugcaaacaggagcaagaaugaaccucuguauccuccaucuugaacugaaaagcugccuagggugggccauccccagcaggagcaucccccggcuacaggaaaggggcaagacccacccagaagacagaagaggcagguuugggccugugugagugcagaacacgggggaaauggcaguaagcuccccuccagauguuacaaaaauaauucugaccuacaguuuuaugcauuguuuccggaaagcagucaacagaagaucuauagcaaagaauaccaaacaacacuaaucaggcacgguuugugcugagcuacgagccauuuggaaaaggucuuggacaaugagacuucaaacaaaauccacacugauguucaaagaguagaaaaugccaagccacuucuuagugagaacaggcguuguuccuuaucuccagcagccuagaaaagagagggaauucaccucacaaggguuucuucuguaucaugaaauagaucaucucccacaugccuuggaauagagugcauuacauauuauguauuuguggaaaagguguuuagcagagguuaggaugacccuggacagcuuuccuggggauguagaaagcugacccaggcucccuucccucugcccugaaagccaccuucaucuugggaucucagucauucacugcacccuggucuuggaaugcugcugcuccuccugcaacacuccagcuaggcaaaggggcagacaaacaaggccucuacaucauacaacagaagucugaggcccucaaaggggacuccagcaaaggcuggcagauaucacaaaggacaucgucacuaaccuggcucagagacaugguguuaagguucaugggaaugugugugggucccaucuuaauucccacugcccugagcucaacaccuagaaccugaagaauuggaggguacaaagagccagggagacccaccccucacuggagugucuccuuccaggucagucuuggagggucuguaucugauuccaugaggaagaugcccugcuggggagugagagaagcaagacucccaauggugcagguacccaggcugcccugcggcuccucaauaaugcccugggaugcaccuccccagguguuugcugggcacaacugcagaauucccaagcagaagcagggcuggaacccacagcccuuuggaaaucaaagcaagcacuuucccaaacagaucacauugccucccucacccacacaagagcaguuuggcuggcccuugucugcuguaacucaaaugcacaaugacguacaaaacaaaacuccagugagaagaaagccacauuaagggaucaauuuucccccuugcuguagcggcugagcuuuagagccacugggguaagucacauauugcgcuucauaagaccagcuguuuucacaggugagaagaauuagcaguuugcccugucuaaacugcugaaacauccucagccuuuccacaggucagguucuaagaccuggggagcauaaaauaccucuuccacucaaaaaccccagggccacacagcagaguccaaaaauucccaccaacuccaaauuuacaucagcacagugacuaauugccacuuguaauuuauuuuacaaaaaucacaaaaaaauucacaagagugagaauucaucacguccgagggaagggaaaaggcugcaagaaacaacagguucuuccuccacugugucucccaaacuggcauuggaacccuggaaauuucagauaaugccauggcuccaaauucacagacacagauucauagguuaucuaagcaggaggggacccuggagagcuuauucccaggcacugcuuccuccagccuagagccaagacugacagggacaaaguuuacaccaaaaucuaaaguggaaaggaaccugcugaauuauuauuuccuuccaagcccaagguacucaaugguucuaacaacaauagcugauucaaacccugauaacaaccuuucaguucaaaacuucugaucagcuggucagaugaaagguuuuucccaaauccugugcaauggaaaaucaggcuagagauaagggggcaugcacacacaugcaugacacucacgagguggcacgcgggaaugugcuuguaucuauguguuuacagaacaucguggcuuccuccgcagcccagcacugcucuguaccuaggccaccauccagcaagacuaccgcaggccagcccaugagugagucuuuucugaaguuaauucagcuggcuguuuaccaggcugaucccaagggauacagagauuaccauggcccagaguucagaacaagccacugaaaagaugccaucugcuaaguuauaaaaagacauccuagccacuucaaacaucgccccaacucuccugguacucucaacaagacuauguuccuuucugcuaugguuaccacauaaaagggccugaguguccccaccaacaggcugccaucaacaaagcaucaagcuacuucucugcuuugcuugcuacuucaagugugguccucagaccagcagcauggggaacaccuggcacuugucggaaaugcagaaucuuaggccccagcccauuaaaucagaaugcauuuuaacaagcucuccaggugauugauaguuuaagaaguacuauguaacuaucuaaacugauuacaaauaauuauguucauuuggagccaguagaagagauugcccuugagaagcaaggcucucuccuccuaucccauccccaguuaaagaugccacaaacucaaaggcccuuuuuuuuuuuuuuuuuuuuuuuuuuuuuugagauggugucuugcucuguuacccaggcuggagugcagugcggcgaucuccgcucacugcaaccuccaccucccggguucaagcaauucucuugucucagccucccuaguagcuggguaccacaggcacacgccaccacgccccgcuaauuuuuauauuuuuaguagagaugggguuucaccauauugguaaggccggucuugaacuucugaccucaggugauccaccugccucagccucccaaaguguugggauuacaagccugagccacuaugccuggccucauaagccuuuuagguccucucaucaaugcaggacucuaaacuucuaauuagggcaaccagcauguagcaggcacauagagugugcaggugcuggguuaggcucauugcgggcaggaucaaauuuacucuucacagcaacccuacgggagguacuaauauuauccccauuuuacagauagggaagcagguggccagaggagguuaagaugguuauucauguuaagaugccaagcuguagcacgcaccccaguagucaaauacaucacccgugcccuauucuacccaccccacaucagccugaaaggaggaaaagggaaccaacagguacccagugcccccucuggugccagcuacucacauauguaauccccaccugagcaagccccagugagccuuugagggcagcucugaagugagaacucugaugugaaagcuccgucaugucaaagggcaugcugggguuuggaagagaaaagaccuuccccuccccaucaggcucaggugacucaaaaggugaacuucaaucaccuugcuuuuccaaagcauugacacugcugucaugguguuaaccagagguuugccucucuuaauaagcagugugggugcaucgguucaugcaccaacacugguuaugcucacaagggugcuuucuugcucauggccauccugucaggcagccucucauguguuuuccauucagagauguugggucacaccaccaguaaguggcagagcugggauuugaacccagagugucuguguccaauggcaugcucuuuccagccucuccaaacccccuccugguguggcaguuuaagugcccugcauuuuuccaacaaagcugcuuccugagcucccuguguguggucaagcugucugugaaggcuccauuccagccgcccaccucgcucugaaccugucucauguuuugaggguaaucugcagguaaauucucuggagagcgggugacagagaaggacugagccgcagcugccucccugggcaggacugagaacugacagugucucaaagauucccucccuccccacaaacaccacagcagcgauuccacaggcaaaauuauagccagaucaaggacagcaacuggggauuaaaaacuuuaaacccauuagguuugcuuucagcauuugaucccaaagccaaagcuuccccagggacccacguuuugguuacaugagucaaauucuucacuguguguccaccacggggaaaccccaggaauuguccgcaucccuuacugggcagaaagcagcccaggcuugaguaaaggaagagcuggugccaggauagccaccucugaccacaccaaacccuucauuuccagagggaggggacucacuagggaccaaugcuugcccaauggagccaugggaccugaaaggccucauaagcucuucuuauauuuggggaaacugaggcuccugguauuuaagcaguggauacugacugcuuucuaggguuuuaagccaguaguucuaccuggcuucuaagcuuuaugggaaaguuaugcauggugauaaaguguaagaagcacaggcaguaacauaggguuuaaguccugccucuacugcugacaagcugugucucuuagacaagugucuuaaacacuccaagccucaguuuuccucuucuguaaaacaggaggaauaaaaguguaccuaagaagguuucuuguaagguuuaagcaaaagaauguuuauaaaacacccaucauagugccugcuacaaaguagguguucaaagaaauguuagacugcugggcaguaguaggucaaacaccuugacacucaacucaucccaguucuaacuccuggcagcacccaagagcucauagauccuuagaauugcaaaaguugucagaaucaaaauggagucacuuauguuuaaaaaaaaaaaaaaaacccugacaaauagagcugugggacgccaugaaggaaagguuuucaugcauaaacaacugauaacaagaacuagcacaaaaaaaucugcaaaaacacaaucuugcacaaaggccaucacaaccuuacacacacacacacacacacacacacacacacacacucacaccuucugugaggaaaucuaccuagcaacucucuauccaaccucaaacuggugccacccuugucacugauccuuguauccaaagauaauuaucucaaaacaauuaaguaauccucauuuuuccuuuaaaagccuuuguuuuccuuuaccucccugaauauucaugcagauuacugugacacauguauucccacugcaaugcccuauuccugaguaaacauuuucuuuuagagagccucucucuguguuugcuauuuagguuaauagaaccuuguucccuuuucuggugcgcugggcaggaauuuauucagacugucacaguaauucagggacagccaggaugcuuucaccaccaguaauauauuacaaaguggccacaauuccccauccuuccuguaucccugcucuuuucagugugacuuugcagcuucucuugucaagagaugaaauguguuucugccuccucuugauguagucuggaccugugacuuacauuggccaaaagaauguggcagaggggcaugguuugacuucugagcuuaggcuucaagaaaucaugcaagccucugauuguucuguugguacccuacccaaccaccauguguacaagcccaggcuagccugcaagaggaugaaauacauauggagcaaaaauaagcccucccagcugaagccauccuuugccagccagccaaccagcuaacccagaaguugaccacagaugcaugagugaguccuggagagaacagaagaaccacccagcugaacccaaccuaagcugccaaccagagaauaagcuacagguggugguugauuuaagccacuaaguuuuggggugguuuguuagggaugcagcaauauuguggugauagaaaacagauacgucaucaagcuaaggcaugccacuucugacggaaucuggaccgugguaauuccaucgcccacuaauucccgcuaaguccaaaccaauuauccaacuaugcagcugacaacuauugcuauggcuccucuagcuaccuggucuccuuucccucccucaaaggaaucucaucaccaaccaggaccacagacuuuuacugaaggcccugagaugggacaggcaugguggaguaguagaauaggcccuaaagaguguauccgaagucacacccaggagugugccagcuacagcuaugugacuuuagacaaguccccuggccacucugacccuuccuuuccuuuucuguaaaacaaggauaauaacaaaugcaugaucccccucccaaggcagugaugaggcacaaaaggaaaaggcagaugaaaguguuugggggaccaugcaccccaggauggccugauuugcaagaguagauuaugguauuuuaucugcaaggccaagagcagacacaaaugcccuccgaagaagcccuuuuccuuucagggcccuucuccuuuuuccuuagaaaccugauaccuuggacagggccuugauggagguggagguagggaggguagcauggcuaacccugagaacagucaguuuagcauuaaaucagucccaccuugguucaaagcacaacucuguaauuuacuuacuugcuggguaaccuuggacaagugacuuggcuucucugugcuucgggagugguagccugcucugcauaaagggaacuaugaacacagugguucuggcauauagaaaguauucauaaaagguuggcaauaauaauuuuuauccuggagagccuagguuacaguaaauggagggagagcaguacaauccacaccacauaacgcuaagucagagaaugaaauugguggaguccaugcccaacugggaaaagcagaggcacgggggcaggguccaaccuuggagugacauugguccccagcuuguguguuagggagugaaaggucagaggcugcugcccuggccuggggcucaggucuuggcagacacacugaggggaggcaacuggagaaggaggcaaggcaaaaggacugagguuuuccuuccacaucugaaagcagcaagugaacacuaaaauccaagggauagagcaaauuacagacuucuggcagaucuaagaaaaagccuugauaucuucuuguugguuucuugugauaauuuuuuuucaagagaaauauggcaauacauuuacauuuacuuuuuaaaaaaguaucccauccuggaacuguagaucuaccucccagacuuaucuggagccuggggugggagcuggagcuccccauaacaaggguggccucccaucugcuccuuggcuuuccaagagcacagagaagaaacaggcaggcaaaauucuaggauuuacaaucccaaagaucuccauuuaaaguagccaucucagauccuuuuuggaagcagacaggguguaaaugaaugcacaaaaaugcagauuuauguagagcauaacaaaaauguuagaggccacacauaaugaagagugugucuauguuagaauaucucauucauuucaguguugagugucaacacucaaagucugaugaauaaaugaaugaaucaacaaaaauacugaaagaaaacucagcaucucaagucaggaugaaaaagaccauugguuucauaaaucagaucaaguaacaagagaaauaacuacgagcaucuaucaagggcuuacugugugccguguugugcucugggcuuugcagauaucaucucauuuaaugcccccaccaaccuaaugagggauguacccuuauuacucuuuacagaaaaggaaacugagguucaaacagcugaaguaauuggucaagaucacacagcuccuaagcagagagcugaguaaggcaggcugagggcagggcuaaugcuggagcccacucucuuggccaccaggcacuugugcaucucagcagugcccccuuuuauggcacaaaaaucguggaucugguuguugcuguggaaccagggauucaaugaagguagagacaggaacacuacucagcugaaucuggaacauccacccucuaggacccauccuggugcaaaagaggugccaagacccucugcaaugcugccuacugguguguacugcacaacaccaaguuuacucugggauccacauacaucacagcacuuggacacuagauaggaagggguaggaaaggccaucucccagguggccuuaacacaccaacagaucagcuaagauggaggaaauuuguuccgugauuuuuuauuuuucuuaaaaauuugggcacauaguccgggugcgguggcucacgccuguaaucccagcacuucgggaggccaaagugggcagaucacgaggucaggagaucgagacuauucugcccaacacagugaaacccacucucuacuaaaaauacaaaaaauuagccgggugugguggggggcaccuguagucccagcuacucgggaggcugaggcaggagaauggcgugaacccagaagguggagcucgcagugagccgagaucgcaccacugcacuccagccugggugacagagcaagacuccaucucaaaaaaaaaaaaaaaaaaaagauuugggcacacaguagguacauauuuaugagguacaugagauauuuuguuacaggcauguaauauguaauaaccacagcaggguaaaugggguauccaucaccugaagcguuuauccuuuauguuacaagugauucaauuauacucuuuuaguuauuuuuaaacuacaaucaaauuauuguugacuauugucauuuuguugugcuaucaaauacuaguucuuacucauucuuacucauucuuucuaauuuuuuguacccauucaugccuuuuauuaaguguucaaauauuugaggauacaaaucauccucucacauauuguuggucacuggugcagaaguuugacucuguguggguuucuuuaauaaaguuacaaacccaggagugauucugaaacacuggccaccauggcuaccuuccccaauucagagauuccuaaauaaguggugggagccaguagaacucagaguggauggggggauaguaacaaagcagccccaggagguuagagggauacauggaauauugcagaguacuccaucuuuccugggacacuucugucuuaaugcuagacagccuuggugugagaagaggcccuucaaaugucccuggcagaaucauugggucccuguucacucagugaucaaacaucuccagaaaacagaacccuagcauccccccaagaguagccagugggucaugaauaagcauccccaaagggugccgcagagaagcuacugcuauugcaauucaauaacuuuuccaggaaagcaggcagaacagaacuucacaagacagauguuugagcgcccugaagcccccaaacucggauucuugacuuccugacaggcagucagccugggugggcaaaggcacaggccugugcucgacaacucauuagccauguaacuugggcaauaaugccucuguaccucagcuuccccuccaugaauggggauaaaaugauagccagcugcuacagacugaaugcuuguguucccucaaaauguauauguugaaaucuucaccccaagguaauguuauuuggagguggggacuuugggaggugauuaggucaugaggauauaaccuaugaaugaguuagugcccuuauaaauguggccccagagagcucccucaucccuuucacugugugagcuuagagugagaacaccacuaucuaugaaccaagaaacaggugcuuaccagacagcaaaucugcuggggcccugaucuuggacuuccaaggcucuagaucugugagaaauaaauucugucauuuauaagcaacccaaccuauaacaguuuguuauggcagcccaaauggcuaccagcugaaaggacuguugggaacauuaaaugagcugguaugaguaccaauguagauagcacuugacaucuacugaauauucagauacacuguugcugcuuuugguguuauuguugcuacuguugcuaauuuaaacucaacacagaaguccuuuuuggucagaacagacauugguggaccaagugagcccgugguuucaaagacuguagauuuuucccaaucuuggacuuacaucggcuuccuaggacuccuucuggcaaaaaggaagguugggauaaaacauuuuauucugcuuugguugaucgccaaauccacuuggcuaaaaggauuugcaguucagagaacucgguggcucagcguaaagcagagcuccuuucuucugaaauccaucaccugugacuucucugacaucagaaagaggcaccuugugagucagcugguggcaagauugcucaggauucuguuucugggccagucccaauggcccuacugucaguccugacgcuccacacacugauuacagagguaugagcaaagaugauccccagccacacugcaggccaaggagcacaucucacacccucccaacacagugauucacgcguggcaggcuccagggcagccacagaggugugggucacuucaugcuguucagcugcaaggcggaaugucagcugacagccuccagcugcagcuuucuugggaucugcugcaggauuccagcugaggcugugcucuucccagacagcuccagccaauaccugacccuggcagaggacagcuauuucugcccagugaucucuguugaguugacugagacuuuaaucagaucugcauagagucagaggcucucucugucccauccaacuuccccauuugucuuucacaggcaauacccgcccccaacaauucucucacacuccuaucucuguccuagcaucugcuuccuaaaggaugcaaacugacacaagcccccagugaaugugcauugaucucucaggcuggggugggccuugaacaaggcguguaacucuguaagccucaguuccccaaauagcaaacuggaaaccacucaccaggauguuacaaagacucaacuaaagaauauuaugccugugaaagcaucugacuucuuguagauacuaucugacgaaauucauuuugguuguuaaaauuccaugcaaccccuugaaagcaaggaauuucagagaacaccauggcugcuuuuaacaaauguaaaaacaacauuuucccugaacaaaucacaauagaaguuaucaggagaccauuuccugaacagcagcaugucaccagggaaucagagcuggcuggggcccggcccuucacacucucacacucagggccguuaaugacugguugagacaagacugucuucuugcccuggaagguucuccacugggcaagacagcugucucugcccccagccagcauucagcacuagcucagaaaacagcacccuugccagcuucuccagaucuucagagaaauuucccagaaaccccgagaagaugcuuuuuggauccccuuggaacucaggccucauauauguguuguuccuucuugagagcuugagaaagcaggcucuguagggugagugaggaccaggaacaaugucugaaaaugccauuucccuagaaaaauucaaaugaggaagcggaccuacaccuuccccuagagucuggcacaggacagaggaacucugcaaagaugcucaccacugagguuaugagaaggcagggcucccaccaccauuucuggguguuuccucagcaagacgggcagggccaggggcagcagguccuaugaucccagggcuccccuucuaaauguuuucccuucacaggaguuucucuucugccccucugaacaacucaugccugccugaggacaagccucucccccaucagagccuagaucuuaaauuucauuugagacacacaacuagaaccccacaauuuucucaccugucagauugugagcaaaaaguuuucauuguugaacccccagcccuaaauauagaucaggcccugcgguguuuuaugaguagaaagacaauucaaccucuucagcaggcaauaauuuuuaguuagauguaagcacccguuucgguuuuaguacucacauaugcuauggguugauuuuuuuucuuuuucuuuuucuuaccucuccuuuugauccuugucuagcccuuuaagacuuacaucauugcucuaaacccacacugcccaguagaacuuuccgugaugaugaaaauguucucucuguguuguguccaaugcaguagcuacuagccccauguggcuacugaguacuugaaauguggcaagugcaacugagaagcugcauuuuaaauuuuauuuuuaguuaauuuacauaccaauauaucuggcuaguggugacuacaucagacagcucaccagaacuaucuagcuuguucuuuuaauucucaaccuucaugcaaaucaaggauauguucuccuuggcuuggaauugccuccuauuccucacugaacaacacucugacaacuuuaacaaagcaaaaagcccagcacaucuuccauuuccgagcacucgcucugugccuaagcacagccgucuugaugugucccaggagagggagcaggaagcacgucuccagaaaggaagccagugcacccaaccacuuuggacuccagggcgucuggggcagagaaggaggaggggacgggguggggugugaaagacguccgcucuggaggcugcacgccagccaggcagcauuuauuuauaucacaggguguuacaguugucagcccugcagcugaguaaccgguccaugucuaaaggaaggggacagaaaucggcuuuguccauguucccuggcacuuacuguuguuguucaaaggacgccagaagacucagggagugggagcuauaggagaggaagcuggcucugggcaggcagacacucuggguguuauuagaaaaaaagaaaauugagucccuugcauguuuguauccuagcugauacaaacgucaucuggaacauuguccaggauauucugguccaucuagccauggggacaguucucacugcccagagcacagugacagcgggaccacucaagcaaguacucugagagaagcugggucuggggcucugugcucagugugauauggcuacagagcuggguucagucaccagggcugggaaaagcaagaucacccccacacuuacacagggaucuaggauccuccgauuagugacaauuuuggucuacaaaauaauugagagaaaugcucaguuaugggauuagagaagugcuaguuccaccaacagagcacauucacaugcuuugagauguacacccgcaggucccucaacaugggaacgcucuacucugccgccugcagaguccgugcugacuuuggggucugugcucucccccuaccacuuccagcacauucuucucccucccuuucccuagagacaacacaucuuuucaccuguaaaacagguaguuaauuagcaugaagcaaauaucuuagacugcaaaauauugaauuaaguaacaaagaauaauuucuucgagaagagagacguaagauacaaggcuuaauuaacaugucuucuuuuccuuucaaaguuuugcuauacugcuuuucccuuucaugucuauauuuuaccuuccucacucauuuugacgaguauuugugauccuuuuaagucacccccauguagguucuauacucuuucagugcacuagagcagcccuuugcaaaacuacucccaagccuccagugucugaauaaauuaauguauuuuucuaaaguacacacacuucacuggcacuuugguaauacauaaagaaugccuugaagcuuccauccucucugacccagcaauucuaagcccaggaauuuauucaaaggaaauaauuaagauuguccucaaggguuucguuaaagguuguuuaccccugcugcuguuugcaaucacgaauaauugaaaaugacugacaugucccucaagcaggacuagaagauccagggcucagguacugcuuaggaguaagcgaccaacaaucaguuaccaagucaaucaaccaaccccacaguugaaguuaagguacagacuuaggacagauccagaauucacaggaccugaucuuacaaauuuagggugacuaacuuuaagaaaauuaacauaaaauuauaaaauuggggacaaggcauuaauaggggccuaugcaagcaagaauccuuuggcuuaaguuucagcagccuugcacaauaagucuagccucuagaggaaagaaaaaggagaaagaagauguuggaagucacuugcuccaaaggccauaguuuaccaagccuggguaaaaaacacauucaagcauacauacagcaaaaaauacauucaaggucuaagacaaagaauacugggaaaaagggaaagagaaaaaaggauggggaggaaaauacuugaaaacaacagcaugagaacagaaaucaaggggagaacacaaucuaagaaaaaauuaagucaauauggugggugagggaggaaaaagaagcauuauuuuaaaaagauuucaguagaguuaaguuggugccugaacagcuauggggacaagcacuccaauacaaagaguagccagcuuguaucagaacaagagagggcacuuuugagcucagcagcccagacacauggguucccauggaccccugaaauaccagucccacaucucaacuggcaacaagaauaugcacagcauuacugcuccacacccacucccuaccauuuacccuggguaccaagcugaaggccagacugucuuuucccacacuggccaaaucugcucaugucacacagcuuuucuucauccccguuuuaaauccaaguaggcugaacaccuuuucucugucagaucugcucucgucucuacccauuccuuucccaggcaguguggcuuugaccuguggcccaugcaaauccacagugacaguggccuggccucucucccucuagcugucaaagagcuccaaggcaguugagccagccucagccugcagaucacacacaaugcuccggcuggcuuggcugccugcucagcugcccgcccuuucucagcagcccgcuguccacagcagcccucccauuuuugacagugcuucccgcgugccuggugccuaguguggggaucugggauguguucuucaaccucagacccugagucugcaggacacagaaaaauguucagccugcuccgcuuuaaaaggggaauuugacaaguguuaagaacagacacacucggucuuauacccagcaacuggaguaagugagagagggagauguggagcugggcgagagcuaugugagggcuuugaaaacugguucucuugaaggcugaucuccugaacagcaugauucuuagugggcuggucucagaguccccuuuuccaggaaugcuugaguacugcgauccacaaaccacccuuuuccaucagccucuguccaauacagagcagugacucuccugcauaacuacaugcugagagcaccagcaucagugaccucgaccucccugccugccaccccuaaggacgcucaggcuggugaauacacaauaaaaucaaccccggccuggcugucaccugggcccccaugaggcacgaccuugaacgggggaacuucccgcagccuaacucucucuccuaucaagaagugaccacuguguggcuguuuauacccucugguccagaggauguggccaaggagggcaccaacccccccuuagugcuucucugcugggguugggcacaagcucuguaccacucggcuuauggugcuuaaugggggagagcugcccccuucuuaggcccaccccuccggacucaggggacaacuggaccccuuggccacuauagaaacacgucucucucuuaaggcuucuggugaaggucuccgggucgaauggcccauaugagaugagacucaggcucucccaagagauaacuaccugccccaccggcggugucacugggaagugcucccucaccuuccucuucccuauauccuaggagcuucuccgcuccacuuccacccagggucuuguaggagcugggggggggggggggcgccggggcucugggcuccagugcgccccaguggaucccagacacccugccccuggggagccccaccccgcgcagcggcgcuggagaggcuauacuccuuccucagggguuccccaaaaccggggaggggugcagcuccagugccccgacuccuccaggcccugcgagguucaggaggcucgcugggccagcggcggccgcccggaggcagaggagccaaguuacuuuucgauucagagagugaagccgagucuagcugggcggcggaggagacaacucuagcggcucuccccccacgcucugggcugggaccccagggaggcacccggacgcccccgcccgccuccaggcgccgaccccgaccuuagcgggccccggacggcguccucccuucucccgccgucccccggcggccgagccgcgcgcaacggagacauuuaaaucgcccccucgggacggcggcguggaagagaccggaaaggcggcggcggcgcuggccugggggccggggcgguggccgcgcgggccagggucgcggagucgggcgggcacucaccagcgcguguugucguggaaaugcuccagaacugcguagccgaagaacgagucagcggggcccuggaagugcacggggcgcugcgggucgagguuguaggcgcccgcggggauccccgcgaccaccagcgccagcagcagcgcgcggagccucccggcgccccucggcgcagccgggccgcccauccccagccggccgccgccuuccccucugcccggcgagcagggcgccgagcgcg

SEQ ID NO: 192108 - RNA, 17780 nt, Homo sapiens
gcuuuuguccuguggccuucuggccaaaggcagggaaagguggccaaacacugagaccaagaacaaagaaagaaaacugcugguggacuucuuccaccaugagcaggccaccaagcccgcagcacugcacugcagcccccagcucuguccugggguugggggaggugaggaggggcaagguggggagcacacagagcacccgcuguccucggaacaccacagcgacuagagguaagggagcaccggauguggcugggaugugggcagcaaggggccagaggggccuugaaggggucacagaccauuuaaugaagguguauugaaggccaccaugggccaggcccuaguuagggauggaucagaauuauauagcauaugccaggggucaggcagguaaugaagugaucggaaggugaugaggcaguggcaguugagauucacguugcagucgccccaagcuggccaggccagggagcagaagcauggcuggaugccggagcccaccaggcuccccacugcagggcaagaguggcagggggagagacugugaaaggagcauaggccagguccugggugaaagcuguguccucagccuugacugauggguauagggagccacuaaaugccuuggggcagagaggugaggaaaaaaauauuuaccgagcaucuacaaggugcaagguacucacuagaugccuucaguaccaaagcuucucaaacuuaguaugcauaucacucuucuaagaauuucauuaaaaugcagauucuaauucagcagauauagggcagggcuugaggugcugucuuuaauaagcucccagugccugggacugcacuuugaggagaagagcugugugugccccagugugguccagugaguacucugggcucccucucgugggcagggaagcugagggccccaugagcucucccagcuuccugaaggcuccccauuaaugagagcugacugugcugugcuuugcugacugcagggccugcucccugccccccaccuccagguugggguaaguggcaccucucucccuccagcuccgcagucuucccugagguuuagaucuuccagguuuauaaagucaggcccuccuguuggcagcuggccuccacccuggaguaucugagcuugccuguggcagcaucuaaagauagucucccuuacaggaaacaagauacuauuggcuaacucugcaaauaaaaugcucuuagagggaaggaaagggaaauacucgucucugguaaagucugagcaggacaggguggcugacuggcagauccagagguucccuuggcaguccacgccagguaggugcacaggacuaguuggguaccugugggugggguggagcaguggacagcuaauagguuaauaaugccuguuugcuuacgugcagacaauggaaaccauuuuccuggggauguuguagccuaaauauguccaaggggauggaagagugggaggcaaggggugaucagaucauuuauaauacacucaaccugguggaauaguauuagaagcauuaguaauuacauuuuagagacauggagaaaagcucaugauuuuaaacuaacugaaaaaagcaugaaaaauugcaucuggaugcuguugaggaauuauugcuaauuuuuugagaugagaaauuguauuaaagucuuuuucaaaaaagaguccuuaacuuuuagagaugcacacaaguguuuaugggugaaauuaaauaauucaguagagacauuaagugggaaauagaggaaauauugaccauggguugcuaauaguugaagccagguguuggguauaaggagguucucgcugcuuuuauuugaaaaguugcuuuuuauuugaaaauuuaauaauaaagaguuuuuaaauuuguaucuguauuuuaauauaaauauaaaugcacuuaauauaaauauaaaauauguauaacauuuagauagagaaaagcuaaaagauuacugugguugauucuaggaaacugcauugcagauaguuucauggguuuuuuuuuccuuuuucuuccacuuuuuguaccaucuauggguuuuuguuuguuuuuuguuuuuuggguuuucuuucuuguuuguguuuuguuuuuugagacggaguuuugcucuuguugccuaagcuggagugcaauggcacagucucggcucacugcaaccucugccuccuggguucaagugauucuccugccucagccucccaaguagcugggauuauaggcauguaccaccgcccggcuaauuuuguauuuuuaguagaggcgggguuucuccauuaauaaauuccuggcacaaauuuaguguucaauuuugauauauguuguuauaaccauugugaggauacucaggcucagguuuguguggguggaaaacauggucuucagaaagaaauuaugagugcaagacaggaggaaauccaucagaggccccagcugaggacugaccacggcuuguuauuucucuugccuugccucuggcaaucacagccucacagagccugcaauccuugcuuugugaguuuauagcucaguccagagaauggcuaagaaaguuuaggauucuuucaacacccacuccacaaaaaaaaaaaaaaaaaagaaaagaaaaaaaaauuaauuuuugaaauacuugagguagaaaacuugaggcagaaaaaaauugagccaaaaaaaaaggaaaauugaaccacgugaaagcaggcaagaaagcuugcauugcucagggcaucccaggcccagagggcgcuuuggagggagcuggguuuccugagaggaggcagggugggugacggaccugugcuggagagccuugaggaccacuguggguugggaaugggggcaguggauugggguucaaaaccccugggaaugagaaaugggcucaggaaggcuaggguggauucuuucaucuuccucuuugcuuggcuuuauuuucacaaaggaaggcagggcaggaaauagucucagcccaacuucagugugguucuucuuagugcucaggcuuaccuggcacuugccacaccucugggaugggagcaccuacuauccaucagccacgugccagucuccacaaagucugcuccugaacccugcuccucagcuggccccacuucacagauggggacauaggcagcuuggcuuuggaaugaaggaaugaagucaggaaugaaguccuggcucugcacuuggugacugugcacugggcuugcuaagucuguuuccugcuuuuaaaauggagauuguccaucagccuuugaagccauguaauggguaugugucaacuuucugcaaggauuaaaggcaugguauaggaagucccaaacacacugccugacccaucuuugaugcucaagaaacgauauauguuguugucaugaggaaacugagccucagaaaguuuggauaccugaaaaacacugacuacuauugaaugagguugugaagaauccagagcuguaggggcaggaaagcaaagaacguauuagagcugacccagucaggacgaucgucuauccccuuccucaccccaccccaucccaggaggaagccugcccggcccuaggcagcuauggcacaguggcaaugucagguaugguucucccuagccagagacccuagccucaaaaaaccuccuucuugggauccaggcauccaacugcuccuccccagccccagccucugacccaguauccugaguccagagacguuuggaaccagcaccuguaauggaggagcugaacaaggaggggaacuucugcugcuccacagcaggucacggucauaggagggaguggaaccagaauggcagaauccagaucuuggcugccuuucccaaggacuuguucugauuccuagcagcacagcccaggcauuccgagaaguugggcucucuggcaucacucacucugcccagaagagccaggggaaaguuggggcuucuagcugaaccuugaucccaccugcccucuugaggggcucagaaucugcuggcugcuucacaggugggauucucacggcacgcuggccacagcugaugcuucgacccccucaucuuguuuggccaaagugcagcuuuuuagcuugugaguaaggaagaaaagcuguaucauaugucuuuaaacaucuuccuagaccaccuuuguuuuccccuuaaagugugcuuaaggagaaaauggaaagucucuuuucaguguguuguauuuuguuuauugcaaaauacaacacacugaaagaacaaugucuggguuagcaaaguauuagauuuaauuucccacauuacuaccauccaggcugagaaagagaaccccagaagccucucucaugucccuuccugaccacagccucuuccucucccacaaagaaccacaagucugacuucuauggugaucacuuccuugcuuuucccuauaguuugacugaaucuaaauaucaucccuaaacaauauagcuuagcuuugccuauuuuugaucuucauauuuggauucauacuuuuugguuuggcucaagacuaaacuuuuaaaaugcauccacguuguaggagauguacaugcacaaaaauuuucacggcaacauuguccaaacuagcaacaaacugaaagccaccuaugugugcauuagcaguagaaauggcaauaaaucauggacuagucacacaguggaauccuacgcagcaaggagaauuagcagucuacagccaaaccaacagcaugggugagaugcuuccagaaauacugagaugaauuuagagauaaaggcacaauugguccauaucuacagggcacuuaauccagugcaucuccacuagacaaaauuuguauuuccaugagcaagagucauuugcacugcuaucugcuauaaccuacggugcuguaaaauuagcucaggcaauaaaagggggagguagccccaaagaguaugccagaaaggacucccaguaaucuucagugugugucuauuucaaagucuuucaucauuuuuccuuguaguuacuuaguguggaauuucagaccccucucuaugucccucuucucccuuuucagccuuggcuuucucugcauccuuccccgaagcccugcacucagccuaaacugacuuuccugaacacucugggagcaugugggcuccucccaacuccaccaucuucacugccuucuguuccuauuucccucugccuggccuuggccccaggaaaccuuccuaugcucagacccucugugccuuugucuucaaagcccacccacuauucacugccaccuccaucuuggucaaccuggaagacuuuccccauccuuaaaacaucagcucaaacggcagauuuuuuuuuuuuuuuuugugauauccucuugaucacccucccccaguuuuuaaggagacagauauagagguucaauccuugggcuucccaugacuuuucuuauauucuguuacugagcaauaauaaacacuucuaggaacuguaucuuaaacacuuuugccucuacagaaucuagcacagugccuaguauuggugaaauauaauuaacaaagucuucuuucaacacagagauucucuccacaaaaggaguagagaaagaacaguuuuauuauggaauaagcaguaaaccaaaauaugcagagcauuauaggccaucuacuaagagguugcaagaacagaaagaaaucucccccuuuuguauagccaaguagauacaaccuguuacauacauguuaucaaggcaaacaauaacuguuccucaaguaagaggucuugccagcaccguuugccguacaugguucacucuaaauuuaccugguaauuaggguaaccacuuguguuagcuaacuggcucuacccagaggaaaaucaaauuuaucuuuaagacaagggguaauuuugcagcacugagcaaggcucuucaguuaggcucauaccuucccacagaaacuaagagauagaagcacuaucucccuuagguuuguuuacauuucaaagagaugacgcccagguccuugggaaagacuagcuuagcucauaaagcugacaaaaagccuaucuaguuucaaaaggauuuacacauguucaaagagaggagaaaguauguaaaaguuuucuaggugggcacgguggcucacaccuguauucccagcacuuugagaggcugaggcggguggaucaccugaagucaggaauuugagaucagccuggccaacauggugaaaccuugucucuacuaaaaauacaaaaauuagcugggcaugguggugggcgccuguaaucccagcuacuugggaggcugaggcaggagaaucacuugaacccaggagguggagguggcagugagccaagauggcaccauugcacuccagccugggcgaugagagugaaacuccaugucaaaaaaaaaaaaaguuuucuaaaguaaaugcucugagaaaaaaacagaaggugaggagaucucuguccuuauuuuuaacaagaauaauuaaauguuuuuauuuuuaauuucuacuuagacuagaauaugguacagaugcucaaaaauauugacuuaauuaauaauuaaacaauuaacaagucuaucucuuuccuaauuauuaaaaaaauuaugaaguauuucccuucaaaauuucacaguuuacuuugacauaaauaaauaaauaccauaaaguauuuugaagaggaaagggaaggguggggcuucaaacacaaaauaauggcagguuuuguaaaggggcaauucacuaaacccaauaggauucuccuguugcuauuuuuuuuuuuuuuuuuuuuuugguggugguuggagggaaggguugggugugcauuuggccugugugaaaaacugguggguagacaaugccaugcuguucuagaugggcucauugcuauaggaauagauagucacugaauuuacuugcauaggggaugggguauaaaauguuuccuuauagcuccuuaacauggaauucagcaccccucuccccaucagccuuagcucucucugaaucccaagggauauguguuauaaaaauagcugccaucauaaaugagaaaaccaucaggaccugguaaaacuuggcuucccaaacagucaggggucugggcauggcagccgacugagaaccuuucuaucuaguacaagguaaacaagauuugccaagacuugaucaacugauccagcucccuaucuccaaacagaaccucaucugaaugcucacaggcugugccccagaaguguagaagugucauguucccugggcaggcugcugggcagccucucuguugacaauagaccacacuuuugcugaccuaggacucauguugcucuuuaagacugcuuccuuggccaggcaugauggcucacaccuguaauccuggcacuuugagaggcccaggcaggaggaucucuugaggccagauguucaagaccagccuggucaacauaguaagaccccauaucuaccaaaaauagcugggcaugguggugcacaccuauacucccagcuacuuaggagacugaggugggaggauugcuacaucccaggaguucaaggcuguagugagcuaugaucaugccacugcacuccagccugggcaacagagcgagauccugucucaaacaaacaguuuccuucuguuugauucuugcugaaaaauugagcaugccagagcuagcaaggcucuuagagguggucugguccaaugcuuuaauuucauacaucaagaaacugaagcagagcagagugaccugcccagggucucucagccauucaugcucagaaauguaugggcuccugugaaacauguggcucuuaaaagcacuaucauauauuugaaggcagaaaauaggcuaaaccuucagccuucagacuuuuccucuccagagaaaaugaccccaguuuccucacuaugguugcugggagcuagauuccuggggaucuggcaguguggaccaccuagugguggcuagaggagcaaauaauaucccgcauuccauuuuccacucaccaaucccugaggggcagccugcuggguuaugagcccacagggggagaaccccaacgaauucagagaugcaucauggaccaguuucucuuaaggggccugggucuacuauuuucaguucuacuucgagagaaguggccugcaauauccugcagauuuccccuccagggagaaaagcauugugcggugcaaggagcacaggcuuuguggaaagaggcaucugggguugagauccuggcucuuuugcuuccuugaacaaguuaaccaaaucucugggccucugcugguuaauuuauaccauggggaucaucauuucuccagugggguugugaagagaauguggugggaucuuguguguggagcaugacacuuagcaggcauccgggaauggcagccuccucccuuucuaaacuggggcuuucugagggugacuucagauuccacaaugucaacagcacaauggcauccucauaaggaaaguuuggguuggggcuccucaagcaauucucuacucucauuugguacaaagaaaaaaauuaagccucacaauuuucuuggcaccagacugaaccucaaacccagucuucacuuuuacuaaaaagccauaaacagagaccaggaggguaaaaacuaccagaagauacacuggauuuagaaaacaguaagcuggaugugaagccaaaagagagggagaaagcaacauaaaagaaugucagauugaagaagaaauggauucuggccaccuaaagaagaagggaaguauagaaaagggaagcugauuggaaacaauggguaaugaugagugucccuccccuaaaaaguuaaaaaauaaaugagcaggcaugagaaaaggaaguaggccagaggaaguagaccaggaucagccacggaugugaguggggaauuuuacaaauuucuacuugggugugaaacauguguacacucaaagcucugucuagguucaccgaaacucucccagcucaaggccauuuaguaaaaccuuggcuuaacugaauaguggguaaggaggccugaggauggcccagagaagguuuaaauucuuacuggcugcugcacuaaguuguaaagugcagccuuaguugaugaugccuuuauuagugcaacaucccagaaugcaugcgucuuacaacccuuguggauaugaaacccagcuggguagacacugcaaagucuucucauuugauucuuccacuugguuucuagugucccucagggacaaaggaaagccaugguccagucuaagaugaaaaccaauuagaccucuggcaggccuuugaccacccugagggccacccccaaggcacggccacacucgcaucugcugccaggaggcccuaucuuaggcucagcucccaaaccuugaacaucuuggaggauccacaaauaggagguacacucagcucaggcucagucuuccuuaaaaagcgccuugcuaaagcuaucaaguucacuggaauacuucugcgaaggacacagcuucagcgaugucagauuuuuuauguaaauggugccuucacaugcucuggggcauuuggcuaccaagggcgguuugaacuagcuccagcacacagaauacaagucucuucagaaccaggcaaaacccuauguugcccaaugacuccugcuguuucuugagauuugcacagaagacagagcugcaauuacccacgcugauaucuauuucaugaccacauauguucaaaagccacaugugagagguaugguugaaaugagagguuguguuugccaaguugucuucugacuguggagagcuggugagccucuucucaucuccuggggcuccauauuauagagcugacgaaucucuuuucuugcuccuugaagucuuucauucacuuauuuauuaauucauuuaacacaucaggcaccuacuaacuucucagaguucaaggcuuccuagccuaugaucagaaaggacaccugugugcucaugagcaccccugggaucagggugacugauagggugcugucaucacuacuagaugaaacucuuuggaacaaaggucuaggauauaauauuuauccuucugcaaauauucauauggcauucgcuguguaccaggccuucuguugaacauuggccugcagagcugaagaggacgugggucuucucuuaggaacuccuagucuugggaaaaaggaauggggaagggcuguaaugugaaguuaaaaaaaagugcugaggccgaacacaucugggcccucacugcagcccuauugcacacacacugcaucaccucgaacaaguuauucacccucucugaauucaucuauuugcccauaaaaauagagaugauccuuuuauauguuggcuaccacuuauuaugugcagcaugcuuguuauuguacuaaguuacucauuuuuuaguuuuucauauaacucauauuuuuguugauuuuuauuuuaaaauuccaaacgaauuaauuaaacuauuuuccaaaauacguaguauguguacaugguaaaaaacauuuccaaaaguuuaccauaaaaacugucuccuuucccauauccucaauccuucagaaucccucuccagggauaauuaccaccaccaguguauuccuuaagagauauuuaaacuuuauacaaaauacgcacacaucauucuuuuccacaaaugacagcauacuauguacaugguaccucaccuagcuuuuuucacuuaccaguauaucuuagagauuguugcaugacagaauauacagaucugccuguuuuuguuguuuuucccaaguuuccaagagcuagaaacuguuugguuuuuaagcagcugcuugguauuccauuaauuggacuuaucgugcuuugaucugucccuagugauggacauugggguuguuucccuucauuuauauuugaagcuuguugcagugacaguguacacacuugcuugagcaugugugugucuacgauaaaucccaauaagcaauuuaaaguaauuuaauucuuaugcucucaacaaaccuaagagguuauuuuuuuagaggaggaagcuaaggcuguuguuuugaugccuuuuuaccacuggacuugggacucaacuguuugauagucaucgaguccuugacucuucuccccugccaggauuuggccccuaagcccagggcccgagucuccuccaucuucaagggagagugggaacagcacaggccuuggccucaguccugcucccccugcuucuagcugugggaugggccaggugcuucacccagcugugccuccugugaggcacagugugugcaaaauggaaaugugaacaugaagaucaaaaaugucccucaaugaccagugcuguuccucagagucacgugggaacucauagaaagcgauauugguacugcucuuuccucuguagcaugguccagauggcucauagcagggaccaugauaugcugggugagcacccacugcaugcacccacugugccagcacugagagacuccugugggagccacagcaauucuagggucuucacuggggacucugagacagcagggagcuaggaugagggcugcagaguguucgucugcccucacugagcagacccccuggauggcagggagcagucccaagccagauggaugcccauaaccagccauuuggcucucaauacauaauaucaccacguaucaggcaaaaccauccugcccagagcauuaucugaauuugcaucccaucugcagaagauacauucacccacuucuuccauucugucuuaaucaaagucuuuaugugaauuuuccccauugagaagacaagccccuuccuggcuuagacuguaccugacugaucuuuucaugagcuccuugccaagccagaccacccccagcuuauauggagacuuggugcaaauuagagaugccccugugcacguggcagcccugagcccaagcacccaguaaggcaaagggccugauuugggaccccucugccacuccaccaggcaaucaguugcuuauuucuaacuuucccuuccuucuccacauuugucccauuccuuccucucaucaugaauauccccagaggcauucagcagugcagugaauuaaauauagaacuuuuuuuuuucagaauugcagaacggauuagaucaauauuaauccaaacagagcaaugagccugacaguuuaguaaaagcucaauaaaggguggcuuaccucccccaaaauaaucugaaaagaaagcaugucuuauuucagggggaaaaaaaaauaaagugaccuuuaaagaccaaauucccaggauacccaggguggagguggaacaugggaguccacaggcagccuggauguuuccaaagauccaaagggcuuuugcuuccucacauaaugcaggaaacaaauugaacauguauuaagugcuugcuguaugugacacacugugccaggugcuccccuuaaaacaguucugugggcaggcaugagaaugaaucccgaucuuacagacaaggaauguuaggcucagagguuucaagcucacccaucacucagccagagaggacagaugcaggauucaaucucgggagugcccgaguccacagaaguuccugugcugaaggaccgaccacaggcacauaaagagaugcgagacaauuuuuacuggauuuggccaccucucgaggucggcuuugccagcucuucucacugggggaaggggagggagaaaguagcuagcuccagggucccuaacauagaaccaccaaggacuugacuauuuuuacucauacagcagcuugucugggaagaucaugcucugugacaagcugcaggcacuaaguagcaauuucuguuucccacauauuagcuugagucauauaaaacugacauggauguggcucaaaaauagcuguaugucagccauuuuauaccauuugacuuaaauguuauuaauuaacgucacagccagagauuauucucugagaaaagggcauuguagccugaagcagagaaagcauacacguucccugggguugagaacucaucacagccugagacagcuuagguuguaaagccccggcccacuuaucccaggagagucugggugagaugcaggccccaaagcagaggcugggaagcgagaagugacacacccuggcugggugggcccucaucuuggugagacaccaccuggguaaaaccaucauggaaaggguguaguggggcguggaaacucccucgguuaaagcgugagcuuugcuguaaguugugguaaggagggaggcagugacaaccaggaggccuguuuugaggguuucugagggacccaucugugguaucacgaggagacgcccagaggagccgugugaaagggcugccucccagccggcucuggagugaaugagcagcaaguccuggcugcgaaaagaaggggagugcagccugcagaagugucuucuuuuuucaauuccugcucagaaggaaacaggagauaagaauaguggggaaguccaaaccaaagugaacuauagggcugguaaucguagggggaauuagucacccggagacuagcccagcagacuaacggagccccauccuccaucuugaaucagucagccccucuaugacugcagaguccugaaugauggcaacaccuucucuucacuuagcguuguaggaugaccaacaguccugauuugccugggacugagggguucccaauagaugggacuuucagggcuaaaaccaggaaaguccugggcagcccaaaacaagguagucacucuagaguguaugacucugucugauaccugcuaagaaagagaaggacuuguugauuauaaggagaagaggaggugaaaugguucucaaaaaacaaagaugagggcuuccgggugcuguucugcccaaggcucugggucugaggcuucucucuccaggccuagcuucauggaaaaguaaggggccagaggguggaaaagguggaaacaaaggaagaggauggagaauugcuuuggggaaguuuggacuggaagugugaauuacagcugcacccccaauucaccccaucucaccccccucccccuccugcucaugguucucccuuucucauccacacauuggucaaacuagcuagcuuuuggagagauuuugggcaguaaaaguaaaacagaucugucucaagcuucaaaaagccuagagcuggcugggcgcuguggcucacgccuguaauccuagcauuuugggaggcugaggcggaaggauaaucugaggucaggaguuugagaccagccuggcuaacaugaugaaaccccaucucuacuaaaaauacaaaaauuagccaggcgugguagugcacgccuauaaucccagcuauuugggaggcugaggcaggagaaucgcuugaaccccaggggacagagguugcagugagcugagaucgcaccacugcacuccagccugggugacacagcgagacuccauuuaaaaaaaaaaaaaugccuagagccaaaugcucacagagccauuuacugcauggcuuugggcaagucaaaggaguccgccucuccugucagaagagucuguugcagucuucaucacaagacuguuguggggauuaaacaagauggcaagugggaaguugggaaauguagugugcacccaaccaauauuuguuucuuccugccugccuacauaugaggccacacagaauuccaacuuuguuucucugauaacuaacacaguuacuuguuuuucuuucugauccaggccuucaccauggaucaguucccugaaucagugacagaaaacuuugaguacgaugauuuggcugaggccuguuauauuggggacaucguggucuuugggacuguguuccuguccauauucuacuccgucaucuuugccauuggccuggugggaaauuuguugguaguguuugcccucaccaacagcaagaagcccaagagugucaccgacauuuaccuccugaaccuggccuugucugaucugcuguuuguagccacuuugcccuucuggacucacuauuugauaaaugaaaagggccuccacaaugccaugugcaaauucacuaccgccuucuucuucaucggcuuuuuuggaagcauauucuucaucaccgucaucagcauugauagguaccuggccaucguccuggccgccaacuccaugaacaaccggaccgugcagcauggcgucaccaucagccuaggcgucugggcagcagccauuuugguggcagcaccccaguucauguucacaaagcagaaagaaaaugaaugccuuggugacuaccccgagguccuccaggaaaucuggcccgugcuccgcaauguggaaacaaauuuucuuggcuuccuacucccccugcucauuaugaguuauugcuacuucagaaucauccagacgcuguuuuccugcaagaaccacaagaaagccaaagccauuaaacugauccuucugguggucaucguguuuuuccucuucuggacacccuacaacguuaugauuuuccuggagacgcuuaagcucuaugacuucuuucccaguugugacaugaggaaggaucugaggcuggcccucagugugacugagacgguugcauuuagccauuguugccugaauccucucaucuaugcauuugcuggggagaaguucagaagauaccuuuaccaccuguaugggaaaugccuggcuguccugugugggcgcucaguccacguugauuucuccucaucugaaucacaaaggagcaggcauggaaguguucugagcagcaauuuuacuuaccacacgagugauggagaugcauugcuccuucucugaagggaaucccaaagccuugugucuacagagaaccuggaguuccugaaccugaugcugacuagugaggaaagauuuuuguuguuauuucuuacaggcacaaaaugauggacccaaugcacacaaaacaacccuagaguguuguugagaauugugcucaaaauuugaagaaugaacaaauugaacucuuugaaugacaaagaguagacauuucucuuacugcaaaugucaucagaacuuuuugguuugcagaugacaaaaauucaacucagacuaguuuaguuaaaugaggguggugaauauuguucauauuguggcacaagcaaaagggugucugagcccucaaagugaggggaaaccagggccugagccaagcuagaauucccucucucugacucucaaaucuuuuagucauuauagaucccccagacuuuacaugacacagcuuuaucaccagagagggacugacacccauguuucucuggccccaagggcaaaauucccagggaagugcucugauaggccaaguuuguaucaggugcccaucccuggaaggugcuguuauccauggggaagggauauauaagauggaagcuuccaguccaaucucauggagaagcagaaauacauauuuccaagaaguuggauggguggguacuauucugauuacacaaaacaaaugccacacaucacccuuaccaugugccugauccagccucuccccugauuacaccagccucgucuucauuaagcccucuuccaucauguccccaaaccugcaagggcuccccacugccuacugcaucgagucaaaacucaaaugcuuggcuucucauacguccaccaugggguccuaccaauagauuccccauugccuccuccuucccaaaggacuccacccauccuaucagccugucucuuccauaugaccucaugcaucuccaccugcucccaggccaguaagggaaauagaaaaacccugcccccaaauaagaagggauggauuccaaccccaacuccaguagcuugggacaaaucaagcuucaguuuccuggucuguagaagagggauaagguaccuuucacauagagaucauccuuuccagcaugaggaacuagccaccaacucuugcaggucucaacccuuuugucugccucuuagacuucugcuuuccacaccuggcacugcugugcugugcccaaguuguggugcugacaaagcuuggaagagccugcaggugcugcugcguggcauagcccagacacagaagaggcugguucuuacgauggcacccagugagcacucccaagucuacagagugauagccuuccguaacccaacucuccuggacugccuugaauauccccucccagucaccuuguggcaagccccugcccaucugggaaaauaccccaucauucaugcuacugccaaccuggggagccagggcuaugggagcagcuuuuuuuuccccccuagaaacguuuggaacaaucuaaaaguuuaaagcucgaaaacaauuguaauaaugcuaaagaaaaagucauccaaucuaaccacaucaauauugucauuccuguauucacccguccagaccuuguucacacucucacauguuuagaguugcaaucguaauguacagaugguuuuauaaucugauuuguuuuccucuuaacguuagaccacaaauagugcucgcuuucuauguaguuugguaauuaucauuuuagaagacucuaccagacuguguauucauugaagucagaugugguaacuguuaaauugcuguguaucugauagcucuuuggcagucuauauguuuguauaaugaaugagagaauaagucauguuccuucaagaucauguaccccaauuuacuugccauuacucaauugauaaacauuuaacuuguuuccaauguuuagcaaauacauauuuuauagaacuucca

SEQ ID NO: 192109 - RNA, 48425 nt, Homo sapiens
aaguggaucuucgcugaggacucaucaaaaacaccuuguguaaugaaaaacccagaucuauaaccucucccuauauauucugcaugcauugaaguaggcucaaacccucagggaccugguauagacgcagaaucuguuucacacaacaacugcuauuugaagguaagaggauuccauugguuuuuauuuuacuucauuuuauacuuucaucuuuaaaugacaaguguacuuuuuuguaugggccauuucauuauaucccagggaaaacuuucuguaagaauagucaagauugagaggacauacaaggauggagaaaacaagaacagaggacaccauguuuauucugaugugggcagggggccuccuggaauguuccugcuaauguuuggaaaucgucugagcccagagagaggcucugagcccuuacucagauuuccucagauucaaagccccauguuccuggagcuagauggaugguaguacaugcugcugcugcugcugcuuuuuuuuuuuuaauuuauuucuucuuuuauuauuugucaugauuuaaaaaugaguuuuucuucuuaucuaggaacaauuuuuuuccucauacaguuggauuuaugugugggggaucuuaauggaacaacaaagcccaaaucuuuucggaauucugcccccuguagaccaacaaccuuaaauggaaaggcgcuaaugcuuugucugauacagaauaucuuagaaacaacagggaguuuucaguucuauggaugacagagaaaggaaaaaauauuaugugucagggaggcgaguaaugaacuuggccuacaguacuagcaggaaaacggggaaaggacuuuuuaauucuuugugaauaaaucagggaggcagagagcaggcugcugccaggugugcggauaugcuguuucguauuuagaaugacaggaaacuuguuggugagugaguuuuaaaaauuguuucagauuuucagaaaaguugcaaacaauacagaaaauuucaggugcagccaaauuacccagauguuccuguuuuaccauauuuccuuuaucauucucuuucucucucucuguauccauacauauggguguauauauaaaaauauguguguguauauacauauauacauauguguguguauauacauauauacauauguguguguauauauacauauauacauguguguguauauauacauauauacauguguguguauauauacauauguguguguauacauauuacauauguguguauauauacauauauacaugaguguguauauauacauauauacauauguguguguauauauacauauauacauaugaguguguauauauacauauauacauuguguguauauauacauauauacauauguguguguauauauacauauauacauauguguguguauauauacauauauacauauguguguauauauauacauauauacauauguguguguauauacauauauacauauguguguguguauauacauauauacauauguguguguauauauacauauauacauauguguguguauauacauauauacauauguguguguguauacauauauacauguguguguguguauauacauauauacauguguguguauauacauauauacauauguguguguauauauacauauauguguguguauauguauagauauauauacauauguguguauauguauauauacacauauuuauaucuaauuaauuuuaauuaaaauuuauuuuaauuggaauuaacuaaaauuuauuuuaauuggaauuaauuaaaauuuauuuuaauuggaauuaauuaaaauuuauuuuaauuggaauuaauuaaaauuagaaaauuacuauugagaaaauacuguuuuuaaaucuagagauaucuagauuucaucaauuguccaaggagcgaauugagaaccaugcaugaccuuuuguuguccuguccccucagccuccuuuagucuggaaccacaccugaggcagcuuugaccuagacaguuuuggagaguauaagccaguuauuuugcuaaaugucccucaauauggguuuggucugcaguuuucucacaauuaugcaguuuucaaaggaauaggcuugcauuuuagaucauacauauccaaauucauacuugaaucugaguauacaauuuuuaaauucaagaucuuguuuaccuaauaguuacuaggauuuuaaaugaguaccuaaaaucuuuguacaccaaauugccaaaaauuaaaaaucuagagcuuuuacagauaauuuccaaggaaucaccaaaaguguguaaguauugcccuuggauuauaaauagcaauuacagugaccuguaugugaucuuauaggcuuaaagugagguauucaauuuagauucuuuguguguguuggagucaugucuacugcucucugaguauuaguuucauaaauauaauaauuccuuucuaagugcaaccaucugcugaaagcagauacaacucaauagaguuucccuggguagccacuccaggcuggcuggcauccuuucgcggguugacggggacgucugcccuaguggaggaggcggaccucuggcaacgcugcaaaaagucuccugaucaaaaguguuuccuacauguucuaguacucacaccucagcacugaacuacagaccacacccauauugagggacaacuagcaaaauaacuggccaaaacuguuaaaaacuguccccuuauggggacaggaaucaaaacucugagauccuucagcuguaccagacauucguaaaacaagucuucucaacaaaaucugugagguaggaacuaucauucacauuuuacagagaagaaaauugagauccagagacuagccuaugauuacacacagcuagugaaugacagagccuggaacucaaguaugauauaagccuauugaauuuauggaugagaugcauuauucuuuuuuacuaauacaucacacacuuuacuuuaaaguuacaaaaauuuaaguuaaaaagaugagcugaaaaugaacuaagcaauauuuuaaaauaauuuuuauuaaugguauaaaauuauuuguacucacuaaaaauaucaguuguauuuuuaaugagaguaauugaguucaaugucaaauuuaguuuuuccuccucuuuguuaauuuaauaaaaagaucuuccuaguaguaggggcagaguuagcucugccuauuaaaaaauuaauuugggcuuauauuacuaccaguaugaucuuaaaagucuuaaguuauucacuaguuccuuaugaaagaauaaguucagcuaaaacagcuaaaaaccagaagauauaaucaacaaauccacucaccaggcucaaucuucaauaauuuucaguauacugagagcaaagggacaagugaaggcacccagaugaccauccauuguucagggcguggcuagcuaacuugugcugaaugaggguggcaggaucaacccaugcauuaaauguuaaauguaacaaucucauuuuuaucuuuguagauaacacauaugaaaagaaaagucuuuuuuuuuuuuuuugcgauggagucucacucugucacuaggcuggagugcagugcaccagccuaguggcucacugcaaccucugccucccagguucaagcgauucuccugucucagccucccaaguaccugggacugcaggcucgugccaccacgcccagcuaauuuuuuguauuuuuaguagagacgggguuucaccauguuagccaggauggucucaaucuccugaccucgugaucugccugccucagccucucaaagugcugggauuacagacgugagccacugcacccagcaaaagaaaagucuuauaccucaucuuucugaaccucagugaaacaucuugggaacucccauggguaggcacaucugcuuuggagaccacugggcugacccuuccaccuuaacaauucaauuacaccaggauaugaugggcugacaccaaacuccucuugguauuucagucucugucaaccccaagucuggaacgucuccauuccaaguucuuuuccagcuccuccucuggcaugaggcaugaguccuuucccagcuccucuucuggcaugccggcaugccccuccugcacuuguuuccauucagcucugcauuaccugcuacaauggcccaguggccacauccagagagcuaguaauuacgcauagaaggaaucuaacauguacugagauauagacaccacagcgcucccaagaagcaacagguguguggaggcauugacucagcuaccagauccaccaccucugcaagcgcagagcagaguucauuucuccacacaauguuugcacgcagguggaugagggcuucuggugucuucaaguccaaaggguuuucuauaacuacuauagagaaccuuguggugguuuccucagaaucaccaagguuaacuucaagucccuaccccuugggugccugguagagacagaacucucauuuccuuuguaaguaagagaaccucuguuuggaaguggcuggcaguuuuaucauuguggagauagaggcuuugacuucccagcagacuuccuuuacuuugagaagauuacuaaaaugaauuccuuagauuaacaaauauaaaauauccauuuuuuuguuuuuguuuucauuuuuugcagagaaaacacugaagucacaaaaaacuuaaaugcagggcaguugguuaaccuauuguaugaucuuuguaguacagugaacauauuguggcuuuaauaguacuguucccuggaugacauagauuaacuuuuuucuccuaaauaucgaauuagguuaaaauuuugggguucuguacauagugcuauuuaauauugaggaacucaacuacugggaaaauguagcauuagcuauuaugacuguuucaucugggccguaaaagucacucuguaguuugauaaaguguuuucuacuuaaaagacuacucgaaggauauucccaugauggaccauccuggagugaaaaaugagggcccccuucucucacucagccaaaaaauugggcgccacuggccaggcaugguggcucaugccuguaauccuagcacuuugggaggcugaggcaggcagaucacuugagcucaggaguuuaagaccagccugggcaacauggggggaccccaucuccacaaaaaauacaaaaauuaaccaagcgugguggugcgugccuacaguuccagcuacuuaggaggcugaggcuugaggaucauuuaagccugggaggucaaggcaguaugaagacauauucgugccauugcacucgagccugggugacugucucgaaaagaagacugggacucuugucucaaaaaggaaaaaaaaauaauugggggccaggacauggaaggguugggaggccagagagucuuguggauagggguuaagcugcuuuccacaaccuggaaaucugcggggcuggacugggccccugggauuagaucccaucaugugugcuccaagagugacuucuuauaauaacugugcaggccacucuggcuucuguugcuucugucacccuuaaagcauuagguaaauaccuggugucagcugugcucugggugguuaaggaaucuucguuuuaaaagguacuucugauuuuauuuuuguucagguauggugaggccaaccagaucaggagauaguugccauugaaaagacaguguuuuacccaucacucccaggaggagggggaacauggggaagggccaccuggccacauggggaagcgcuaaggucuuaggucaggagucagaaggagugagggugaaaaagcaugggugagagccuuuauugugguuuuuguugggagaaauggucuaggcagaguaagcaggagaggcgugcuuaagauuggcuaguuugaauaauuucauggggcucugaggcguaggagcugucugguaucugguccuggagggauaagggcagaagaauauuaguucaacuuguaagagcucaauaaaggagguaguuggugaauuuggguucuggauugguugauuugcauauaaauggcagcucacaggggaggcaauugcuaucucuaggaaucagcuagcccugggaggggcagcgucuccagggucagcaaugccccagaugccagagcaucaagaaagaauacagaaaauaagaucauuucccacagaauauauguaucaaaacaucacacacuguacaccauaaaaacaaaggaaaagcagcacaggaagcuauaagguuguguaauaagggugcuugagaguuaaacuagacuggcuaagaaaguuuucccugagggaggcauauuugacuugaaaucuuguauucuugggcagguguuacacaaguaaagugagcuggggagguauuucuggaaauaccaguccaagguagaaggaaccauagcgcauugagacaauugaauaugguugaaacacagagagacaggagcuaaauauguuuuuuagcucuauuuuuagcucuauuuuucuucacuuggcugguuuucugaaugcuccaaacaagggauuugagaguuccuacuccaaucacugauacuugaugguuuauguaaguuauuguaauaaaaacauauaaauggcauuaacuuaaaugaaacacugacucaaauuacucaaauuccaaucacuggcucuugaugguuuauguaaguuacuguaauaaaaacacauggauggcauuaacuuaaaugaaacacagacucaaauuacagugauguguugguuaacaacaaagauacguucugagaaaugagauauuagacgauuuagucauugugugaacgucauagaguguacuuacacaaaccuagaugguacaggcuacuuaauacaacgguaaauauuuguaugucuaaacagaaaagauacaguaaaaauacaacauuauaauuuccuggggccacuguuguuuaaaugaucccucauugacugaaauguuguuauauggcagacgacuauacauggaacuccuaacuuauacacaucaucccucuaaaaagccauuuuucccuaauugcuucuccccauccauuaaauuuuaauacuacauauguauaguaugucuguuuauguauuguacauaucugugcuuugcacauaaaaagagugagaauucucacauaggucugagauuuaaaaaaauaaaauaaaacaaguaagguuuuuuugccuccccucaagauccaguuuuuacuucuuggaggggauauuacccacguugcaaauacaugcagugugcccuuuacauugcuuucuuuaauguuaacaucuuacguaacuguguagcacaacuaauaaaacuaauaaauuaacauugauacauuauuaauuaacuguagacucuaaucauauuuuacaaguuuuaccacuaaaguccuauuucugucagguacuaauccaggaucuugcauugcauuuaguuaucaggucucuuuaauuuucucuaaccugugacaauuccucaguuuuucguugucuuucaugaccuuuagacuuuuuaaaaacauugaaaaguuauguauaguguccuucaauuugaauuuuucugaagucuucucaugauuagguugaaguuauauauuauugaaaagaauuacacagggaugaugugugcuucucauaucagagaauaaacgaggaugaucugucuuauuacuggugauguuaaccuugaucauuuggcugagaugauacuucccagauuucuccacuuuaaagugauuauucuuuucuuuuuaauuaguaaauauuucuugggggaauauuuugagaugauacaaauauuguguuucuccuuacacuuucaccuacuaauuuuagcauccauuagucaaugaugcuugcagaaauuauuauugugguacucuaauagugauuuucuauuucucucauuacuucuacauucauuaauuggaaugauucuuuaaggaagauuaucucuucuacuccauuuauuuauuuauucaguuauuuauuuauaucaguauaagcccaacaauauuuauuuuauuccuugguuuauaauccaauacuauucuuauuuaccuucuugcucaaauaacuuugguaggagcucuuuuagguuagcuccugugccuuuuucacauguugccaaccccucugagcauuuucugacaucacaauuuuuuccaggauaaacuucuauuuucucugucucagucucaaaucaaucaccucuuuaaugagccaugguuccuuuuauuggacacuuuaccaguguagccuaguacacugaugauaauuaaaaaacaaaauuugguuauuacuuguuguaucaguucauucuuacguugcuauaaagaaauaucugacacugaguaauuuauagaaaaaagaagcuuaguuggcucaugguuuugcaggcuguacaggaagcauagcagcuucuguuucuggagaggccucaggaagcuuccaaucaucacagaaggcaaaggggaagugagacaucucagauggugggagcaggagagagagagggaggaggugcugcacacuuuuaagcaaccagauaucaugagaacucacuaucgugaggacaguaccaagggggaugaugcuaaaccauucaugagaaaccaugauccaaucgccucccaccaggguccaucuccaacucuggggauugcauuuuaacaugagauuugguggggauacaaagccaaaccauaucugguguauuucuugcuauugggguguuacuucuucuaaagcuucucaucagacagagcuaggaaaucuguguguguauacuaacuuacauaugcacacaccuauguuuauuucuguauuucugacuccaaucuagcagcacaaguuucauucuagccuucuuccuuuccuuuuuugugacuucauucuuuggauaguaagaaacuggauucucacuaucuauaauguauuuauuugcuuaauucuacuauuguaggauuaucuacacuauuuuucaaaguuacuucagccauauccuuucuuccccccuucccuucagugugguuaugugauucauuucauuugauuuauuuauuguagucaguuucauuauucacagccugcauuucaucuuggauucccucugcuuccccacauugugauugauuuauuuuguuugauuuuuuaaaaaaauucuuauucuuuauggaaaagccucauuuugucauacauuaugcuuaucuuuucucuauuuuaacauaucaauaaugauaaucucugggucugcuuccauugaccauuaaaaaaaauuugguauccuuuuccuguuucuuuaggugucugguaauucuuauuguaugcuggacauuguggauaauagauuguagagguucuggauuauguuaaauuaccagagacacucugacccagucaagucuugguuuuaggccuugcuaggucagaccuauuuuaucuuugcauuuacuucuaugaguugucccuauucuagggugagagcuuucuggggucucaacugaaagauugggauguucaccaaggucucacagugucuccucauuaauaugugaauucagauauuucuacuugguuaacagccucuuagcaaaaauuuuuaaggggcuucccauaguuucacccugcaguugugcaacuuuggauuuggccaaggaucugagagaaauuauauacagucaugcacugcauaacaauguuuuggucaaugacagugguggucccauaagauuauaauggagcugaaaaauucgugucaucuagugaugccauggcugucauaacaucauagcacaacacauuacucaucuguuugugguaaugcugguguaaacaaaucuacugugcugccaauuguauaaaaguacagcacauacaauuauguacaguacauaauacuugguaaugcugauaaaugaauauguuacuaguuuauguauuuauuauaauacacuuuuuauuguuauuuuagagugugcuccuucugcuuguauuaaaaaaaagguagcuguaaaacagccucaggcagguucuuccugagguguuccagaagaagacauuguugucauaggagaugacagcuccauguguguuauagucccugaagaacuuccagugggaugagagguggagguagaagacagugauauugacuaucuugacccuguguaggccuaagcuaaugugucuguuugcaucuuaguuuuuaagaaaaaaguuuaaaaaauuaaaaauuaaaaauuuuaaaaauagaaaaaagcuuauagaauaagaauauaaagacaaaauacuuuucuauagcuauauaauggguuuuaagcuaaguguuauuacaaaagagucaaaaacuuaagaaaauuuaaguuuauaaaguaaaauguuacaguaagcuaacauuuauuuuugaagaaagaaaaaauuuaaaaaauaauucuaguguagccuaaguauauagcauuuauaaagucuauggugguacacuguaauguccuaggccuucacauuuacucaccacucauuuacugauucacccagagcaacuuuugggucugcaagcuccauucaugguaagugcccuauauagcuguaccauuuuaaaucuuuuauauuguauuuuacuguacauuuucuauuuuagauauguuucaauaugcaaauacuuaaauuacuauuguguuacaguugccuacaguauucaguacaguuacauacugugcagguuuguagccugggagcaauaggcuauaccauauagucuagguguguagcaggcuaaagcaucuaugauguuugugcaaugacaaaauugccuauugacucaguucucaggauuuagcccugucauuaagcaacacaugacuguauauuuucccagugguucccuauugucuguuauucuccccuccacccuuccagauucccacggccuuagcauccccuaacuccuaccucuguuucuuucugucucuccuuggacucuuuuuuucccuguacagcagauugaaaaauaucuucacagaaaaaaccaggaugaaugugggguuuaacugcuuugcuuccuuucucucaaggaucauagcccugcaaucguugccauccagugccugagaauaauucuucuguauauuuuuucagcuuuauuguuucagcaggaguuuaaauucaauacuugcuucuauaucacuacugaucauuugucuuuuuuuuucuucuucuuuuuuuuucuugagauggagucucacuuugucacccaggcuaaagugcaguggcacaaucucagcucacugcaacccucaccucccggguucaagcaauucuccugccucagccuccugaguagcugggauuacaggcgccugccaccacgccuggcuaauuuuuguauuuuuaguagagacggggcuucaccaucuuggucaagcuggucucgaacuccugaccuugugauccacccgccucggccucccaaaguguugggauuauaggccugagccaccgcgcacggcccugaucauuuuucuaaauaagaaagcuuguagauucauaggauuucaauuauucugucaagcagaggggagaaaagaaacaugcuagugauccuuaucugauuucacuuaaaacucuuacaaagauuucuauaguucauuacacaaaguuuucaauuacauccuuauuacuagaauaaaaaugaucaacuaagagaaccaacuagaauuacaggguucuuuuggaagcuauuuuugugucuagaaucuuuauaaucuuauaagaccuuuuuuuuuuuuuuucaaauagcccuucugagaucugauauguauuaauaaggaaugggaccaaagguuaugaauacacaugaacuuccauauuucauaugaaaacaguauuaauauccucuggaaguucucaauuuaaugcuuuaucaaauuagauuuuuucaugugauauacagcacaaagaacacaucucuucuuugagagccguagaaaaggaggaggauauuccuuaggcuccuuucuugggaugauuuauuugauugugaagauuuauauuuuuagagccagacucuggaauuucauuuaucaaguuuauaagcaaaaauucggcuuguaaagcucaaauuuacugggagaaaugaaaaaaagaacuacagauuuucuauauaaugacagugaauuaacuggacauauagcuuuuuuuuuuucuguauaauguuaaggcgguuauuaaaaguuuacacgugauuuugugacuguaucuuucccccaucccucagcuggcagauggcaucuagaucaaacgucauaauccucccuaggauuaugagagugaagcuccauguauaacacacuugaauuaacugcaaccugagaaaccaaaacacuauauuaaccagagcauauucuacugcuucacuuuuaggaaaaaaaaaaaaagaagcaaaugauaccaagacaagcucauaacagagauccaaucagcagauguguacggaugaaaauacagguacaaaugaaucucuuauagccuuuuggaucugcaucuaaauuuuugcauaaugaugacuaguauucagaaugucacaauagaaugcagaaucagcaaaagaaugagcaaucaaauuuucaguaagaguuaaacacuucuuuaguauguccacauggcucacccuauucuagguucugggagcagaaauauaaaaaaaaauuuucucuaccccagagggacuaugacccaagccaccgagugucugugcuuggcaaacccacauaucaugcacagcggaacagccauucucugauaaacagacuuccucccuuuauauucccaaacuuucugcaggagagcccuuccaucuuuuuguguuaacugaaucuagccaguucucugagaacaaggcuuuaucuguuagccucucaaauggcggccacuuuacacuccagguagcuccagguuugagaggggggucagugucuuccccacugccaccuuaggccacugugccuucacccucuaguuaaaccucugcaauuugaagcuugugcuccauuccuguggcagccuucaccgggccuccaagucacaucuccuccuucgcugaugguuuuuuacugggcugcccacucccucuccacuuaggugacuuuacuauuuacuugaaugaaguguucaccacuccagugaauuauccacucugcucauccaucuauugucauucugugaccauugucaguaccucaaacuacuccaucaagcaaacagugcaaacgucuagcaucucauucacaacuuccuuucuuuucauuuguuauauauaucccauuacaagucuucuuucacuaggugcuucuaguugacuugcccuuucaccucccauucauuuaccuauccauucaucuaucaccuuuuucuaccuucuauuuucuucacauuacugauagauucuaagauccauuacuucaauucuucucuugaaaauugucuggugaauuccaccccagggugaaccuauccaucuccucuaugucuacacccaggcugcuaagaaaaacuaaagaaaaacagaguggagcagauuuguauuucugcaaauuaauggucagugacuucaacuagacucccaaaacugacuggucuaauuucuacaaaaucucucuuaaacccauucuauuccucucaagccucaaacucucuuauucucagcaucuuuccauuucacuggaaaaauggaaacuauuagacggagacuucauacugucaaaagucuucucucuucuaacaaagaccaaccauuuugcaugugcucugcacucuagcuccucagguuuuucucaagaauauuaauuauuuccucucuuuuuugauauuauuucuauuucuuccucucuacuuccuauuagcacuuaugcauaguccaauuuaucucauuacuacaaacagcucaacaaaccagccaaacaucucccucugcccccacaaagaacccuuugcaaaccacgugauucucuagcuacuucucucccacuguucucaaauuucugggcugaguugccuauaguuucucugucuaucuuuagucacuauucccuccauaaacccucaaauucaacuucuguuucaacaacuccauggaaucaacucuuacuaaagccaccaauuauuuucuuaccacuuaaucaacuguacucgaguaguccucauaucaugccaccucucagaaucauucuacaaaguugagcauuccgucuuuugaaauacuuuuucccuuugauuccuaugaugucacaugcuccuaguuucucuucuaccucucccauucagccaucaaagcaaucccuuccacucucauggcuucaauugcuaccuauacuccaacaacuuucaaauucuaucucgagccaacuucuccucugaacuauucacaugacaucuucaucuagaagccuucaaacaccucaacuugaauccauuaaaagugaacucaugcuucuguuuuucgcccaaaccuucuuuuucucuaguagauacuuccaacacccaucuaguugcucaaacgacacaccuuggauauacccuugacuccuccucauuaccacuucuuaugugcaacgaauuaccaagucuuguuaauucuacucuuggaauauuuugucaccaccuucauuaaucacauggccuccuggaaugggcuuugcccaugaaaacaauuuuccucaaagcuauggaagugaucuuacaaaaacgcaccucugggucgggcacgguggcucaugccuguaaucccagcacuuugggaggccgaggugggcggaucaugaggucaugagaucaagaccauccuggcaaacauggugaaaccccgucucuacuaaaaauauaaaaaaauuagccggccgugguggcagacaccuguggucccaccuacuugggaggcugaggcaggagaauggcgugaacccaggagguggagcuugcagugagcagagaucgcgccacugcacuccagccugggcaacagagcgacacucugucucaaaaaaaaaaaaaaaaaaaagcaccucugacuaugacauauuucuacuuuaauauccuucaguauauuaaggauuucccucccuuauaguauuuuuugaucuaccuagcaugucaguucacagcucagccucugauuuccucuccagcccauccugcuccacuccuucuuauauacauuguuacagccgcacuggccuuguccuaaguccucaaauauaccuccccaaccccaacucagagccuucugucccaaacacucucggccuacuccuuucucugcugcaauaacauugacucacucuucagcuccuacccuccaaaaagccuucccugaccuauuauccuaguuaagauccucaacuauauggacucauugccaccuguacuuuuccuucaaggugcuagucaagacucuaaacaauuacuucuaaagaugguacuuguuuaauguguguccuccuugcuagaaugugcacuccugagaucauuguucauugucuuuguucauugucauauugucaggggcuaacauuauguuuggcucaucauauguacucagugacugcuuuuuugaaugaaugaaugguuuuaauauaacaugguaaauauaaagauggaggcauagagauugcaaaauggaacagagauaaguggcauuucacucagcugaggaagucuaccaguguaauugcuauugugugacucagaugauggucuuggacacaaaauuugggaauaggguggucagcaaucuagugcuuauuucagcuugugucuccagcuuggccucuucuuugucucucaaagaauggaaccccuggaaaacccaaggcagcuuaguagcuaucaccacucacuaguuguagguggagcaauacauuagcccaucagauaaucugaguucucuucuuaaguccccugcuaugaccacagaucauuuagguuuuucuauaaaacaauacaauuugggagauugguugucuuccccaucauucaggaaaaaauuauaagagaauuuguuuuaccuacguauguguacauucaaaaucccaucauuuucauagggagaaacaaaucauccuuauuuccuuauuucuuacaccacaaacacuggauuaagaaaggcaaauaauuguaaaaccuaguacacuuugaaauuauaaugcuuucuauggagagacaauuuuaugcuaaaaccuuaauuuuuuaaacuacccuugcugagaaccugacaaaagcagcccgaguccuacauaacaucccagaggacagaagcaccuggggaauuuuaagacacuuucaacccaaucagugucaacguucguucauuaaguggauggugaaacagaacccugaggauucagacagaaacucuguccucaaagagcucacgcugagaucacagacauauagccacauuauuauaacauaguccacaaauagaaguauguacaaguuauaaagauagcccagagagggacaaaucuuuuugggggaucaaauccugaugagguaagaccucagcuggguuguuaaggaugaauagguauuuaccacacagacaugauagggaaaaggcauuccagggaaagguccaucuucugaugacaggauaaugcuucuggccuguaccagcaagaaauggugugggaggugaaggacagagaccaaacccugaggggucuaugugccguauuaauugagaaacaaggacuugguucuguaacugaggcgacccuuaaaguuuuugaguagggacagguauaaucaauuucacaucaucucuguggcaacguggaggauagauaaggggaaagugagucuagagucagggccagccagcagauaaacggagagaccagcugggcccgccuguccccuuggccuguagaaaauugugggaauauucauccacauacaauuccaggguaaauuugaguguccauaaacuaaaaccauguauuguauaauuuuagauacaagaaacugaaggguaucauguuauuuacauaacauucagaaaacuacugcacuucuugaauguuuaucuggccccacuacaauaagugaagguuuuacuccugaaauaauugcuaaauaaauuaucugugugcuaaagauaacaaccguaggucacacccuuuccuuucccuuagaauagcuggaagcagguagaguuuguucaucagaaaggacuuuugcacaacuuuaugagauaguugcaggugggcagugugguucuuggaccacauuaguuuguccuuguugccuaaaacaaagcaaaacaaugagggcauuuaacauggcuuuguuuuguguccccacaugggccuucaaaauaauuaaggacucucuuauguuuucauuuuuucauagucuuggcagguccccacaacaguauuagauuuugacaucuugcugcuuucuguggaaaagcacccagauuccaaauaaauauguguaugaaauuuuccauuaccuggcacugguuugucaccaacaaucuacuguucaacauuuauuguacuaauuuguaaacauaauaguugucacggagacaaauggauaaacaaggacagacagauaaugacauccuuagagacagcauguaguaguuacagccaaccuugggguccuacauuuuuguguuuuugcugcuguggacugaugaacacagaagccauuguuuuuuacuguguaaaucuacacucagaagaaagggucgucagccgcuggccugagaggauuagcaagguuuuagagacuaaggucucuacgggagcuggugaauguggaaugaaauuacucuuugggaaacauggaugauuuuuaucacagcuaaggaguuggggcugagcaguuuuuggaaggcugugguuaggcauaugugaaaaccugggccgguaauggaaucuuuggacccccaguuauuauuccaaaauagcucuuguagaagcacccgugugcacuccucacuugcaggaaaucauggguucuuucugacagccuggggcucaccggccugugggcguuccucucaccaagugcgaguccagucaauggugguugaauggacccaccucccucgccagugccucugauuggcugcuuucccccuaccugacgucauuuccccuguuuuugaggaucaaucaagauggacacaaacgaugcuuccuuacuguccuuugccuuucucugaguacuacauaguuaagaauauuuguaauaugauugcuagcuauaaaagauaccucuuuuucuauuauuucccuguuugucuacuuuuuaaaaaaauguauaguuuguuuuuaauguaaacauccugguuacuaaaacuucauacguuuauauguuggaauauuuucuucuauacaagcacuggucuuuuaacuuguaaccucaaguuguauaaaauaaucuuuuuaguuuauaaaagagucucuaugauuugcuuuccuccuguucaaguuuguuguguuagaaggagcauggugucaggguuaggcauacauucuaguuuaccuugguugggguccugggacuccauuuacuagcucugugaucuugguugaguuaucugacuucucugacucucucauuugcaaaacggggcuauuaugagguuaugaggaugaaauaaguuaaauacgugaagcccuugaacagugccugguuuguaucucauuccacguguuugcuauuguaauuuuuuucuaggguauuuguucuaauuucuucuugucuuuuuuuaggguaguccauccauuucccgacucuauuaaauaaaauaaaauaaauaaaaaugcucccuguguugugauccaugcuacuauacauauguauaguauauauguaguguauaguauggaaguucauacuauacuuccagcuuacccuccgaaguggcucuucaccaacuaugugugagaguuccuguuugucuacggacucucuuaaguuaaugucaggcuauuuaacuuuuacccaucugauucuuguagaaugguaucaauuguuauaaccugugucuuuuugauaauuggugaguuugaauguauuuuuauaugcuuaugggucauccaugacuuccuccucuguaaacugcauuuucauaugauuugcccaauuuucuuucggguuguuuuuuccuaaugauuuguacgaguucuuuaaauauucugaauaggaauuauuuguauauuauauguguugcauucucccaguguuccuuaacuuuugacuauguuuauugugucuuuugauguacaguagcuuuuuuuuuuuuuuuuaacuucuguuuuuagagacagggucuggcuuugcugcccaggcuagagugcaguggugugaucauagcucacugcaaccuccaacucccaggcucaagagauccuuucaucucagccuucugaguagcugggacuauaggcaugugacaucaugcccagcuaauuaaaaaaaaaaaaauguagggauagucuugcuguguugcccaggcuggucucgaacuccaucuuggaccucaaaugauucugccucagccucccaaaauacugggauuacaggcaugagcuaccaugcccagccuguaguuuuuaauuuugauguaaucacuuuuccuugcaaguuaauuuuaucaacauuauuuguugaagaaucuaucugcccccuaccaauuuauaauaacaucccuaucauauaucaaguucucuuguuaauaugguuguguuucuauuuuugaauagaacuguuccacuugucuauuucugggcaaugccacacuauuuuaauuacuauugcuuaguaauguguuuggauaucuggguaugaaaaguccugucauucuuuucagaauuuucuuucuuuuuuuuuuuuuuuuuuuuuuugagauggagucucauucugucgcccaggcuggagugcaguggugugaucucugcucacugcaagccccauaucccagguucacgccauucuucugccucagccucccgaguagcuggaacuacaggugccagccaccacgccuggcuaauuuuuuguauuuuuaguagagacagguuucaccguguuagucaggauggucuugaucuccugaccucgugaucugcccgcaucggccucccaaagugcugggauuacaggugugagccaccgcgcccggccccagaauuuucuuaguccuuugauuguugguccuuugcccuuccaucgaaucagaucaucacaugccacaaaagacuguuggugauuuuaguaagaaaugcaugaaguucugaacucacuuuggaaaaguuuacaucuuuuaugauaaaguuuuuuucuaucuaugcacaauuuuuccuucuauuuauucaugcauucuuuuauacuuucacugaaguuuugaaauuuuuucucaaaacaauccauacauuuuagucuuugauuuauuucuagguacuucaggauucuuguugcuauugugaauaaaauuuuuuucaguaauuauuuuuuuccauacucccucucuuccuggguguucuccuguguucccuuggcuguaaaucucauuuuuaugucaaauacagugcaauugauuucugccuuucucucuugugauuucucaauccacaugaccagucauucccuuuuacagacacuuggagguuucagaaguaucucagacugaacaugucuaagauugaacucuugauucuuuucuuccccaucccuaaaccauucccccaccuuagaaacaugauuggcugucuaccuaauuucucuuggagacauccuggaugucugugcuuccuugcugacauucagucugucugcauguccuguucauuguuagguuucuuuucuugcuaaugcuguacucugaccuaccccagacuagucuauuagguggcaccaucagcacuuagaccuuuagaagcaucucaggcuuaaccuguguggaacauaguaggugcucaauuaauauuuguugaauacauaaauguuuagaacuguacucuuaccuuuuuccccccagccuuccccaccucaguaaauugcuucauugggcauucgcuuaagucauaaguguggcagucauccuugccuuauucuuuacaacaaaucgcacauccaguuuguccucaugugcuauuaauuuugccucuaaaauccaccuccacugcugcugcccuugucaaagucucugucaugucucccugguuuuccuauuuccucuccugcuuacuucuaaucuauguugcaaggagcuugagugaucuucauggaagcuaaauaugaagauuuaucuccuuuagugaagaucuuucaacaccuuccuauccuucccauuccuuagcucacuuucaagggccugccuggucuuucucaugccuugccccuagccucaauguuccccucccucacugugcuucagccacucuguucucugguuucuuggagacaucaagucucaaggccucugucuguaacuguuuccucccucauguauggguggcucccacauaucuuuuggaucucaaauuaaauuucauuucuucaggaauccuuccuuagccuucuaaucuaaauuugucucauugcuauauugucuccuagcacccaguuccuuccuuuuagagcccuaaucacauuucagucauacauuggauauacuacucaugggguaagagauagucuguuaaugucuucuucucuguacccuaagcucugugagcauagggaccuucuuugucuuacucaccacuggcacuuaaagguacucaauaaaucuucaaauggaugacuguuaggauuguauuuggcugccuuuaccuucagucaucuuauguguauauucuuugcacauauagacugauaucaucugccuuuccugucagugggaucuauuguggucauaaauaaauugucucaguagcuccuaucuacuguucaggggguccuugucagucuuaaaauuagcaccaagaauugcucuccaggguacuaauauaucuuaccuacucaaggcaggagcuggguguauuguuccccgcccagcuccugucccagccccuggugagagugcuaccucuggaggugacugaggauaacagagggagcuauaaguuccuucgagccgacugccacauugacgguuaacuggcuucagcugggauggcuggccacuccgaguuucugccauauaauuaaugaccuagcuuccugcugcuuucaguugcuauuagagaaguauuuucuuaugucaauacaaccucuucauaagcaccuuuaaaaauggaugucuaauauucaguuggucuucaaaugacuccauaauauuucuguaguuagcuaauuauaagaauaucaauaauuaaauaagaaucaaaucuuuacugcuuacauuguauuugcacacuuuguaaauaugcaagaucuccccacuuaucuucucuucuuuaauaagcuaggcugacuuuaggaaagauaaagaauagugaaugcuucacuuuuucuguuucauuaccacuccuguuucugggguauaugcagaaauuaaguuugagauuuuccuacuauccucccccuguccucaucaauuaguaaaauucaaguuacaguuuuucaugcauauuauuauuauuacugaaaauauauuuuauuucuguuucucuucacagaaugaaagguuaaaagauuuuauugcucucaagggcauugauauucagagaguaaauauuaaauugugaaauggaggcaagguuuaacaaaaacucauugaagauugauaaauauuuuaagacucaaaguuaauuuuucaugcuuugaaaaaauucaguauuuuaaauguuagacacuuccucuuguucuuaaaaccagauuaugaaaauuguaauucccaguuguuuccaucucuuccuuacaauuuuuucauuuuuuuugagacagagucuugcucugucacccaggcuggagugcaguggcgugaucuuggcucacugcaaccuucaccucccgggcucaagcgauucucaugccuuggccucccaaauagcugggauuacaggcaugcaccaccacccuuggcuaauuuuuguacuuuuaguagagaugagguuucaccauguuggccaggcuggucucgaacgcuugaccuugggugaucugccugccucagccuuccaaagugcugggauuacaggugugagccaccgugccuggccucuuccuuacaguuuuuucuaaucauuugaaggcacagggggugaugguguggguuuugagaaauuacagccauguaccggaaggaauuaggaaaaaggaaagggaagguuuaggaagaacaugaccuuauuugcucaagucuuuucuacuuugugaauuuaugggggaaauucuguguccuauggaguacauucuuaggucacugaagggaacacuuuuccauucuguuccuuaaagugggaacaaagaaagaggcuugggauagguaauuuauuaugacuaucuucacccuuucucuaguguuagguaugucgcagugaugucauccucuggacugugaaugacaaauugaugaugucacugaggccccaucuccccuguauaaacagugugguacggauuauaacagacaauuaaucucaccggucacucauaaauugugccaauucuuuuuuaucuucucugggccucaguuucuucaucuguaaaauaaggauaaauguaaucuaucuccuaggauuauuaccaggguuaaauagaugaauaaauguuaugaacuuggaagagugccugacuuacagugagcucuccaucaguaguacuauuauuagcuauuauuuauaacuuaugcuucucaauggguaugauuuaggaaauagcaaaauaauauauuuuggguuuuuguaauucuuaauuucaaauggacuggcagcuuacauaccaagaaucauaccagacaacucagaccauugaguuuccucuaugguguaaaaugcauguccuuucugcaaagaaagcugagccucagguuuggugccuggaggugaaaagagaguaggcuagaggccaagucuuugccagagagaaggaggaagcagaaagaagaguuuuucuagccaaaagaauaggaaagaagagaaaaagcaagagagagagaggaagcuaaggaggcagauacuuguuuucuccuuuuucuaggcgaaaccucaaaaccauggugggggauguggguaugguguaguagaaucauccagauagguuuaaaauuuuuuguguguguaugaggggcagugacacacuucaacaggaauaguguagugggggcccugcaagccucuagaaaaggcugcccucagccucauccagcaugacuaugagugacugcacagcuuuggcugggaggcugucuaagccaauggcccagaauaacgcucuugguucccuacucguaaugcaugggaaccaaacauuuccuagaauagaugugaaggagcugagaggacagcuggaccagaauaggaggcuacugagucaggagccugaugaccaguggcuuugguuggaucaaguggucaguagcaaugugugucauucaugcuaaaaggugggugagaccagaugagguaccccauggcaaggccuagcagaggacaccacccagaccagccaccccuucccucacugccaugaagauacucagguuuuucauacucuuauccaccuugagaaggaagagagggaggugagaaauagucauguuagggaacugaacucugacuacaaaguaggaagggaugguuucagcuagaagugaccaggccacuauaaauuuagaguuuugguugcucucuucuuuccacuuucuuucucagccaauauucaucauggguugggcuuguaauaucacaucaauucuacaguuacagagaaauaaaaaaaaguugugcuuuuuuugguaaaaucaaucucgauuugaauaaauuugaaauuucuugcuuuauuaaccugaaauuucuuucuuaaguauauauuaaacaucccauuccuuaauucauauaauagaucuggagacugaucauuauuuuccuuuggaguuuugauaucugaagccaguguguuauucucacauaggguucagguccugggugcacagucaaggucaaagcuugucuccuguucuucccauguugaguucuuuauaccaagggaagaacagacccuugcucaagguugugagggagccgagugaaagaauugaagaccuauucugcuuucaaaauauugaccugcaucuacccuucauucugcaaacucuauacccguuugcaugucugacuuccugugauaccaugcagauaugaaggggcaagugggcugcagcaugucaacuuaccacuugcauuuucuuuccuuuccagaggacugcccagaauugagggccaccuguggcuuucaugacaugauuaugccacaucccgauugcuuuuuucagaaaagaugauaaaaagaaaggaggaagggugggaagaagggcaaaaaauccacuuuauacucaugguuuuaauuucuuccuguagccuuuuuagggaauggcgaagcuguguuuauagauacuaugacacuagugguuacauagagcuuaaugccaccccuaggacguguaaugaaauguguauguaaugauuaaagauagcaaauuaauuuguaugaauuagaaaaagauauauuguguucacaaaaucuuuuuuuuuuuucccuaaagagcccaguuuuagaacuuucaagguuagugagaaaggucccuuccucuacugaacagacauuuuugccugaauccccauuggaacaugggacugcuagagagcaucuggggacaggacauaaguggcuaagggcucugcagcuguugugaaaggcacccuuuguucauucucucauuuuuaaucaaacaucuucugagcaccuguucuguaucaggcauugaacaggcuuaaggacaaaaauuuuaaggagacagugaaacaguaaggguagcacuaaaguucuagaugcuuuccuagaauuauucacagaacacaaaggaaggagguaugaucauuacucuuugggggaagggaaggaucuggaaaggcuccccaaggagugucuugacuuugagcugaaccucaaggcaauggaggcauuugcugugcaacuguugagugguaaaagacaggggaaggaacccuaugggacaaguuccaaaggcuugaaauaauccugucucuugggggcuaggaaugacuggguugggcuggaugcacuuaccagaggaggguuccuucuugaauaaaaagccuuauuauugaagaaaggucaucuucccauagacuuuuugccuaccuuucauugacuagaauguggucacaugggggaauuauauagauuaaacaaggcauauagcacugccaaacaaaaucaagguucguuacugaguuauuaggcagucuacuaguccuauuaaccauuaugaguuugcuauuuuaaaauuauuauuguaugauguuggggauuucacuuaaauucuuccccaauuuucucaucuguaaaauggggauaguaggaacuaucuggaggguuguuuggggaauuacaaauauuagauauaaaacauauggaacauacuaggugcucaauaaaugguggagagguuuuuguuuuccuuucuuuggauccuucccuucacuuucuucuccuucuuugaaugcuuacuucacuuuucucuccuguuuaguuuuaaguuauauggaaaccuggagaagauuauauuuugcaguuucaaauuuguuuuuuuuuuccucauccugccagagaguucauaguuaucuuugcuugcaauuaggugguaucuuuugugaaaacgucaugcaguguuuauaauuuguuuuuaaccacuaaaguaaauaaagaugugauuaaugcuuaaguaucaucagagauacacagugagauaaauagagugugucuaaaaaacucagcaggauuagauaggucauuuaaaugaauucucaucugugaaaggaaaauauaauuuauuaagcaaguuauuuacauuaguuacaauuuuuuauuuacuuuauuucauuucauauuuucaaagcccccccccgccccccgaguuacguguuguuauuauuacaggaaacugagucuaaccaauuaggaauguauuugguuacuuguaacugaaauaauagugguuuaugcaagguggaaguuugucucucauauaagagguguucagaguucaagaguccaggccugaaacaacaaacuccacaguccuccaggauucaggcuccucugguauuuuugcuccaccaccucacaggaaguggcuucaccugugaaguugagcugugguccaagauggcuccuguacccaggaguaaacugcuagacuacaguuugugcacauuuuuauccucacuagacaaucccaaauuguuuccagaaaugcacagucuuugcaagcacacguagaacaaggucauaaagcaaauuugaacaacuguuggagucacugucauagcgacugcuuucucuaacugcauuaaaaugagaagccaauguaacaaaaauaucuccauauauuuggaaauuuuacaauagauuuuguaauaacugaugaauugaagaagaacucauccauaauuaaaaugaagauuaaaaauuauuuuaauauuuguggcaugcagcugaaguugcacaauggaaaagguuauagccauaaauguacauauaugaagcauuugacucaauaaggaaaaaaaaaauaacacaaauauaaagaaaauggaagaaaagaaauuauaggccaggcgugguggcucacaccuguaaucccagcacuuugggagucugaggugggaggaucacuugagcccagggagagccugucucuacagaagaaaaaaaaaauuagcuggguguaguagcacgcaccuguagucccagcuacuugagaggcugaggcaggaggauugcuugagcccaggugguugaggcugcagugaacugugauugcaccacuguacucuagaaugggcuacagagugagaccuugucaaaaaaaaaaaaaaaaagaaaagaaagaggaaaaaaagaaauuauaagugcauacagaaaugaauaaacugggggaaaaaagaacaaagacaagaaaaccacuuccuuacuuuugaaaaaaaaugaaguagauagcuucugacaaaaguacucaaaaaaaaugagagaagauacaaauauagaauauaaacuauagagaagauuauaauuacagauuuauuacaaauuuuaaaaacgguaagagaacacuacagacaacaugaacuugaaaagugaaugauuuuuucaauaauauaaauuugaaaaauauguaaggugugguccuacuuuuuauuaacuguauauuuacagguaaauauuuucaaagaaaaaaguuaacauauuuuacaaguggcuaaccaugggguaagaauuuaugaauuuguauuauuuucuuuuucuuuuuuuucuuuuuuuuuuuguuuuuugagacggaucuugcucugucgcccaggcuggagugcaguggcccgaucucggcucagugcaagcucugccucccagguucacgccauucuccugccucagccuccugaguagcugggacuacaggugcccgccaccacacccagcuaauuuuuuuguauuuucaguagagacgggguuucaccguguuagccaggauggucuugaucuccuaaccucaugauccgcccaccuuggccucccaaagugcugggauuacaggcgugagccaccacgccuggcuuccuuuucuuuuuuuuuugagacagagucucgcuguguugcccaggcuggagugcagugauguuggcucacugcaaacucugccuccuggguucaaucagcucuccuggcucagccuccugaguagcugggauuacaggcucccaccaccacgcccggcuaauuuuuuuuuuucuuuuuuuugagacggaguuucgcucuuguugcccaggcuggauugcaauagugcaaucucggcucaccacaaccucugccucccggguucaagcgauucuccugccucagccucucaaguaguugggauuacaggaaugcaccaccaugcccaacuaauuuuguauaaaaaguagagaugggguuucuccauguugguccugcuggucucgaacucccaaccuugggugauucgccugccucagucucccaaaguguugggauuacaggcguuagccaccucgcccggccuggcuaauuuuuauacuuuuaguagagaugggguuucaccauguugaccagccuggucucgaacuccugaccucaaguaaucugucugccucggccucccaaagagcugggauuacaggcaugagccaccgcacugggcauauuauuuucauccaucugaguuuucuaacuuucagcagugaauauagauuuuuuuaauccacuaauucacuggaggggaggagcugcagaagugccuguaggucacacuucccucagggcccaucccaaguuuacuaucagucccggacagggacccuucuggcgcuggcagagaaguccugguuucuguuguugugaagucuccaaacuccauucucuaucuuucucuucuggagugauuuguuuccccaacuuucagucuuugucacccuaggacauagacucauggaucuuugagacuuaucccaccccuggguccaucucuaguccucugaagucuagucugggcccagcaccuggacuccuauuccuugggaggaggguugagucuauaggaagcacaaaacaguguuggaccugucuaaagugcuugggaugcuggagucacacagauguggauucaaaucccuugcugccucuuacuggcuuauggacuuagucauguucuguagauuuuccaucuuuaguuuguuaauaaugccacauuaaaaaaugagauaaaguaugcaaaacaacuauacacaauggugcucaguaaacuguuacuucuucgcuguuaguuauuugcuuuauuaaaggaaaaacuuuaauaaaacaaauucaauuuaacagaguuuaauucagcaaagaacaauucacagaucagacaguccccagaaccagauuaguuucagagggacuccagggccaccacacggucagaaaacaucgauggacagagaaaggaaagugacaaauagaaaccaaaagugagguacagaaacagcuggacugcuuacagcuggaauuugccuauuugaacacuguuggcugucugugauugacuaaaacucugugauugguauaagacuggguuacaauguacccauccgguuagguuacgguuuacuauguacaaauaaaccguuagguggaacuuaaaauauguaaggauguggcuuuaggcuaaacuuaauuuaacagccuguauuuccaaggaauuuacuagcaauccugguguguuauaaaacgaugacucugauuuagcaugugaggcuuagcguuuuuaaauuggaggguggcauggggccgauaguuggggaagcaguauauagaacugcuuaagcagguaccccaacuaagugcuguauuucugccaccugggaaaagaguuaggagggcaguuuuuuguuguuguuguuuuuguuuuuauuuuuuuguuuuuggagacggagucuugcucuaucucucaggcuggagugcaguggcgcgaccucagcucgcugcaaucuccgccucccggguuccagcgauucucuugccucagcugcccgaguagcugggauuacaggcacgugccaccacacucagcuaauuuuuguauuuuuaguagacaccggguuucaccauguuggccaggauggucucaaucuccugaccucgugauccgcccgccagucuuuucaaaaauauaaacauuuuacuaaaggagggagaaaacauuauuuugaaaguuggaugcauuuucaggugguuguguuaggaauggcgagguucuuccagggaagagaauuacuuuuuccuucaggaccaugcaucgauggauaacuagaggugaugcugcccccugccggacauggucgggggagacagggagugagggaaguugucauggaguaagaaacaauuuuccccugaagugcugggggaagaaaugacugggcgggggugcagaugggcauacagugacccaggcauuacaucagcuggagcagugagugggauuugagaauucaauuagggaaggaauucagagucacagugggcuucaaaucuccuucuuaucacauacuaguuauuucucaaacaguuggaguaagagcuaaauuuucuguuauuugugacgggugccugagccguuugggaaaaggugacccuagaaggccagaggaauugggaaugccuggguugccuguggagaguugaguaacagucuccaugugcugggcaccugaagaaauuacuccugaagguuaauccuaaaguguuucacuucauuauuucccaugggaggagaaacucuagcugaacuucgcgaccuauguaggacuuggggaagggcuuagcagacguuuagggucuuugcaaugaaucugacccuauaagucagcugcagcuucucauuggucuauacauaccugucuggguaaagggcuccuuugaauauaucugaucaucuccuuuugaaaauucagcaauuucucuccuaggagacugcuacucauccuaccuuucugaauacccauuacuccuucuuccugcagcuugaaggcagguccacgccuccuccuggaagccuucccuugacugacuccucgcugaguucacagguaucucauccgugcccgacguugugcccccuuccaugaggugaagcgcucucaaaaugagagcuuuagguccugaguuuagaaugccuguuucuucauggauguccuuggcucuuuaaacucauugugucucagacccaugagaugaucucccuccuucucaucuacuucgaccucugauuagcugauggcaugacuguguucccagucacaugggcuagacacuucaccugccucauugccuguguccuggcucuauuaugucuuccaauucugcaaugcagauaggaugagggcucucggggguaaugcaauucacuguguaucugcuuagguaucagucauucccaagcccucaucuuuggccagaugaaaugccucugcccaugaaguuucaccuuguucucuagcccaacauauugcccucucuucuguggacuuuucaugccauugcaccagcacauucucauguugcagagcaugcuggccuuguaugacacucacugaugucuguggacauuccucuaccuacaaggugagcucauugugagcaggauguuuaucugcucuacccacuuccucaucucagugacuuguacuuauuuggucucaguaaaugaaguuuuucuggccauuagcacauuaugugcauucuaaucacuuacuugccuguaucucccacugguggauaaguuucuugaggacuggacucagcaugauuuagcuuuguguccaguaugugaacugagcacugugccaggcaaaaccaaaguguauaguaaauguuaaauuaaaugggugaagguaacuucauuuauuauuuaguauuuauuacaccuuaaauaacucuaacauuaaaaguuuaguguuaaaaaaaugaaagauuugccaaaagcagaugagccuauaagggaaauggacaaggagagacuagagauagaggaggagaucuaggagaauguggugucacaggaaaggaaagacuuuagauggagagagaccaaauaugaaggcaauugguuuagcagcauggaggucuguggggagcuauguagagucauuuuuccuugggaggaaagggccaggagccacaguggggugcacugaugagugagugaguggaagauguaaagauggagggaaaaaauauuaauaccuuuucaagaacuuuaccuauacaaaagaggaggguaauagggaagcaaaaagacacgggagcaggauccagagaggauuuucuuuuaaaauggggcaucaugaguauguuaaaagcugacagaauggggaaaacuuucugggaaaaauacaaaaccuuuaauaagaucuaagauacuuaauuacauaaaacuauuuuugcaugauaaaaucaagugaaacauugggaaagaauauuuuuaacauacauaacagaugugacacacaauuuugaugaucacaaacagaggugcaaaaacaacguauuuguaacugcauucuaccugcuucucagcugucauuucuauuuguaguagaagacaaccacaccaacagacaaaaaaauuaaaauauccccucaaaguuauuuaguuauuguucuguacucauccuuaaaaacccagauuauagguucugucuucaaggaauccauccuuuuuccaugcuuuguacacacuuguauuggccaacauaacaguguuuuguaauuacauacugcacauaugcaucuccaaccugacccugaguuuguugagagcagagacauucucaguauccaguuuaugcccauuaacuaaguugauuccuguugauugauagucacguaaguccccugugggcuucgguguuuugcaguguuagguaggacuauuucugcaucugucacauuccuagaaggacuguuuucagucuccagcaagcuccccuguugccccuucugagucggaacccaccuucuccaaauauaacuaugcucugauuucuagcaccaucgauuaguuuugccuguucuugaaccuccuguacacacagcuuguuuucuugugucugacuucuuuuguucaaugguaugucugugagaucaaaauguguugauguaugucagcaggucagcaguuuguucuuuuuccuuguguaguauuuuauugcaugaaugaugauuguuuuaauaauaaauaauaauaaauuuuuuauuuugcuuuuuagagaaaaggcuuuuccuaacucuagaauauuauuuagucaaggauauguuugguuuuaaauguuuuccuaucuuacaugggucucuaaaacauaaggaaaacaagagcccauguuucuuuuucuccuuaaaaacacgauuuuuaaaaauacacaaaugaaaauuaaugaacuguuaguugaguuccuuuccacagaguuggggggaaguuggucuuccaggguguugcucuguagggccccccugaauguuaccuuggauuaugggaguagcagggggcuuccagaguagagggcucccuuuccugaugugcguuuaugucuccuccugucuccuugcaucggcgauuuccagugagaugagucagaaaccggccaaggagggucccagacucuccaaaaaccagaaguacuccgaacacuucagcauacacugcugcccgccguucaccuuccucaauuccaagaaggagauaguggaucggaaauacagcaucuguaagagcggcugcuucuaccagaagaaagaggaggacuggaucugcugcgccugccagaagaccagguaagcggccgcccagccccgcggcaccaguugggcacagcgcguggucucggcucccagcacgccccucccgcuccgcaccccacucuucccccuagucggcuccggguuaggcuccgacaccggaaggcacuccagggagacuggaaggugggugggggagcagggccuuccuaccuguuuccagcuccugccagcgucgcuuaagcagcagaggagagcccuggcucccgccuccagcuucuuuuggcccucucagaaccagccgccgugccaaguccccucagaggcccaagcaacagccagcugcgccccccgcgguggucagagcgccagccaagccacgguccccuccgaggucugagcgucagccacgguccccuccgaggucugagcgucagccacgguccccuccgaggucugagcgucagccacgguccccuccgaggucugagcgucagccacguccccgcccagagguccgaccaccgccagccaagcagcgucccccucagaaguccaagcaacagccgcgcagcagcccccucagagggccaggcgccagccguggggggucccccgucaaagcuucuagguucugguaacaccaucucuucccuuuuguuccccagcccuaagguuaguaguugcuuccuguguuuacuaacaccgggcugucuccauggcccucuucagccuuauuacccaaccuguguaaucagcucccuccauuaaauccccucuguuugaaauaccuaguguggcuucugguuuccuccuaggugcuauuggugcauacuucagguggcuguggccauugcuuccguugucuaauaggacuggaaguuguuaaucuaucaauugagauuauugaccaugguaacagauugaauaaaugaguuccucaaugccuaugccucagggagauaacgaauggugacucuaaucaauauccguauaaguaaaaggagaggguaauccauuggacccauccaucucccaacacacuucaucugaugucaaucucaguggcaauaccauucauucauucacucauucacuuacucaacaaauccuauugcauaccuguaaaguuccauuugaugugcugggggaagggaauauggcagugaggaagccguguuguuugagauuuaccaggaccaaauaagagaauaggugucaucguguagggaucagugcccuaauguuuucauaauaugcauguacaugggaccaugagaaccauaagcagggaguuauuggcucuguaggcuauuuuuuuuuuuuuuugagcaguuuuagguucacagcaaaauuaaggggaagguacagagauuuccucuauauucuugccccaauacacacaugccuggccaauuuuuuauuuauuuauuuauuuauuuuacuguucugaagguauaucagcaugccaacuuuuuagaccuuuuacuauuuggaacugaaucuguuuauaaguuaguaguggguguuaauuguauuugagauucucauaucuacucugauacccagcacuuguguagcaucuacuauguguagguaucacaugauguuuacugauuuaguaggaagaagagucaauggggaagaauguuaaagaugccccuagaaaaugugauuuuugggucaccacuaaggccuggguaugugccuuuuuaguaagcauucaccccgcaaagguacaguuauguagacaguacgcagacuacacaaugagcaaugcugaccuaaacaauccauaaaugaauaauccagauuauuugugaugugagguaaagaaauguggagagugauaaauuuaugguaccaaaagugaaagcauuaaaaaggcacaagauuaggcaaguuuaauuugugaaggaaguaacuagucacuaaaacuuuaauagcaaguuguaugacagguuaccuagucauuaacugagucccucuuaaggacccugaguagaaggguccuaggacagguaaguauugauauauggaaguaguuagaaaauguaugaaacagaggaaauuaauuguauaaaaggcaugccaccuauagugguggcuuuggguggcuggaguucaaucaggacauggaaaggaguuagaagacaaugaaagcaaacuucaccauacccacagauuugucuggaccuaaccuggaucaguguauucaccuaaauucaggagauacccuaguguuggugugcuuugacucccucaguuaacuaauuucaguggguaucagaaggugccuccacaggccguuauuaccuccucagccauugucccuuaccugggaacagaggaucugaaagucuucauucguaauguccccugacuucacuuaugcacugucuugaguccuauuugagauauucauuuuuccuucuuagauucccaaaggucuucagguaauauauuggagccacuucuucaucauauugucuauuccuuuuauugauacugauugacuauuuugaaucaaaggagugggaggcagguugaugugaugggaaauauuugcucuuaagcagagcuacuaacuugcacaugaagaaaggguaaaaaagauuuucugaagccaacuugcuuucugaaacagugcuauuucugagguauugcuuuuagagguuaaauaauuuuggcaaaggccuaauuggauucuuaauaacucccuuggauaggucuucucaaaaaccagagaaugauuuaaucuuagaaacugauuguacgauuuccagcauccugauuaaacaugguagcauucauaauauuugauaggaggaaaccguggcaucucccucuuaguuuauucuguccucccaguucuaagauuuuaggauuucacaagguuguccuugccuuuggguuuaacagguauguccugggccucuuuugguuucaguguucugcuuuugggagcuggggaucugugguucuuugaaaaccaccauggcugugggugguuaauuuggagucaaucagucacauauauugggaagugcugugugugccuuugacucauuuuuuucugcacagcauguuuuauauuauuaaauugagcccugcacacaagcagccuggaagacuaugauuuuccagguaacagcagagcuagagaaaaggccugagcucuuugcuuucuguucaggcucuuguucugccugugucucagguugcauuauugcuuuuauuaguuugggugacugaacucuugaauuuugcccuaucuguggcauauacucuuuccuaucugggagcaguccuuuauacauccugguggucccuauagcacaaugcuuaugcagaacagaugcuuuugcagaggccuagguuagccagagaggcuuccaguccugggagcuguguguuguuuuggagugugacagccucugccuggucacagguccuuaccugguccagaccacaugguuaacuacgccuucucugauagccuuaacccaauugucucucauucuccuucaacacucguuuuauaaaucccugauucuagaucaagcucacaaccugccugcauugguuuuccagcugcugaggauggucaugugugcauagagcugcugagugcaguuugggaaaagcuuuauagccugguggguuggugccaccacaaauggaugaaccccagccacuccccagacuguccuggcuccaccagcccccacacguucaucagaauaugcaucugucuuuaaauccuuccccucagccucagagguugaagcauucauucgcugaugaggccagucccccaccccucccugugaucuuccaaccucuuaucuccuuugaggucuugcuguacaacuuagcaaccccccuaaccacuucagccuuuguaucuugucucuuucucauuagcauuuugacguguuuugcucucucauauugacuguuuguucacgucuggcccuauccucuuuucucucuaccuuagacaaauuuuaaaaagaauaguguaaacucgucaucuuuacuuccucaaaucccauuugcucuucaauucauuguguucuaauuucuucccuuagcacccccgccccuggaauuccucuugugcagauuccuccagaaguaacaaugcaagggcaagaaguuuauuugggaggugaaggggacacuggaggaaugugggaagcaagauaaggaagggaaagagccaauuaaaaaaaagcauuaucuaaccaauucucaccguggguuccugggacuuaguccugccgaggaccucuggggaacaguguagacaugugcgucaguuaucuuaccagagggguggaggaacugggauauuuauacaccaguucucgucagacauuagucagccaacgcugcuucaaggaugggggcauucauucuuugacacgucuagcuuguuaaggagauggcaaaguggacugcagcagcaagauaaaagcccucaggaaaagaaaggcaagugcuggcaccuggaaguggggcugagcacaagagugguaagggcaagggguuaugggcaaggcaccaguaguguuugcucuaaugguuaccuguggccuucaugcugcuuuuccuaaugagugcugaacccaaucuguauaucaguggugcuuucuguuggauuuguugggcuguucucucauucagucuuuaaacucucuguucucuugguuucugugacucucuucuuccuuuucucugcaggaacuuuccuucuucaucuucuugugagugcuuccuuuucugccaauugcucaaccuugagguccccuaggguucccuacugagcucucugcuuauaugauuuugccuucucuugugguuuuaauuaugacucacgugugaugacuucuaaaccuuaauucaucauugacauuaauaugugagccuauucacucagcagaucaauuugauguuggaaaaccuaaucugucuacacuugauuucuuuccuacaaaacuuguucuucuuuuuguuugcuaucucagcaaauaacacagcuguccaacuaaucccccaaguuggaaaccuaagcacauuguaacuuccaauuuuccccugcauauaaaugcuggccaauuugacuuucugaugggaaggggugcaggauugagaucaagcuagaaacaaaguagagggaauggagguaguugauaaaauaagucuccuccauagcacauauggagggauuggccuuugaugggaacaagaaaagcuguuagauugugcaaaguagagagagacccauuaauaggcauuaagauagaggucaugcccgagaaugagcgagcuagaaguuugagaagguuaggguacaccuggaauguuagagaccaggcuucuaggcaguaguuagggcuggcugagcugagcucaacagagcuguauauaaaucauuuguucuuaaggagcuccuucuccaaugaaaggaaacagauugccaccucugaaauuaucaguggaaucacacaacuccacauccacacucugcuucucuuccaacuuguuugccaaaugcccucacagcaacuguucuuaaacuuuaccaugugccuccaguguucugacuccuccauuuuuaucuccaucuaucagacuccacuuuccucgcuuuccaaauuagaaaugauaucccaacauuuuaaugucguucacaaauacccuagaauccccugccuucugaauauuugucuuacaccccugggaaaaccccagccuuugaugaacccagcuaacuggcuucaccauguuuguuuuugggcagcuaagcaucacuggagaacagcacacagcaggacgauaguagcuggguauaagcagaauuguguuuauccuaucacuaagcaguuuccuuugggcaguuauaguucaauugcaugcauucagacaaaaaaggaagcauguaccucaaaagugucauguaugcauguguaguuuauaugcucacacacauacuucauauguaucaggcuuacugaaguauaauuuacaugugguaaaauuaaacucuuuuggcauacauuucuacgcacauaguccugugacuacugccacaaguaagauauagaauauuuucauuacccuucaaaauuuccuuauauuucaccuaugcagucaacuccccagcccauaguaaccacugaccuaucuucugucccuaacuuuugccuuuucuaagauuccauauaaguggaauuauguaauauuauagccuuuugagccuggcuucuuuuacuuaacauagugcuuuugaaccauauuguugcauuuuuuuuuuuuuuuugagacggagucucacucuguugcccaggcuggagugcaauggcaugaucucggcucacugcaaccucugccuucuggguucaagugauucuccugccucagccuccugaguagcugggauuacaggcaugcgccaccaugccuggcuaauuuuuguauuuuuaguagagagggcuuucacuauguuggucaggcuggucuugaacuccugaccucaugaucugcccaccucggacuuucaaagugcugggauuacaggcauaagccaccgcgccuggccccaacauuuuaaucucuuucacaaauacccuagaaucccuugccuucugaauaucugucuuauaccccugggaaaaccccagccuuggaugaacacaacuauauauacaggcaucccuauacaguauauauguauauaguauauauacauaugcauccauauagucucucucuauauauguguauguuuauauguaugugcauauauguauauacauacgugcacauaugugugugagaguguuuguguguguguguguauauauauauauauauggauucacaugccacaguuugcuacucaccgguugaaagauguuuguuuccaguuuuggugauuaugaauaaagcugugaacauuaugugaacauaaguuuuccuuucuauuggguaaauaauugggacugguaaugcuggguaauaugguaguuauuuguuuaaacuucuaagaaacagcuaaauuauuuuccaaagaaguuguaacauuuuucauuccuaccaguaaccugggcuuauuguuaacacuugguacuaucagcuuuaaaaauuuuauucauucugauagguauguaaugguauucauuguaguuuuaauuuugcauuuuccuaaugacuagugaaguugagcaucuuuuaaugaguauaaagauaauccacuaaagacacuuauuuggugaaaucucugcuuaaaucuucuacauauaaaaaucggauuguuuuauuauuguauuuugaggggucuaaaaauauucuagauacaagacauuuauaaacaauauguuuugcaagcauuuucuccaggucugugacuugccuuuuuauuuuauucacaguguuuugugaagagccaaaguuuugacaaagucaaauuuaucaaauuuuacuaucacacuggucuuuaaaaauaaaaaauuauuauuuuuuauuuuugauaccccaguuucuucaccucucugaugagauacagaugagauacugauguacaggucuacacuguuccccagggacccccagcagggucauacuuuuuguguuguauuuaagaaaucuuuuucuaauucaaggucacaaagauauuuucuuguagaaauuuuaaauucuagguuuuacuuuuacaguauuauccauuuuaaguuaauuuuuuguaauggugugacguaugaauugagguucaauuuuuuuguauaugguuugcauauggcucaauuuuuuuguaauuauuucaacaucauuuguugaaaaguuucuccacugaauuaccuuugcaauuuggccaaaaaucaguugaucauauauuuauggguuuauuucuagacuuucuauuuuuucuauuaauuuauauaucuuuccuuucaccaaagccauacuuuauuacuguagcuuaguaguaaguauugaaaucaguuagugugaauucuccaacauuguucuucauuuaaaaaaauuguucugguaaaaaauuauucgaguuuuuuuacuuuuccauauaaauuuucauugugucagauucuacaauauauuaugguaggauuuugaaaggagcuguguugaccuuauaaaucaauuuggggaaaacuauaacaauacugagucugauaauucaugaacaugguauaucucucuauuuauuuaggucuuuuuuuguuuuguaguuucuaguacauagaucuugcacauauuuuguuugguuuguaccuaagauuuuaugcuuuuuggugauaucaaaaauagcauucuuuuucaauuuugauuucuaauuguucauugcuaguauacaaaaauauaagugaauuuuguauauugaucauguauccugugauuuugcuaaacuuaccuauucuagauuuuuugugguagacucuaggguuuucuauacugcaaauuauguugucuuugaauagagacgguuugauauuuuucuuuucaaucuguaugccuauuuuuuguauauguuucgaacugcuauuuuguucaaaacauuuaauuuuuagagaaauauuuuaacaagauuaaauucuugccaaauuggcucucuggcuuauuacaagggauuacagccugaaggcccaagccuaauaacacaagaugcuuagguuagguuguuaguuuauuccugugcuuucuuuauauccuuauuucaagauauggcucaacuuuccucauggccuauugacugauguacuguaucaucaaaauagaaaauuggcacgagcauucuuuggauguaaaaaaucacagagguccuaaauacuauuagaauuacuauggugguaauuguucaaaauugccuaaugucaucuuaaugguuaugagagaugguuaccaaagcucuagggauuggauuuacaagguggauucaauuucaguucacauuuggggacaaucucagucuuggagggaguuaacaucuugaagaacagucaugugguaguuguccauguguggaccaaagacuauggcacuuucuucucaaacccuacauggcccugaauuaucuguuuccucuauucagcuaugugggcagucuuuauaauuuaaccuuucaaagcugugcuacaauacgaugacuagagcauuuuauauaggacaugacuuuuguguacuagugaccuguuauuuuccuguuuuggguuugucagggugauugaugugggguauuuuguggaagcagagucuaaagagucaucauuauuggcagugauaagggguccuggcauagcccucugacuuaagagccuucacacuucuugcugagcagauggucgcccuuucugugagcucccuugauacuuccacugcuauaauuuggacaucuuugcugaucaucacuuacuuguccaucuuccuugcuggauggagugugcauaagucagggucagagaaucuuacacucauccccccagggccucacucagggccuggcugaugauguugacugaaugagcccuauaaauacacuugcagucagucuggcacagugagaaggguaagggcucuggcaucauuccaacaauuggaaauuaaaauggaaaaaaaaaggcaugaauugaaaagguuugaaucugagcucugcugccuguggauuuccugugucuuaaguacuuauucuaagucacauuuuucccaucuguaaaaugaggguauuaucuauuucauuaguucaucauauuauaggacuagguaaguggauauuauuggaacaauuauuuaaugaauacauugugucacuuaacccuaucuacuagcauauuaucuccaacucaauugccuucccugguugauugggaguucagggcuguugcuauauaaacuggucauccccauuaccaucaauguggcugcuauugcuaguaaaaugccaauuagaaaauuagaugcucauauuaccuaggaugccacaguggcugauugcagagauacuugcugagggugaugccugggaucugugggccuccgugcuagucucagcaccuggguuuuauauucagcaguaucuauggggaguucgaaaacaugcaggcugccacaugucuggaggucauacaggcaauccagaaaguguaaagagauuccuuccucaaauuucaagggauguguuccaaccuuucaggcuacaauucacucuacaaguuuuaauaacauauuucugcauuuauuuuuuucugguauccucaauccaguuugaaggguaucagcuuugcuagcgugauacaucauuugggauuuuaaaaaugguauugcuaauaucugaguauaaauuuuauuucuaauauuaaaaacuuuccaaauuacacaaaagcugugauccucauaaguuuugucucuagaauaaaauuaugugacauuccuaaugcaugcauuuuguuuuuuguguauuuguuuuuuaaacuaagaacuuugaugaugcacugaaacuauuugacauagccucauuucaaaggcagucacauagaguucugcuaucuaaauaaauuaaagcugauaucacacaacauuucaguuggguaagcuugcaggcaaugcuugucugggccacauauuuauaaugucuaaugucuuuauuggauguuguuuaucuccuucuugaacacgauuuguucccucaucaaaguggaaacaugucaguauguucacaauuuuauaagugcauauacucuauguguauauguauguacauucacaucuuuacgucuauaaguaguaaaauauuuuuuccaggaguggguguacuuuaauuuccuuuguguuuuucuauguuucaaaauuaucuacaaugauuaaccagaaaagcaauaauuaucauacauaaaauagaacucuuaaagaauaucuuuccuaggcucgggccaagaaaaaaauaucauauuauuuuuggccagagacuaccagaauuaagaaauuaaagagaaggauuuugcagaauaaccucaaagguagucucaaaauccacaauuauacuaacugaacacagagaaagagagagaguauacaucaccuaccuaugucauguguuuuucuuuuucucuuuguaaaccagauugaaaaggaagaucaggccaaccccaaagaagaagugaccaaggaggaguuuaaacugaaugaacaaccucggcuccuggacucauugcuucacaacccaucuaccccuggaugaaguuaucuggcuucaaauauuaugcaggggcaaacaccugcugauguggcaacugcugaugcucaugguccccauggcaugggggccucagggcagccugccuggaggugagcagggcuaucucuguguguuguacuccagucaggggguuccagcagcacccgcaggcucuagagcucaaugcacaguucuuuuuguuucaccugcaguccuuucuucuccaggauaugcacaggccuccagggucuuucauggcucagggucaggguggcucaagugccaacccacauguuguccuccaaauauucccuucuaucccuggcaugcuguugcugagcucaacuuuuaauuuuugacuuucuccuuuguaauuaaucucuaucuggguuucucucuuucucugugccauuugguuuccuuaauuaguucccugugccagcccauagucagagccauaauuggcucuggggaagauccaaguuauuuucugaguaagauauuaggcuuccauaugauccagagaugcaaagaaaucccuagagaguguaggaguugucuaaauccaugugucagauguagccaacgaauuaugucagaagcagagagaaaaggccugaaaagcagcucucucccacuccucaggcccuugucuccaaccuuacaugaggcuuuuugaacaucuccuccuggcccagcuggggugagagcaaguccucgaaggcacugccuuugagccuugcucagcccaucugaacuaucccaacucuagaauugacugcuuucgaauugugugaccuugggaauguuaucuggcuucaaccacaaugcccuacccccagcuccucucccaaaugauccuagauacagggcugcuuccccccgacccuaccccaccucgggacacaggcucauggccucauggcacuucaccaccagaaguggugcucagaguuccuauuuccacaucuaacccccuaauuccugggaaagucugaggccugguccccccagugcuuucccuggcuggccucuccacauuuucaucugaugguggagugagaucaggaaaaauaggacaggagcuuugccuugggggagaagagaguuaaguguggaaaggggugaguuauaggagguuaagcaguccaagauuucucucucuguguaggaggccauuuccugaugugaggggucugaacccaauuaugaugggacaggguugggcauugacuucccaucucuucucucuguuuuucucccacuaucuguagcccaaaacucuuauggaggacuuugaucuuuaguauaggcuauuggucagggccauaggaacuaaccccgauccucacuccaccaggaucuaccacauccccuacacacaaacacaugcuguggggagggaguuuuccccugggucaaguugaggauccuuagaucaccuugugcuccuguggacuggugugugcguguguguguguguguguguguguguguguguguguguguguguguguguauguugggaaacuuagcuuucagagaaugucuaugggcucucauuuucucucucacacaaaaauacucgggacuucuccaagucccugaggagccugaccacugaagcugaucaugagaugacuguaugcugacacacccccuucaggggccuggccuugacuuagggcugcacuguauccucagcaacggccuugcaggagccccuuuuggacugcuuucccuauucagcccagaguugggguggugggagaagagggguuggagugaauccaucucuauucaaauuccagcugggauuacucuaggagucuuccuggcuuguuuugggcccaaacuuagcuacauuguuuauuggcucccaaagucgggauugaagagugaaaagaugcaggcaaugaauccuucugcacacuccuccccaaccuuuccagcgcuuuucuacuuaggaggccaguggaagggaggagaggccaugcccuagcccacaggggacaagguucauuguucuuccaggcuugguucacucugcuuuugauucagaagcucuuucccuacccagcaagacuacacuuucuugccuucuuucuauuuuuucuuuuugugcguauaaaugguauguugugauauauucucagugcuugugcccaccuuggaacucuguucuugcucuucauuccgcaugugauacucugguccaagaucuuggccaggugccuucugcucaaauaucgucucagaggugcuucccuugaaaacucggugcuguuuccauaguuacucuauuugaucacucuaaguuugguugucuucauagcacuugucacccucuggaacuauucuauucauuuauuuacuuguuuaaugcuuggcucuuuuccccuccuaacguaaacuccaugauugccaacaccuguuuacuuacuacaguucccccuccccccacauuccugacacuaguaagaaccaauaaacacuuguugacggaa

SEQ ID NO: 192110 - RNA, 91540 nt, Homo sapiens
gcggccuccaugcgggcgucaacguccgauccaagcgccaaauucaaauuugcggccaucuugagcgggcggaauucagucgcgcgcggugcagucgggagguggaggcaccggcugcauuguuuucgggaucgaggggugagggcgcuauggcacccggcugcaaaaguaagucugggcccccggcuucguuacccuauuuuugcccccaaauacagcugugaaaggauggcagccucggaccgcccgcaagguucuugcuaggcaugaacugcaggagcugagugaccggcggggacguuugggaaucccgcucugucgcucaaagacaauacgcuagccgaaaagcucaucccuuccuucaguguccugugcgcaugccaggagucuggcgcaguucuaggcgcucgggaugagcaguggaccugacguucuucccuuucuuucccuugguucugcuguuucuucgcaggccucuucccacaucccgaccagggcuaccucucuagauauccuugucucaggaucggcuuuugcucccaccagcuucugcguauuucuacauuucugaccuuccuauagggaaggguuuauuuauauuccaaacauuucuuucuccucuuuccuuaaauaaauggaauguuaaaacacagaugucagcaaugucuuuauguucucacagucucuauuuucacuuaaaggagacccguccgauuucuuucucuuuuucacggaggagagcacugucauuuugcuuaugauaaacccuacaguuuucacuaacguagucauuugcugugccuguguacgugcuccacuucucacauugccacaucucuuaaggagucuuauuuuuguaaaccugauuaugagcugauuuaaugggaucuuugugaguggucugaaugguaaugaggagaggccuggauuagaugauuaagaauuugugaacuucugucauuugagcuuuccaacgccguuaauguuucuagcuuucugucaauuguagucguuuuugauggguuuguuguuucauuaaucuuuuaggucgaucacaccuaaucggaacaccuccuuaugcuaccuuuuugcauauaaaauauuccuuuuccuuucaucauuuucaguauucaaggacuaugagcucacaaaaugguaccuuauuggagagaaauguucauccugcuuucugaacaaucauacuguuuguucuuuguuuccacuuuauggaucagucacuaaaucuggacucaagcaaaaaauuugaugccuguuaaauaaguaaaacaucugcuuauuuaaugagauauauguaugugacugagggcucuugucugaaaaccaaauuugagaaccuuucuaaaguggugggagcacucuccuuuaugaugguggugaugccauggggaacuuuuccacuccuuuaaguuuguuggcaaaauugagguugaugacuucccaguuaaagugcuucuugcauucccagcagcccagaggccuggagcaugaagugggaacacaugggagaagagagcccgugcaguggucuuugcaacuuuuacuuugugccccgaaggcuaucucucucucucuuuuuuauuuuugagacagagucuugcucuauugccgggcuggagugcaguggugcgauauuggcucacugcaaccuccgccucccggguucaagagauucuccugccugagucucccaaguagcugggauuacaggcacgcgccaccaugcccagcuaauuuuuuuauuuuuaguaaagccgggguuucacuguguuggccaggauggucucgaucuccugaccucgugauuugcccaccuuggccucccaaagugcugggauuacaggcaugagccaccacacccggccccaugaaggcuaucucuagugacaucauugacaccaugaguugcugacugugaaaucagagaaaugaaaaagugaaauauacgauuccccccuuuuuuuuuuuaaagacaguguugcucugucacccaggcuggcuggagugcagugacgcaaucuuggcucacugcaaucuccaccuccuggguucaagcaguacucgugccucagccucccaaguagcugggacuacaggcgugcaccaccaugcccugcuaauuuuuuguauuuuaguagagacaggguuucaccauguugcccaggcuggucuugaacuccugaacucaagcaauccaccugccuuggccucccaaagugcuaggauuacaggcgugagccacugcaccuggccuaagauucccuuucugaacccaaucauguuugggcaaaugacugaugaguauuuaucuagacugcagaguaaagcauccaauggucuguuuuaaagcaggaagacucuuuaaaagacuuacuguuuuguugagguauagcuucaugcaguuaagggcacaaaucuuaauauuauucaacaaauuuuuacauauaaauacacuaauguaaccaccauccagaucaagaaauagaacuguuccuguacuccagaaaguucccugugacccuuccuagucaauaacuaccugauccccaaccauuacucugauuauuauuaucacugauuaguuuugcuucuauucuugaacuuaauauaaaugguacaguauguauucuuuuuuuauucugguuucuucaacugaacauuaugucugugaucauuguccaucauuguauguagcagcaguucuuuuucauugcuguguaguguuccauuaugugaguauaccaugauuuguuuauucuccuguugauugacauuuggguuuuuauuauaguuagggcuguuaugaauaaagcuacugagaauagacuuaagcauauuuuuagauggacacauagaggaccucaaaguugaaagaauuuuacagugaaugccuauagacuucauuuuuuucuuuucuuuuuugagacagagucuugcucugucacccaggcugaagugcaggggugcgaucuuggcucacugcaaccuccaucucuguucaagugauuacuccugccucagccuccugaguagcugggacuacaggcaaccaccaccaagccuggcuauuuuuuauauuuuuaguagaggcaggguuucaccauauuggcaaggcuggucucaaacuccugaccucaaaugauccacccaccuuggucucccaaaguguugggaucacaggugugagccacugcacccagccuagacuuccuuuaaaugucaaaauuuuaugacagccacaugauaaacuuuuauacucucuuuaaccuuugaucaagagguagcauauugaggugguuaagaguaggagaucuggauuuagcaugccuucguucaaauccuagcacuucucaaugauguuuccuuagaucucaauuagaaauaaugccagaacuaucuacauuuguguaguuuuaaauuucacuuucucucgcuauuugcuuauuaacuuuucuucuuuuuuuaucaaguaaacauuuuacuuuggguuccuuuuagauuuaccagaaaguugcacauaagugcagaucaguauccaucuaaucauuuuccaucugaucaguuacagagaucucugcagaaaugaagagcuggcagccuaccuucuggggcuucuuauuguuguuugcuuguguauuugcuuagcaacuggcuggaucaauuuagugaagucuauuucccuccuauacuguuaagccuuugauauugcuccucaggaauccaaagcuccagcuuuggauaugcccaccuuuauccugggaugacagugguuuugguagggaucucuuucuuucuaugacugcacacagcuguuaaacuccaguaauuguuagcugauugcucuauuguuuuuuaacaaugcccugggcauaaauugucuuacaaacuacuucaauucuugcuccauugaaggaguaguuuuugagguuuucuuucauauuucuugugacuccaguguagcuacuccuaauugucuuauauccccauugucuucugcaagugaacaggccugcaauuuagcuuguaucuugaaugucuuccuaauuacuuucacuaaaaccuacacuguuccugagagugcccuuagguuugaacuucucuccacccccucucccccagacggagucucgcucugucaccuaggcuguaccacaguggcguggacucagcucacugcaaccuccaccuccugaguucaagcgauucuccugccucagccucccaaguagcugagauuacaggcaugugccaccaugcccagcuaauuuuuguuuuguauuuuuaguagagagacgggguuucaccauguuggucaggccggucucaaacuccugaccucaaaugaucuaccugccucggccucccaaagugcugggauuacaucaugagccaccacaccuagacagguuugaacuucucuaugcuuuguugcaaaugaauucagcuccuuugggaagagauuaggaguuaucuguuuaugggcugauucuuccuuuaggcaaaaucucagagccuggggacuugaguuggggauggggauaauggcagucuugucucugagugauacccuuuguaguugcugagcauuuuguggggaagguggggaguguagcagcccaccuucuagacuuuccuuuccuugugcagaaccacugccuaaugaguuggggcaagggugaucagggccccaguguucuuagcaugcaguugcaagaugagggcugugugggagaagggagagcccucaccucucaaccacacuugucugggacuuuaucugagcaucagguagcuagcuggagacacaaugauacacugacauccugcuacucuguggaggaaccccuugcaauuaggagcuggagggaucccuguguucuuggcugcugcaaucuacaguggaguguuugccuugcugagaugggagggagacagcaaucuuguuucaaauaacacaggaucaacuuucuugaugaauuuucaugaauguucuugaacagauguuucuugguuugcuguuugucuuugggaacauuuccagaggcuuuaauuuucuuuucuuuucuuucuuucuuuuuuuuuuuuuuuuuuuuugagauggagucucacucugucucccaggcuggagugcaguggcgugaucucggcucacugcaagcuccgccuccuggguucacgccauucuccugccucagccuccuggguagcugggacuacaggcgccugccaccaugccuggcuaauuuuuuguaucuuuaguagagacgggguuucaccguguuagccaggguggucucgaucuccugaccucgugauccgcccgcuucggccucccaaaguacugggauuacaggugugagccaccgugcccggccaacuuucuuuuuuuaaauuucaccaguuucacuggggagugggucaguggaauuccucauaaugucaugucagaagucaaucucugaacucuuuuuuaacagaauuauucugcccgcuagguugagaaaagaugagagugggggagaaagagaagcagaaagacuauuguaauaacacaauaaagagauauugcuggcuugguucuacacuguggcaguggauuuggcaagaaguuguuggauuguggguauauuuugaaauuagagccaaagcuuugcugagauuggauacgaagagugagaaagaacagggucagggaugacuauaugguuuuuggccuaagcaacuggaaagauggaguuaacggagauguagaaacacauuugggcuagagguggggugaucaggagcucaauuuuggacacauuaaauuugauucauugcccacugcauauccaguuagagauaucaaauagguaauaaguuguaagaguguggagcucggcugggcgugguggcucacgccuguaaucccagcacuuugggaggccgaggcggguggaucaugaggucaggagauggagaccauccuggcuaacaaagugaaaccccgucuccacuaaaaauacaaaaaauucucagggcgugguggcaggccccuguagucccagcuacuccggaggcugaggcaggagaauggcaugagcccgggagguggagcuugcagugagcggagauugcgccacugcacuccagccugggcaacagagcgagacuccaucucaaaaaaaaaaaaaaaaaaaaaggaguguggagcucaggacagcaguccaggaagguuuaaauuugugaaucaucaauuuguaccuaguauuuaaaaacaggccaggcaugguggcucacuacuguaaucccagcacuuugggaggccaacgcgggcagaucacaaagucaggagaucaagaccauccuggccaacauggugaaacaccgucucuacuaaaauacaaaaaauuagccaggcgugguggugcacccuguagucccagcuacuugggaggcugagggcaggggaauugcuugaaucugggagguggagguugcagugagccaagaucguggcacugcacuccagccuggugacagagcaagacuccgucucaaaaaaaaaagaaaagaaaagaaaaaaaaaaccacugaugcaagauuuuuugcuccuuagcucagcuaaaauccaaguucguguugcaugaccaggaaaaaucaggcacgcggacacaucgaaagaugaggagaguggaauuuauuaaaaggaagcucucagugaaaaaaagugugauacaccagcugaagaggccaggcuucucccccugcauaaggugcaaauucccaguggcuccacuccauucucccagggcgcaugugggccuuuagucugagccacuccacauugauuuauuuuccuuacugcgcauguguuaagggacagaauuuuucagugacccggcaggcguuuggcugucuccugucucuaucauuccccacucuaaagaaguacaucuaacugcccuuagaauaaagauaaggacaaagaccaaucuuaacugcuuccugcugacagggggugcuguguugggaaaauggcagucagauuucccuaagaggccaaucuaaagguuccuggcaaaagggaccauuaucugaggcuccaguugcacgacuggaguuugaugaccugaaggcgagaagagacaaacugaguuauuagaaaacauguaucaaaacaaaacaaggaugggguaaggacagaagucaugccagaagucaugcucgaaaaucccgaggccuuuuacugguuugcacagggagagggaggccaaaagccugauuguuaaaaguuaaaaaaaauuuuuacccuuuugcuggcuugucagucuucgagguucccuucccccaagcccaguccuaagcuauucucaaguuuaagguuugggaaauuaacuuuucgcaguuuagaggauggauccaaggggagugugcuguaguaaggagacacaauuaccuaucugugaagagaggacacaaggggaaaaggaaaaaagaagguguuuuuuucaaaggagucccagggguucaggauguauucaaaaaggccacagacugaagaugaauggcaauccaucaagaaagaggggagcaggugucccugguuccuuucucuuccuagugaauacccaggguaggugagggagggagaaagugacgugccccuuuucauuucuucuguccuuauauccccaagaccugggugaucaucaaagggugccacccaugaaugucaaagcggcuuucccccauguuaacagggcuuacccacguacgcccuaucuccccugcugucaguagccuucaaguucucuagaccucauuuaugucguggauacuagcaugauguuuauccaugaaacaggaggcuuggcuuaaucggcaggaguuagucaugcucaccugugcugugcuuuuuaacuucuguuaccgucugcuucuggaucccucagauccaguuuuuuuuuucuuagggcuuugaccugaaguugggaauugaguuugggaccaaaaauaugucucagggguuguauggacuccuuaucauaagcugaaugcuaaggugaagcugugaaagggguccuccuccaagggaaagaaaaggaugcccugugacacacccagauaacugguggcuauaguuauguuugcuaagauuugggugcauggagcuuggcuuugguuagcucccuuggucuuacuuucccaaaaaggaaaccucuggaugacaggcacuguauuuauucccaccaccuagcaggauuugcaggauaauugcuuagaacuagaauauugauucagauuuuuacauuacccaucccccuuuguuccuucugggcuguaguuggagaucucugguuggaucacaggcauaagcaggguuaguuuuuaaacgaacuaggcaaaaaacuugaaaacaacuagugggucuagaauuuaaugaugauaaguuuuuaaacauaauuuaucucucuccaguccucaguuuucuuaaaaacaaaccaugauaggacugaguuguuugcaaaauagacuuuggucuuauacuuggcuugauucuuugcaugaagugcagcaagaauacuuauuuuuacagagggcuuuuagauuggcuuugauggaacucuauuccacaaggaaucucagauaggacuuucuaaagcugaacccagcuguggguuuuuacccucaaauaccugugaguuggguaaacuccucucuucuugaggucccaagagcauaggguuccugggccuguuaaaaagugacacuucuuacucaccgcagauuaggaacccuguacagggacuguguaggcaagguaugaggccaguuuucccaaggagcuuuuaucaguucugcaagucaagcuugacuccuuaaaaggaagcauacccuuccagucaaaggccuugguaaaacaacuagugucuucaguuguguccuguugcaaagaaaauggaaucuuauugcacugaugcaaacaaauauauugucauaaguuaaguauacucacaacuaguuuccaaauucuggagaagccaggcagagagagagagacaaacaugcuccaaauuuuguucacaggaguauaccuuacucaauuauuaaaggcuguaaauaguucaaaauaaguuuccuucacucugaaaaacaaagcaaggauuggcaaugguccaagcgaaagucaaaaagauuacuucaguuuuguauucauuaaguccauccaguuaacucuuguuuugcuugauauucaugaacauuucagcucuucaugaguccuguuuguuuuuucuuuauucuaaugucucaaucuccaaaguuaucagaaaccugcauuugagagcaccuaugaaaguucuauggcugauuauaaaccaucuuuugaagaggaugaaaacaagacaacaauugucugugaauaacaaaauguccaggguaguuagagucagaaacagaauugacaaauaaauuugguuaucucugugguuuauaauaacuuaacauaacaaccuuaauugugauugauagcauauacucaugauggggcccuaagauaauuucugauggccugggacuccucggaaaaaacagaaaaggcaccacagauuccauuuuuauggccagacacuagaauuuuaggaauccuuuacaauuuuggaacauauauuaauauuauucccuaaaauauaaccugaagaagauuaaacauuauuuuggcaaucccauguaccuaaacaugucagguaauccuguuuaccucucuucuggaugugucaggggcccucuguagcauccaaaagccaggugucaggaaagacaauuuugaaacugaaguuugauuuugggaagccuguugaauauguuagagguuuaaaacauuugauuuuaugaaauagaauuccagauuaccguaaguuauuuauuuugucaaaaugaugacucagaaauuuuaaaaagcaaaaaccuuuuauaacccuuuacagauuuagcuaaagagcagauuggugccuuaagagaaccuuguugugcuuuuauuucaaugcucaauuuauggaaaagccauauaauacccuuuugaauuuaaucaguauguucacacaaggaauuuuuuuuugcaagaucaauuuuuacaauccuuccacuacuuguuuacacauuuagcuuuaucuuaucuaauucaaaacaguccuuuaacccuaggcaaaaauguacauuuugaugacaucugcauuuuaccaauaauuuuuaaggcuguuuuuauuucucaaagauuaaagucaugugaacuaaaagguaccacagcucuucuuuccuuuaaaaaauauuugaucuaagugcuuauuuuccuuuaggccaauuaauuagaacucuuguuuauagagaucacacacacaacacauacauaacuacacagccagaagaagauccaguagcuguaagauuuucuguucaccaauuucguaacuggacaauuagccucucaguggggcccuuuaagagcagggcuaggaaagcauguaguuucuagggccuaguaaacagguauagcuagaagacaaaaacagauuuugagagggauccauccaccucuaauuccuggggcuccauuaggaaaacaaaggucucucccaaaauggaauccauggagacuuuucuauuuuucccaaggagucucaggccaucagaaauuaucuuagggccccucaugcaugcauuaagaggggcaagacaaaauggagaaaaagaauucaguugacugagaaaaaaaccuuuacccagcaaaauaagaucuaagaagagaaaaacauaaaggucuuuuaaauauacuuauaacuuggauauccacuuucaauuaagcugaacgcuuuuuaagaaaauccuuuugagucccuuauuacccgacauuagccaugcaaaguggccaguauuucugacuuccaaacuuuaccaaagguaacuucccaggugcucagagaaaggaaaauucaaggugguucauggagggaaagagaaucaacaaauagcuaaggucacacagauaucaaaccagaaaggacucauuccuuaagccaggauugaauccaggccaccauuguaaaauggcagaggcuaaaacaaagcacugggcacgugguuacaggccgugcuuccaaggacauaaaacaagauggaggccugcagcaaaguuugccauuaaccaguuugccgggcugguuugaacaguggaccuauggaguccuaugccagcaucccauccuaagguaccccucuuucugacagagccauacagaaagacauggaaagcacaccagcuugguuacagcuuaagaccaaccucacaaauccuuuuucauaauugaaaccuuacagagaauauaaacagugauaguuggggucuuggccuaguaaaacaucuuaaaaaaaaaaaaacaacaacaaagccucucacauaaaaguuaaucucugguggaaaaaagaaaaaaaaacuuuaaaugcagggcuugaaagaugccugaaaggagaaccucuuauucuuaugcaaaugaguuuuugcagcagggagagaaaucuuuaauugcuguuucuucccuggggcuugaaccuagcugggccccuuggcuaggggaggggaggacucugugggcauguggcgggaaacccuggccagccagccaaguggggcccuugggccaugcaccccagccccacccagaaggggagggaugcaaggaacugccacucgccccacuugccuguccauccuacgcaugagccugcagccacuggguugcggguagaacacccccaacauuguagaagaaaagauaggugccauuacagucucaaaaaaaagaaggaaaaugccacagaaaggcuggguuggaaugaggccaacauucccuaccccugagagcgaugagggguagaagggggcacaguuuccucuauucucagaagaaguccgaggacaagaagccucagaaacaagagggaaaaauauuuuuugguucacauuuuacucaccuuuacucauguucuuauaugggccaccaaaaugaugcaggauuuuuugguccuuagcucagcuaaaauccagguucuugucgcaugaccaggaaagauuaggcacauggauacauugaaaggugagaagagcagaauuuauuaaaagaacgcucucaaugaaaaaaggagguccugcgaacaggcucccaccucacagauugaauaccaggccacaacacaccagcugaagaggccaggcuucucucccugcauaaggcacaaauuccuagugguuccaccccauucucccagugugcaugugggcccuuagucugagccacuccauauugauuuauuucccuuacugugcauguguugagggauggaauuuuucaccgugggcagguuuaggcaagcccccugugcacaaugaccugggcagcauuugacugucuccugucucuaucaccaugagacuagguguuacaaccaguaauggguugggauagaaugagaauaggaucaaggccugggcuguggagcacagcauuguuaaagucagggaucugaggaggcugaauguagcaggcaacccaggaacauguuagagaagaauaggauuuccauauuacaauuuaaaugaccuuuaauaacuuuuuuuuuuucuagcugaguuacgcagcgugacaaauggucagucuaaccaaccaagguaaggagaaaaauauucucaaugagcucccaaaggacuagggauggaauauuuuuaaaauaaccauuuagcauaguaaagaguacuuauuucaaaauuuaacuuaguccucaaccagcuggaaaugugggaaaacugcauauuaccucugcccucucacuuuccaggcaaaaugauagaaucaauagcauaauucuccuugggaaugacuuauuuauuauugcuaguaagagggaaaugagagacaagcacuacuuggaacuccaugcaaugaacacacacucccuuugaguucaaguaaagggaugugaaggugccuauugugaaguaaaucaguaaaagguauaggucaugugagacucuguaaaaagagauaaauuuggcugggugcagggcucacgccaguaaucccagcacuuugggaggccaaggugggcagauaaccugaggucaggaguucaagaucagccuggccaguauggugaaacccugucucuacuaaaaguacaaaaauuagcugggugugauggcagaucccuguaaucccagcuacuugggaggcugaggcaggugaaucacuugaacccaggagguggagguugcagugagccaagacugcaccauugcacuccagccugggcaacaagaaugaaacuccaucucaaaaaaaaaaagagguaaauuuguaugggauaugucuugggcuuuguuggagaaacucauuauagaaacauuauaggcaauaugagacuuggauccuuuuucaguuuucuucuucaauaaacugaacuguuacuuucuuuuuuuugucuuuaguaaugaaggugaugccaucaaaguuuuugugcgaauucguccuccugcagaaagaucugggucagcugauggagagcagaacuuaugcuuaucugugcuguccuccacgagucuccggcugcacuccaacccugagcccaagaccuucacguuugaucauguugcagauguggauaccacucagguaaugauaauuagaaacuuaacuuuuuuuuuuuuuugaaaaggagucucacucugucaccaggcuggagugcaguggcaugaucucggcucacugcacccucugccucccggguucaagugauucuccugccucagccucccgaguagcuaggacuacaggugcgcgccaccaugccuagcuaauuuuuguauuuuuaguagagaugggguuucaccauguuggccaggauggucuugaucucucgaccucgugaucugcccgccucagccucccaaagugcugggauuacaggugugagccaccucgcuggaaacuuuacuuuuuaccuggaacauauaagccuccaaauuucauuucuuggccaggcgugguggcucaugccugugaucccagcacuuugggaagcugagggggcaaaucaugaggucaggagaucgagaucauccuggcuaacacagugaaaccccgucuauacuaaaaauacaaaaaauuagcugguugugguagugggcaccuguaguccuagcuacucgggaggcugaggcaagagaauggcaugaaccuaggaggcggagcuugcagugagcggagaucgcaccacugcacuccagacugggcaacagagcaagacucugucucaaaaaaaaaaaaaaaaauuucuuuucugggcuggucucuuuuuaauuucauccgucucaaauaaggagacugaaacguuccauaaauauuuuaaauuuaaucuuauuaaauaguauucuccuuuuuucaucgaacuuuguagcagaaugacaaaagccuucuuuuuuuuuuuuccccccacuaagugauaggaaauuaugggcguaguggcacaugccuguuaucccagcuacuuggagggcuaaggcaggaggaucacuugagcccaggaguuugaggcugcagugagcuaugauggugccacugcacuccagccuuggcaacagagcaagacucuaucucuuaaaaaaaaaaaaaaaagaucugugauguucauuguaguagccauuaguuauauguggcuauuuagauuuaaauuaauuaaauaaaacuugaaagucaguuccucauauacacuagucauauuaaaaguguggcucaugcaucugaggcacuggagguuagugaagaugcacuuuuuggagccaguggaugauugagaaguacuguugaacugccuaaucuaaggauuuaggauuaccgugaugucaacaacugcuuuucuaauuaaggucaacuuaauuaagaccuaguuagugcuauccaauggaacuuucugcagugauggaaauguucuguaucugugcugucuguuacaauagccucuagccaaaugugacuauaugaguuuaaauuaauuaaaauuaaaucaaauuuaaaauucagugccucagaugcacuagucacauguggcuccugagcacuuuuaauaugguuaguguguaugaagaacuggcuuuuaaguuucguucaauuaauuuaaaucuaaauagcuacauauaacugauggcuacuauacugaacaucacagauuuuuuuuuuuuuuuuuuuuuguaagagauggugucuugcuuuguugccaaggcuggagugcacaaauaauccuccugcuuagccucccaaguagcugugauuacaggcauaugccacuaugcuuggcuaauuuuuuuuucauuccaggauaaaucucaguuaugccaagcuaaauuuuaaauuuuuuguagagauggagucuuacuauguucccuaggcuggucucgaacuccuggccucaagcaguccucccaucuuggcuucccuaagugcuaggauuacaggugugagccacuucaugcagcccaucacagaucuuaaguauucccuuauacauauggauguuuuugggccaacauuuagaucuuuggaucuuuuuuuuauguggagcaucgcuggccaauagauaaguaaaacgaggacugggugcuguggcucacgccuguaaucccagcacuuugggagguggaggugggcggaucacgaggucaggaguuugagacuagccugacuaacauggugaaaccccguuucuacuaaaaauaaaaaauuagccaggcaugguggugugcaccuguagucccagcuacacaggaggcugaggcaggagaauugcuugaaccugggaggcggaaguuucagugagccgagauugcgccauugcacuaaaggcgacagagugagacuccaucucaaaaauaaauaaaaauaaacaguguaggguugggaguucuugcauuuguaguaagacugcaucuccuuguagguaaaaaugaaaauaaaauggagguauugacuguucagugcaaacuuaugagaaaaaucacugaagaagauguacagccguuuauuuaugcuaguaccaguacaauaucuacaugcaauaugcucuacaaaauucuguauaaaguuuaguugugugcuuuaaaucuauagguguauaggagauuaauagauguaauuauguguaaaguugaaucaucuuagauaguuuagccuuuuuucuguaguggauguuauccauguuauuacuaagcaauuuuugcuguuacauuguagaaugcaauuuaggaaaaauguuuucauuuuuaugauauguuaacauguuugguuacauuuguaggaaucuguauucgcaacuguggcuaaaagcauuguggagucuugcaugagcgguuauaaugguaccaucuuugcauaguaaguuguugacuguguccuuauacauaguacaugcuugaauuauuuuccuguugcuguuguaacaaauuaccacaaacguaguggcuuaaaacaacacaaauguauuauguuacaguucuguaagugaaaaguucaacaugggucucucacagguaaaaucaaggcgucagcagggaugcaauucuuuuggcagccuuguugcuuucuggaaaauuuguuucuuugccuuuuucagcugcuagaggccacccacauuacuuagcuuacagcccuguuuaucuucaaaaccaacaacauguaacucuuugacucuucuuccuuagucacaccucccucugacagcagcuaaaaaagguuuucugauuuuagggacuaaugauuagauuggccccuccuggcuaucaagguagcagggauuacacuccaagguagaggaguaguguagagcagaguaucugucuaucuauauauauauaacuuuuuuuuguaagaaaguuuguccagccaggcgugguggcucacgccuguaauccuagcacuuugggaggcugagguggaugggucacuggaguucaggaguucaagaccagucaggccaacauggugagacccccgucucuacuaaaaauacaaaaaaaauagcuggaugugguaguggucgccuguagucccagcuacuugggaggcugaggcaggaaucacuugaacccaggaggcagagguugcagugagccgagauugcaccacugcacuccagccugggugacagggcgagacuccgccucaaaaaaaaaaaaaaaaaaaaaaccaaaacaaaaaagaaagauuugucuguuuuccacauuuauucaauucuuuauauguuauggauaugcauuuauuuuauucuuuagguuauaauccaguacuaaaaauuauuuaccuuguuguucuuguuguuccagcuuugcccaaugggcccuccuugagguugguuuuugugucccuuugcuauagcucauccuuuuguuuuuugagccccuucuuacuuuaugaugcuacaagaugcucugggcucaucuuguguuuucccugaccuacgccuagaaucagccauuucaccaaugaacccuaauuccuuuuauuggagcaugguauuuagaaaccaagaucugggcgcuagguguguuugguuuguugcuauuggaaugccauugcuucuaggccuucucagcagacagagcuagguaauacauggcaggguggguauacugucugguuuacugaggacaauaccaauugucaaguaauuauuaguaguguccucuucacucucaagugccuguuuggacaauaaucuauaggauuacccuauuuguggcugggcacgguggcucacaccuguaaucccagcacuuuggggggccgaggugcguggaucacgaggucaggaguucaagaccagccuggccaagauggugaaaccccaucucuacuaaaaauacaaaaaauuagccgggcgugguggcagaugccuguagucccagcuacucaggaggcugaggaaggagaaucauuugaacccggaggguggagguugcagugagccgagaucgugccacugcacuccagccugggugacagagugaaaaaaaaaaaaaaaaaaaggauuacccuauuuguagaggacucaauaauauccauuucucauucugaguuacuaaagaauuuuuuucccucuuuucuuccagaagaaggggguaaaaaacuauagcauacuguuuucuaguuuuggggggcauuuaaugaaaaaguaaauccaaaauuuucuguuuuugcugugaaucuaagcuaaagucuuuugauaucuugauuaacaucuuuaaaauacaacuuuuuuuuuuuuuuuuuuuuuuaaaagagauggagucuuguuauguugcccaguccuggagugcaguggcuauccacagcugugauucuagugcaccacagccuggaacuccugggcucaagccaucuuucuacuucagccuccucaguagcuggaacugccuggcuucaacguuuuuacuuuuaguuuuuuguuacucuuguuucuguuaagugggauaacaggagagaugacauugcacaaaaaccuauagcauaagaauuuuuuuauugcuuuauauuuaaaugaagagauuuuaguaucuuuuaaagacaaagaauuuaggaaaggaaaugcuguauuacuuggcauagcaaaaauuggaaacaaaaguucauuugauucugguuaaauaaauuauggugcugcaagaugcuauaugaucccaaaaccauggaauacuguguagcuauuaaaaauaaugaggcagaccucuauugcugaccuaggaagauaucugagguaaaauuaagggaaaaauagguugcaaagcaguaugaagagcaucaucccaauuuugguaaauaaaaauuaaaugaaaacucugauggcuauguuuguguaauauagaagcauuugccaauuaacagcaguuagcucuuuguagggagauuggagagaaaggaggcagaucauucacuuuuuaucuaauagaauuuaaaaauagaaagaaaauaagcuaacuuuuuguggagaaaacuuauacacuaguauuauaauaggaggaguagucuuuuaauuuuauguguaaaaauaauauguaaaacauuuuuuacaguggacagacuggcucagggaagacauuuacuaugauggguaaguaaagauuaacuuuuguuggcuuaaucuacucuuucugugauaacaguaaccuacaacauuuuggggaaaggcauaauuucuauauaugauguugaucucuugaaauuagggaaauucccuaggcuucugccaaguugugaguucuuugcuagcaaaguccauguguuaaucauguuugcagcuauguuuccagcucaaugccuggcacagaguggugcugaauaaacaguuuuucaguaggauuuaaugaauucguauauguuuauacaccuguauaaccacuaaccagaucaagauuccuggucaguaacuaccaaacccuguccccuggaaugccaauuacucugauuucugucaucauuaauauugcuuguuuuugauccucuacaaauaauauuuuguuguguaucuuuuguuucugaugucuuuuaguguuaaguuucugcgauucacucauguuguugcauguaguaguaguuuauuuccauuacuguauaauauauuaucguaugaauauacuacacauuuuccagucuacuguugauagacauuuggauuauuucaacuuuucaaccauacgaauaauguugcugugaacaucuuucuugugucuuuucaaauaauuuauguuggauauguauccaggagaauugcuggaucauaggauauauguauauuuagcuuuaguagauucugcccaacaguuucccaaagugauuaucucaguaguauauggaaguuccaguugcuccacuuccuuauauauacuugaaauugucaauuuaaaaaauuuuagccauucuugaguauguauaguauuaucuuauuguguauuuauuucuauugacaacugaauaccuuucauagguuuaauucgauauaucaauacccugucuguugaaaugcccauucaagcuuuuuucucccauuuaaaaaauuagcuugacuuuuucuuacucauuuguggauauuccuuauaaaacagagaaguuagccuuuuguccaugauauggauuccagauuuuucucuagauuuuucauuugucuuuugacuuacuuaagguuuuuuuuucuaugcuaaaguuuuauuuuacauggcugaauuuguuucuuuucuuuuucuucuuuuuauuuuuuuugagacggagccugccccugucgccuaggcuagagugcagugguacaaucuuggcucacugcaaccuuugccuccuggguucaaggcuauucuccagccucagcuucccaaguagcugggauugcaggcaugcgccaccacacccagcuaauuuuuguauauuuaguagagacgggguggggggcgcgucucaccauguuggccaggcuggucucgaacucccgaccucaagugauccaccugccucggccucccaaagugcugggauuacaggcagaagccacugcaccuggcuucuuuuuccuuaauggcuucugaauugugaguuguaguaagaaaggucuuccucgcucucugagguuauaacaacaacaacaacaaauaauugaauacuuguacuuacaguaugcccagcacucuucaagacacuguugguuuacuugaauacaaggcaguguccuggcucuuguggaccuucugauucucaggcagagggaauacacaauuaaaagcaaauacaccucuagaaauuaugccaaagguaauaagugcuaugaauuaaaauaaagcaauguaaagggauggaaaaaaguagagggugcuauuuuagguggugggucaggaaagaccucucaggaggugaccuuuggaguuauuaagugaaaugagagugaaccaugagacuguccaagagaauaaucuuacaggcagaggaacagcaguugcacaggcccugaggugggugcacacccaaggauguuugaagaccagcagaagacccacugagaguggaguuuuccaggauaaggggcugguagcaugggaagucggagcuauacccuaggccaggucauauaggccuggugaggauuuuggauuuuguuuugaauaugaugugacauuauuggaaguguucuuuuuuaaaauaaacaaauaggaaguacaugaucugauauuaaaaggauuacucaggcagcuaaauggaauaaagacgauuaggggauagagcgggauuaggagauacugcaguggguuaggcaagagaugaugaagguaauuaaagauuuguugaaucuuugucuuagucuauuuguguugcuguaaaggaauaccugaggcuggguaauuuauaaagaaaagagguuuacuuggcucacaguucugcaggucauagaggaagcauggcaccagcaucugcucggcuucuggugagggccucaugcugcuucaacucauggcagaagacaaaggggaaugggcaugcagggauuacauggugagagaggaaagugagagagagagagagacaaagagagagagagaugaggaggugccaggcucucuccaacaacuaguucucuugggaaauaagagaacucacucccaugagaauggcaccaagccuuucaugagggguugugccccccacacuccaugacccaaaaaugucccagcaggcgacaccuccaacaguggggaucaaauuucaacaugagaauuggggcaaaacauacuauaucuuuauauaauauauucuucaaugggaaaaugauguaaaauuaucuacauguucuaauauucauucucuuuauuuacuugcauuuuucuaccucuguuauauauuucuuaagcuacagauuacaaggaccauuuuaaauauuccaggugugguacaaggccuucuaccaaagacaacuauuauauuuuaaaauuuauucucuauuuuucuugugcaugucagcauuuuguuaguuccuuuggucucuaaggcauacuucaccaauauuuugauuguuaaauagaucuagaucuuuucuagcuauauauacuuuucugguaaauauugcuauaacuugaauuagaauuccuuagaauccugcuauuugcauauccacucuuccuuuucccaguguaacaaaauagagacucugcauuuuucugucuauguggaaaucuuguaagauauucuuacaguacuuuucuuaccagcuuggcuuuuauugccuaauuuuaaaaaaaucaacuagcuaauccugauuuuuaguacuuaauguguuuaaagcacuaacauggcucuaagugcuuuaccuuuacacucucaguuaauucuuucuuuuuguuuugagacggagucucacucugucgcccaggcuggagugcaguggcgccaucucggcucacugcaagcuccgccucccagguucacgccauucuccugccucagccucuccgaguagcugggacuacaggcgcccgcuaccacgcccggcuacuuuuuuuuuuguauuuuuaguaacgaugggauuucaucgugaucucgaucuccugaacuugugauccgcccgccucagcuucccaaagugcugggauuacaagcgugagccacugcgccuggccucucaguuaauucuuuccaauaacccuaugugauauuuauuaccauuauuauccccauuuuauaauugagaacucugcagcuuaagagggauuuaguaauuagccuauggucacacaguauggggccaaggccuggagcacaggucagucuaugagaccaaaugugcugcaauaaaggacaauuauuugauauuccugcagauuuugguaccuggcaguuggaaaaauuucaauuucucucacagaccuagauuuaacuugcuuggagcacaaguaggaaacugauuguaugguguaucaucuaauuucuguguaaauugccauuuugaaagacucuuggaauagaauaaaaauccaguguuuuuuuuuucauuuuuuuaggaccaucugaaucugauaauuuuucucauaaccugagaggaguaaucccacgaaguuuugaauauuuguuuuccuuaauugaucgugaaaaagaaaagguaaaacaauguaaaaauaaagugguucuaugaaaugucuaauuuugaauagguagcuacugauaauuagcucaugauacaugguggagcauggaugguacucuacaauaugaauagacuagcguggcauaaaaaaaaaccuuucaauucugaggauaauauuaaggauucugaguuguuuuaucucaacugaguuuuuaguuuauaaaacaugcauuauccuuuaucccaaauugcugguuuacaagaaaggaaaauagugcuucugaggcucucaaaaaaagauuuuguaagagagaaacuguaaagaaaaucucaacugaggaaaacagauacauuaauacacuaagccuaaucaucuaccuguaccuaggcucacaggugacugcaggugucccuaaauccucaugacauccagcagugauggacucauccucaccaccuuuguagcaccugcuacugccuuccaugaucuuugugcuccacaugugguauggcuccaucacccuggggauauggucuuuccucuugcauuggcucccagguugggccuucucacaguugugcugauuuagcuuggugaauucggggcuuagaaccauuaguguuuuauguuccauuacuuguguaccaaagaaauauauaacauugguuuaccauuuacuccuuugcagaaaucaccuaacacugaaauuagacacacaaauuguauggcagugaaauaauuuaguaccaugcauuucuaugguuaaaaauccuauaaagucuuuuaaaauaaauuauuuucaaucguuugaagaacauaacacuugcuucaaauaaaacuuuaugaggacaucaaauauauaagacagacaaaaauggaauuucccaacuggacugcucaauucuccucccccuguauuagcucccaggcaccuguggaggccucuagggugccuggcaccacaguuugaugcagcucuaaaauauaaugauguguuaaaacuaguuaucagcugagcacgguggcucacgccuguaaucccagcacuuugggaggccgaggcaaaucacgaggucaggagaucgagaccauccuggcuaacacagugaaaccccgucucuacuaaaaauacaaaaaauuagccgggcgugguggcgggcaccuguagucccagcuacucgggaggcugaggcagaagaauggcgugaaccugggaggcagagcuugcagugagccaagaucgcgccacugcacugcagccuggacaacagagugagacuccaucucaaacaaaacaaaaaaacuauuuaucuagauuuuuuuuacuuuuagguaucuuauauuguauuaaaggauaauagcauaggaaauuuacaucuugugaagcgagugcaaaauuaaugcucaugaaaacuagguaugaacacaugaaaauaauguaucuaaaugaggcuucuuuuuuacaggcuggagcuggaaagaguuuccuuuguaaguguuccuuuauugaaaucuacaacgagcagauauaugaucuacuggacucugcaucggcuggacuguacuuaagggagcauaucaagaagggagucuuuguuguuggugcgguggagcaggugguaaccucagcugcugaagccuaucagguacccugccaugaguacuuaauuggugcuuaggcaacaaaccugcugugaaugcaccccaaacuccaaaaagugacaauugagguaccaaaaauaugucauaaaggcauaauacagaauguucaugggaaguaaagauaaaauaauauggcaguauuuucuuuuccaagagucuuucaaaauggaaccucgaaagggcaauuuauacagaaauaagaugauacauuguaucaucaguuucuuacuuguccauauguuuuuagugguuccuccugggagaugccuguuugaggggcuucugggaacucuggccuuuaaaccagcuggcuguucuuuucuacguugcuugcuuguuaggugucaaaagcuaacuuaccuugagcauucagcucaggacaagcaaaccucuugacaggaauuuacaaaauauucuagauauguuuuuaugaaaucugaucuggcuuaaugauuugaaaguuuuuuauuaugaagcauuugacacauaugaaauauugccacaagcauguaaguuaccaagcauaauguuaaagugaacuuucaggaggcuuuuagacaauuuaaagacccugguaucaccaguacuauccgauuuacuggugauauuugguucuuuaaauaugcuauaaauagguaaauaggauaccuguccucccuaucccauaucccuggcucuuccccaaaauuaagcacuaaguugaaugucauuaucauuuucuuccacuuuuaaaucacauauguaugugguuuugccuguuuuugaguuugaaaaacacauauuuagcuuucuaugacuuuuaaaacucaaugugguuuaugaaaucuacguugcauuucauuuauuuucacugcuguaugauauuuuauaauuuauucuuuuaucuucaauaaaagauggaaucaagucucuugauuccagcuguuuaaauugagacuccccccggcgagagauagguuguacaugugacguaguauguguauacauacauacucaaaaauuuguguuggguuuuuuauuggaauuacauugcaguuauagaccagucuggagggauuaacaauucuuuuuacaauguuuuacaauauucaguccauacauuagcauaguaugucuccucuuuuuagaucuuuaaugucuugcaauauaauuuuaauaauuuucaucauaaaagucacacauacuuuuuguuaacuuuauuccaguauaccuuauguuuuuaguuucucuaauaaucucuuucuuauuuucauuuuuauuuauuuuuuuauuuguuuuuuuggagacagaaucuugcucugucacccaggcuggagugcaguggugcaaucuuggcucacugcaaccuccgccuccuagguucaagcaauucucgugccuuagccucccaaguaggugagacuacaggcgcgcacugccaugccuggcuaauuuuuuguauuucaggagagacgguuucaccauguugcccaggcuggucuugaacuccugagcucaggcaauccaccugccuuggccucccaaagugcuaggauuauaggcaugagcuaccgugcccggcacauaaucucuuuuuuaaauuacauuuaguguuugguguguauagaaaugcaguugauuuuuauaagaugcuuuuauaaucagccaccuugcugucuuaaaaaaucaagaauguguguuaaaguuuuguuugaugcuuuuuccaccauuguugagauaaucuugugcuuuuucuucuuuaacauguuaacacgauaaaguacucgauuaagauuugcuauuauuuuguuuaguguuuuucauaaauuuaaaaaauugagaucaaucuguaauuuccuuuguccuauuccuuuuuucuuuuuuucuuuuucuuuuuuuuuugagacagggucucgcucugucacccaggccagaguacaaguggcagaaucaugguucacugcagccuugaccuccugggcuuaacagauccucccaccucagccucccuaguagcugagacugcaagugcacagcauuaugucuggcugauuuuugaauguuuuuguagagaugagguuuagccauguuguccaggccagucuugaacuccugggcucaagcauuucaccuugccucagccucccacuauaggcgugagacacugcaccuggcccuauucucuuugucuuguuuuauuaucaauguuacuuguuuucugaaaguauuugugccugggaugacuuauucuuagaauacauaguagaacucaucugaaaaauuaucugggucuugugagauuuuuaacuacaaaacaauauuuuaauagagccaugcagccauguuauuucuucuugggucaguguuaguaaguuauguauuuuagaaaaauuucaauuuccucuuaguuuucaaguauauuggcauaaaguuguuccuaguauucacauuuuuacaaucuuugccauacugccauucuguuuccuuuuuacacaguuguuauuguuuauauggacuugcucuuuaauauuuucuuuguuuucaguuuauccuggguuuaucaugcuguucuuuuuccaacuucuuaagcuggauguuuacucacguuggcauuucuuuugugauauaaguauuuaauacuauaaauuuuuacuucuuaauacuucuuuaacuucacacaaguuuuaauauuuuaauuacgguguagauccaaauauuuuucuacuauaauuuuuuuugacucaugaauuacuuagaaaugugauuuuaaauuccaaagcgugugaggauuucuaacuuauuucucacauugauucucaauugcauugggaucgaagaauguggucuuaugugacaucuagucuuugaguuuuuuuugagacauaauuuauggauuaauaaccuuuuucuuaagugugucaugugugcuugagaagaauauguauccuugguacaagguuuuauauuuuugcuaguuuucuuguccguguaaucuauugauacuucagagagaugcacugauuucccacuaagguguugguuuuucaguuucauugcgauuuuugucuaauuuuauauauauauauauauauauauauauauauauauauauauauauauauaaaauagauacauacacauauggaaacacaacaaguccucacuuaacauccuuauagguucuuggaaacugacuuuaagugaaacgauguauaauaaaaccaauuuuacuacaggcuaauugauacaaagaagaguuaaguuccuacugcauauuuccagucauaaaagcaucaccaaacuucucaauaagaacccaacacacuucuaauauuaaacauugaaauaaaugucaacuauacauuuauuuuaaaaagaauaauaacaacuaagauaauuauuuacccagguuuugguggauaagugagugauggcagucaugguguuggguuaaaucgggaauaaauguuugcaaaguagaaauugucaggagcacuuccuaccaccauacaguucagaaacaaacaauaacaaauauggcgggcucacugaguacuuucauacugcauuguuuauuguccuguauuuguaugaguaucauauacuuuaugacauuuuuuuuuuuugagacggagucucacucucucuccaaggcuagaguguaguggugcgaucuuggcuuacuucaaccucugccuccuggguucaaacgauucuugugccucagccuccugagcagcuaggacuacaggcuugugccaccacacccggcuaaauuuuuguauuuuuauuagagaugggguuuugucauguuggccgggcuggucuuuacacagacaguugccccggguggaaaucauuuuauuuucucaaguucacaacaaaauaacacugaaugaagugaaauggaggaccugcuguggacuccuuuauuagguauauauacaaguguagaauuaguauauaucuuccuuuuauuuucaccuauaauuauuuauugauucuguacuuuccuaucaacacauuuugcuuuacaaaucuguuuugucugauguucaccuaccacugaacauucuuuugauuaccauuugccugguauacguuuucccaucaguuuuucuguuucuuuuuuuuuuuuuuuuuuuuuugagucucgcucugucgccaggcuagagugcaguggcaugaucucggcucacugcaaccucugccucccagguucaagcuauucuccugccccagccucccgaguagcugggacuacaggcaugcgccaccacgcccuguuaauuuuuguauuuuuaguagagaugagguuggccaggauggucucuaucucuugaccccgugaucugccugccucggccucccaaagugcugggauuacaggcgcgagccacugggcccggccccuucuguuucuuaauguuuuagguguuuauuguaaaccacauagcuauacuuugcucguuuuuuuaacugcucaugacaguaccuuaccuaauuuauuuacauuacuauaugauuguugauauucuuagacugguuucuaccaucuuucuuaguguguuuugccuguuucaucuaauacuuccuucucuuuucuugccuuuuuguuuuugauccaguaugcagcaugauuuauugaaaaaaacucuuuuuccuauuacauugccuuugcaucuuuggugaauugacuguacacauauggguuuauaucuaacuguauucuguucuguugaucuauauguuucuuuucaucaauauuaaauggucuugauuauuauauaacuuguugcuaaguagugucuuuagaucagguaggguaaguccuccaacacuguucuuuuuaacaauuauuuugguuauucauuguccuuugcauuuucauuuacauagaaccaguuugucaauuucuacaaaauaggcugcugggauuuugagugggguuguguugaaucuaucaauuauuuuugguagaacuggcaucuuaacaauauugagucucccaaucuaugaacacucaccagguauuuuuguuuuugauuuuuuauuuugauuuuuguagaaguauucaggcaaacaugcuuguauuugcuuuuuccccuuauguuacacaagugacagcauacugugcuauuuuuauaccuugccuuuuuuauuuuggagaccaagucucgcuguuuugcccaggcuggagugcaauggcaugaucucagcucaaugcaaccuccaccuccuggguucaagagauucuccugccucagccucccgaguaguugggauuauagcugucugccaccacgcccagcuaaauuuuguauuuuuuaguagagacgggguuucaccauguuggucaggcuggucuugaacuccugaccucagguaauccaccugccuuggccucccaaagugcugggauuacaggcgugagccauagugcccggccgcuuuuuuuagauaauaguauuuuggaauuugucucaguuuggaggaucucucucucucucuuguuuuuuguagcuguaugaauguaucagauguauuuaauauguaauauacaguauuuaauguuauaaaaagaaagcauaaaguacuauccaagaaacauaacagauacaaauagcugggcgcaguggcuuacuccuguaaucccagccucuuugggaggccaaggugguggaucacuugaggucaggaguucaagaccagccuggccaacaugaugaaacccugucucuauuaaaaauacaaaaaaauuaggcauggugaugcaugccuguacucccaccuacucuggaggcugaggugggaggaucauuugagccugggaggcagagauuucagugagacaugaacaugucacuacacuccagccuggguaacaaagugagacucugucuuaaaaaaaagaaaaaagauacaaauaauuucaguuuuauacuguugcugauuaauaggguuauaacagcuacgaauuuuuuuuuuuuuuuugugaugagacagagucucuguugcccaggcuggagcggaauggcccgaucuuggcucacugcaacuucuaccucccggguucaagcgauucuccugccucagccucccgaguagcugggacuacaggugcaugccaccacacccggcuaauuuuuuauauuuuuagcggagacgggguuucaccguguuagccagacuggucucggucuccugaccucaugauccacccaccugggccucccaaagugcuggaauuacaggcgugagccaccgugcccugccaacagcuaugauuuauugagugaaggugccaagcacugugcuaacuucuuuuguauacauuauuuuacuuaauuuucaauaugcccuuugagauaaagacacuaauuuccccauuuuacccuauauauacuguuacccuccuacccaaaaugugguccucagaacaucagcaucaccugagagcuuguuagaaaugcaaaaucucaggccccaccucacacugaaucugaaucugaauuuuaacaacaucuguagaugauucauaugcaccuaaaacuuauauguucuguucuaugggauagguacccauauucccauuuuacaaauaugaaggcugaggcuugaaaagguucagcuggccccagaccucgccuaguaaauaguggagccaugguuugaacucauaugcaucugauuccagagccugcauucugaacuuucauguauccugcuugccauagggaauagaagggaaaaaauacuuuguagaccaaaagcuuacaaaacuuugggcuuaaagauaauuuacagauuuuuccuguccaacauucucauuuucuagguaaagaaauggguucagagagguuuugugauuuacauuagguuaacacaaauaaagcguggcaaaaccaguucuagauccuaugcgcucugauuuccuguuuguucuguuucuguaauguggaaagggaacacaaaggaaaggaaaauaacuucagcuuauuccuuaauggaccaguaaucuuucucaccacccuuuacaaauuuccuacugauuuugguggcuguuguguaccauuuggaacuugggauaauauaauuuaucuuauaaagcuagauaacaauggaaggcaauagauacuccucaccccuguucuaaauagaaaauaugcuuuauguaaauauauuucuuuuucccuaugaaaguagauaauuagcuguauguuaguauuuuucauaauaaaaugagugauucucaagugcuuauuuuacauuuuaaguguaccuauucuuguuccuuuuuuuuucucuuuuccuuuuuuuuuuuuuuuuaagauaggaucuugcccugcugcucaggcuggagugcaguggcacaaucauggcucacugcagccuugaauuccugggcucaagagaucuucccaccucagccucccgaguagcuaggacuacagguuccugccacuguacauagcaaauuauuauuuuuuguagaggugaggucucacacuauguaggucaggcuggucuugaauuccuauccacaagugauccuccagacauggccucccaaacugcuaggauuacaggcauaagccacuguaacugguccucucauuucuuuuaauauguuuuccuuuugcauagguguugucuggaggauggaggaauagacguguggcaucaacaucaaugaacagagaaucgucuaggucucaugccgucuuuacaauuacaauagagucaauggagaaaaguaaugagauugugaauauacggaccucccuacucaaccugguggauuuagcaggaucugaaaggcaaaaagauacccaugcagaagggaugagauugaagguaagaaugaaauuauggucuucaacuugugugugaguucuuacuagcagucaauacagucgugaugcaugacagugucucagucaaugaggaacugcauuuaugaugggggucccuuaagaguauaauagcuauaccacauggcuuagguauguuguaggcuauaccaucucgguuugcauaaguauauucuaugaugcccacaaaacaaucaaauuuccuaacagcacauuucuuaaaauguaccccuguuagccgggcgcgguggcucacaccuguaaucccagcacuuugggaagcugaggcagguagaucacgaggucaggagaucgagaccauccuggccaacguggugaaaucccgucucuacuaaaaaaauacaaaagucagcugggcguggugaugcgcgccuguagucccagcuacuugggagacugaggcaggagaaucacuugaaccugggaggccgagguugcagugagcugagaucgcgccacugcacgccagucugggugacagagagagacucugucucagaaaaaaaaauguauccguguuguuaacugauauaugaccauaccaagcuaaguguuuugaggguggcaaagaaauaagaaauuguuccuauugaaaaggaacagagauuucuuuuguggaacagugaacauagaugggauagggcaagucugucaguagcaaaaauguuuuaauucauaccagaggggauaaggguacaagagacaacaggggucagaggaagaagggugcaauauggacugcuuguggaacauguggaaaagaaguaguucuugacuugugaaggauuucgguagggagagagaaacaggaaaugcaugccuggcaggggggcaucucaaggguuauuguggaugcagaaugaguguagcauuuggcauuucagcauggcucaauggauggguugguuagagaggcaagcaggcccggauuaucaaggaccaggagugccaggccaaguuuguaucaacucugcgaauacugggaaacacuuaacauuucuuagcaacuaagugauucaugaagaaagccuguuuuauagaaacuuagucaucugacccacugcuguuaagauuuuagaagggagagcccacagaaaaagaugaccacuuacgcuguuuaauauuucagguaugaaggguuaaguaucuaguccuaggcuaagguaucaacagugggaccagagguucuauguaauauguauugucaauauguguuuauauauauauauauauaguaauacgaauugucaauaaaauauuuguagagucuauaguuuagaauauacaugggcaaggggagaggaauuggaaaggaugagggaagagaucuacuuuuuucauuaaaagugaggauuugagucgccugaccuacauuugaggcaguuucaggcaaucugaagcucauauuuuuuuguuuugagacagucucacucugucacccagcuggagugcaguggcaugaucucggcuuacugcaaccucugccucucugguucaagcaguucuucugccucagccucccaaguagcugagauuacaggcgcccaccaccacacccagcuaauauuuuguauuuuuaauagagaugggguuucaccauuuuggccaggcuggucuugaacuccugaccucaggugauccacccuccuuggccucccaaaguguugggauuacaggcguuagccaccacgcccagccuaaagcucauauuucuauugagauaugaggcuuaauaaauauagcauauggguugagcaugguggcuuaugccuguaauccuagcaccugggaggcugaggugggaggaucccucgaacccaggaggucgagauugcagugagcugugauugugccacugugcuccaaccugggugacagagugagacucugugucaaaaaaagcauaugcuuauaauaggacauauaccaagucuguucuaaaaugcuuuacauauauuaauucauuuaaccuucccaacaacucugggaaguaggugcuauucuuucuauuuuacaguuaaagaaaccgaagucacacagcuaauaaagguagagcugagauucaaaccgagcugcuacaguacucucaaccaugccacuaaccaccuuucugauuuacugaaugauaacagcagugacucugaauucaguacaucuugcauuauaauuuugacuuuuucucuuuuuuguauacuccuuccacugcagacccaguuuucaaaauaugcuaccuacaguaaaaaucuaauguaacguauuuagcucauuuuuuccccccaccaagcuucuguuuuaaaguaguuuuuauuauccuuuacagaauuaaacugaauauucuccucaaauaaguucaucaguggcuuugggggcuguaugggugaguuauuaggcauuauacccuuaaauauuuuagcauaaaaggauugaaaaaaguaccuauuaaugcacuacucuagcuuuuuuuucccuauuuuuuucuggucuuuauagcucgguuucaaacuauuacaaucaugaagugacauuaauauuuuuuuucuuugcaugauuuuuguguuugucuuuuuuuguuguuguuuuugagagagggucucacucugucacccagguuguagugcaauggcacaaucucagcucacugcaaccuccaccucccaagcucaagugauccucccaccucagccucccaaguagcugggacuacaggcaugugccaccaugcccagcaguuuuuuguauuucuuuguagagaugggguuuugccauguugcccaggcugguauccaacuccugagcucaagcaaccugcccaccucggccucccaaagugcugggaugacuagcaugagccacagugccagccuguguuugucuucuaauacuaaaauuacaguguacaucaaauaggaaaagguuagggauaguucagcacuucuuuuuuauuuguugaauaguuguucuuuauuaacauugucccugacuugccuuuucauccagaauuuuccucugcuagauauauuuucauucaaaauaccaaagaguaaccaacguaccuaaauuuuuguucuuuuccgucaacacuuuaggaagcagguaacauaaaucgaucauugagcugccugggccaagugauuacagcacuugucgacguggguaauggaaaacagagacauguuugcuacagagacuccaaacuuaccuucuuacuacggguaaaguagauccuuggguuccugggcuccuuuugguuaugcuaaaguugauagugggacagucucucagccuugguggcaagaguauacauuuucuuugcuuaaaaaggucuugugauuucucaccgaaaauauguucauuccuaucauuaaacaggauucccuuggagguaaugccaaaacagccauaauugcaaauguucauccuggauccagguguuuuggggaaacccuaucaacacuuaacuuugcucaaagagccaagcugauuaaaaacaagguaaaauacuggcguauacuucauuaaauaaaugagaaaaauacuaaagcuuacaguaugccauuuuugugauugcccuaauauuaacauuaacuuuuauuuauuucucauuguaugcaaaauuucuauuuuaucuuuccuacccuucuauaucacacauguaauuagagaccuagguuagaucuuaugguuguuauugcuugacuaguuuuuucuuuuuuuuugagacacagucuugcugugucacccaggcuggagugcaguggugcaaacacagcucacucuagccucaacuuccugggcucaagcgauccuccugccucagccuccuguguagcuggaacuacaggcaugcagcaccaugccaggcuaauuuuuuuauuuuuuuaauuuuuauuuuauuuauuuuuuauuuauuuauuuuuuugagacagagucuugcucugucacccaggcuagagugcaguggugcgaucucugcucagcugggacuacaggcgcccaccaccacgcccggcuaauuuuuuguauuuuuuaguagagacgggauuucaccguguuagccaggaugaucucgaucuccugaccucgugauccgucugccuuggccuuaauuuuuuuauuuuuuguacagguaggaucucacuuuguugcccaggcucgucucaaacuccuagguucaagcaguccuccugccucauccuuucaaagugcugggauuacaggugugaaccacuguacccagcugacaaauuuuuucuuaagggaaagcaaauuaaguaugugagucuuucuuccugccaacagccaaucaaucaguucugcagcagacaucagcugagugucuucugauucaguuccauccugacacuuuaugucuggagauagggugagaucucacagguucagggcucaguccuacaagacugcgcccaacuucugaugccaauugcaagccccagcuuguccuaucugugcuuucagaccaacuggcuguaaaucaggagguccauguugccccuuucccuggguaaaucagaagacuauagaucuagucauuuauuuuauuuccuuggacuauggaguacuaguaagaugaggaggaaaaaucauuagagcuuccugacccuaagucucuuaagauuuacuagaagucuuuggagauauagaacugcagcaauaauuagaauuaugaagucacugaugggacagugaugucagaagugcaguaguaccuuguaaugaggcuggccauaagaaucagaagcaacuggaaauggcugcuuaacacacaaaagaacaaaaccaagagccuucuacuagucacucucaaugguaagcccuuugcagccuaucaguggaaagugccagaguaucugggacuuguuuaaggaugugcuauuuaaauuuuuccgugagcaaauugggcuuacagcgagaauacagaagaccuuggggcugucacaggguguuuuuuccuugcuggaguacugaguauuucacaacugaguccucugaccugguugguacucagcuguuggcacucguuaucacccuuuaggcuuuguggaccuuuuuaaagcuuuauuuuuuuaauuaaucaacuuuuuuuuuuuuuuugagauagagucucgcucugucaacaggcuggagugcaguggcgcacaugugugaccugccccacucuugacauccugccccacaguggcacauuuuguuugugaguccuuuagccuuuuagaaguuguccuaaauaagacauuucuuuaagaaaaugaagauaaucauuuagugugguaaaaaauuaaaaaaaaaaaaaaaaaggaagugucaaaccaaccccuccuuccaagagggcuguuaaaaaauaaaggucggauuccucuggagaagguugcuucugccaagcucaagcccacccugcaagucaucaugcacuuagaggcuaggcuccuuccccguagggagcuaggaaagaagggaaaugauacucacugagguauuggcucuucuccauugggagggugggggaaggcugucguucucagggaaagaaguauuaggugaacacacccggauccuaagggugacccagccuaaaagcucagggcuagucagcuggggggcagagagccuggcuggggcugucucucucuggcuccaggucugaaggcacaagaaaaggaagcuuccuccccacuugagcacacugugauuccuguguccuuuugacuaugauguggucuugaaguuuuguuugauguucaucacuacaaaucauaccaaacaaauguaaacacaggacuauacuacucaaaaagcauuauuuuaaugcuuuuuaaaaaauuccugaacaggcaguaguaaaugaagacacccaaggaaaugugagccagcuccaagcugaagugaagaggcucaaagaacaacuggcggagcuugcuucaggacagacaccaccagaaagcuuccugaccagagguaggaugagcacacaguccuuuaucuuggggaagacuguacaaauaauaguuuaagagcccuuggugauagacacaacacaauaaggcaacccaaauuuuucugcagguaucucuuucugcuuauuucuccuauauaggaacauagugguuuguuuauaaucagauacagauaccauaggcagugagaagggggaauuaaaauaauuuugaauaauguauaagugcuaaaaagagauuaauuucauuuagaucuacuucuacguagcauauguaaucuauauauguuuacuauaggauaagagagacuuauuuuucuucaaagaauagcuaguagagaauuaauuaacuggaaauccauaaaggcaagagggugaauuauuaacagaucuuaagaggugcacagcacccugggacuccucuaauuuuuuaaaaaaucuacuucuacuucuguuacaccauguguaaucuauugugcauauuaacuaaauaaagagaaacuuauucuuugaagaacgacuaauauguggaaugguuaauuugaaauccgugaucuagugaugacggucucauuguuuuuuuuuuuuuugagacgcagucucucuuugucacccaggcuggagugaagcagugugaucucagcucacugcaaccucuaccuccuggguucaagcgauucuccugccucagccuccugaguagcugugacuacagacccacgccaccaugcccagcuaauuuuuuuguauuuuuaguagagaucgggggcggcgggaggggggggucucaccauguuggccaggcuggucucgaacugcugaccucaagaaagauauccgucugcuucagccuccuaaagugcugggauuacaggcaugagccacugugcccggccacagucucauucuuuuagauuaguugagagcaaucaauuaaaggcuaucuguucucuugguuuugcaaugugauaaauauuuuuuuucaucuucccuuucuuauuggaucaauuacagacaaaaagaagacuaacuauauggaguauuuccaggaagcaauguuauucuuuaagaaaucugaacaggaaaagaagguaggaaauggaauuaguaauaaaggagauucaagauaguuaguuuuuugcugugugguuuuuauugccuuacuaagugaaauaaauaauaccaagucaauaaaguaauggaaggcuaugaaaaaucaaauuuugccuuuaagauuaaauaugaaauuaguauuuguugcuggacuuacgaaaauuuagggaagucaaauuauuuuucauguuuaaccaaauuaugaauuucuuuaagucucugauagaaaaaguuacccaauuagaagaccucacccucaaaaaggaaaaauuuauucaaucuaauaaaaugauugugaaauuccgagaggaucaaauaauacgcuuggaaaagcuccacaaggaaucccggggagguuuucugccugaggagcaggaucguuugcucucagaauuaaggaaugagauucaaacucugcgagaacaagugaguauacggcaucuauaauauuucuaaaaauaaaagaaguucaaagcaaaucuaaguuugucagcaaguacuuguucuuuaauacaauggaaauuguuuuaagugaauucuucugacagugugauugcauaauuccuuuaccugucuuuuuaaaauaguuaaagggaagagaaggggagaaggaagaaguuguggugacauugcuacauaguaugcuacucuagcaggccacgcagaauuucacccagugggcaguugugguuaucugagucaguaggcucuuuaggguugugccuuuuaacguuuuuguuguuuuuccuuuuccuuagggagaauggauaggucauacagguacauugugggaaaacccaaaaucucuuaucagcuucuuguuuaucucucuggaguuuuuaaugaauauucaaacuaauauggguggauauuuguacuuuuguuucuccuguacacuuuuuugcacuucgccuuuuucaguuaaucuugguugacaagauuaauuugguccuuguucuuuucaguguguugauuuaacuagucuccuuugcaugaaaagccugccacaauguacacccuugugcuuaccuccuuaggugggugaacauuucaagggucuagacuccaacugagaauaggagaguuacaggacaugcauauuuucaaacugaucacaaaugccaaguugcuuuccauggugguugcagaaggguaccaccaguagugcaugugcauaccuaguuuucuaauggcuuuuuagaggaacuaauucacuaaggaaauguuuguaaauauauaaugcguguaauucuucuaugucacagauagagcaccaccccagaguugcaaaguaugcuauggaaaaucauucccucagggaggagaauagaagacugagauuauuagagccugugaaaagagcucaagaaauggaugcccagaccauugcaaaacuagaaaaagcuuucucugaaauaaguggcauggagaaaagugacaaaaguaagaaaugauuguuguauauacgugccauguaggaaggggcuguuuuaaagagcauuuuuagugccuugugacuagggucuucauuuuagccuccaggccugcuaugcuaaugucuuauacacauauucuuuuauauuauagaaagguauuuacuaaacuuuucuuuuucucaaaaaucacagagcauaaacuacguaagcuaauagauauaacgagaaaauacucauuguauuuguuuuauugauaaaaagauugauucagauacuauguuaaauuuuuacuaaauuuuccuguuuaaaguauuugaaaugaaaagucuuuaacuaaucaaacgugaauaaaaauagaguugaaauguuuaucaaucuaauuaguccugugcaguauaagagauauagaaaggucagacucauagcacaguguuuggguccugauguuguguuuggguccugguauugugguuaccaauguaugcagucucuaguuacauacuacuuucauaaguuugcauacuaugugaaaagugguuuaguuaauacuaaaucugccuuacagucuugacagcuguugguguucauacccugggauuugguaacaaagucuguguuugccccagucuuagaguuaauauuuucacggucuuuuaucauagacuuggccuugguuuccuuuuagguugaaauugaaaaaguucuaauguuuuuauucugcauucauaaagaagacugucucuuugcuuuuuaaaauuucauuuuuuaagccuucuuccauucuguuaugacugaauagaauaauaagagucacaguaacuggguuggggagagacuuaagauauuagaugcaaaauuacuaucagguuuucuguuguuuuuuuugagauggagucucacucugucacccaggcuguagugcaguggugcgaucucggcucacugcaaccuccaccuccuggauucaagcaauucuccugccucaggcucccuccugggauuacagucacacaccaccacaccgagccaauuuuuguauuuuugguagagaugggguuucaccauguuggccaggcuggucuugaacuucuggcuucaaaugauccacccacuucggccucccaaagugcugggauuacagaugugagccccaacgccugacuuagguuuucuguuuuauuuaaacuacuuuucccuacagugcccuuuauuuuguuggccauuuuguuguggccuccauaauaccuugacuuacucccuucagaagauacuaaugucuggaucucaucaguuucuaaacauugaucauucucuaaacaacuuuuacaugaucuuuucccacacugaaacucaguggacucucuucaacauauucaguguucuaggcauuuccugaaaauuaauauuuucuaccugauagaugauaccggguucuuacaaccugcugcccuugcuauuuguuuccuuuucuaaauaauuccuuggcuguuaacauuagcugcuagcacuaauuccuacaagauucacuggcugcuguuucucugucuagcauuaggcgugccacacuuucgucauuguuuguucuuucuccuaaugggaaagguguugccuuaacuacacuucuccauccuguggcaucugcuucuuaaacaugacuucuaauccccuuuggcacacugugucacauccugugccuucugcugaguuauaagcuuuuguauuuuagggcucgcuuuccaacccauuucucacuuuuccuccuuguggcccaaaauugauaccugacagagaacuuagaaaauguguccuguuauuuuugcuugucaaacacugaaguuguaaagcuaggcaugguggcaugcaccuguagucccaacuauuugggaggcuaaagcaggggguucacuugagaccagaauuuggggcuuuaguacacuaugaucaugcuugugaauagccacugcacucuagccugggcaacauagugaggcccugucucagaaaaaaaaaaaaaaagacugagauuguuuucuuauuaacagaucagcaaggauuuucaccuaaagcucagaaagagccauguuuguuugcaaacacugagaaguuaaaagcacaacuccugcaaauucagacagagcugaauaauucaaagcaagaauaugaagaauucaaagaacuuacuagguaaagucuaaauacacaugcaugcacacuuauuuucuuucaguguucauuugcuguaguguuaauaucgauaauucaauugggcauuuuacuuuaaauauuaaacucucauagcagcaacuacuuugacaugaagagaaagagcaugcuucuagcucuuuacuaauauauucaaugaacuagguaauacagguguuuuaagcaguuuuuuccuguugagagucuauugaacuugcauaguaaauuauuuaaauuuaaauuugauaaucagaguuguuaagacuuuuaggaaguauagguuuguuaauauuccuacuugauucucacuauguaaaaacaaagauaaaucacauucauauuauaacuaagaucaaucuuacccuaaaauauaaacaaauguuugguucaaaaaugacauaucacauaugguauaaucauggacuauuuguuugggcuuuugaauuugagcccuaccauuuacuaguugaaucccuuaaacagucucugagcuguaguuuacugaacuggagaaugaugggaauaaucugagagaauagagaauaucucugauuuagagauaacuauaaaguuaugugagagcauaaacuguaaaguauucuauaaauguuugacauuacuuauuaccugaaauacuccguuuuacaauaucuauuaggaaaaggcagcuagaauuggaaucagagcuucagucuuugcaaaaagcgaaccuuaaucuugaaaaccuuuuggaagcaacaaaagccugcaagcggcaagaaguuucucagcugaauaaaauucaugcugaaacacuuaagguaggucaucugaacaauaccuccaccuuaaaucagugcaaugucauuuuauuaauaauggagagagucugcauggucuaucuccagaugcagaugacaucccaugcagguaauuaacaccggugucacacuggucuuuggguuacugcuagcaaucccacugauguauccccccagugguagggugggguaggaaagaauucagcauuugcaaucaaauucgaaugugccauuaacuuuagucaggguuuccuaacuucugagccuuaucuuucuuuucucuaaauuggaaaugaagguaauuuacuugcagaguuuuagaguacuaaaugagauagauaagcugccugguaccuuguagauaucaguaaaauggcagcuauuacuacaauauaacauguccucaaaguuuucaguagaauagaaacccuaaugggcaaagaccgcuaagggaucacaggugccacuggaaauaacaugagaggguuuuguccuaaauaaccacaucccucauaaaagaaaaaaaaaugugugaacaacugagaaugaggagagagaaaggaaguacacaaggaaaacaaaagguugaggaggugauacugauuucagcuuuuguauccaauuuuuugaagguuaaaaaauuuuuuccuuagcugggugugguggugcaggccuguagucccggcuguuugggagguugaggcaagaggauugcuugagcccaggaauucaaguccagcuugaauucaaguucuuuucuuuucuuuucuuuuuuuuaagacagagucuugcucugucggccaggcuggagugcaguggugcaaucucagcucacugcaaccuccgccucccagguucaagcgauucuccugccucagccucccgaguagcugggauuacaggcgccugccaccaugcccggauaauuuuuguauuuucaguagagaugggguuucgccauguuggccaggcuggucucgaacucaugaccucgugaucugccugccucggccucccaaagugcuaggauuacaggcaagagccacugcgcuggccucaaguucuuuucaauaaaagaaagaaauagagaagaccgaaaaccuuuccuuauaugucuuagaauauaaauagauguuuauuuauaaugauuauuuuuaguaguggugcuuuuugugucacuuaauggaagacuacuuguauucauuugaauagguaauuuaugugacugaaauuuccuuucuuuucuuuuuuuuuugagacggaguuuugcucuuguugcccagguuggagugcaguggcacgaucuuggcucacugcaaccucugcuuccuggguucaagcgauucuccugccucugccucccgaguaguugggauuccaggcgccugccccaacacccagcugauuuuuguauuuuuaguagagacgagguuucaccauguuggccaggcuagucucgaacuccugaccucaggugauccgcccgucucgccucccaaagugcugggauuauaggugugagccaccgcgcccagccugugacugaaauuuucaaaggcauuuaguagcaaaucucuuuccuucuguuguucuuccagccaaccaagaacuggaggcaaucagugucaccaagucaaucaaugucaccaaguauuuucucacuuuacacaaaugguggcauaacauacacaucauucuacagcuugaggguguguguguguguguguguguuuuaaagcaauauuuuagaguuugucccaugucugcaggggaaaaaauguucucccccuuuuuguuucuguuuugauuuuuuauuuguuuuggcagcagcucaagaauguuauguggauauauaaugauuuauucaaccuggaaaaugcuggguuuuuuccuauacagguagaaauuuaaaaauuauuuuuaaauuuugauuuauuuuauuuauuuauuuuugguuuuguuuuuuagagacagagucuugcucugucacucaggcuggagugcaguggcaugaucauggcucacugcagccuugaacuccuggcuucaagugauccuccuggagccucagccucccagagcacuaggauuacaggugugagccaccaugccugaccagaauuuuuuuuuacuguugcuuuuuaaaaaagguggucuuugaaguuuuuguaagaaauuauugaaaaauacuugcagaauacugccaaauguuuuauaauucugugucuguagccccuuagcacaauggaauuauagagcuugaagcaccacggcauucucguccuacuucuuccuuuuaugacugagcaaacaggacucagaggauuagguuugccaggaggggcauagcaauucagagucuuuguuguuguuuuaguuggacaacuacuauaugaauacauucucuuuguuuaaaagaaagacacauauuucaaguuaaaguuaaaauuccuuuucagcaucacuuccaaucuggaucuaauauaauccuuuguccccacaaucccuggagguaguuuaauccuuuuucuuagcauuuuuguacuguuaauauauacagacugagaaaacacauagaguuguuuccuagauuguguauuguuuugcuuuuuuuuuuuuuuuuaaaaaaaaacggucauucuucauguguuauuccacaauaugcuuuuguuaacucagggauaugccuuagaucuuuccacauuaacugguaccuagagccucauuuggaugugaggcucaaggaauaugagccucauaccaguuaacgugaggcucaaggguuaugagccucauaccaguuaauguggaaagauccaaggcaucuccuuugagggacagaagaauuauagagcuugaauuauagagcuugaagcaccaugagggauauccccuugggggauaugccuuggaucuuuccauauuaacugguaccuaccucauuuuaacccuagguuucuauggcuuaaguagaugguuuccagugcgugcauucucuggggguggauuccguuaaaggagaaguggucauuuuaggaugucuuagcauuugagugagucaagcugaagcucccuccuagugcccuguucccgcagcauagaugcauagaugcacuccuuucccagcacuguccgcaggaacugggauugucaugcuuguuaauguuugaccaucugauggguaaaaaaugagaucuuguuguuaagguuuuaauucucauuucucuaauuucaaauaucuuuucauauguucauguccauuuguauauccuauucccugaaaagaaaaacuauuguuuuuuuauauuuuucuucagauuuuguuuuuauguaauaagcauuuguuuguuagguguacugccaauauauuccuccaucauguugcuugucuuucaucuuugcaugugaugcuuuuguuauauagaaguuuuauauuuuugauguagccagguuuauugaccuuuuaucuuuaugacuuuuuugccuuuaauuuugcuuuacauugagguguuuguguauccacuguuuuucuuuugaaugguaugagaaagggauuuaacuuaaaaaaaguaauacagcuaggcauaguggcucacaccuguaaucuuaacacuuggggaggcagaagcaggaggauugcuugaaucuaggaguucaagaccagcuugggcaacauaguaagacccuaccucugcaaaaaaaaaaaaaauuuaaauuagccaagcaugguggugugcaccuuuggucucaacuacuccugauaccuaaaauuuccacagaaagauuauucuauuucugggcgggguguggugucucacgccuguaauucuagcacuuugggaggccaaagcgggcagaucacuugaggccaggaguuggagaccagccuggccaacauggugaaaccccaucucuacuaaaacuacaaaaauuaaccaggcaugguggugugugccuguagucccagcuacuugggaggcugaggcaggagaauugcuugaaccugggaggcagagguuguggugagccaagauuacaccacugcacuccagccugggcaacagaacaagacugugucucaaaaaauaauaauaauucuauuucuggacuuuguauuuccucccaguguucuauuugaauguacauaagcuaauguacuguuuuaauauaauguacuguaauguaauguacuauuuuaaugaccauacucccauaccccuauguauuuuuauaucagauggggaagucuuccuaauuuguucuuuuuauuuuuauuuuuuugagagacagggucucagucugucacucaggcuggagugcaauggugugauaauagcucacugcaaccuagaacaccugggcucuggggauccuccugccucagcuucccaaguagcugggacuacaggccugggacaccaugcccagcuaauuaaaaugauuuuuuuuuuugguagagacaggaucucacuauguugcccagccuggucuuggacuccuggccucaagugauccuccccuucucagccucccacgguguugggauuauagccaugaaccaccaugccuggcuuguucuuuuuaauugucuugucucuucuuguacauuuauucuuuguaugaaaauagauaucagcucauuaaguuuauuuuuaaaaauuguauuagaauuuugcuugggacugcauugaauugauaaauuuauuuccacuugggcauuuuuguacugugucucaaggguacuuuuuccuuucuuuucaugaauaguauuucaauuuuauccucucuauucacaaaauuauuaaauaugcccuuuuuaaauaugugcuaauguuuuccauaaucauuuuuugcugcagauuauaacuacaccaaccaaggccuaccaacuucauucccgaccaguaccaaaauuaagcccugaaaugggaagcuuuggcucucuauacacucagaauucuagcauauuagauaaugauauauuaaaugagccaguuccuccugagaugaaugaacaagcuuuugaggccauuucugaagagcuuagaacagugcagguaauguuuuguucuagaaaaaauaaauaacuggacauccauuuaaauacauuugcuuuguuauuuuaauucccuauaaguuacaguguucaaaagugcuuaguauuaaaaucauaucuuuuuaaguguggguuuauaaucauuccuagauuggaaaucagcccacucuugcuuuuugucucuacuuuacaaucuuuagcaagucauucuccauggguuuuuguuccuuaguguauaaaaugaccaguuggccacuagcuccaaguuccagaacugguuuauauagcaaagugcuguaucugcuaaaaaaaguuaaaagaggccgggugcgguggcucacgccuguaaucccagcacuuugggaggcugaggcaggcauaucacgugagaucaagaguuugagacuagccugaccaacauggugaaaccccgucucuacuaaauagacaaaauuagccggguguggugguacaugccuguaaucccagcuacucgggaggcugaggcaggagaauugcuugaacccgggaggcggagguugcagugagccgagaucgcgccacugcacucuagccugggcaacaagagugaaacucugucucaaaaaaaaagaaaguuaaaagaaucuuauuauagaucaaauuuuagacaguuuuuaauauauuugaaauaaugugaaauuugauuauuccagaauuuuuaugguuuguuaauuuuuuaaaaagguuuucuacuguccaguaaaaguuggagugggccagaccaccccaaaccccaguauuuuguccuuuccaggccauggagguaaccgcuugcagcccugaggaagcuucuuagaagucucaagauggcucugucauguaauccaggauuuuaauuuuaaucacuucuuuccuuuguauuucaaagugucuacuuuaauggaccacaaguguaaaucugaaacauuagcaaucauuuaguauauaaccuuuugaugauguuuucuggcuccaaacaggccuuugauaccuuuguucauaugagguuuugaauuuguuuuguuuuguuuuguugucucuuuaaugcagacgaaaugguggaauguuugagaauuccauuaaaauaaauuuugaugacugaaguuuuuguguugcaggaacaaaugagugcucuucaagccaaacuggaugaagaagagcauaaaaaccuaaagcuucagcagcauguugacaaacuggaacaucauucuacccaaaugcaggaggugagaccaagagcacagccucagaaaauguaugaaguacccucaaauguuaccuugaggaaacauccucaaggauccucaaacauccuugaguaugcaugaaacauauucagagaguaucacagaaagaaaauguugucacauggccuuagugaaggcuuauuugagcuguauucucuaccuuguuacuuagcaugcugcucugauaaugagacaggcaugcauagucuaaaccuggcugacuuagucaauaaugcaaauggaucccuugcuauguguuuagaagaaaccaagauggacuguccauggcuucauaguuguuaaucaucuuuacuguaguucauggggacagccaauuuucuucuggucagagacguuaaagcuagacuuuaaaaacagggacagguuaauggggccaggcacaguggcuaacaccuguaaucccagcacuuugggaagccaaggcagguggaucgucugaggucaagagaucaagaccagccuggccaagguggcgaaaccccgucucuacuaaaaauacaaaacuuagcuggacgugguggcgugggucuguagucacagcuacucaggaggcugaggcaggagaaucacuugaacccaggaggcggagguugaagugagccgaggucgcaucacugcacuccagccugggugacagagcaagacucugucucaaaaaaaaaaaaagaaacagguuaaugauuuggagugcaucuuagcaugccaguauuccuuuuccaguaaauuuaucuuuuuucccaaagcuuuucucaucagaaagaauugauuggaccaaacagcaggaagagcuucucucacaguugaauguccuugaaaagcagcuucaagagacucaaacuaaaaaugacuguaaguuauucuaucaggagcuuugugacuugaaggaauacuguaacucaauaucuuuuuacuuuuauuaauaaaugcuguuccuauguuuuuggaugguugcuuuguuguuguuguuuguuugauaaccagacugcaguuugcaugcagugguaaguaacaguaauauaucauaaaagguaaauuucucuaucauugcccacaaacaaaugauacaaauguuugcuuaaaguuuuuuguuguuuguuuguuuuugacacagacucucgcuuugucacccaggcaggaguccaguggcaugaucuuggcucacugcaaccuccaccucccgaguucaagcgauuccccaccucagccuccugaguaguagcugggauuacaggagugcauuaccaugccuggcuaauuuuuuuuuucuuuggucauuuuuuuuuuguuuuguuuguuuuguuuuuuuuuuuuuugagguggagucuugcuuugucacccaggcuggagcgcaguggcgggaucucggcggcucacugcaaccuccagcuccuggguucaagcaguucuccugucuccucccaaguagcugggauuauaggcgugcaccaccaagcccggcuaauuuuaggagagacacgguuucgccauguuggccaggcuggucaugaacuccugaccucaggugauccacccaccucggccucccaaagugcugggauuacaggcgugagccacugugcccagccugcuuaaaguuuuagauaagcugcuuugaaaaugaagugucuugaauucaugaauguuuuaauauuaacaaagcguagguuauauauuuguauauguuuguagaugugggaauaucauuugauucccaauuuuuucacuuuauuuuucccuucauuaaaguauuugcagugguuuguaauaaagcuaaaacaaaaagagauagccauucuauuuucuuugaacuaaaaaguuaacuaauacuauuugcaguuguaguugucuuagaagaccugaaguaguuaacccauguuggaaaguuuaggcaaauuuccaagggauuuucaauaacuaagaugagcucacucaaaauauguuacaucuuuuaauuuuuuuuucuuauauuaagaguuuuguuuguuuguuuguuuugagacagagucucacuuugucacccaggcuggagugcagugggugcaaucucggcucacuguaaccuccaacucccaggcucaagcgauccucccaccucagccuccugaguagaugggaccacaggugcucaccaccacagccagcuaauuuuuuguauuuuugguagagacaggguuuugccauguugcucagucuggucucgaacuccugaccucaagcauuucgccugccucagccucacaaaguacugggauuauaggcauaagccacugugucugcccuuauauuaggaguuuugaagcacauuuuacaggagaaaucuagcaaagucaagugaccuguaagucagggacagauguuaaugcuuucuauuucaguagaaauuuacgaaaaaccaugugcaagggagaggaagaaaauagaaaucucagugcugcuagguacccgccacuuaauucuuuaacauuuuuccuuaaaauagucucuucgacuugauuuugcuaauugugggacuaguaccuaucagauuuauuugucugcuuuaagaaaccuacugaggauauguuuucuuuguuuuuuaguuuugaaaagugagguacaugaccugcgaguaguccuucauucugcugacaaggagcuuucuucagugaaauuggaauauaguucauucaaaacgaaucaggagaaagaauucaacaaacuuuccgaaagacacaugcauguacagcuucaauuagauaaucucagguagaguuguucuuuuaugguuucaaguugccugauuggcuguaaccuacgacuguuugaaguuggaaguguuauaaacucaacucaaagcaguuagacaaauaaaaaagauaauuuauuggcuccaauauuggaagccccagaggugauuuugguuucaggaacaaacuagucugagucucaagcaauauugucaguguucuaucucucucagcuaugcucaguucuauguguugcucuuauucccuccuauuacugagguccuucuucuaugugacaaggaacagauugccucacacagcuccauauuuugguucccaggauaaaaaccccuguaaagaaauucucucucccaauagccauguauuaucccagagaaaaucugaauugguuuugcuugagucaucugcucaccuuuggaccagucacuuuaccagguuugagauggcacuggccugacauagaguaaugugccugcucuggagggaaaggugugcucuuacuagaagaaaggacagucaguauaagguaaaccaaaacaauagucuucacugcugugcacacuaacucuacaaaggcuggcugauuagucaagugcugauaucuugaaacaaauguaaucucacaucuaaauaguuuauucuuuguuauuuacuguuucuuuuuuucuucuugcuaauuucaaccuuuuguauaacauaacacuuuuugauaaugucuccugugucuauaagccauaauuuaauaauggacaugaauguuacacugugaaugugaugugaauguaacuguuugcucuggaaaagcuacuaguaggcagccuugaguuuaauuuuuguagauguuacaaagauuaaaaucuguagcuguugaguguuuuuuggauauacaaccagaaauugaaagagaggaagaaaacuugagaucugcaggccagagccaccuauacauacauuuuucuuuuuuuuuuaaagauucauuucuauuuguaaaaugaaaaaaaugcauaauuauuacuaaugaaauacugacaauaguuucauaaaagagaaagugaugacauuuguaaccuuuccuugccauaucucuaucucacugaauguugaauagcuugaguuuuaggcaaaaucccauauuuaucugcugcugcugcuucuccuuuuuuuaaaauuuuuuuaaauuuuacuuuaauuucuaggguacaugugcacaacgugcagguuuguuacauagguauacaugugccauguugcuuugcuguacccauuaacucaucauuuacauuagguauuccuccuaaugcuauuccucccccagccccccaccccuugacaggccccagugugauguuccccgcccuguguccacguguucucauuguucaguucccaccuaugagugagaacaugagguguuugguguucuguccuugugauaguuugcugagaaugaugguuuccagcuucauccaugucccugcaaaggacaugaacucauccuuuuuuauggcugcauaguauuccauguguauaugugccacauuuucuuaaucuagucuaucauugauggacauuuggguugguuccaagucuuugcuauugugaauagugccacaauaaacauaugugugcaugugucuuuauaguagcaugauuuauaauccuuuggguauauacccaguaaugggaucgguggcucaaaugguauuucuaguucuagauccuugagggauugccacacugucuuccacaaugguuuaacuaauuuacgcucucaccaacagcguaaaaguguuccuauuucuccacauccucuccagcaucuuuuguucccugacuuuaaugauugccauucuaacuggugugagauggugucucauugugguuuugauuugcauuuaucugaugaccagugaugaugagcauuuuuuucaugugucucuuggcugcauaaauguuuuuuuuuugagaagugucuguucauauccuuugcccacuuuuugaugagguuguuuguuuuuuucuuguaaauuuguuuaaguucuuuguagauucuggauauuagcccuuugucagauggguagauugcaaaaauuuucucccauucuguagguugccuguucacucugauggucauuucuuuugcugugcagaggcucuuuaguuuaauuagaucccauuugucuauuuugucuuuuguugccauugcuuuugguguuuuacucaugaagucuuugcccaugcguaugucuugaaugguauugccuagguuuucuucuaggguuuuuaugguuuuagguccaacauuuaagucuuuaauccaucuugaauuaauuuuuguauaaaguguaaggaagggauccaguuucagcuuucuacauauggcuagccaguuuucccagcaccauuuauuaaacaggaaacccuuuccccauuucuuguuuuucucagguuugucaaagaucagaugguuguagaugugugguauuauuucugagaccuauguucuguuccguuggucuauaucucuguuuugguaccaguaccaugcuguuuugguuacuguagccuuguaguauaguuugaagucagguagcgugaugccuccaacuuuguucuuuuggcuuaggauugucuuggcaaugcgggcucuuuuuugguuacauaugaacuuuaaaguaguuuuuuccaauucugugaagaaagucauugauagcuugauggggauggcauugaaucuauaaaauuaucuugggcaguauggccauuuucacaauauugauucuuccuacccaugagcauggaauguucuuccauuuguuuguguccucuuuuauuucguugagcagugguuuguaguucuccuugaagagguccuucacaucccuuguaaguuggauuccuagguauuuuauucucuuuguagcagcugugaaugggaguucacucauaauuuggcucuccguuugucuguuauugguacauaggaaugcuugugauuuuugcacauugauuuucuauccugagacuuugcugaaguugcuuaucagcuuaaggagauuuugggcugagaugaugggguuuucuaaauauacaaucaugucaucugcaaacagggacaauuugacuuccccuuuuccuaauugaauacacuuuauuucuuucucuugccugauugcccuggccagaacuuccaacacuauauugaagaggagugguaagagagggcaucccugucuugugccaguuuucaaagggaaugcuuccaguuuuuguccauucaguaugauauuggcuguggguuugucauaaauagcucuuauuauuuugagauacguuccaucaauaucuaguuuauugagaguuuuuagcaugaagugcuguugaauuuugucgaaggccuuuucugcaucuauugagauaaucaugugguuuuugucauugguucuguuuaugugauggauugcauuuauugauuugcguauguugaagcagccuugcaugccauagauacagccgacuuuauugugguggauaagcuuuuugaugugcugcuggauucacuuugccaguauuuuauugaggauuuuugcaucgauguucaucagaaauauugaucuaaaauucucuuuuuuuguugugucucugccaggcuuugguaucaggaugaugcuggccucauaaaaugaguuagggaguauucccucuuuuucuauugauuggaauaguuucagaagggaugguaccagcuccucuuuguaccucugauagaauuuggcugugaauccgucugguccuagacuuuuuuugguugcuaggcuauuaauuauggccucaauuucagagccuguuauugguguauucagagauucagcuucuuccugguuuagucuugggaggguguauguguccaggaauucauccauuucuucuagauuuucuaguuuauuugcguagagguguuuauaguauucucugaugguaguuuguauuucugugggauagguggugauauccccuuuaucauuuuuuauugcaucuauuugauucuucucucuuuucuucuuuauuagucuugcuagcagucuuaucaauuuuguugaucuuuucaaaaaaccagcuccuggauucauuaauuuucugaaggguuuuuuaugucucuaucuccuucaguucugcucugaucuuaguuauuuccugccuucugcuagcuuuugaauuuguuugcucuugcuucucuaguucuuuuaauugugauguuagggugucgauuuuagaucuuuccugcuuucuccugugggcauuuagugcuaugaauuucccucuacacacugcuuugaaugugucccagagauucugguacauuguaucuuuguucucauugauuucaaagaacaucuuuauuucugccuucauuucguuauuuacccaguagucauucaggagcaaguuguucaguuuccauguaguggugcaguuuugagugagucucuuaauccugagaucuaauuuauugcacuguggucuaagagacaguuuguugugauuucuguuuuuuuuacauuugcugaggagugcuuuacuuuuaacuauguggucaauuuuggaauaagugcgauguggugcugagaagaauguauauucuguugauuugggguggagaguucuguagaugucuauuagguccgcuugguccagagcugaguucaaguccuggauacccuuguuaaccuucugucucauucaucugucuaauauugacagugggguguuaaagucucccauuauuauugugugggagucuaagucucuuuguaggucacucaggacuugcuuuaugaaucugggugcuccuguauugggugcauauauauuuaggauaguuagcucuuuuuguugaauugaucccuuuaucauuauguaauggccuucuuugucucuuuugaucuuuguugguuuaaagucuguuuuaucagagacuaggauugcaaucgcugguuuuuuuugcuuuccauuugcuugguagaucuuccuccaucccuuuauuuugaaccuaugugugucucugcacguaagaugggucuccugaauacagcacaccaaugggucuugacuauccaauuugccaguuggugucuuuuaauuggggcauuuagcccauuuacauuuaagguuaauauuguuaugugugaauuugauccugucauuaugauguuagcugguuauuuugcucguuaguugaugcaguuucuuuuuuuuuuccuuuuuuuuuuuuaaacuuuuauuuauuuuuuauugaucauucuuggguguuucucacagagggggauuuggcagggucacaggacaauaguggagggaaggucagcagauaaacaagugaacaaaggucucugguuuuccuaggcggaggacccugcggccuuccgcaguguuugugucccuggguacuugagauuagggaguggugaugacucuuaacgagcaugcugccuucaagcaucuguuuaacaaagcacaucuugcaccgcccuuaauccauuuaacccugaguggacacagcacauguuucagagagcacaggguuggggguaaggucacagaucaacaagaucccaaggcagaagaauuuuucuuaguacagaacaaaaugaaaagucucccaugucuaccuccuacuacacaaacacggcaaccauccgauuucucacucuuuuccccaccucuccccacuuucuacuccacaaaaccgccauugucaucauggcccguucucaaugagcugccgggcacaccucccagacggggugguggccgggcagaggggcuccucaccucccaguaggggcggccgggcagaggcgccccucaccucccggacgggguggcuggccgggcagggggcugacccccccaccucccucccggacggggcggcuggccgggcgggggggcugacccccccaccucccucccggauggggcggcaggccggguggcgggcugaccccccccaccucccucccggaccgggcggcuggccgggcggggggcugacccccccaccucccucccggacggggcagcuggccgggcagaggggcuccucacuucccaguaggggcggcugggcagaggcgccccucaccucccggacggggcggcuggccgggcggagggcugacccccccaccucccuccuggacggggcggcuggccuggcggugggugacccccaccuccuuccuggacgggguggcugcggggcggugacgcuccucacuucucagacggggcggcuuccgggcggaggggcuccucacuucucagacggggcggucgggcagagacgcuccucuccucccagacgggguugcggccggguagaggcacuccucacaucccagacggggcggcggggcagaggcgcuccccacaucucagacgaugaguggccgggcagagacgcuccucacuuccuagaugggauggcggccgggaagaggcgcuccucacuuccuagaugggauggcggcugggaagaggcgcuccucacuuuccagacugggcagccaggcagaggggcuccucacgucccagaugaugggcggccaggcagagacgcuccucacuucccagacaggguggcggcugggcagaggcugcagucucggcacuuugggaggccaaggcaggcggcugggagguggagguuguagcgagcugagaucacgccacugcacuccagccugggcaacauugagcauugagugaaccagacuccgucugcaaucccggcaccucgggaggccgaggcuggcggaucacucgcgguuaggagcuggagaccagcccggccaacacagcgaaaccccgucuccaccaaaaaaauacgaaaaccagucaggcguggcggugcgugccugcaauugcaggcacucggcaagcugaggcaggagaaucaggcagggagguugcagugagcugagaugucagcaguaccgaugcaguuucuuccuagcgucgauggucuuuacaauuuggcauguuuuugcaguggcugguacugguuguuccuuuccauuuuuagugcuuucuuuaggagcucuuguaagucaggccugauggugacaaaaucucucagcauuugcuugucuguaaaggauuuuauuucuccuucacuuaugaaucuuaguuuggcuggauaugaaauucuggguugaaaauucuuuauuuaagaauguugaauauugccccccacucucuucuggcuuguagaguuucugcugagagauccgcuguuagucugaugggcuucccuuuguggguaacccgaccuuucacucuggcugcccuuaacauuuuuuccuucauuucaaccuuggugaaucugacaauuaugugucuugggguugcucuucucgaggaguauauuugugguauucucuguuuuuccugaauuugaauguuggccugccuugcuagguuggggaaguucuccuggauaauauccugaagaguguuuuccaacuugguuccauuauccccaucacuuucagguacaccaaucaaauguagauuuggucuuuucacauagucccauguuucuuggaggcuuuguucauuucuuuuuacucuuuuuucucuaaacuucucuucucgcuuuauuucauugauuugaucuucacucagugauacccuuucuuccacuugaucgaaucgacuguugaagccuugugcaggugucaugaaguucucaugcucugguuuucagccccaucaguucauuuaaggucuucucuacacuguuuauucuaguuagccauucgucuaaucuuuuuucaagguuuuuagcuuccuugcauuggguuugaacaugguccuuuagcuugucgaaguuuguuauuaccgaccuucugaagccuacuucugucaacucgucaaaguuauucucguccagcuuuguucuauugcuggugaggagcuacaauccuuuggaggagaagaggcgcucugguuuuuagaauuuucagcuuuucuccugugguuucuccccauuuuugugguuuuaucuaccuuuggucuuugauauuggugacugacagaugggguuuugguauggaugcccuuuuuguugguguugaugcuauuccuuucuguuuguuaguuuuccuucuaacagucaggucccucagcugcagcucuguugguguuugcuggaggcucacuccagacccuguuugccuggguaucaccagcggaggcugcagaacagcaaauauugcugccugauccuuccucuggaagcuucgucccagaggggcacccaccuguaugaggugucagucggccccuacugggagguuuaucccaguuaggcuacacagaggucagggacccacuugaggaggcagucuguccauucucagugcucaaacaccguguugggagaaccacuguacucuucagagcuaucagacagggauguuuaagucugcagagguuucugcugccuuuugcucagcuaugcucugcccccacagguggaaucuauagaggcagccggccuugcugagcuguggugggcuccacccaguucaagcuuccaggccgcuuuguuuaccuacucaagccucagcaauggcggauggcccucccccugccaggcugcugccucacaggucgaucucagacugcugugcuagcagugagugaggcuccgugggcgugggacccaccgagcuaggugcgggauauaaucuucugguaugccauuugauaagaccauuggaaaagcucaguauuauggcagaagugucccauuuuuccagguacagucugucauggcuucccuuggcuaggaaagggaaauuccccgaccccuugcgcuuccugggugaggcgacgcccacccugcuucagcuugcccuccguggucugcacccacuguccaaccagucccagugagaugaaccagguaccucaguuggaaauguaaaaaucacccaucuucugcaucgaucccgcugggagcugcagacugcagcucuuccuguuuggccaucuugccuaauucacauacauuuuucuuaggccugcccaguggcuaaagaaaaauaaaugaacauagcauuuuaaaaauugaguguuuuauuauaaaaaucuauauuucagcauucucuagcaaagucauacuauuugguaccacuaggcccacaucccugcauggcagccaucaguugcugcaaaauucaccccuuucucuuuagagacagaaugugcugucugggucagcacagccuccaccacccugucccauuuccccagcaccaaguccacuuaucuaguugucugauuggccuguaaucuacuugaagugcagugguauaacccaacucaaauuaguuaaacaaaauagguaauuuauugauaacuuaucacaggugcacuguugccuucucuuacccuuagcauuuguuuuaacuucugaaucacuggaucuaauaaucuuggccucaacucaaacuauuuuguguaauuuguuuugaagucacuaaucucaugggaucuuaauuuccuaauguuuauaugucagaguugaacuacaucaaaaaauguuaagaauccacuauauuuugcuacauacuuaaauucuauuuucaucauuaaauacuuccuagguuuguuuguuuguuuguuuuugagacagugucucacuuugucacccaggcuggagcacaguggcauaaacacggcuuacugcagccucaauaucccgggcucaagcuguccucccaccucagcuccccacauagcugggacuacaggcacaugccagugcacccagcuaauuuuuguauuuuuuguagagacagaguuucgccauguuguccaggcuguuuucaaaccccugagcucaagcaguccacccaccucagcuucccaaagugcugggauuagaggcaugagccacugugcccagccucuuccuagcuuuuuaaauacacugaacacaauuuaaccuucucagugucuccaguuuaaguacaucauuuacugggcugcuuauauuccacuguggccuucaaugguuguuaaguccugugaaugaaacagcaugacacugccauguguuucuugaauuauuuugucuacuuuauauaucuauaucuauauaguuuaugccauaaauacauaaauauguuccccuucccuaccaucuauugcccauguaucugucuuuagcaauugauuuauaccacuuuaugauuugcugcuucugcucugcuuugaguuaguacagcagauauuccauauauaauaaccuucuguacauaagcuaggacaucugcuuuggaugauccagaggucagauugauugugugguaguucuuggcugagcucuggauucuuggaggugcuacagcuuacucaggagggaaauaagaggaugaaaaccaaaaaaagcaguaauuaucuuccaaaaacauuuucuuucuugcucaaaucaaauucacauugucaucuuaauguuccuagagcugagaggauguaugaauaguuggaguugagcuaucaauaaaacuuggaaauuaacagccagugccuggcuuacgugagcauuaggucuggaaaccccuaaaugagucuaaucacuauaaauugcucauccauuaagcaugucugguugaagccauggagaaagaaugaggaagugaugcuugcaagcuaaugcucccacuugucuuuucuguuccuaccaaacuacucuaugguccagugugucucacauguuugugcaucauggacauuucacacagguccauaaggagccuuauaucacucgaggcuuaugugaguugggaaugggcuguagaugagauaaauugaacugcagaugaucugauuaauagaaauacauuaaauguuuauuuaccauuuuuaaaauguuuuccuuauaaagguuagaaaacgaaaagcugcuugagagcaaagccugccuacaggauuccuaugacaacuuacaagaaauaaugaaauuugagauugaccaacuuucaagaaaccuccaaaacuucaaaaaagaaaaugaaacucugaaaucugaucugaauguauguuaagaagggugaauuugucccgcaucugugacuguccuuuugaguguaggacaaggacuguccuuuccuccuucuuugcuauacuugcccacagugccugccacauagaagguacuugacauguucguugacuaugcauugcuaguaacaguuacuuaaaaucuaauguugucuuuuagaauuugauggagcuucuugaggcagaaaaagaacgcaauaacaaauuaucauuacaguuugaagaagauaaagaaaacaguucuaagugagugcuauuuauuuuuucuacuagcauacuagaauauuguuuaauaccacauucuuaaucuuguuuuuuuuuuauugccaauacccuguaaagaguuauuuuuuuaaagcauuccaaaagcaacagcagguucuuuuguauaaauggcuauguggagaaacuuaauuuuucaaaacauguaacaacuagcuauaguacuuuuaaaugaauagcaauuggugguaaucagaacucagggccuucuguaaauaaaucacagcaaauauauaauaagaugacuucuaacucuuccuuuuauuauuggaaggaggagacagauuuuuauuucugugucuacaaaucuuuuucuaccaggaauguccccuaacaggaaugcugccauauuucuucccucuuuccagguuccucuccuuaguagucucagugaaucuuugggccucggucacuaggcugagagucacucuaaugagaagaauuuguuuauucaguagguacuuauggaguucuuccuaugaggucgcuuuucuucuaggcccugguauacaguggugaacguagagcuuacauccaguugagagacaagcaauugacauuuacucauuuauucaaacauuuauugauauccaacaagccaggcacugaucuggugaauuccagaacauuuagaguugaaacagugaacaaaacaucccuguccucguggauuuuaacuucuagcacagggagacagguaauaaacaaauacuauaugauauauguuauauuuaggaguacuaaacacucugaggaaaaacagucauggcacaaaaauggguucucauugaauaauuuuugaagaaauggguucaaauuucugauccccccggaagguaaugccugacaccaagggugugccuaacaaaguucauuugcacuuaaucuauucuguacuaacagauucaguuccuguuuucauugagugaagucagggguaaaagauaauuauucucuuccagagaaaucuuaaaaguucuugaggcuguacgucaggagaaacagaaagagacggccaagugugagcagcagguaaaauuccuguuacucuaacucuaguauuugaaguuuauaacuuuuauuccugauaccuaaaaggcuuauuauaaugauuucagcuugcagauguuggaaauuaguaagaaagaaauggaauuuggggcugguucuauuauuuuuaauuuuauuuuuuucuucuuuuuuuaagauaguuucucacucugucacccaggcugcagugcaguggcgcagugauggcucacuguagccuugacuucccaagcucaggugauuuucccaccucagccucucgaguagcugggacuaugggcaugcaccacuaugccuggcuaaauuuuuguauuuuuuauagagaugggguuucaccauguugcccaggaucgaacuccugagcucaagugauccacccaccuuggccucccaaagugcugagauuacaggccugagccaccgugccuggccuauuguuuuucgacucuuguuuuucuaacucccagaggguuacaauaauaauuuguugguagucuccugguagacagcacaaaaucacugucuuucaacccaauuuaucauuuucaaguauuacuccuagcauagacucuauaauaugaaaagcugcuuucaacuuguuuaucuguguguaugguuaacuuugcgauuuaauuauucuucuaaaaauauuucuuuuucaccauagauggcaaaaguacagaaacuagaagagagcuugcuugcuacugaaaaagugaucaguucccuggaaaagucuagagauucugauaagguugguagaguuugaagcuacaucucucugugcauuuucuuauaaaugcuaguuuaacauuuuguucuccuaccucuucuugcaccuccagggugaccaauagauaauaugaauauuucuauaugcaguuaagccuuguucauccuccaagguuccuagagaaugaggucuuccacuuaauuugccauguaacuucaaguacaaacuacugucacuuuggauggcaguguuucuaaaacgcauccuacccuuuuaacuaggaugcugauauuagugugacccuuucuuguugacucuaagucccaugauacaaauuuucaaauuccugguguugacuuuaacuaaaauaauaaaaauagucuguauguccaaguuuaaauuacguauaaaauucuucuaugucuagcucauauacauucauaaaaccaaaacaaaugauuaaaugaaauauuauagacugggcacaguggcucacgccuguaauuccagcacuuugggaggccaaggcagguggaucaccugaugugaggaguucgagaccagccugaccaacauggagaaaccccaucucuacuaaaaguacaaaauuagccaggugugguggcacaugccuguaauccuagcuacucgggaggcugaggcaggagaauugcuugaaccugggagguggagguugcagugagccaagaucacaccauugcacuccagugugggcaacaagagcgaaacucugucucaaaaaaaaaaauuauaaagccauuaaaauauaaauugaugccaggcgcaguggcucaugucuguaaucccagcacuuugggaggcugaggcggguggaucacgaggucagaagaucgagaccauccuggcuaacauggugaaaccccaucucuacuaaaaauacaaaaaauuagcugggcaugguggcaggugccuguagucccagcuacucgagaggcugaggcaggagaauggcgugaacccgggaggcggagcuugcagugagccgagaucgcgccacugcacuccagccugggcaacacagcgagacuccaucucaaaaaauauauauauauauguguguguguguguguguguguguauguauauauauuacauauguauauauaauauauauguauauauuauauacgcauauauaauauauauguauauaauauguguauauaauauaugcauauauaauauacgcauauauauuauauguauauaauauguauauauuauauauguauauauuauauauguauauauuauauauguauauauuauauauuauauaugcauauauauuauauauguauauacauuauauauguauauauuauauauguauauauuauguauauauaauauauguauauauauuauagauguauauauauuauagauguauauauauuauagauguauauauuauauauguauauauuauagauguauauauauuauagauguauauauauaauauaugcauauauaauauauguauauauauuauauauauaaauugauacuaaugugacauacgaucuuuuacuaaaauaaaauugacuuauauugccauuaggaaagauaagugauuuaccauuuaaaaauuuucuucuccuuaaugucauuggguaugaagauauuauuucuguccucaucagaaaguuguagcugaccucaugaaccagauccaggagcuaagaacaucggucugugagaaaacagaaacuauagacacccugaaacaagaacugaaggacauaaauguaaguucggucaccaacaagauguuaaauuugagcaugggacacuucacagacuuuucaagaguuuaacagaugcuccaccagaaaaaagauucuguggucaaauaaguuuggaaauucuaguuaaauaaagcucaacagguuuguguguuuguaggacuugcagagucauuauggaaguguguaguauguaucucugggggacaauguaggcugcaguguuucucagguuucacugaucugggacaauguucucugugcacuguuugggaaugccgguauaaacugaauaagaaacaggcugguugcuggccguaacaguuaaggcaaaugugguguuuuuuaguggcuuugaggaaaaaguaacacaguagcacauugcaguuaaguucagagacauuaauuagaaagugaguucguuuccgcaauauuggacauaauaucauuuccuaaaguuaacuacuuauuuugucagcauguaucugaguucaguguugaugcuuuucuccucugggucgaggcgaaggcuuuugucacuccuccucacuccucugcucuacagggagcuugcugcacuccauguuuauuucugaaggcaguagaugacaaacccuguguuuuuuucacugauacuuagaggacuuuuccauuucucuucaccauucaugcacuuauucuucuauuccuucagucagcaaguauuuauugaauuaucuuguguuaaucuugucaucaccuuggaacccagacucauucuuguuauuuuaaucuagaaacaggaaauaaaauggcucuuauagcaugacuuucuuuucuacagugcaaauacaacucugcuuugguugacagagaagagagcagaguguugaucaagaagcaggaaguggauauucuggaucugaaagaaacccuuaggcugagaauacuuucugaggacauagagguagguauuaacgcaucacagcuucuuuguuugccuuauuacuugucaauauguguauuuguguguggaaguuauuaaugaauaaauacaggauuuuuaaagaaauaauucuuauacagcugaugugccucaagacgcuucacuacacaggcucauucuaccucuaccucacugccugcaccucaugcugccacccugacugcuugcugugccugagauacuccacacacguucacgcugccaagcuuccuccucuggcagucuuauacauauacugucuccuuugaggagauaguauuuguauacuacuaauguauuauuguauaguguauaauaauacaaauagucauguauaauaauuucaccaaaauuauuauauuuuaucuagcuaaucuauuuuccgucauuuuugcugacaccacguuaacuuccuauaacugaccccuguaaggggagcagaguggaaacugcauuuaauuggaugcagugauaguagcagauagcagaaaagggcuguuuaaacaggcugauuucaggguugucuuuugcauuuuagcgaagauaaguuuuauuuuuguuuuuuugauguagauuuaucuuuuuaaaaauuaagcaguacagguuaauuuguaaccuacagcuaaaggaaguuuuuuuguuguugaugaugugaacuuaucuuuuuaaaaauuaguauauaagcuaggagcaauauggauuuucuuccagcccuuccuauuccucagcuacccccauguuuucaguuucuuguguaacuuucaagagauauuuuaagcaauccuauauacuuuuagccuuacuuuuuuccccacacagaugauaaccuauuguauaaauuguucuauauuugcuuuagaaauaaagggguuuuggcuaaccuaugcuacccaugaaacaaauucaacaaauauugaauccaccuacuauacaaccuguacccggccuggcauuugggaauggaaagaugauugaaaaacacuguuacuuacaucaaagcaugcauucuagcuuaagagauauguguaauaugauguaauaaccugggggcacagaaaagggagggaggggaguaauucugccaggggaaauucuaaagaccuccucagaagagagaguauuuguacacaacuuugccagagagggaagcuuggcagugugaacauguguggagugucccaagcacagcaggcagucaggguggccaauacaaggugcuggcagugaagugggggcagacugagccuguguagugaagugucuugaggaacgucagcuguaucuuuuaggaaaccaaaacugcauagacauugaacccaggcagaaggucaugaagucagagcuaagaaaugcuaguggggauagggggugagauagaguugggaaauguuucagagcuacaggugacaguuguugguguccaguuggauauguaccaugaagggaagaagcagucagagugggcaccaagcuuucuagccuggaggacugaaugguucugugcacauuucagauggaaagaauagaggcccacagaaaguuaaugagaugcauuuuauacauaccaguuuugaauuuuaaggaccugugggguagauauccaagauggcuauucccaguaauuuguauuuauaucuugcuacaucgcagaaaggauuugaagcugcuaacacacauaagauauaagauuaaaauaggcuggacgugguagcucacaccuguaaucccagcauuuugggaggccgaggcggguggaucacuugaggucaggaguuccagaccagccuggccaacaugguaaaaccccaucccuacuaaaacuacaaaaauuagcaaggugugguggugcgugccuguaaucccagcuauucaggaggccaaggcaggaaaaugguugcaggaggcagagguugcagcaagcugagaucaugccacugcacucuagccugggugacagaucgagacuccaucucaaaaaaaaaaaaaaaaaaagaagauuaaaguagacaacaaaaauuagaauaaaaggaaaguaaggguagaauaguaacaaguuauuaagagcacaggcuacggaguuggaauucuagcugugugaccuuggggaaguuaaauuucucccugugcuucauuugccauaucuguagagauaacaguacuuccuacugcauaaggcagugguccucagccuuuuuggcaccagggaccaguuuaguggaagacaauuuuuccuuagaccaggagugugaggggggcugguuucuggaugauucaagcacauuacauuuacuguguacuuuauuucuauuauuauauuuacauuguaauauauaauaaaauaguuguacaacucaccguaauguagaaucagugggagcccugagcuuguuuuccugcaacuagaugguccuauccaggggugaugggaaauagugacaaaucaucaggcauuagauucucauaaggagugcccaaacgagaucccuggcacgcaguuugcaauagaguuaaugcuucugugagaaucuaaugcugccacugauuugacaggaggcggagcucaggcaguaaugcgagcgauggggaauggcuguaaauacagaugaagcugugcucgcuuuccuccugcugugcagcccaguuccuaacaagccacagacugauagcagucuguggccuaggggcugggggccgcuggcauaagguguugcagagaugaacugagguaauacauggaaagugcugagaacugugucuggcuccuuguaacugcucaauaugugucagauggaaauaguuuuagcaagccaauugaaaaguuaguacacagaagccacaaccuaggguccccuacaaaguauaagaugaugggcuaaaaauucaguuucauacugacuauugacgaaguuaaaaggaaaucuagcuauuugagugggaguagguaaauaaugaaaacucaugccuguuuaccuaaaagcucuucuuuccuuccuuccuugcuuucucucuuuuuucuucuuaaaaauaaaaugugacuacgaauauuguauuuagauuuaaauaucguauuuuagauucauacauuuuagauucaaguggaauugacccuauaaacagcuaauucauauucccuuuguacuuaucuucagucuuuauuagcuaaaauuuaguuuuauggcuaugguuugugaauuguucaguauauucaaauuguucauauaucaguguuuuucaacaauaugaguacuuagccaaugcaguaaaauggaaauacuaagugggauacaaauaucauaaaaacugagagaaagugacuguuauuugcagauggucaugagugucuacauggagacuccaaaauacugucugaauaucuauuagaauauugaguuuaguaaucaguuauaaauuagucuuaaaaauaauauuuacuaugugccauuaauaaccauuuaacaauauuggaacuaaaaaauucuauucacaaaaacaaccaaaaguguuaaaacguuaggagagaauuuguaacaacuguuaaggacauaaaacuucccuaagggauauugaaagaaauugaauauuaaagaaagaauagcuuuacuggggcugggcacuguggcucacgccuguaaucucagcacuuuuugggaggcugagguagguggaucacaaggucaggagaucgagaccauccugguuaacacggugaaaccccgucucuacuaaaaauacaaaaaaaaaaaaaaauuaccugggcgugguggcacgugccuauagucccagcuacuugggaagcugagguaggagaaucgcuggaaccuaggaggcagagguugcagugagccaagaucgcgccacugcacuccagcuagggcgacagagcgauacuccaucucaaaaaauaauaauaaagaauagcuuuauuauagauuauuauauaauauuauguuauaauuaaaauaauauauaauauuaaauaaacaguuuaaaaacauaacaggagcuuuuaaaaauucucuuucacagaaauaauauagcguaucaaaaucuuagggugaauauuugacaauuguuaagaacauaaaacuuuacaagcaacaugaaaagagacuucaauaaaaggaucuaaagggagacuuggacaggaagacccugucguuuuagaaacagaaauuuauguaauuccacuucaaaucccaauguauuuauuuuuauuuuuuugagacagggucuuguuuuguuacccaggcuggaauguaguaaugcgaucauggcucacugcagccuugaacuccugggcuuaagugauccugccaccucagccucccaaguagcugggacuacagaugugcagcaccacgccuggcuaauuuuugguauuuuuuuguagagaugagguuucacuaugaugcccacgcuggucucgaacuccuaaacccaagugauccuccccugccucagccucccaaauugcuaggauuacaggugugagccaccaugccuggccucaaaucccaguauaaaaaacugaugauuuuaagguuccuuugaaaaaaauacccaagauuuaccaacaaaacuuagaaaaacaauaaugcagagagauuucuaagcuaaaugguaaccauauccaguguuggacugaugauagagagaucauugcaacaacuuugaacauccacaaauagagagcagugaauaugaaggaauuuaguguaaugguaaaggaaguauuucucaacagugaagaaagagucgguuuaaucaauguauauguugggaaaauugucugaccaauuugaaaagauaucaaagccaaaacaauuuuuacauggauuagaguucuguacaaaugaugacaucauagaaguacuagaaaauaaaaauacaagccaggcaugguaaugcacgccuguagucccagcuacucaggaggcugacaugggacaauugcuugaguccaguaguucaaguccagccuggguaauguuguugcaagagcccccaucucugaaaaaacaaaaggagggaugggcacggugacucacaccuguaaucccagcacuuugggaggccaaggcagguggaucacuugaggccaggagcucaagaccagccugcccaacaugacgaaaccccaucucuacuaaaaauacaaaaauuagaaaaauuagccagguguggugguguacaccuguaaucccaacuacucaggaggcugaggcaugagaaucgcuugaaccugggagguggagguuacaguuagaugagaucacgccacugcacucuaucugggcgacagagcaagacucugucuaaaaaaauaaauaaauaaauaauuuuuuuuuaaggagaagaaaaaauacaaauacauaaaaauaucuugaguuuaugugacucugaaaauaucuugauauaaagauuagaacucauaagggaagauuauacaauauuaaaaacaaaaauucuaacaacagauggggaaaauauuugcaacugaugacaaaguauuuuaccaccuuaauuuauccuucaggagaaggauagaaacacagcugguggaaaauggacauagguagcuccccaaagaaggaauauaguggcacaaaacuucuuuggaaucagagacaugcaaauguuccugaaacauuaggaguucagccuaggucugguugcuuaccacacagaaagccaaucacugagucaaggaguauugccagcgaagaagacuuuaaaugagugccauagccaagauaggagaucagucucaaauccuucucccugacugacuaaaauugggaguuuauauagcaagaaagguaaccauguguggaaaagcaggaacuagggagggguaaggaaaaggaguugguuaacaggaaacagguugucaguuaggcagccaugacaggugaggggccuggcaucucauuuguccaguugccaugaucugguaaguuucaguuccuugaucuugucugggaugccuguugguugguucccugagaaaggaacucagauaagacaaauguaacuuucuuacguuuuaagacugggagggccaauuucuauguuuauucaaaagaaaccauaaacaucaguucuaggggacaguugggccaguuucacaaauuaaaauaacagcuauuuucuaaucuuauaacugguaaaguuuaagacccaaggaagaugugcagacaaggaugauuacucaaacuucuggaggaguuuauguucagccuuuggggagguagucugguaauacauagccuuauauuuuuuacauauccuuugaguuugcacuuuuaaaaauucagccuaaagaaauaaucuagauacaagaaugaagugcauagaauagugaaaaauucaaaucaaccaaaauauuuagugauagauuaaauugugguacauccauaaggugaaauggaguccacacagugaaaagagugaguacaugcagaaauguuugugaugugucaaguuuuuuuaaaaguguguguuuauauguguguauauauaucuguguauauccauguauauguacaugucuauguacacacauauauauguguguguauauauauauauacaugcacacacauaccuacauacauauauauacauuuggaaaggaaaagaaggauaagcaguaucugcucuaauuugggaggaauuacauauacuguguacauagaaauuauguaugcaaccuauaggacuucuaauuuucugugccaguuuccacaaagcuacuuccugaaacuuugauggucuaugacaaugaaucacaaucuggugcaaacugcccaggcccuccucaacuggcugauggaggcucaucuucacagcuguuuacuuuccaguauauaaaggacuagagucaauuggugagacaacaacaaguaaccaagagaccuuugaguccuccccaggagagggagauuggcuugagauccugggggugaggagagaaugcaauuagaccucaaaccuagaguacaguuaaaccucaauugggauaccuauauauguuuacuguaauaauguuaaucucuagaccuguucaucuaaauauuaacugauuacuuugucuuagaauggauuagcacacaagcaaaagaaauagguuuuuacauaaaacuuccuuagucuguuaaaaguuguacauaguaaugauuugggaauccuuauuggaauaccauaauuaagaaacugugaugauugucuccuaacagagggauaugcucugugaggaccuggcucaugccacugagcagcugaacaugcucacagaggccucaaaaaaacacucggggcugcugcagucugcccaggaagaacugaccaagaaggaagcccugauucaggaacuucagcacaaggugagaaacacacaggugucacucaagaugggagacaagagaccaaguguaguggcucacuccuguaaucccagcacuuugagaggccaaggggguggaccacuugaagucaggaguucaagagcagucuggccaacauggugaacugaaacccugucucuacuaaaaauagaaaaguuagccgggcgugguggcgcucaccuguaaucccagcuacuugggaggcugaggcacaagaauugcuugaaccugggagguggagguugcaaugagccaagauugcaccacugcacuccagccugggugacagagugagacccugucucaaaaaaaaaaaaaaaaaaaaugggggacaggaggaauccacaguugagguugucaugacauuccugcauuggccaacuucuccauguacaaaggggaggcuaauggaguauccuuaccuggacugagacuugcucagcugccucccacccaccuuagguccuugacacauggcaaccaguucuaaccacuccagugagguuaugccugacuuuuaucauauuuuuggugguuguuguugucauuuuauauuuuguauuuuucucagaugacuguuuuguuacuugugaaacuuggaacauuuuuauaaguauaaauaaauuugugagagaaaaggagauggguccaggugcgguggcucacaccuguaaucccagcacuuugggaggccaagguggguggaucacgaggucaggagaucaagaccauccuggcuuacacggugaacccccgucucuacugaaagcacaaaaaaaauuagccgggcgugguggccggcuccgguagucccagcuacucgggaaggcugaggcaggagaauggugugaacccgggaggcggagcuugcagugagccgagaucgcgccacugcacuccagccugggcgacagagagagacuccaucucaaaaaaaaaagaaaagaaaaggagaugaugauuggguuauaguagcaaccaaguuagauuucacaauuacuuuuaaaaauaucauagguuuauuuuaauaucuuacugcuuuucaaauuauuaaucaaguucugaaaaaauaauguaaauacagcauauuuccauaugccaugggaagaaaccgcaauuacuuuugcaucaaccuaauaacuguaaucaccaugcccugcaguagaucuccaaaagguauuccuccuguccaacugaaacuauacccuuugaccaacaucucccauugcugauucaugucuccuuccaccccucacuucccccagacucugguacucuccauuucuaugaguucaacuuuuuuugauuccacauauaagugagauugugugguauuugucuuucugugcuggcuuauuuuacuuggaacaguguccuccagguucauccauguugucacaaaugacagaauuugcuuccuuuuuaagacuaaguaguauuucauuguguauauauauagcacauuuucuuuacccauucucccaucaauagacaguuaaguugacuccauagcuuggcuauuacgaauaaugcuucagagaacaugggagugccgcugucucuucaauagacugauuuuaauuccuuuggauauauauccagaggugggacugcuggaucauacaguaguucuguuuuuaguuuguugaggaacuuccauacuauuuuucacaauggcugugcuaauuuacauucccaacaguauacaaggaucccuuuucuccacaaccucaccaacacuuaacuuucaucuuuuugaugauagccaucccuaucaggugcgaagugauaucucauugugguuuucauuugcauuucccugaugauuggugaugggaaguuugucuuuucuauuuggaccauguaccccauauuacuaaguuguaaccuuguaucuguucaauuuucccagcuaaaccaaaagaaagaggaaguagaacagaagaagaaugaauauaacuucaaaaugaggcaacuagaacaugugauggauucugcugcugaggauccccagguacuuuucagaaaaagauuauuucaggaggaagaaacaguuuuguaaaugauaaaaauuuggaaauuaggaagaacauaccuuugucuuuuuaaagaaaaagauuuucacuaauacccucugucugcuuuuuacuugaugaaaguagcagucuuuuauuuccuuggaaaagaauuagaauaauaagcuaagcagcggauuuuuuuuuuuuuuuuuuuuuuuuuuuuuggcagauggagucuugcucugucacccaggcuggagugcaguggcaugaucucggcucacugcagccuccgucucccagguucaagcaauucuccugccucagcuucccaaguagcugggacuacaggugcacacugccacgccuggcuaauuuuuuuuucuguauuuuaguagcgacaggguuucacuguguugccuaggcuggucuugaacuucugagcuuaggcaguccgcccaccucggccucccaaagugcuaggauuacaggugugagccaccaugcccagccguagcuagaauauuuuuuauguacuugacauuuacguuuaaaagaaaucuuuauaauaucacuuaauuggauauuuggaugagaugugauuuuauuuuagaguccuaagacaccaccucacuuucaaacacauuuggcaaaacuccuggaaacacaagaacaagagauagaagauggaagagccucuaagacuucuuuggaacaccuuguaacaaagcuaaaugaagacagagaagucaaaaaugcugaaauccucagaaugaagguaauuggauuuuuuuuccaguaaauuuaauuauuuuuaaagagaccaagucucgcuauguugcccaggcugggcucaagugauccauuugccucagccacccaguaucuggcacuauagguauaugccaccaugcccagccaguaaauuuaauuuuuuuuuuuuuguuuuuuuuuugagacggagucugccucugucgcccaggguggagugcaguggugugaucuuggcucacugcaagcuccgccucccagguucacagcguucuccugccucagccucccgaguagcugggacuacaggcgcccgccaccacacucggcuaauuuuuuguauuuucuaguagagacggaguuucacuguguuagccaggauggucuugaucuccugaccucaugauccgccuaccucagccucccaaagugcugggauuacaggugugagccaccgcgccuggccaauuuaauuuuuuaaacuaagcagcauccucaugguuacugaggauacaaaauucaaaaagcacagaacugaaagguagacagagaaaaguauuccuucuaccccugauacuaauccaccuacuuugcugucccuggaggcuuccaggguagccccuuucuuuuagagcuuuuuaaugcauacauaaccacaucgcuaagcauucucuccugccccauuugguuuuuacacaauggugucauauacagguugcgccagcuaugcucucaucaggaaugaaggugagagcauguuuccuuaaaccucaccucauggugcuaucugaauuucggaucuuuguccguuuaauagcuaaaguauuaaaugauguaguuuuacauuuauauuuuucuuaagaguaaaauugagcaucuuguuuuucuguuucugugaacaauauccauuacccauuuuucuaucacuggacuuuuucuuauugauucauaggcauuuuuauauauuagagauuuuuuuagucucugauaaauuuaaaauacuuucuuguuuuccauuuuuuuaagcuuccucauaguguuuuuacccaguuacuugaugguauguugucugaguaguggggugugcacauggcucagggguggggcacauggaagagugucuggguagguguguaggugcauggggaaggaugugaugcuccacagaagauagcauuuauccugugaggucauugcucugcagggaguuuuuguuuaggaacacaaauuguucacuuuaaccaagggauguauauaaagacagcacuuaucuugaguuuuguuauucauggagaagauuauucccaaucuuuuuauuuagggcaguucucaguaugcuaucucaggaauguggcuguuauccagauugccaugaucuugaaacuuagaagaaacugggucaggugaaacgaaaucagauaauaggcaaguaaauccaaaaggauauuccuugcagacaaguauuuauuucuuccagauagcuaugcucaugauuuucaaguuaggaugcaauugaguauuuugagggaugagcugugacgucaauuuuuuguuuuaauuagaaucuacguaauaaauagaaucgaauaguugagaacauuuuucaauauagagauuuuugucaucuuuauucacaaaggaauuuuaauuuuuaaugaauucugugauauugauuuuaaaaaucuguguucaagacacuguggaugugaucaugaaucaccauucuaggccuccaauagcuugucacagucugcuuuucaugcagcaauacccagugcagugucucugcauaggaacuuaaaagaggaauaccugucucagugguggccuuggggagcuaaaugaagccuacuguaauguguuuuuugaaaagauacgauuugauguuauuaggagcaguugcgugaaauggaaaaccuacgccuggaaagucagcaguuaauagagaaaaacuggcuccugcaaggucagcuggaugauauuaaaagacaaaaggaaaacaggugagaaagaaccacgagaacucuaugggcuaaaucuuggccugccuguguggaguuaaaugagguuggaauugguuucacagguuucccaagguguacaauguuucccacuaauccaggagauggucuuuugguugauuuugaaucaagucugaucuguucaccuuugcauugcucugcagugcguuuuuggcauuguugcauuuguuuuaaagugauugaaaugaauuuaaaacaugugagauacuuaaaacaaauuacuuauauuuaaaaaaauuuuuuuaagguauauauaauaucgacaagguucaagaagccuugcagagaaagggagaauucccuacuaguuggcuuugcuucguaacucaugguccagggaaagccccugggcaggacaagaaggauauccuuagcauuuuacagaggagcauucacuuggauuuagacaucucucugaguguguuuuggcuucagguaaggcaguuuuguaguugcauuugccgauacauuugcauagugucggggcagccauauccagacuuauaucuugucuuugacuuaaaagucauacgauuuucaacauauuuuuuacccuuuuaguacuucacuuuccuuaacaauaaaaugaagaaaauguucauuuucucacaaggaguuuuaaagauuaaaaauuacauguauaaagugccaguuacaguguuugguagcaggugucagucaaugaaaaguaguuauuaaguacacaagguagaauuaugauucugccuauuguaacuuucugagugagaguuuggagaugauaguggccuguaaaauuaugcaagaagucgaauugaaucaaagugggaucuccgagauagaagcccuuaccgaauuccacugacugcuguccaugcuguugccacaacaucuuugacagagaagcuugugcacuccugcagcucccuggcccuguccagaaacaccccugauaugaguuguucaaaaccuaaaugaggcaggagagauuugaggaugguaaugguggcuaugcuaaaaucucuucuuaaaugauucucuucaaauuuuagugagcaucagagaucuuauucaguagggcuggagcgaagcccagaauucugcauuuuaaaaaagcacgugccucccuuuguaggugauucugauguagguaguccacagucugcucaccuaguuuucauaugcuccauauauguccaauucuauuaaagaaaagccuuauauuuaguauacugucuuuugucaagagcuacugugaacauagaacauuuccggaucauuuguaaaaugaaaauuuaaaauaccguauuucagagauacgucauaagcuuacuacuuuugcccauggaugccacuaaggaugcaucguucaagucuuucuucccacuaccaacauaucuaagucagagucucuuaaauagcccgaauagcuacagaagcucuucaucagacgauugagcuuugaaacaaccaauaagagucuggggagccauucugaguagugaggaaagcucauggauuauauagcaaugagagacccaaacaccaagcauuccagggccuuugguuuuucacagauggcacuguggaggagauggaugcagccguaaaucaaggcgacacaaggcagaugaaagaguugugaaaccaaagagggaugucaagaaaagauucucaaagaccaggugccugguuaacuguaaaaaagaucuuuguugguggcaucacagaagacacugaagaacaucaccuaagagauuauugugaagguaugagaaaauaggagugguugaaaucaugacugagugaggcaauggcaaaaagaagagcuuuacuuuuuuaaccuuugaggacagccaugacucugcgaauaagauugucucucagaaauaccguaaaguacauagccacuaccaugaaguauggaaaaccauguugaagaaagaaaugguuaguacuucagccagccagagaggucagagugguucuggaaacuuuggugguggucauggaggugguuuuggugggaguaacaacuuuggucaucaaggaaaaauuucacugguaaugguagcuuuggaggcagcuguauugguggauaugggggcagcagggauggcuauaauggauuuaguacuuaaaugauggaagcaguuuuggagauggugggaacuacaacgauuuugguaauuacaacaaccaaucuucaaucaauuuugaacccaugaagagaagaaacuuuggagacagaaacucuggcaccuaaaaaaaaaagaaagaaagaaacucuggccccugugguggcugaggcuacuauguugccaaaacaucaaaucaagguggcuaaggcaugugaaaguugccaguaccagaauggagucacuuaugucaaaacccuaacaaaguggagucaggaggcccuaaaaaaguucucaccgcacaugccuauaauauaccuuaucacaagaaauuccugcaggucccacaugccccacuucugcacucacccugcaacagagcuuaucacaggaauuuuucaggccugcaguauuucagacaagcugccagcaccaggacaguuacucagcaacagccaucuccaccaaugaauaaacgccaacuccugcacugagcuucugugacccgugagcuuuauuucaagcuuuauuucauggauuucucuuugucuuuaaaagcuuucccuuuccccaacuccccuggauacauuaauggcccgucauagcuugcauacccugcaauugcaaucccucugcuauuccuagauaaacuuguuuguucuaaagagccugucuuucugaguuucuuuuuagguugacaggcaguuccaguagcagcaguaguuauggcaguggcagaagguuuuaauuaaugccaggaaacaaagcuuagcaggagaggagagccagagaagugacagggaaacuacagguuacaacagauuugugaacucagccaagcacaguugguagcagggccuagcugcuacaaagaagauauguuuuagacaauacucagguguauggguaaaaaacucaaggaccguauuugugacuaauuguauaacagguuaguuuaguuucuguucuguggaaaguguaaagcagucuuaacaaagaguuuuaauguguuuuuuuuuuccuuugcacucauccuguugauugccaaaugucauagucugaucaugauguugaauaaaugucuuuuaaaagauguuuuucacugggugucguggcucacgccuguaauuccagcacuuugagaggccgaggcaggcagaucauuugaggucaggaguuugagaccagccugacuaacauggugaaacccugucucuacuaaaaauacaaaaaaugagucaggagugguggcacgcaccuguaaucccagcuacucaggaggcugaggcaggagaaucgcuugaaccggggagguggagguuguaguaagcugagauugcacuguugcauuccagccugggacagaguaggacucugucucaaaaaaaaaaaaaaaaaaaaaguuuuucauuucauagccucacauuccuuauauauaaaagagcuacucagaaccuucuuugugaaaaauuagagaaagggcagacuauagcucaggggccuaauucagcucacaaccuguuuuguaaauaaaauuuuauugagacauagucacacccugucauuuuaauauuguuguggcuacuuuugcacuacaauagcuaaguugaauagcuguggcagagaccgcauggcucccaaagccugaaauauuuacugucucguucuugacagaagacguuugccaauccuuggauuaguggacagaaaacauaucuuucccuaaugauuugggguauuucuucauugaggacucauuaccauuuuugucugggcugccagauuuguuaagggaaagaaaccucacuguagcuucuguuuuccuucaagaaauggucuuuuacucaccagugagagagauauuccuagagaagccuacaacauucaggaagguucuccaaggagggagggagggaugucucucugguccaggggcugcacacagaaacucaacuuauuauccucaccuggucaggcucacagagauagauguauuaucuagaauguaauuuucuuacuuuauauauuggaacauuccuuuuccaugaagacauaucuggugcuugggacaucuggcccugguguccacauacacggaaaggcagagugguuaucagaaaaugccaacugacuauggaaccugagcaaaagagagucaaggacuccacuagccugaggccagagcgacccugccuacccaaaaugugcccccucccagcugaucacauucauaccaggcucuuggcucuuucuuucagcccccuuuuguucacauucgaucuucagauguuaccacuuuuaacuaaguuucuacuguauuuuacuuucaaccaauccuugauuauauuucccaccucaucucaucuugcuuuuguacugggaggaauccugaguucuggggaagugccuuauuucauccccaugugucaaucacauuuaucaacuguacugacuugacccaaucacaauagaguuagccuuucuuuguacaccuuggcauugcugcauauaauggauuugaauuugaaauugauacuugaauauacuuagcaguguuuuccuaugccuccucccaccccuguuaaucuaugcagugaucagaaucauccagauaaucaacagcugaagaaugaacaagaagaaaguaucaaagaaagacuugcaaaaguaagauuuuuuuuuauguaauaguuucuucuugucugagcaaugcuuuuauaguuaguauuuaugguaguauauuuuagaaaucauuuuacuauugaaauuccugucuuuucugcauuuccacuguuuagcaugauauuuaccauuaguauuuagacacagcugagaauuaagaauuugucuucaugccuacauggcaagccuacugcucagcaugcacacauauaauucuccauuuagaagcaaguaccaaggccuguuugaagccuuagagggcauagugcaugaagucuuggaaauagguacuuacuuuauguauguguagcuggcacuguggaaaaggauauugguuugauuuuauucacaugaaggagaaugggcugguuccuuucuaucuuuuuuaagcaauguuauuuaagaaccuaagcaaucuuuuuauuuucuuuuuuuaaucuucuuauagaguaaaauaguugaagaaaugcugaaaaugaaagcagaguaaguguacuauuuuguaauuuaaaaucuugaucaucuuuuccuuauucuccucuaaaggaaugauauaccacaagguagguaacuucuuuccuucugcaguaauaagugaauuuaauagauguuuacagauuuuuuuuuaaauaccauuugcuaaaaggguuucucaugugaagccacuucaaaagaaaucuuaaagaaauaaauagcaggaaaagccuagcuucccuugaggaaucgauggggcuuuuccucauggacaaugagaacaauguaacuaccaggugucccuuuucacuucugcuucugguuuccucugauuuaaaaccugaggcccucugagacccaaagaucaguacucugauuucuucuggucuagcccuugggucucuuuauguuuucuaaagccaugaguuuaauuuauucauaaaguuuucauauuaauucauguagccuuauaaauggccucacucuuugaugagcaagguguacuauauuuucuguaaaauucaaacuaaguaagcugguuggcauuaacacaaacaaaacaacauuagagagcuauugggcuuuuucuggguagauacuccuuauuagggauagagaucuucaaacauuuuugcuuauuauacugauuuaaaggauuuugaaacaucauauacccucuugcauauuuuugaaguugacuuuauaucuaaaauuuuucauuguaaguuuaaauuguuacaaagaauagacauucugggauauacaauauagugacauuugaaaauaaagcuguuggcugggcccaguagcucacgccuguaaucccagcacuuugggaggccgaggcagguggauugcuugaguuuaggaguuugagaucagucugggcaacauggugaaacccugucucuauuucuaaaauuuuuuuuaaauaaauuuuuuuaaaaagagaaaagaaaauaaagcucuugccauucuuuuaaaaguauuuaacuaauuugcuacuuucuguuuaagaaauacaugaacaaauuuccaagucuaaaauuuuacauuuuuccuuuuuccuuuguaauugaaguuccuuucuacacccugcaggauuuuauauugauuuaauauauuuucuggaaaauuuuuuuauugauaaccccaucauacuacuuaacaauaaaauauauguauguacauacauacacacacacaaauugaaaguaauuuguaaaaauuuauuuuaaucauauggcuuuguuauguuuauuaccaauugaguucacauuacaauuauuaaucagugugccuuaaauuuacuggaaauuuuuauaaguaauuauuauacuuagggaaaauuuuaguggaaaugcaucucuuaauguauuuuaaccuaaugcuuuuucuucagucagcucauuuuucuguuguacuucucaaaugagacaggauucagcaucaacucuauucguauuuucugcuuuuauagauauaaaugcugagaaaucuuguucacauaguuaaguaaauggcaaugaaggaguuuugauaggguacuguauuccaguuauuugaacuuuaugcaaguaaauaugucaaaaauuacauggugauuuaccaucaaaaauucuuuuuaaugaucagcugacaaagaccacccaauuuaugaaagauuuguuacccaaucauugauucauuugcuucauagaaucagaguauacauaggaaaacagccuuuucaccuguguaugagccauucagaguccggcuccuagcuaauuagugguaaagcuaagucagaaacccagauuauuuacaggauuuuugagaauccagcuaguugguugaauuacagcuauuuuagaacuaauaucuauuugaggucuucuagcaaaaagaguaaaagcuauuuaacuugguguauaguuuauuucauagucuaguaaccaagagucuucaugauaugcugucucuggaacauacagcaggccaaacuucacugcgggcaagugaagcacacuucagcaaacggcaugcacuguuuuaucaaucccagccuacaacagcaauuuuaaacguuacguuacccauauauuugugaagaugcuuuuaaaaguaauggggaaccaauacaaagccaacaaugaauugggagagcaucagugcccuucuccccagacuguccuucugagauccacagaauguaguccaaaaacaacuugccuagaaauuagcuggcccuuuguguauuaaauuuuauguauuauaucaucuuagcaaucaaccgcuagaaauuagcuggcuuugagugguguauuaaauuuuguguauuauaucauuucaguaaucaacagcuagaaauuagcuggccuugaaugguguaauaauacaucauuucaacagucaacauuacauuucaugagcauuauaaaauaaaaagcaggccuggcacagugguucacaccuguagucccaggauuuugggagaccaaggagaagaggauugcuugaggccaugaguuugagaccagccugggcaacauagcaagacuccaucucuacggauaauuuuuaaaacauuagccaagcacaguggugcaugcugguaguccuagauacuccaaaggcuggagcaggaagauugcuugagccuaggaguuggaggcugcagugagcuaugauggugccagcguacucuagccugggcagcagagugagacccugucccuaaagggggguggggggugaaguaggcauuuguuuugggaaacuuacaggauucagaucauuuuauaaagucagugaaauguacaugaaguguauaaauucuaaacaacugaagaaaugaauugaaagaaaugacuggugucccacugucugaggaccaguuuuugaaaucagaaaugaucaagauaggggauacugaauaaaccaugcagauuauaauaauacuuaaauuacauuugccccaagugggcugaaucuaaacaauuuuauucuaaauuuuuuuuguuuagaaaauguuuugaggaguuuuccaaaaugaaagucuuggguaaaacaaaaccaaaaaaagcauaucugguauguagcacuuacugucuucuuuugccaucagcagaggagggcuaaagauuaguaauacuuucaaaucaaaauucuggccuugcaguacacaugucuaacuugagcacuguuuuaugauuauguuucuuucaaauacuauaaagugauaaccuauuccuacagccuagaagaaguccaaagugcccuuuacaacaaagagauggaaugccuuagaaugacugaugaagucgaacgaacccaaacuuuggagucuaaagcauuccaggaaaaagaacaacugagaucaaagcuggaagaaauguaugaagaaagagagagaacaucccaggugugcuaguguguugguguuuucaugauacuuagaacacucaaaugaauagaacuaauuagcguaaaacucacuuugugauuggguguccuuaguucagaguugcuuuauuguaugaagaguugugaggccuugaaagcugggauucuggacucucugacuuccugugcuccuggaaggcaagaaauaaugugacuuuaaaagaaaauuaagaccuacuucucauuuuucccuccuuggauugauuaccugcaggagauggaaauguuaaggaagcagguggagugucuugcugaggaaaauggaaaguugguaggucaccaaaauuugcaucagaagauucaguacguagugcgacuaaagaaggaaaaugucaggcuugcugagguaaaccuaaaaauuauucugaauaaauucugucugguuuaaaaaugauuauuuuauugaaaccaaauuaaaacuuaauuauugaaucaguuaacugcuuacuucagggagcuuccugaauuaaaaaaaaaaaaaaaguuggucguugcuauucugagccuaauucaaucaguggcauuucauagacagcagauucuuguuuaacguuuaguuugcacauugaaaauuccagucuuaauuugaaauauacaccuaauaaaugcaaaaaaaaaccacuuccuguaagaauuagagccuuauuuuuuuucuuuuuguuuuuuuaaaauuacuuaggagacagaaaaguugcgugccgaaaauguauuuuuaaaagaaaagaaaagaagugaaucuugaggauuccggucagcuaccuaggcaucaccuuguuugaagauguuucuucucuuuuacaaguaagaccuacuccuggccacuuaggagagcugaauuuauggaccuuaauuauuaaauguuuauaagguggugguaaccaccucaaguuucugaugaacauucugcauccauauacacccugugacagucagcagucugcuauuaaguggccuacuucaaggcuuugaaucaacuuaagggaaaaccuuuugucuuuguaaaaauaaaagccuguagcuaagguuuacaguggacauuagccagaucauuuucuucuuagauuaugccauaaucuccuuugauucuuauggaaguucuaacaauauauggugguuccaacaccugcagugaguuuaaugacugacuuaguagcagguacaagaagcaaacuuguuaauauagauuauuuuuguauucuuacuuuagguauuuucuugagcauuuuccaugacuguaaauaaagccauuuuuuaagauaauaa

SEQ ID NO: 192111 - RNA, 3747 nt, Homo sapiens
uuaacuuacaaaaaacguauuuauuaauccaguuuuccucuucuugccauaauacauaagcaugacacagauggccugauacaucagcauggaacugucagaaagccccaccagucacugcuucuagaguuacaugacuggcuuuuguuuggcaacaggacaauaauuacagcgugguuucaaguaccauacacaaagcagaccaaccccaggaucuccagcaucugcgaaggcucacugggguaggccugggaggaagaauccaaagcacuguacagaugaucaaaacacuuccgguagaacacugcugcagcugcaccucuccuuacagagccagagccugcuccaucagaggccugcuucccuuggcugauggucagaaggcugcacaacuggaucgcccuaggauacagucccacaugacaucccaaggcugggccaccaucaugaucuuuccagcugguccgucuagccaaguggugcuacugcugcuuguguggaaggggcuuccaggugggugggagcuuccuguggauuagggugaguccgcagagaauaaggaacacuccuccccaccacaagaccuccuggcacucuccauacagcacauagcccaggaaggccugcgagacaaagauagcugugagggacucaacuucagcaggugggcacaaccucacucuccugggacugacuuccuucuaagggugccaggaggaaaggucuggagccagaagccuugggcuugaaaccuagcugucaccuucaucaagucacucuauucaaucuccccugcaugaguggagaggcuaccucccucacugcacuggaccucagcaaaguacacaagaaagacccagcagaugccagcagguagacacagcagguacaugguauuuguuucucccucaacucaagauugacuacgcucagcuccaucuugucaaccucagacuacacagggcagaaaaguuucugggaaucccaacccucuaaaugccauggagccuugaguacacagaacccuaggaaacagcuaggaugcacagugacuucagaaugagggcuccacccuggaggaacagcaagcaaguaggcuuuuuacugucaggcuucacucauaucuaacuuaagaauucuuccaugauuagaauuacauuugcuccaugaauagagcacucauccaggggucaagccacagcccaaccucugcuucaguuccuguccuuucuccugucugggaaaggagggguuauccaaagacaacucacccagaacccagauuuaggacaagagcaccacacccucaggcuacucaccgagcugaggauauuugaaaaagucacugugacagaugcaauggcugaagacauggagaaacugaggccccggcuaaagaagguccacaucagagaauuggugcucgccaucacaauaaugccuaagacgcauaaacccaugcucaccugcaggagaaagugucacugcagccacguccacccugggcagcaaccugcagacccccucaaagcacacccaggacugugguugcuggcacccaggcuccuacugagcucccacuacagcucagagggccucagagcuuuccugcacagggcuucacuuaacccucagugggcagcagacccaucuuacaaauaaagcaaauucagagaagauacucauuuggccaccuugcuggccauaugaucuugggaagaagcaaaaugcuaauccaaagccaguauuuucuacugaacaccggccccuuauuggucccacaaugaccagugcuugaagaucagucccagagggccaaguaguucuuacuccguagguaguaagccuaggguagaguucuuauuucuugagaucaggcaaagcaugaauuagcaaugucugcucuguauucccacccccaaauccuauacaaguuacagcccacuaaggcugacccccucuggguauucuugagcuuuuacucuguguuagguccugggcuguguuuaagcauucucauuuauuccuuaacuucauuuuacagauaaagagccaggggcauuaaguaaccuuccuaaagugcuacagcggugagagccaccaggcuucacaagcaggcaguguaccuccaugcucuuaacuagggcacagccuugccugagggaaacaccaccucagacuauuuagugaucccagacaucccuuggagaacuugcagguauuuucuuucuuuuuuuuuaaaggagaaagucucaagagaagagaagaucuuuagaagccuccuacacaaaggauaugcagucccccuugcuugguggugaguuagaaaccugccuggagacaaggcggcggggggggggggugcggaaucuaaauauacuuauuacuuguaaugguuucucagcagcugaacacauagugucuugagaaaaaggugcuugcuuauaacuuacaccaggguguucaauuuuuuggcuucccugggccacacuggaagaacugucuugggucacacauauaauacacuaacacuaaugauauaugaugagcuaaaaaaaaaauaauaaaucgcaaaaaaauucauguuuuaaauuugcaaauuugcguugggccgcgaguuggacaaccuugucuuacacaaagcagcauaugggccaguggcaaccugcuuaaaggguuaugaaggucuaguuccugacaacaaacuucacggcccauacaaaguuauucauuuuacuuucgaccacuuaccccaugaacuacacccaaugggauacuaaccugaagcauggcagcuacuacuggauuagcccuaaauaggcuuaacccuaaauaaucagugaccacuguccaggucagaggcuaaccuugggcugcagacgcaaugaaaccccuauagcaagcagaggcuggucuacgacgugggagggagaggcagagauacaccuuagcagacgccaggaugcaaguuuaggaguucucagcgucaggaaaacauccagaacgucucugucaguauccucuuaugccuacaguaucccaaacucccaauuuuccugguaguggggcagacuggucaucuggucacaacacccguuaauuacggaguaaagggaugggcaagaggcuucucaccuuaagagucacguggagagaaaugcucaggcacaagggacuuaaaaugagagguagaggguggauguaggagguguaguucuuccccgagagcgaacuagcccaaccggagaaaagguuuuaggucccugguaagggaagaggccucaguccccgacgucucuuaccaccuacacuggacgaggguuuggcgugauuagaggcgaaacacucucugccaccccagcugaccgcagcgccgcccgcggcccggggccccggcgggacagaccggcgagggugcggcggcgcccugcgcccacccccgccccaccccaagagccccgcgggccccgcagcgccccuccuccgcccagcggcgccccgcccgcccgcccgcagcagcagcaccaacagcgccccgggcucgaccucgcugccgaaggccagcuuggcggaggcggcggccagggccccgaacgcgccggcgcacagacaguugaauacgccccaaaagcggcgccgcaucgcacccgccuggaggugcggagggaauuccgcgggggugucaggguacgcggucgcggacacggcgccgcccggaggccccggccucucggccauguugccugc

SEQ ID NO: 192112 - RNA, 41095 nt, Homo sapiens
cggcggcggaggcgcggggccacccccaagccgagccggggugggacggcgcgccuggcgaccgcgcacugagacugccgugccggacccccgagccggagccgagcgcgccgaggccggggccauggagaaagcgcggccgcugugggccaacucgcuacaguucguguucgccugcaucucguacgccgugggccugggcaacguguggcgauucccguaccugugccagauguacggcggaggugagugcccaccgcgccccggccccagcccaacucugugcgcguccccgccgugugugcgagccgggguuagacccaaguuacagaacggcacacugaggccgggaaagcgagcgugauuuguccgaaguuacagacccgggaguguucccaggacaccucguuccggagccggagcucucucccaagccgcccucccaagcccucgggaaccccucgccccaucccgggggcggccaagcccccaacccucacccuuguuggccaggcugcggcucugagagcgcaggggacgcggucuccuucuucgagagaagugucaauggucugacgucuuagugaguaaaccuuacguuuagguguaaaaagugaguaggaaauugucuuauucaacagaaacucguuauacaacuuucagauccgaaacuuaaaucaacgguuugaaacucagguuaagagaaucuugagccauuucuuuaaauuuuuuauaaggagauugguuugaguuuggaacgacagaaagcaggaaaugcaaaucauucuguuuuguuuuguuuuucuuaaauaaauguuuccuccgaagcaucaugcacgcuccggggacagccagccagccacgcgcucuuaccgcacuccccuagcguugcggaaagcugggaacaccuucuacacaugucuauaaccucgugaagcccaaguaccuuuuuggaaggcaauguggcaagagggauuuaagucucagcaucuaaaacacuuuuuuucucgguugucucguuucuagaauuguaucuaaaggaaauugucagaguucugacagagguagaaggauggucaccaucauuuaauaagagcaaaacauuggcaacuuccuaagcccucaaauaaaggggauugguucaguaaauuauagagcauccauucaagguugcucuucgcagccuuuaaggcggcauuuucaaaaaaaaaauuguauuuucucguauccuguauuaaguggagggaggagaaaucagauucaaagcuauauaaaauggauuugacauuuuaaaacaauuacuuaaaaauaugcagagaaaagaauggggaaaagacaucaaauuguuaacaaaauuucugggugauuuuuguuuaccuugucguguguguguguuuuuguguguguauguguguguuuguguauuaggacuucuauaauuagcauguuuuuuucaccauaaaagaucauggaagauguuagaccaaaguauuuacgaaaaugaacccauuugagaagaccaagagcuaaacacugcucccuccuccccuuaccccaaaucaacaaaagguuaauucauagaguuuuuaaaacagugcauucuuaauuuccugauuccuuuuuaaaauuugaagugcauaaauacaccauaaugaugugaagggcauauguugccauaugcucuaacagcauuaccaugugcucuaacagcucuauaacugacucuuaaaaagaauuauuugucagaaugagauuuccacaucauucugugcucaguagaccuacccaugauaccuuuauccuggguacauguuucccagucaucaguccaggugagccucacugucacaugacuacuuaauuccuuguuuauaauaccaccaucaccugaauagucugcagagggaugcauguggggcugauaguucuggaguugaauauguaucaagggguugcuagggaaaccucaagacccucagguuccaagaaaaagaaacaagaaguaauccugugccuggugcagaggaugcuucggcuggauggguggauagauagaugaguggaagccggacggagcauggauugguggcuggguguaugcauggauuagugggugcacagacaaaaggagggugugggucugguggauggcacccugucagccacaugucuacagaauaaagaccgaacaguccacuuggcaccguaggcacuugaccaccuaacuugaccacuuguccaauauuuccaccucauuuccugccacacagcuucaaaccuccuccugccuuccaaacacuuccaugagcaccuccuucugugccucaacccuucacacaagauauuuccuccaccugagaggcuguuguugcugggagaacucccaccauucccuccaggugggaccaaauauugcuuucucuccguugugcucucugacucuccucacuacuucacaggccacauaagcacuuggucagaagaacugcacauuguucuucaguuucucugucuccgcccggcccaaccucugugaugugauggagucacaggagccauccaauaaauauuuguugagugaaugagcaagguauuaggaaaagccacagaauaaaugacgcuagaggaugcuagaggcuuucccaagccuuucacugcacaguaaagucaccuuuaagaagugauuuguguugccccaaacccaggcaguuuacaacccaucccuuaccggaagguaaaaaucagccacauuaugaaaggcugcagagggguguauaacuuccuuguaagcagagcugcaaauacccccagcaaacaaagaauuuguuuauaaaccacagagccaggcugugccaaaauacuucccagaauaagacggauuagggaucugugccccucuccaugggacucugcccgugacuggagaggcuuguuuccuuccugcuccccaggccaggcccggcccggcaugaggaauguuaauucugaagauuacauuccagguaccaaucaucucuguacagcccuggcugccugcucuagaaaaauaaaaaauaaaaggcagcucaaagaacuucacaaaaucucuuuuugaaaaagucagcaggucuugggcaaccaugucaaaaucuaaggcaguaguuguucaggaagaaaucggggaugcaagugugugugcacuaagguguaaaaagcaaauacugcacuaacuauuuuacauaaaccugugcacggaagaaacauggagagaugagaacaguugugugacugguggaaauauggauuuuuuucucuuaaauuuucucucugcaauauugagggggaaaucagaggacaccugacuaugcagugggacaguaucacucucagacuggaaugcuccacaucccugcaaagcccuugcugucugggacaggaagccagcucuuucagcugccuguacugcuuaccccaaauugcuuagagaauugcaugucaaacuguagccuaccugagcaucuucauaaacugcagguugcuagaccccacuuccagggauucugauccagacgccugugggggaggacaggauucuucauuucuagaaagcucccuagcaaggcuaaggcuugguccauggaccacacuucagggaagggucaggguugcuucuguggccccaggcccggcaguagggucccaguaaauguuuaacaacuggcucuugguggaacagcaagacccaauuccaagaauuugcagauuaccuugauguaaauccucccaccauggccaguuucagacugccaacguauugugccggagugugggguuggggagagguggggccgguuggcucuugugagccggccuggagcugcgguggccacagcucuucaggccagcacccagccugggacugauucacagcaggucaguccauggauggaucagggaacagugcugcagcuguuuaccuguaaagugggugagggcccccaguaguugggaaauaccaugaucaggggccccugcugcucacccaaguuuuccagacucaauccugguaacaucugcccuguugggcuccuagcaugugccaggcaucaugugaggcauuuucugaaggaauucaauuuggucuucacaacaugcccacaguugguccugucacccccauuuacagauaggaaacaagucagagagaacaagacuucuggagaaauagcuggggcucaagucacuucugugacaagccagggcucucuccccagcacccugcacucaucugcuacaggcaggacaggacuccucagguguccaggccuuucuaggacccccaaauaagaauugccguggcucaggguacuucuuccugugguucuccugugacacucacccauggcucaccuugacauuggaggagggccuggccaggagccugugcgauguccaccugcaaggaucccuugucccuucuguucuaaccuccucuccaccucugcccuucccugaauauaccucaaaauguuuggcaucuucccagugugcucuucauccucuccaggaaaccuccucccuaaauuaaaggugacuucuuccacaaagcccuccuuugauccccgggcuaaauccaucugauaugaguuugguccccacccaaaucucaugucaaauuguaaucccaauguuggagguggggucuggugggaggugauuggaucaugagguaaauuuccccuuuggugcuguucucgugauagugaguuaucagugagaucugguuauuuaaaaguauguagcagcuuccuacucucucucuuccuccugcuccagucauguaagacgugccuacuuccccuucaccuucuuccaaaauugcaaguuuccugaggccuccccagccaugcuuccuguacagccuguggaacugugagccaauuaaacuucuuuccuuuauaaauuacccaguuugagguauuucuuuacagcagugugagaacagacugauacaccaucccuccugugccuguugcauuguggggucugacaugucucacucccacuugguagggaggaaaagugaccagucaggaacauagagucugccuacugguggagaagccucuauuugucuguguguuggaaucagcccauagcuuuaaaaaauacugaugcuucuguccuauccccagaaauccugauuggauuggucucagauguggccuaaacaggaguuuuacacuccccagagggcucuacugugcaacccagguugagaaucacuaccuuacaaacaauauauaauauaaaccuucuaggcaauuuaagucauucaguaaauauucacugaguaucuucugcaagccagggacuacgcugacggaaguuuacaaauauggugauuauaggguacagggguuggggguggaccaagcaggaaaagcuuuaacaaagcacuguucagaggcuucgcugaaauaacucaagaaggacuaacugcucaagaggaucuagaaagccuuccagcaauggcaacauuuaauagcagcugugaaagagaagucaaagcucaucauguagaauuaggggugaaaauauuccaggcagaagaaacuguaugcaaaaggcacagaaaagcacacauuugagggaaauggccagaaaccccagguggcugugagaagugaggcggggacuagggcaauggcaggagaggaaacuggagaugaaaaaggagucagcaugucccuaagggccccaaauaacaggcuaagaagguggagcuuagcucugacagcaaagccagauuuuaagcagggaaguggcacagucagagcugugguuuacagagauugccagcauggaggccaaggaugcacuggguagcuggagaaggggugaugcugcccgaggggaugagcaaggagagcagagaacagaugggagggaauucuaggagguuuaaaccagugacagucaggaagaguaaagacggcuuuaauuuuucucaccugugcccuuguucuugguuuucaaaagguugacuggguuugacuccaaaugggaaacuuuugggggaagaccaagauggaggcgagugaaugaagagaaggaaggcgcugggguggagagucucacagaauagagcagugguucccaaaguggaacccccaggccagcagcuucagcauccccuggugugcucgguguuccuuacauuaaacauuacauuaaacauuguguauaugcacacacauacacaagcacacacaugccccagaaagaaaaaaaaaagguuuacaaaaaaucccugcuguguuuuuuguuuguuuguuuguuuuuguuguuguuguuuuuggaaaaaaagauauguaaguggagggagagaaagaguuuggacaccugaguaagcuuucccaugaaaggcacugacucgggcgggcaucucuguggcccucaaaggagacagauuaugaugugagggcuugcagugauacauuucauacagaaaggaaugucucuucuagugagauucuuagguuuagcaaauagacaacguacuggcuaugauaauuagaaaaauaagcaacaacaugcucuagaauaacauauggugugaguuuggggguuauaaauguaaugaguguucaucguagaaauuguguaaaagggccggguguggaggcucaugccuguaaucccagcacuuugggaggccgaggcaggaggaucacuugagcucaggaguucaagaucagccugagcaauauagugagaccucaucucuacuaaaaauauaaaaguuaggaaaaaauucuguaaaaugcagaaauauacaaauaauaaaauacgaaaucaccagaaauuccaccacccagagguaaugacuguuaacauuuuugcuguaaaaaauuagaaccauauuuuuauaugugacuugguauuuugcuuuuucaaaauuaacuuauuuuaauccuuuccaaaaucauguaauauuuuuugaaaauauaagcuuaaauagcuccauaauauuccauuuacagagguaacauaacuuacuuaaccauucuccaguuguggaaguuuaagucacguaaaguuuuaugcuguuauaauccagugguccucauguuuuaguggaggaauuugauccguuuauauuuauuaucagguuauguuugcuguuauuuuucaucacauuucguacugccuuacuuuuccuuuuuguuaguuauuauuguuggauuuuguuuugaucuuuuacauuaugaaguauauauucuucacuuuuuuucucaagugauuuagaagguauaauuccuauuuuuucuauuagcaguuaauuuaaauuugaggggaaaguauacuuauuuucucuaguuaucacugucaagaaugaaaugucaucuguugauaucacccuaugaaagaaaaaaauuuuagcacacuuguacuucuugcuucuuuccucacccccauuccaguuaacaacuuuuguugauauaaucuaggauuucagacacauuaugaugauuauuuuacucuuuauauuuuguuucuucucauucagaaauuacauuuuccauuuguauaacuuuacaaugauauuaacaguaugauuuucagacuugauucuguuuuguugguuuauuuaccacuaguuaguucuacuauaacacaaccccauaucugaguuccuuauuuugauccaacacugguuggaugcaguucaugagcacuuaaguuuuucaggaauaguaaauaggugguucgcuuucucagcaugucugagaacaucuguccuuuguagccacaugaguuagcuacaauguuuuuuacucaaaaaucuauagaugcuuuucuguuguuuucagauuuucauuucugcaaaggagaacucugcagccaauuuuauuuuuuauuaguuauuagguaucauggaccuagaauauuacauaaauuuauaugguauuaugugaaucuuauaauuucugaaagaucacaggcuauaugucuaaguauuaaauguuuucaucaaguuaaccuaggacuagugagugcuuucaauguacacaacugggaaaaugacuuguagaauuugugauuguacuuuucuaccaguugugucugcaguguucuuucugcaggcacaacugcugaaacugaguaacgcuuauuagacauagaguagcgcuuggguuugcuguccaugucucuucucuucuuguaaucuccaucucuuuauccuuuucuucugagcugugggauagcuuucuuuuucuuuuuuaucauuuuuuuuuuuuuuuggaaacaggguaucaccaagagccaguauggaucuccccuagcaaaaaauauggcaggaccaggugcagugguucacugguucacccuguaaugucagcuuaggcaacauagugagaccccaucucuacaaaaaauugaaaauuagucaggcacagugaugcaugccuuugggcccagccacucacgggggcugaggcagcaggauugcuugagccugggaggucgaggcugcagugagccgugaucgcaccacugcacuccagccugggcaacagagcgagacccuauccaaaguuauuccacaguucagaagaacaggauaaagagauggagauuacaagaagagaaaacacauggacagcaagcccaagcauuacgcuauacaccacaguagagccaguuacucaacaaacauuuacugagcaccuacucugugccagguccuuccuuaggagcuagagaucaacuaugagccaugcagaucccaucucuacccucaaggagcugacuguuuaggaguuggagguguggacagagcaguagacauucaguguagcggcaggugccucaacaacaggggcuugcaagacaagagggugggucuuaguuuugagugaucuggugacacuuggaggaagugaugcaucuggaagauccagugagacccuaaggauucuuuccugcauucaacaaauauucaauggacucuggcucucugcccagugcuguucuaagcagagcagagaacaagaggagagcuuccuugcuaguagagaggcagacaccaaguaaacaaagaaaauuauagcauuauucacauagggaaauguucagaagguaaaucaagcaggguaaggaguccaagauggcaagaaggcuguucuagugaggguggacagagaaggcggcucuggggaagccaagucugggcagagcacugaaagaagagagaaagcauccugggcaggaggaacagcaagaaccaaggugcugaggccagaccagcaggaaggccagugugacugcaguggauggagagaggccagcggcagggaagggaaggugggagcccuguuccccaagccucagaggucaagggagggaguauggguuugauuccagguggaaggaggagccaaggaagauuugaccaggugagaagcuagggauggaaaaggcaggugugucacaaucugagaacaaacugcagggaggggacuggaggguggaaucacaaagaccugccuggagggcggugcaguggagaugugacagugggugccagggagguggugaugaguaaggauucaccaggcugagcugagucuacaucuuccaauaauucugugacuguaagcgucccacucaucugggguaauauggacucacaguggcagagacauuaccacagggcucaaugugugccucaguuaccuauuuauucauaacaaaccacuugaaaacuccaggacuuagaaggaaugauggaauuaggaaaucgccaucuggcaaccaguguggcaauaaucguuuugggcaaaaaucuucacuggaugccaaaacuacugggcaaaaguaugagaaauaggauaguuacugaggcucagaauaucuccaagaagauaauuauuucuaaggggagaauaguaacucucagcagagaaauccagcagacaccaccucaaccaagugagcaaaaucuacaucaccgugaauggaacacauugacaucuugugccucuggacaaggacacaggauaacuuuaguguuucugccaaaacuccaaaugagggacauuccacaaaguaacuggccagugcuccucuaaagcacugugaaaggucaugaaagacaaagaaaggcaaaaaugucuaaggaggugucccagauuaaaggagacuaaagaaaccugacagcuagaggccuugugggcuugugagcuagagucuggaugccuagaggacaucagugggacagucaagaaaauugcaaaagggcugcagauaaaauaauaguuugauguugguguuaauucccugauuuuacucauugcacugggauuauauaagauaauguucuuguuuuuggaaauacacacugaaaauauugagagguaaaaagaaaaaaaauuagugacuuaaagcaacaauaauuaaucauuucucacaguucugugggugccugagcuguuccuuuacuguuugugucuggccuugcucaugcagccagaaggucccucacacaccugguagugggugcugagcuggcuggucucccucgguucuccuccucguggccucucauccucuggagccuggucugguaucuguacauggcugucucaggcacacuccaagagaaggaaggugaagcugcaaggcauccugaggccugggcucugguaccaacauggacaccacauucuacuggacaaagccagccccaaggccagcccagccucacaguguggggaauagacuccaccucuucaggggaggagcgcugaagaauguguggcuguauuuaaucuccacacaugccuuuaaggcauguaguuguauuacuacuguauuaggguucccuagagggacagaacuaauagggggaagagagagagagagagagagagagagagagagaaaggggaguuuauuaaguauuaacucacaugauuacaaggucccacaauaggcugucugcaagcugaggaucaaggaaagccagucugagucccaaaacugaagaacuugcaguccgauguucaacggcaggaagcauccagcacgggagaaagauguaggcugagaggcuaagccaggcucaccuuuucacuuuuuucugccugcuuuauauucacugucagcugaucagauuggguccaccagauuaagggugggucugccuuucccagcccacuaacucaaauguuaaucuccuuuggcaacacccucacagacacacccaggaucaauacuuugcaucccuuuauccaaucaauuugacacucaguauuagccaucacaacuaccaccaaaaucaugccccuuguagucaaccccuuccuacuccccuacuccuggccaccaccaaccuguuuucugucccuauaguuuugccuuuuccagaaugucauauaaauggaaucauccuacuaugguuugaauauguccuccaaagcucauguguugaaaacuuaguuuccaaugcaauaggguugagaagugggaccauuaagaggugauuaggucaugaggacucuggccuugucaauggauugguaucauuaucccaggaguguuuuuguuauugagagaguggguuuguuauaaaagagaguucagcccccucuugcucccucuugcucccuuugcucccucuugcccucccaccuccugccaugggaugaugcaguaagaaggcccucuccagauacuagcaccaugcucuuggacuucccagccuccagaaccaugagccaauaaauuucuguucuuuguaaauuauccagucucugguauucuguuauagcagcacagacuaagacaggcauucuuuggugaaaugccuguucacauuuuuuuuuuacauuuuuugaaaggguuauuuuucuuauugaguuuugagaauccuuuauauauucuuggcacaaaguuuuucucaagaugcguguuuugcaaguauuuucucccagucuauaguuuuuguuuuuauucucuuaacagugucuuucacaaagaaguaacgaaauccaauuucucaaucuuuucuuccauagauagugcuuuuaacauuguauuuaagaaaucuuugccucaaacucaaguucauaaagguuuucuccuguauucuuauauaaguuuuauagcuuuuaguuguucauauaggccuguaauccauucugagauuuguuuguuauaaaauuugagauauggguugaguuucauuuuucugcauaugaauguucaauuguucuagcaucauuucuugaaaaauuuauugcagagcaaauucacccagauuauguguuuauuugauagguugggucaggagugacagaaaugauuaaugccuagggccaaacagcccccauguucccacuuggcaucagguuuuagauuuccacccuacccaugggcacugggcagucagacccugucagagagacagucgucccuggaccuugccaggccuuacauaguuacuguuuaacaccccgcguaaaaacaggauuaucuuauaaccacugaggguuugaauguggcuucaaagucucagugugugaacccaaucuuuauugucagauauuucaugauugagagccaccaaugaccucuuggacuccuuugauauugagagaaaacucacaaggugcugaaacaagguucugaaggaaaggaagggagccuggccuagaggaguuauagcagugucuggacaugagagggcaggauuuguucuaggcccccacaugagcaggaugaagcuaggaacuccaagccugguggugugggcacucauccacccaugcaagcggcucaugccuuucuuucugugguguggccaugggggcucugccuggucuuugccccagccauuccacuucugggauuuguaucccaaggaaauacacaaacaaguggaccaggcuucauuucacagcuuuguuuaggauggcagaaagcuggaaacagccugagugucuaacaauugauuaaaugcauucugggcucauuuucagagcagaacaucaugcagcucuuuaaggggugaugcaaaggucugugauugggagagugccuggggaaugccauagggugagaagaguggguuacagcacagcacguguguacaauggagacauuuuugguaaauauuagauguucauguaagcauaguuauuuuguuguuuaccuuaacaacugaggauccaguuugcucuguaaucagcccuuaaucuuugcaguuguagugucuggguuuuauuugaucagaaguccugcccucuuuucccacuggacauuuuguuaggcucacccugacaaaauucacacucccuggcuccccaccaucaccaacagcagggaaccucaagggcagggagcagaguugcuacucucccauuccacaccagccaggggcuggcccagaguaagugcuuaguaagugucuguuucauacacuaccucauguggagcaccaucagggcugugcacaaagcccaaaggaagugcauagagguggacagcugaaugcauggauccaggcaugaugucugacauauuuaacaacacaauugucuuggcccugaucaacuauuaguugcugaaauagaagauggaaugugggguuuggcagaagggcugggacaguggaggcauugagaaaggcauucaagcagcuugggacaguggcaguuugccucccagcgaggaugaauuuaaagaguucaacaacugacauggcugcaugucauccacagauggauggacgaacagacagguggcugaguaggaagauaaaaagaugaaaggauggauguaaggaugcauggaaggauggacagaugaauggauggaaggauggauggaugguuggauggauggauggauggauggauggauggauggauggaaauauggaaauacggauggaugaauggaagguuggaaauauagauggauggaaggaaggaaggauggauggauguaggguggauagauggaaggauggaaagauagacagaagaacggauggaugaauggaugguuggauggaaggauggauagaaagugggugaaugaauaguagauagauagaugagaggaauggcagcaagagggauggaugaaaauguggaaugaaagaaggaugaaggaugaguagaaagaggaggauggaugauggaaagguaggagaaugcauggacaaguagaaagacaggaggauggaaggauguuugcacagagguugaguggucguggagaaaagccuuuuggugguggccuggcucucagcucuggacauccacagguaguuuccugguccccuacaucaucaugcuuaucguggagggaaugccgcucuuguaccuggaacuggcuguggggcagcgcaugcggcagggcagcaucggcgccuggaggaccaucagcccguaccucaguggugucgguacguggggccccuccaguccucucccacccagagacccgggcagcaugggggugugggugggaucccaucagcaaagcugcuggaucaaggggcgagcacaaggcccaagagagagcucuugccuggggugaacaaauggccugguggggaugacauagaaugugggcugagaggagcuggguuuccuacccacagggcgguaagacagggaggaugcaugccccuuggggaacagaugccacccuccuucucuucucuggaccucagcuuggucaccuguaaaagggaaacagcuguaacuccaaguccuagcuaacaaccauucuggaaacucaccaacuucucccugcuaaauaacagcucucuuuuagcaagcaccuacuacaugcugggagccagccuauaggauauaugugcaugagcucauuuaaucuucuuuacaccgcugagguguuguggagugccauuaaugucucuggggugcggaagcugaggcccgcacggacagcaggagaggacuguuucaucucaugcuucuccugagugaccuugagccagagccccaggcacuuccaggacaaccuccaccugcccugcacauugcuuaugacccagggcugccucugcaugcagaaggaacccugaccagaaguagccauagccugugaugcucaccccucccaccccagaaaggaaggcaggcaggaaagcagagugacguuucaggagcaaagaggguggaagcuuauaugugaccugguugcagaugcagaagaaauguguccaguguucucacaaaucaucuccaaacccagacugccuccuugucuugaauggcuauuaauuuuuuuuuuuuuuugaggcggaguuucgcucuuauugcccaggcuggagugcaauggcacaaucucggcucacugcaaccuccacucccggauucaaccguuucuccugccucagccuccugaugagcuggaauuacaggcacccgccaccacaccuggcuaauuuuuuguauuuuuaguagagaugggguuucgcuaggcuauuaauuuuuaacacagaaguguguaguuuuacaaucugccugaauaagcaaucacagaggacuucucagaggcaucuucugcaucauaggaaagauaccagauauuugugccaaccaggggaugcuggugaauauuuaacaaccagugcucagaguggaguggggguggggaggggaagcccugguuuauagcauuugcggaugccuaugggguaaauacaggcaccauggccgguuucuacuaccgagugucccagcacuugcggcuggggagaggaggggacgcugguucucaagggcuggugugggccagccccagagcccugcugccucccaccccucucugugcucucaggccgcacccuggguuuugugcaggccugaccgaauuacgggcagcccccuccccaccgccuccucacacccccucuccuggcuaccaggugacucaaccgcuggugagccaaggagggagcauaacuguacaucuggacaagguagcacuucacagcaacagugcuucucacagcaugagguugugaacccaguucugccacuuaacagccggguagucuugggcaggcuccaggccucaguuuucucuucugcgauaugaagauaauacuguuguaaggaccaaagguaaauaaaguacuuauuuagcacagugccuggcaguuagaucucaaaaacaugucaucagccuccugucccagaaggugaggagggagguuggagaaaaagaaaucacccuucccaaguguucacaggugccuggucucgcuuaauacucaccacacaaaccugguggagggaggccucgcccaccccggggcggucgccacagguguguccugggagcacacgcugggccuggcggagggggaagggccauccucaguccucagcgcggcccucugcuuccucgcaggggucgccagcgugguggucucuuucuuccucuccauguacuacaacgucaucaacgccugggccuucugguaccucuuccacuccuuccaggugagccggggggcccgugccagaacaggaguaggagcgagaaagggagagaaaaacagggccacccgcucggggaaggggguguggggcaaggugagcagccucggggcggggagccgguggguggugugagguggaggggaagccaugcaccccaaaccacgugaagggcuucugaacccgggcuccacgggccccuuacgcuguaagcaagaguccaccggugagagugugcguguucuuggagagaagguccauggcuuucaguggauucucucugauggaugugaccccacacacacacuauuaagaacuacugcacagugugccuaggaggaaaucuguggagaggacugguggggagggauucccucaauccagcaagacagcaacggccuguccucuuccuccccguccccuucucccgcuuuccucagggccacucgugcuuccagguuucugacuccagccugagccucuucuuuucccugcagaccccuaaguucuccuagaaggaccauugucacccuguaacacaauagggccauuccuaaacauuuuaaaccacacauuucugaugauaacuacagcugacacucuguagaaaaguggaaggggcuagaauuguagagaagcaagaacuccaauuccacacagagagcugguguacauucaggacaagaggaauuuuccuuuccacugcucaugcucauuucuguuaccuggcuccuaccguuucacucucaggaaccccauccuccacugcccccaccugcuuccaggaaccaccuucaccuuggcuucuucccaguugggaacaguggaggaggcaggagcuaaccaggccaaugccuuacccuuugccccugagccaggccuucaugggacaugccuguccccaagguccgcaagcaagauagggcuggcauggacuauggacugaacuggguuugccucuggggugcuugggcauagccuugacucugugggggcgugaggaaugcuugggugaaugacuuuaauaauccugauuuggcauaccccacucuggcuucccaaugagcuccaccaagcuugccccauugcacguaucucuggcaagaaagcuguaaccugagcuuaguugcagucccuccuucuuucccugguucaaccuagaguuucaugaacacuggccacaacucugccucuccccagccuucucaguggaaacagggcaacucuucuuacucuauagccuggugacuguuuccuguccucugugcagggcucauguaugguugggcagcuugugcacugcacaacaguacugccaacuaagggcuugccauacacauuguaagcauuauagauuuguauacuuauuaagacaaguuuccaaaaguggaaguaaugugucuuguccuaacaaaaucagaauaauuugcucaucccccaaaagcaaaaauaaagugccucaagaaaggggcaucuuuuucuaauagucagaaguaugggggccagcgauucaugaaaaucacuuaaauauucauucauuccauccuucauaggucuguggacuuaucccuuagucccucuacuuugaagcccuccuccauggucccauaauaaugagaggaauaguagcugcagacauucacuuacaugugcuuugggccagacauaggucccagcacuuuagaaguguucacucauguaaucaaaacagccaccccacgaggcugagcacacugagcacccgagcagaggggagccgaguagcucauagcuggugggguuggacucagggaccuggccccggagucugugcuccugucuacucacucccuggccaggcuuuccagccuuguguccagcccuucucagcaggagcaccugggcuguuaugcacacaaaugcggggauccuuguccucaccugcugguucagaggugagugagggaggucagacugggaacuggcccauuuaacaaguucuccuauacgcuaaaccuucuucaaccuggcugcacacuggggagaugaaguugcggggugcggggugcaggguggggaggugugaaaaauccaaugaccaggcccuaucccaaacagaugaaaucagagucacugggggugcagccugggcaucacccccgggugccuuagucguguagccaagccugggaagcaggcccggucuggcaucagcagguaguccagggaacagacucaggucagucccacacaggcuguaaauggcccaaggggaugucagccuaggcagcucaacugggcuucaggucuaccaggaccccugucaccugccugggacuuggugcuggcugccacugggcaccucaguucccuccacgugccucccucucccugcacccgcaucauucaggaagcuagccuggaugucccacagcuggucuccaagagggugagaggcuagcuacaggguucugaaguccugggccgggaagucacucacacagcaucucuucaccauauucaguuggucagcuugcaucggaggacagcccagacucacaggcugaggcaagagacaccacuucuggaugggagaaaugugcacaugggaaggggaaggacuguugguggccagcuuugaacacgauaugggucaaagcaagaaaccagcucacacauuccaauaggcuaggguggccuggggagguauugcaggggugggcguggagguccucaccaggacaguccugagcacugucugggugugcagaccugggcuccagcugccuacuggcacaguagccaugacccauuaggugauaccccgggccuugguucugucuccugugaaauaugggauugagcccagugggguggucagacuugcuuccauuaaugaugcguuuuugucuaauuaaaucugggcuuguagaacccagauaugugcaaaacugaucaauguggggcugguccucaaagagcaggguuggggucuccuaccccacagucagaaguaacuuuuccuccccucccucccaucucagcaccacuguuuaccacuuggccucgggucauggucaugaugcaugcaccauugaggcuccuuuguucauaagugacacgccagcagccuccuaugggggcacaccuggagccuucucuuuucucacuaacaagcuuucccaauccccgccugccuuggagccccgccaaaugcaagcgaugcugcuaucgcccuugcuguagcaaguccuaaguaaacagccucugcuuguucucacuuggguggucuuugcugauuuccucaaguccugagaugcguaagucucagguucugugcucacuaagugcugguggcgaauggcauuuccugcaauguacauuggguuuggaagcuagcaggagaugagguucaggccccacagcuguccugcaugucugagcccgagagaaccuggugcuggugacuucuuugagcuagagucaagcuauaccugaagcaguuagacuccuggacuuugcaggguggagccaguaagacucucaucugcuuaagcuacucugaacugggcucucugucacuuucucugguugguucugaguuggccaaaaaauagggacucucucaaucauugaccaaguccuaagcaaucugggccagugcugcagagggugugguuuaagugccugagcugauugugcacaggccgugggucggaguuccaucaucagggcuggccuggcugugguccauuugcuauucagucucugggacccaccacagaguucaguaguccucaaggaacacccguagaauugcaacgagaguagagcccccuccuccaaccccuuccugccucacccgugcccccugacaaacucuccaacucccagucugccuucaggggcuccagccaccugcccuucggggaccagcacccuucucuuccaagagucuccgcucagggccaccucccucaccccugccacagccuuuguccucagccuucaccucccuggauaacacuugcuuuggucccacaggauccccugccguggucugucugcccacugaaugguaaccacacgggcuacgaugaggagugugagaaggcguccuccacacaguacuucugguacaggaaaacccucaauaucucgccgucccuccaggagaacgggggugugcagugggagccggcgcugugccuccuccuggccuggcuggugguguaccugugcauccugcguggcaccgaguccacuggcaaggugggacagugaggcacagaagcccggugcuccuggugggugggagggugcaccaaggggcagcugccucugucuccaacccuaggcaaugccaagggagugcccucugcaguggaaaggcagcagcuauguuagggcagagggcacagaugguguugcugggacaagucaccuacuagaugacuauagagagggccagagaugguuaaaguugcaacccuaaaucucaaaacaaggacuuucuuagaaaaaaaaaguuuuucuguagcagucagccccaaauccauaccacccagacaaccagacagugaguuugcuuuucuuuaagauuguauguauccucgagacacccuagccacuggcucuccaacucagcugcacauugguauuuucuggagaguuuucaaaaaucucaugccuuagccccgccccccaaaauucugcaguaaccagucugggguguguccugagcacuggguggggaggcaggggagguuuaaaagcucgccaggugauucuaauuugcagcugaguuugagacccuuuguucuaagcugcuuccaaucacccuccagagcugucgggcuugaucuccauaauccuuucuuggugcaucccaaggcucacacuuucacuggggcugacauguuccuucaucucuagucugcuccacguagaagguuugcuuucaguguucccaucacccgccaccugccugaagcuucagcagaugucucggagccuagcacacccugucucauucacugucacuucucacaguagacccaccacggcuugagcacccacauugugucauucuggcaacagccuuucaugguagauuucaugaucccaguuaccugaagcuuagagagguaaauugaccugcccaagggcacagcuagugagggcaaagcccagccucaccccaagacuucccauugucuugguuugguagccacauagcucucucuaugccuuaaugaugucaucaauuccaacugucaccugcugagaguccuaggagcccaccuguccucacccucugacuaccugaguugucuccuccagccacaccccaccccccauguauuucuugaggcauuagaccagagcuacccaugguauuccagggcccaugggacaacuccaguaucaugccugguagggcauuuuauuuugguuucuaagagccccugaugaccagccucuuagcccccaaaguccccugugccauggcugaggaaagggacgagugagcacaggugcucuuuccccgagagagcuuagaaccugcagcagcccacucagucccaucguagagccuggccauacugucaugcucauaaaaaauguuuuuguaauuuauguuugccagauuauuaugaucaugauccaagagaucagagggcaacaucugcagagguagagauuagagaccauuccuuuucccaaucacuuugaaauguguugcauaagaccaugucaugccauaaaaacuuauuuauucuuaucaucuauuuccucugcuucagcuacacccuucucccugggaaaaguaccccaacagcucuauguaaauagagcuaaucuugucacagaccaugugccauuuccuggcauccucuguuggaaucgacuuuguuuccugccagaaucucugcagaguggucagaauugguuucuuccaauagauuaggcuggaucacguguccagcaauucugcccacuuagggacuccaugagccuccaggaaacuugcucaccuugggggaaggagggaaauucucggggcuggcccuaagggccugcuuagugcccauugugauggauguuggucacgagugagugcucugucuuuucaucucucuuaccugguuucuuauaaucuuggguggauuuauuacucuucucaaguuacaacaaccucagcuaagaagcagugauaaaagacacaccccacauuccaccugccguccccugggugacagcguacagagugccauucugguggccuuggaaauggaugagaagaugaugccacaccucaauaggaagggagggccaaguguaauucaagcccaccugaacauaggccaccagccauauuucucacagagagacucaaacuuuaagggaacucuuacacaaaagacaaucuugcaaaauauuuauuuccuuuacaaaugaggcucugguacacauaugaguugauuuacagaaaaaaauccauuccuggauaggcacacgugcacuugaaggucuguauucuauggcuuuguaacaguuagaaucacccagagcaugacaggugacuacuaaagcuaccaugaacaccaaagauauuaacaaaacaucauugaacuuacgaugcaugucgguggagaaagaagaucugguugacaaaaauguccauucagguguaauguuaaagccuaaggaaguaaacccuuucuggaggguugccauaaaaaucagaucugaauuuccuauuguguuuauuauggggacauuguccucuacgcuacaccucgcugcuuuccuguaugagcacucgugaccaaucugcucucaggccccaguccuggggaaaucuguccuccuccaagcugcagauuuuuuuuuccuuuuaauuguguuccugcuuuguguguaggccaccaggaagcucagagcugaaucuggcucagaaacuggguagagacuuaugcacagauucuaugggcugcuuuuuccugugggcucauuacuggauugcccauauauuuuuuucaugcugauuucuuuagcaauuuugaaauguuaacgugacugauguguuuuuguggguaaccucaaauccuuuccagaauaaggucagguugaagggaggguggaaggcagaggcucgguaccuguuugccucuucucuacugaauaagaaaugucgugcuggucacagcugugagcaaccacaucccaccagcccacuuccccagcccuaacccagagccugugugugaccaagaaucuccaugccuuuuccagcugucagcagcugggcggugcagccugaauaccccagaugugguguuccauggggcaugggucuguccuguggaccccacugcuccgggaggccaacucugcccucugaugcccgcaggugguguauuucacggcgucacugcccuauugcgugcucaucaucuaccucaucaggggccucacgcuccacggagccaccaauggccucauguacauguucacucccaagguacgggcugaagcggaagggcccuacgggcaccccucacuuauccugccaccuuccaggaugggugggaagagggaaagguggagagugggccaacgcuguaccuacggaagcugaugugagcccaccaggguguggcaggaguguggaguaccugcagucacuggaucaccuccucagccaggucauccccacucccuguuaauucuggagcauuaagucuuucuuucagcuucuccucuucauccucacugucccccaacugcugcaccccugccacugccucaccucaagccccuuucagacuguggaccaagcuuuuugccaugagcaccacucuggucaucuugcuugccugcuuacaugguuccacgcacccguuucccuacagaguuucccaacccacccauucuccaugcaccccacacccaggguucauccauggagggugcacucuugccuuugggauggggcaaguucuucauuuggcaaaugcagucccuagaaauaaaaugacugugucauccuuccccuuccccauuccagacgccaccgaugucagugccgagagucaacccacaccuagaccuccccugccaggccacacccccuccaucucugaaugcccagaccugugcaguaacugccuaugaaucagggccccauuuguguuuuaauuauuuuacccugcaguauuccauugcacaccuccgcacuggcguauaguggugagcauagcugcuucugguuacacaccuccuauggcugaggugcuauggaggauacguagcaccuuauguccuccacauagcaccuguauucuccacagcaccuuagcccugggaggugugcagcuugagguguguguuucaucugccagggaguggauggggccaggagagcuggucuccagcccuaggggugccccugauggcugcgugcuguaggugagcuccuuccccucucugggcuacucuccuguugcgggucugagcauuugggauuccacccagggaucaucagcccugucccugcuggccuuccagauagagcagcuggccaaccccaaggccuggaucaaugcagccacccagaucuucuucucacuuggccugggcuucggcagccugaucgccuucgccagcuacaaugagccauccaacaacugccagaagcacgccaucaucgugucccucaucaacagcuucaccuccauauuugccagcauugucaccuucuccaucuauggcuucaaggccaccuucaauuaugaaaacugcuugaagaaguaagccugggcugucccaccgagucccaggccucccugagcucugagcugaagggucgccugggcaagggcuggggcaaagugcaccaguuuuggaguccucaauccagggcucacauuuggacucccuacaccaccaccaguugcuggagggccuggggcaugucaacaucugccuggcagggaugagggcacguuagcguguugugagcacuuagcauaauaggacauacaaugaucaaauuuuguuucuucuaccccaucucccccaccucagaaguaaccaagaagccucuagcugagccacagagauugcaggauucacuuucuguggccccuugcccaaaauacaaagacaucauccaggagguaugcuguccaguuggguagucacuagccacaaguggcuauuuacaaauuuacauuuaaaucaaugcaacuuaauucacauuuaaauaacuuaauucauauuucaguacauucccuuguuacuuucaaucaguugcucaguguccaccauuaagugcucaguugccauauguggccagugaguaccaaauuggacagcccagauagagagcauuuucaucagcacagaaacuucugcuggacuauguugguccagagguuaaaauagccuagcugugugaguuuggugccuguugucaucacuguucauaucugaggcuucuucagugccauucaaaauuacccugcccuuuaaaagaucaccaagcaacagacucccuuuccucaccuaaucagaaaagaagaggcugacgggaggcuuuggugacagcugccuuucugaucagugaaggucgauccgauggucugcucugcagggugagucugcugcugaccaacacuuuugaccuugaagauggcuuuuugacagccagcaaccuggagcaggugaagggcuaccucgcaucugccuacccaagcaaauacagcgagauguucccgcaaaucaaaaacugcagcuuggaaucggagcuagacacgguaagaugcccaggcaaggucaaggacuggcuucucuccacacacucaugggaaccuuggugagcugcugacuugggagauaggcgaggucuguaaaaauaaagaaggauccugaauuacuuuuccugcaacuccaaggggaagagaggcuuuaacaccacucucuugagggcuguucgagaaugcuaguuauaauaaacuuccuggcggaccucucuguccuuucucucuuuuucuuuugucuuucuaagcuuuuaaaauacagaaaaguagagagaauaacaaacacccauauauaccacucagaaagaucaauuguaaacauuuugucauuuugggcucagauuuuuuuauauaaaagaacauuucagagaugaaguuaaaaagucccccuuuuuuucccuacucaccaaaggcaagaaccuucauuuuuauauuucuauuacccaucuauguauucuuaaauaauaucauuguuuuguuggcaguuuuuguuuuauuuuuucuuuuuucaacaagccuuuugcacuccuaugucagcaguuuuuaaaugggcauaaauggucuggaaagauacuucucucauucagcauuuuaauuuugagaucuguccauaauaauacauguggaaccucauuuguucauuuaaaugcugcauuuuauuccaucacacaacaauacugcaauuuauuuauccauucccuuacuaauagacauuuggaggguuuuuuuuuuaauuuuugcuacugaaagucaccuuuauuuauauuuuacagaauuaucucugcugugcugggaccuuuauuuuuucacauuguuuugaggaucaguuugauaaguuucauuggaaaaaaaaaaucuagggaauuuuuacuagacuugcauugauuuuauaguguaauuuggggagaauuaauaucuuuugaauugugauauuugacucaggaacauacuuucucuuguucagucaagucuuuuaaaacauucuucagcuaacuuucucuaugaaugucuuggcacaucuuucauuagauuucuauuaccuuacuguuuuauuguauugugaaugguguuuuuuccccucauuucuaucauuuguuuuuguugcaaaagaaagcuaaauauuuuauauguugaccuuguaucuagcaaucuugaugaauucucuuauuaauucucauauuuauguauagauuugcuucaguuuucuauguaaacuaucauaucuccugcagaucaaauuuugcauuuuucuuuucaaugcuuauaucucauucccuuuuucuuauuguauucacuaggacuucuagcacaugggaguagaagugauagugggcauauuugccuaauucuuauauuuaaugcaaauacuucuagagauuauuccuagagaguguuccuagguaauguuuuucaaggauagggaguagggagggccuguggcucugguugcuaguaagcuacuuuggagguugauauuuuuggggugguugguugguuggguuugguuuguuuggcacuuuguuucauggguacaaccacuguaggucauuucaugggugggacaaugcuuuuuucuccugguuguucagcccuagcuccaugccuguuauuggccuguggcaugagccugcuuccccaggcaggcaucagaccccagcccacaaaccccagcccucaaggccuagguccuguucaggugacccaugagguccuuuggcuucagcacuuguucagugcucucacuucaacuuuccuuuauggauggcaccugggaguuuuccucacuuacuuuugagcuuggcucuacagccaagaauuacaugguugguuauugauuuaucuagacuucauuuuuccuguugcuuuguucuuuuuuuuuucuuucuuuucuuuccccauuccacuuuauucccugcuguuuggaauuugguugcuugauuucucuucuugaaauuuuccuuucauauuuaacuuaauaaagucuaaaguuaaacaguaucuugaccuccuucccaaaauucaaaaggacuuuagaguacuuucauuuuaucucccauuuuaaaugauuguuuucuaguucugucuccuuaaccccauacauuggacaugacauuaugguuauuuuauacagcucuuguauuuaccuacauguuugccauuuuauuuguucaccauucuuucuugcaucccagcaucuccaaagguuuuuccuuaaaauacuuucauuuagaacaguuuucuuaaauuuuguucuauaauuggcaucuaucuuuuaaagacauuguuccucggaguagaaaauuccagguuaacaauuauuuucucucaacacuuugaagauguuugccaugugauucaggcuuccauuguugcucuugauauuuucuuuuauucuuuguaagcaagcagcuuuuucucuuucucaugaucuucucuucgucuuuggccucugcaaucuagacauggcaugaauauauuuuuauuuauccacucuaggccugggugagguugggcuuccuggaucuaaggguccaauguuucuuaucaguuuuggaaaauucauaccuauuaucucauaaucguugucucugauucucucauuuuucuccuuuuggaacuucauuagaugugacuuuuucauccuguccuacaggucucuuaaccucucuuuuauuuuucccaucuuuuuauccuuuuuuauuuuauugauucauuucuggauauaucuuucaguucacuaacucucuuuucagcugcaucuaaucugguauuuaacugucaauugagccuuuuaauucaauaacuauauuuuuuauauagaugcuauuuuuuucagauuuacuuguccaucccaauaguuuauugauacauguuuauuuuuguaauguuauccuuuguuucuuuaaacauuucauacguaacuguuucagugguggccauaggcaagagaaggagagcaguauuuuaacacuauuuagaauugcuggcucaugauaaucauaaaaaguauaucaacuuuuuguagauuuuuacuauuguuuuuaaguucucuacaagugaucacucccuuguugucagcacauaaagccaacuauuuucaguaugccccugagcaacugguauacuauagaauugaccuguguucuuauauuagucagugcagccugccauaacaaaauauaggcuggguggcuuaaacaacguaaauuuauuuucuuuuauuuacuuuuaguagagacaaggucuugcuauguugcgcaggcugaucucaaacuccugagcucaagugauccucccaccuaagccucccaaagugcugggauuacaggcaugagccgcugugcccagcaaaaaacaggaauuugucucucaauccuagaggcugagaaguccaagaucaagggccagcaggguuugguuucugaugaagaccuauuuccugguucgugaacaccuaucuucucacuguguccucacauaauagagaguucucucucucucucuuccucuuguuauaaggcuacagucuggucagauuagggcuccaauauuauaacucaauuuaaccuuaauuacccccuaaagacccuaucuccagauacagucacauugggagcuaggguuucaacauacaaauuucagguggacaugguucaguccauagcaauucugaaucugacaguccaacaucugccaccucggggagggauguucuaaaucugauuucuuaucuugcuaguucuucacucauagugacuucucuccuuguggguuuguaaaucccuguuuaugagcacuuugcucaaucucugggaauccugugcaucuaaaccgggugggggggcuucuacccagggagggcuuguuuuugcuucuucuguggguagccagagaguacgcacaaccuauuaucccuuuugagccccuuaggggauuugucuuuaagcaggaguuccagccucaauuuccauaguuuaacauuuccgcaacagaguuaccagcacagggacgugaccgcugagcaccugccccuccugguugccugcugaccaagcugucucccuacaauucugcuuccugcugcccuggccccgcccucccuccucaggucccagccacggagguuucaggacaccuagucggucaucacauuagaagcagaaauuauccauuguuuuauuaucuuucauccagaauguacguaaguuggggcaggagaggggaacucaguguugcaggcuggcuacaaguucucacgugcuuugcauauaugagcuccuggcagcucccauuucguuucagcccagcugaguguaagggguugaucugcagauggaagcuccaaccucacaauguggcuucucauggccacuuccaaggucccccauguugcuuaguacugagugcgugaauaagacuauaagucccucuugcauguaacuggugucuucucacccugggcaggccguccagggcacuggccuggcauucaucgucuacacagaggccauuaaaaacauggaggugucccagcuguggucggugcucuacuucuucaugcugcugaugcugggcauugggagcaugcuggggaacacagcggccauccucaccccucugacagacagcaagaucaucuccagccaccugcccaaggaggccaucucaggucagcggggccagccaguggaggaggcaggggucaggagggccaaggcgugggggugaacaggggagagcucccucaggggucaugggcugguucagguggcuacaggggguugcagccaccucaccacgguccugccaugucuucucacaaccugggaccugggccaugugauucacccugugcguuccauucuccacaucacagggaagugaaguggccaccccaacccaacuccccaaccugacauucaaaguucuccaggcuaggagagaacucgauuuuguuucuguucauuuucauugaaguauauuauauauauuucagacggagucucgcucuguugcccaggcuggaguucaguggcgugaucuuggcucacugcaaccuccaucucccagguucaagugauucuccugccucacccucccgaguagcugggauuacaggugcacgccaugacaccuggcuaauuuuuguauuuuuaguagagaagggguuucaccauguuggccaggcuggucucgaacuccugaccccaggugauucgcccaucucagccuccgaaagugcugggauuacaggugugagccaccacaccuggccugaaguaugaccauuauaaaguguacauuucuuaaguacaaacucaguggauuuuacauauguauccacccaaggaaccaccaccuaggucaagauacagaacauuuuccacacccuagacaguuccuucacaccccuucccaggcaguaugcaccccuggaguucaccucuauuucugacuucuacauuuuagggguuuuuuuccuuuuuuuuuuuuuuuuguuuuuaaagaaacagucucacucugucacccaggcuggagugcaauggugcgaucuuggcucacugcaaccuccaccucccaggcucaagcuauucucgugccucauccuccugaguagcugggauuauaggugcacaccaugaugccuggcuaauuuuuguauuuuaguaaagaugggguuuccccguguuggccaggcuggucucaaacuccugaccucaagugaucugccugccuuggccucccaaaauacugggauuacaggcaugagucauugcgccuggccuuccuguuccugaauuucauaugaacgaaguccuauuguacacacucuacgucuauugucuucacucagaaucuaccugugagauccacucauguuguuucgagcagcgaucgucugccccuuuuugugccuauacaauaauccauuguaaggugacauaccacaguuucuuuauccauucugcuguugauggacauuucagaucuuaggaaaugagcuggcuuuuccaauuacaucucucaugguuucacucccuggcccaucugcuccacuccaaucaggcagugccucaaggacccuguggccuacacuacuccgucucugaaaacaccauuccuugacaugcaggaugaaucaaacccagcucccaggccaucuccuucaagccccgaccacuccaguuggaguugcccccaccucuucagagugcugcagcacuuagacccccuccucaggccuggucuuuguagccaacacuaggugugcccauagccuucagccagcgcauggccccuuucuccuuguguguccccgucgggauagcaggagggcucgguagcuggcaguguacggugugcuaguggaaagggcaggugugggcucuagacucagacaugcaugggguccccagggaaggcagcuggaggggccugggaugaaggcccagguucuggaggcuaaagggccugggucugaauccucacucugccauggaugugcuaugggaugucgggggagccuuagacaucucugagccuugccuucccaucugugaaagggggcuccggacaccugccucagaggccuaaggguccaacgcauugcaagugccuggcacaagggaggaucuggguggacauuugucucuucccugccccacccucuucuggguggaggcaaguccucucuaggaaguccugauggggccacuccauauucaagccuccuccccugauucauuucucaugagcuccagggcugaguuguugggauaaacagcggggguuauaauuguagacccacagccugggcgggauccuggaaugacagugcccacuacgucugcuuguucauugagcuuuaagcucugccaccccugcagggcagcucagugagucaacaucagugaccccugccaacacgcuucgggacaccauugugcccccugccccacacacguggcacacaccuucagagaguccaaaccaugacagcucuuucaacccauguggaugaagcaaucagccaaaauucccugagggccgacgaccccacuguccuguagagaacugguaagcaguagugggggggucucgggcaggugagcagcuggucuuguggcccccaggucuggugugccuugucaacugugccauuggcaugguguucacgauggaggcugggaacuacugguuugacauauucaacgacuacgcggccacacugucccugcugcucaucgugcugguggagacgauugccgugugcuacguguacgggcugaggaggugaggaggcccaggacccucauuugcauagggaaaacacagccacagaggccacgccccucaaggaaaacagcuguuucuugaugcacaucuucaccucuucuuuaagcuucgcaucaugacucaacguuuguucuuugcccgcagaucucagcuuaugcucugccucuauuccaugcucaguuugcuucagugaauaucuuuuucucuauucccuguacuuuugcuuuguaucauaggcuguuuuaggguugacccugcuggacccccacagcuuacuggggcagggaauugugccuccaggcacuggaugcucugaucaucggccaacaucaguauuuuccaagaacccugaccaaaguccaguugauaacuuagaccuuagaaaauuuggcagauucaaaauuuagucagugagguucucaaucccagugcacagcacgggacuggaauguuuuaguucuccccaggugauggaaugugcagcuggggcaagagccacuggucuagagcaaccuucaaacucgagugugccucagagucccuugggcuggucaaacacagcugugagacucacccccaggguucugaucaggcaggccaggggagggccaagaauucacauuucuagcagguucccagaugagucuggcacccacacuuugagaaccacuggccuagagagcuuugcuaccucaaguguggucccuagagcgggagcagcagcaacaaggcgcucguugggacugcagaagcucgggcccaccccauccugcugaaucagauccuguaucuucacacuauguccagggggccugaggcacaucacaguuugggcagcgcugcucuagugggugcgguuugggcgaggaggcugugccacguuguuuucugcccucuuccccagucuuuuugauccucugugcugguucaggguggggagggagacauugacaacacucugggaggcaggcaucccugaagcagcaaucccugcuguguccccggaaaggccagggucccgugccaugcugagggaucucccaugauccaucaggacauaaguuaaacaaagccaaauugaugucuuucccguaggacuucucagaaucuuaaagacaguuguggaucccaaagagaggguuagaauugcagcauuuccagacuuacuuggucaaggaaugccuuuucacccuccucucacccgacucccacccuuagcuacuaacauuuugaggacacuaguguuaaggggaccaacucucccuguuuccccaggauugagggguuuucugggacguggaacuuucaguacuaaaauugggaaaaucccuggucaccuaggaaaugccagucuagagggagaaagagauuggucacugagagggugaguguuucaggauaaaaagagaagguugggagagaggaacagaaccuagggcccgcuggaggucacuagaugggugaggggcacaaguccaucaaaaaggggcuggugaagggagacagaggcagaaacaaacgugccuuggagaugucguagguggacugaccauguaaguggcaggaggggagugcuucggcuugcucaggugacaccgccaucuagugaccacccagcaacaguguccuggggcuuuucugcagccagcucuucccaacuuucuccauccaggaaagggggggggguuaugggggugugaagggacaagaggacccccaacacuuuuucaccugucugauuuugaaagccccagguuuucgugucacauacaugagccuucauggccugcagccuagaguccaacuacgucagcagcagcaaagggcaggugguggucgccacacagccucgcauggacacccaggacaugcagcaggucccagggagggaggggcuguggcugcagcuggugacgucacacccacaccaccccagccccucccgccaaggcugccucuuccgcuguagggagcagguuuaaaggcucugggcuggaggcaggaggccaacccagguucugggccuggucuuuaccaagcccuaaggaagaaggcaucgcagcccugggccuugguuccuccugugugaaauggggaguuucguugggccaacaucucccaaaaugccaaagauacuuuuuauacuguguacguguauucaaaaacacacguacuuaguuugucaagucgaugagaaacuggcugcuguugugcugcugcuaaccguagguuuaaaaguaaagaagagggaaaagagagcuacaggcaugauggagguggugaugguggcugugggcaacgccuuugggacucacugcccuggccacucuagaccagcuccagcaggccagggcuacgguccuucaguccgagguuggcucuuccucugucccagaaaaccugcucugguuucaauggaccaagugauucugcuccgugguguuucuacugggaaagggagucacugauugacaggggcgggcuggguaggggggugggcaaagccgcccaagaagucccugucauugaugaccagccugacaaauguccauccccugcugccugugcccaccauuccuggaggcugcccucugggcuaugccagcagccuucaucugaaggcuggcauuaggaaggcgucuucugauguccacucucugcggguugcuugcuccgucaucccuucugggcagccucagcccuucuccccuccccaccgcagcacucgucucucaagaaggugucacagaggagcccaguggccaagcucagacauccuuuaccaccuagaacagaauguuccuuugugaauagggacaggcaagcuggacgcccugaccuccgcagccugguuaauccagacuuucucucccuguuuuccaaauagauuugaaagugaccuuaaggccaugaccggccgagcugugagcugguacuggaaggugaugugggcuggcguaagcccacugcugauugucagccucuuugucuucuaccugagcgacuacauccucacggggacccugaaguaucaagccugggacgccucccagguaucuacugucuccguagggcuggcgcugggcccccauggccacugaaaagcaugggccauucauuuuccgaaaccaggggacuauuuccaugguguggguagguuauuugucacgacauggaaauaucacugagguauuuuagaaauaguccagcacggaggagcugggcuuugagcuuuuagguaugugcuucaguggggcgagaggaaggcacuccuccagagcuuccccauccaccugucccccggaagcugagaaaaacucccgcugcaaaggcgccagcuccugccuccugagcagcgcucuccuccgcgccuaccgcagcagacagcacugacagagaacguugcuaccuucacgggaaagucccauuccaggcuaagaguagucgccuacaguuuagguucccugaaaguugccuuagacauaaggugcuugauuauuaccaugguuauucauuauggguagcuccaaacaauagcucuacacccacugguucaaguaguuacuauuauuccuaguuuauggaagaaaaagaaggugagggcaguuaggcuccuggcacauuugcuagugaauugcagagcccguggccccaggagugaggacaccggccccacaugcucucugcccacgucacaucaccuccccaucacggaugggcccugaggcccaggggcagugcucagcaggugcucucugcugacacucagucucuccuuucagggccagcucgugaccaaagauuacccggccuaugcacuggcugucaucgggcugcuuguggccuccuccaccaugugcaucccccuggcggcccuggggacuuuuguucagcgucgccucaagaggggagacgcagaccccguggccugagaugugggcuucccagccgcucacgguuuuacagauacuauuuacaggcggaaacuccucggcugcuuuuucaaaugcuuaagccaggagugcucagcccaucaacuuccugagugucuaaagaagaugaggaaggugugcaggaagaaaacucccuugggagaacgcacacccucccgugguggcuguuccucccugucaccugccuccucaucauggaagggggugggcuaugaaagccggucucaaagauaacugcauccuucauuccaggaaagcccuagaauuagggcacauugcaaacugaaauaugacuauaauucuuaugggaccaaauuuaagcaauuuuuguuuuuggcugaagagacaccaaaauauuagaggacaaauauuuuuagauccauuuaaggaguuuugaagugccuaagaugaccuauuugucaguggugcaaaauuaauucucuucuuuuuugaguuguagugaauaugcaauuucuguguuccccuuccacccuuuaaaucuuaggaugacaaguuauaaagaaagaagaucuuugucugggacccccaaagggauccuuucucuaaggucucugacgguggguccaggaccagaccucucuacaaaaaauugccccaacuacaguuugcaaccccaaaccacauuagaagucugugcagacaucccuccguggugugugucuuggugcauuggaaaaggagucaggagccacugugaggugagaaugaaaguggaucucagcugggcacgguggcucacgccuguaauccuagcaccuugggggucaagguggguggaucacuugaggucaggaguuugaggccagccuggccaacauggcgaaaccccauuucuacuaaaaauacaaaaaaauuagcugggagugguggcauaggccuguaauuccagcuacucuggcugcugaggcacaagaaucauuugaaccuaggagguggcgguugcugugagccaagaucaugccacuccacuccagucugggcgacagagcaagacucugacucaaaaaaaaaaaaaaaaaaaaguggcucugacuuucccauaggcuuaauauuacauuuggacaucguggccaacucuaucaagaccacaaauaccacuuacaauuaauuuuaaauuauucaucuguacauaguuuucuaaaauguauauaauucaaacagagcaucuuguaacugaagacacaccauaucuaugauaucgcauuaguccauguggggaaaagaaagaucagauuguuacugugucuguguagaaaaggaagacauaagaaacuccauuuugaucuguacuaagaaaaauuguuucugcuuugagauguuguuagccuauaacuuuagccccaacucugugcucacagaaacaugcgcuguaaugaaucaaaguuuaauggauuuagggcugugcaggaugugccuuguuaacaauauguuugcaggcuguaugcuugguagaagucaucgccauucuccauucucgauuaaccagggacacaaugcacagcagaaagcugcagggaccucugcccaagaaagccuggguauuguccaagguuucccccccacugagacagccugagauauggccucaugggaagggaaagaccugacugucccccagcccgacaccuguaaagggucggugcugaggaggaauagugaaggagggaggccucuuugcaguugagauaagaggaaggcuucugucuccugcuugucccugguaauggaaugucucgguguaaaaagcugaccauucccauucguucuauucugagauaggagaaaaccgcccuguggcuggaggugagauaugcuggcagcaauacugcucuguuacuccuugcuacacugagauguuuggguaaagagaaacauaaaucuagccuacgugcacaucugggcacaguaccuuuccuugaacuuauucgugauacagauuccuuugcucacauguuucccugcugaccuucuucccaccuguugcccugcuacacuccccucgcuaagacaguaaaaauaaugaucaauaaauacugagggaacucagaggccagcgccggugcggguccuccacaugcugagcgccgguccugggcccacuguucuuucucuauacuuugucucugugucuuauuucuuuucucaaaaaaauuuuucuuuuuuuaacugcaauaaaguaggucguuaccccuaaagugagcgagucccuuccugcucuaacguccagugcuuccuugagaucauggaauucuggagaguuucuguggauauauuugcacagauaucuuugaagacacaaacacucaccugggacguuggccggagaugucuuuuuauuuuugugcuguaaaauucucuuacagcaaaaauaggcuuuagaaaggucuucuacugucuucagcaaccaucucaucuuccagcuucaccugauuguccaguuaucauacauuugacuuucaaauguaugaaccagcauguaccccauggauuuaaucuuaucuaccccguggauucaaucuucuuaucagaagguucuuuuaugucaaaaaaccugcugucaaggcuugaagagccggcacacucaauggcaaacacagcaccgagucugcucugaauccuggaggaucuggcccuccucucaauccccacucacagucaccgucuuacaacucagggccaccugggaucagucaucagucagggugcguaagccuugaauaccagguagccucaggagugaaaagauaaauguccuagaucauuaccuuauucaguguccccaccuugcagcgcauuccaaccaccugggagcauuuaaaacuccagaugcccacaccacacccuggggccacccaucagaccuucuggaagcaagaccugggccuccauggccccaaaaacucccuaggugauccgaugugcagccaaaucugagaggccccauuuaaaaaagaaagaacaugggugguacauugaggaguauuuacauuuuauaaaaugacuuaaaaauuugaaggcauuuuugagcauuuccaauuauauggaagaguuacuucuacggaauaguuuuugcucauggaacucaaacagaugaagcaccacuguuacagaauaaugugcuccagaugaaaaugucucguuucugugaauuucaugaagagcagaacauuucucaagaauccucuugagccaguaaucaauccugucucaaaaaauguucuuugccauuuccuagauacugcacaaaaguggccaugucgacauuuguccacccacccuccaauaagcuggagcgacaaagggacauuccaucccuguacccuuagugguagccaugacacgauggccagaucauggacuccggaaagcuuucuguuuuuacuggaaacauagcaaaccuugauuuagcuccaagaaauugaguagggaaauauuuguuuuuuagcaauugucauaguaaauaaaacucuaagcaaguguaucuaca

SEQ ID NO: 192113 - RNA, 47328 nt, Homo sapiens
ugaacauuuauuuauuuauuuuauuguuuauuuuugagacugagucucacuguugcccuggcuggagugcaguggugugaucuuagcucacugcaaccuccgccucccaaguucaagagauucuccugccucagccuccugaguagcugagaugacgggcgugugccaacacaccuggcuaauuuugguauuuuuaguagagaugggguuucaccauguuggccaggcuugucuugagcuccugaucucaucucaagccacccuucuuggccuccgaaagugcugggauuacaggcaugaggcaccgcgccgggccgaacauuuaauuuuugauuguagaacuugaauaucucuugcagugacacuuugguuaucacuugaucagaaaaauacucgucccagcucaaacauuaccuuagaauagaaagugagaauuauuucaugacgggcaaauuauggguacaaacuaaaaugacuuccaagauugugauuaaugagaaaugcuccugaaguaagguaaauguuugcccuuucucacguggcaaccuaugaauuggagguacgggugcuugauuugauguugagcuguacauuauaaauuuacagcuagaacuuuuuccaaaugcugucuuuaaaagcagaaccuugaggucuacucucaaauuuuaaaaaguggaaccuuuucaagaauuacuuuuaaugcauuugcaaauaguaauuugaaacuuccaaauagaguuaguaaugauaacaaagucagccucuuuucugcuaauaauuuucuaucucaaacuaucuuauuagcauagccccuguauuugugaaaagaugguaacugaucauaguacagagcauuuccaucuuaccucuaugguaaugaggaugacaaucauccacuccaagcggagugcccucuucucauucaggugauuccgcauuagaucuguuaguuccaugcagugcugaaguuuuucauucaugaccuauguaagaaaaauuucaguaacauguauuuaaacaauuuaauacggucauacacauaaaaauucuauagcuauacagugaaaaauccugcuccucaguccucuccccaaaggcagccaccaacauuaucaguuucuugugaauccguccagagacauuuuguaauguacaaauuuaacugcaagaaauacuuugcauacugaagcucuucuauuuguaagauuuugauggaagaacuaaaaauagguuuuugaguccuaguuuuuaguagcugcccuuuuuagcaguuaaaagaggcaaacuugaaacauaauguuuuuuagcaagaccuaaagauaauuuacuuucuacuagaaaaucuacgcuuaacauuugaccugcuguacacacaccacuagauggcauugcuuucaacugaacugcaacaguucugcauuccgaugccuccaaacaagcuggcuguggggguucaaagaaaauaaagucccugaauucaaaauuuggaugugacaacuuuuuuuuuuguuguuguuguuguuuuuugggauggagucucccucugucgcccaggccggaguguaauggcggaucucggcucacugcaagcucugccuccugggaucacgccauucuccugccucagccucccaaauagcugggacuacaggugcccgccaccacgcccggcuaauuuuuguauuuuuaguagagaugauguuagccaggauggucucgaucuccugaccuugugauccgcccgccucggccucccaaagugcugggauuacaggcgugagccaccgugccaggccuggaugugauaacuguuaaauaccuaccuaauaucuuuauauaucacuugcuacuggaaauccugaaagcaaaauuuuaaaacaguuugucucauggguaugcugaaguuacagguuuggucagugaacauuaagagaugaaucacagguacguguucagggguugauuggaaugcguuaacugcaccauguuacgauuuuugcacauagcauuaaacugccuuacuaggcugggcucgguggcuuaugccuguaauccuagcauuuugggaggcugaggcaggaggcgcacuugagcucaggaguuggagaccagccugggcaacacagugaaacccugucucuacaaaaaaauuagccaggcaugguggugugugccuguaguucuagcuacuuggcagggaugaggugggaggauugcuugagcucagguggucaaggcugcaaugagccaagaucaugccacugcacuccagccugggugccaaagugagauccugucuccaaaaaaaaacugucuuacucacagaaccacaggacuaacugacugaaccacacuccaccauuugccccuauuuccaggcguuauggucacccuguaguuucuaaucuguauagauguguagagcaugccucuucccucuuccuuuccccucccuguuuuccuuuccucuugcccuuucuuaaugucuguuucuauuggcugcuugaucuuggucuuuaauguucauccuuaagcuugcuucucucuucagacuacugauucagccucuugcauuuucuuucaacuugggccaaaaaacaggcaacauuuucuuccuccacuaccucaucaucauccaauuuauuccuuuaguuuauauuaccacaacucuccuaaacgucccaaagucuauuauuaagucuaacaacuuagcuucgaaccucaauccaagcaucugacaacacacugaaaugugcaagcaagagucccuauggccgggugcaguggcucuugccuauaaucacaacacuucgggaggcuggggcaggaggaucacgaggucaggagaucaagaccauccuggcuaacaggguaaaaccccaucucuacuaaaaauacaaaaaaauuauccggguguuguggcggccccuguugucccagccagucaggaggcugaggcaggagaauagugugaacccagccgggagguggagcuugcagugagccaagaucgcgccacugcacuccagccugggcgacagagcgagacuccgucacacacacaaaaaaaagucacuauuaccacagcaugcuuucuauuuauuuagguauagaggcauguacgcgucgagcaugcagauuaagggagcaaagaaaaaaccaggagaggcuucacagagguaggaaaugugaauuaggcuuuaaaaggcaguggacaugaagaaaaggugggaugcuggugggguuauugggggaugaagggagcaugucaagcauaggaaacagcauacagacaagcauagcuagauuguggacaaccuagaagaaagugcuuggaagugagguuaagaagguaagucagcugggggcgguggcucccaucuguaaucucagcauuuugggaggccaaggcaggcggaucacuugaggucaguuuaagaccagcauggccaacauagcgaaaccccgucucuacuaaaaauagaaaaauuagcugggugugguggcaggcaccuguaaucccagcuauuugggaggcugaggcaggagaaucacuugaacccaggagucggugguugcagugagccaagaccacggcauugaacuccaucucagaaaaaaagaaguuaguaccagauugugagagguacuguguacuacauaugguauaggcagaaccaugucccccaccccaaagagauuuauguccuaauucuuggaaccugugaauauaauauggcaaaggagaauuaagauuguauaagaaauuaaaguuauuaauuagcugaccuuaagaugagauaauccuagauuaucuggguaagcccaauguaaucacaaggguccuuaaaaguggaaaugcggggcagaagaguucagaaugauacaauaugaggauuccacaggccuuugcuagauggaggagggggccaugagcaaggaauauggguggccuccagucacuggaaaaggugaggaaauggauuccacucgcagucuccaaagaggaaucaacaucuuaacuuuaggccaugccagacuucugaccuacagaacaguaagaugacaaauuucuguuaagcagcaguaggaaaguagcaugucaugcuagaauaucugaacuucauucugcagguaauggggaggccuuuguucagucuggaaguacuuguuuuaacauuuacuguacuacgcugggcagaggagacagaauggugaaauagacaugugucugucuugcagccaaagggugcagagagacugggaaaagguccagucuggagacugagagagucaagaaggaaucagacaaguccaggugggaaaggaagaugaggggcuguguggaugaacauuaauaguugggggcuugaagacgggucaguaugguauuccccuguuucaccagccuagggccuaucauacaggcuuucaauaaauguuugcuaaugaauccaugauacuuagagggaacuaaaaagauuguuugacuggauauggaaggugaaggagaaaaaggacacccagaugacuuuuaaguuucugguugaaugacuagauaggugaggcuagaagguccucccaugagcugaaauagagaacugaaaagguuuaccauuuucuggggugggggggaauuucaaaaguuucauuuugaaauuuuaaucauugacuaauucuacaaauauuucuugcggacauacuguaugugaggccuuugccaagaacaggcaagaaaauaaucauggucuccgaucucauggggcuuacauucuaguggaaaaugguacacacaauuuuuaaaaggaugcgacgagauauguaaaugaggaagaucugugagauugaggggcaacuggaaaagucuggaaggcagacaagagacugggaugagagagacauuugaaaauccccaggagaaggugggauuagaagucacgacaacaaacaaguguucacggagaagguggcauggggacagaagccucagcgacaggacuucaggggauacugacgugagaaaauggagcgagggauccacugccaacuaguuucugucccaugacacuguguaacugcucucugcaucuggaccucuguacucaacuuuuuagcaugucuuaugccuacucaccccuauuuucucaagacccuuucuucuacuuuuugagggggaauaaaaaaccccgcuacucuuuguuccauuuuuuuuuuuuuuugaggcggagucuugcucugucacccaggcuggacugcaguggcacaaucuccgcucacugcaagcucucccucccggguucacgccauucuccugccucagccucccgaguagcugggacuacagacgcccgccaccacgcccagcuaauuuuuuuguauuuuuaguagagacggggucucaccauguuagccaggauggucuggaucuccugaccuugugauccgcccuccuuggccucccaaaaugcugggauuacaggcaugagccaccgcacccggccuguuccaucuguuuucuuagaagacuguaaagcuggcugaagggcaggaccaauucuuacuuuucuuuuguauuauguauaaugccagcacuaugcugagccuaaggcagggugaacucucaaccccuucuaaauaaccuugacauaauccaacgagucugaacugccuucgggaugcugagaaaaaacucugagaaagguaguuugagaccuuuuagguaugcuucauaacucaugcagaagacuuaacaccaaaaaagaugucccacagugagacuggggaaugaaauaaagaacaauuacuugcucagauuacuccaauugauuaauuaauauuauucuggaauaguugaaucacucaauucaaaccugaguaauucaaguuuugggugcuacuauaaacagaaguuuuaaaauuucauuuuccaauuguguauuugcaguauaacgaaagauaaccguuuuuauacauugaucuugagaccuugauaaacucacuuauucugguagcuucuuuguagauucuuccaggucuucuacauacaagaucauacugccuguaaauaaauucaguucuaguucuuccuguaggagacuuuaucuuauuuauuaauuauuuuuuuggagauaagucucacucugucacccaggcuggagugcaguggugcaaucucagcucaucggaaccuuugccucccaaguucaagugauucuagugccucagccccucaaguaccugggaucacaggcaugcaccaccaggcccggcuaauuuuuguauuuuuaguagagacagguuucaccauguuggccaggcuggucuugaacuccuggccucaagcgauccucccaccuuggccucccaaagugcugggauuacaggugugagccaccaugcccggcccuauaagagauuuuaaaucuuggggauauaaauagagccacccgugaaggacuggugauaugucugggugacauugcuuauggcuuucuccacagguguagggugccagggacugggguggcuuuugauucuuccagcugcucaugugcacagagguauagaugugaaccccuucauggagggacucaaucucaaauuggccucgauaccagaaugaagagcacauucaguagaggcagaaggggcuugggcagccugcuuguucucaacggguguccuuucuauaacugcaguugaucucagccaugaaacagcugaccacuuaguugucaagguacucuucacucagguggguauccucaguugcagacuugacuucaguaauuccaucuugaauacugaggauggacagauaaaaaaugccacccagguaaaagaucagaucauuaaauuuggcauuaacguucucgucuaagcugagaccagcggcauuuggcuugcugacaauucagaacacaaugagaucaguaaugguuccaccaacuuugauggccugaagcuggcaaccauuaaaguaacugguaguaugaggaucguguaggucaggggucauaaaguagguuuccagaauuuucuccaucuuuuucaaaaccaaugugguaggcagauuucuaagaugccacccaaagacuccccaccuccugguguucacuuuugugucauccccuacccucgagcguaggcucagucuaauaacuugccuuuuuuuuucuugagacgaaguuuugcuguuucauccaggcugaucuuggcucacugcaaccucugccccccuuagguucaagcgauuuuccugccucagccucccaagugacugggauuacaggcguccaccaccaugcccagcuaauuuuuguauuuuuaguagagacaggguuucaccauguuagccacgcuggccuugaacuccugaccucaggugauccacucaccucggccucccgaagugcugggauuacaggugugagccaccacgacuggccauaacuugcuuuuuaauuuuuuuuuuuuuuuaaagagaugggcggggguaucacuauguugaccaggcuggucuugaacuccuggccucaagugacccucccaucucagccucccaaagggcuaggauuauaagcaugagccacugugccuggcccuaacuuguuuuuaacaaagagagcacagcaaaaaucacuucugugauuagguugcaaaagacugugacuucuguuuuacuagcauucucuuccugacagucucucuugcucucuguauuaguccagucucucacugcuauaaagaaauaccugagacgggguaauuuauaaagaaaagaggccuaauuggcucaugguucugcacuguucuacaggaagcaugaugcuggcaugugcuuggcuucuggggaagccuccagaaacuuacaaucauaguggaaggugaagggagagcagguaccuuacauggcagaagcgaagaagagcgaacaaggggagaugcaggugcuacacacuuuuaaacaaccucacgagaacucacugucacaagaacagcaccaaggggauggugccaaaccacucaugagaaaucuacccugaugauccagucacccccccaccaggacccaccuccaacacgggcauuaccauucgacacaagauuugggcagggauacagaucuaaaccauaucacuccccuacuuguucaucugaugaagcacacugccauguugugagaugcucuauggagaagcuucuggacaucagcuuaugaggaacugaggccucaaucuaauagccugagaggaaccaaauccagccaauaaccacgagugaacuaggaagugaaucucugagaugacugcagccuugugagaaacacagaaucagaggacccagcuaagcugcacugauuccugacccacaaaaacuuaaauaguaagugguguuucuuuuuucuuuuuauuuuuugagacagucucacucugucacccaggcuggagugcaguggugcagucucagcucaguccaaccucugccuccuggguucaagugauucucaugccucagccuccagagucagcuacuugggacuacaggugcaugccaccaugcccgacuaauuuaugggguuucaccauguuggccaggcuggucuugaacuccuggccucaugugaccugccugccuuggccuaccaaagugcugggguaacaggcgugagccaccgugcccagccaguaagugguguuucaguccaccaaguuuugggguaauuuguuacacagcaauagcuaacacaaccacaggaaauaccucaacuguauaaagcuuuuaguaucccucccuuuccuccucuggaucuucagccugugugcacagucgacaaccaggaaaguccagugcuuuucauguuugaccagacaguuggacugucaaaucggugucuaauuacaccucuguuaucuaaaacuguguugauggaguccacugaauuugauuccuaaaccaucacuaaucaaucuuucugugucagcuaaaagcaacauagcuugguuuucuugccgaguggugaugaucucuacuguccugugcuggaagacaccuacagaggaauagguggugccaagaucagugacaacugcagauagcuuugaugugguuuugcaaggggcggugucuagcuuagaggaaaaaaauguagacacuaaaguggaacauagcauucaauaagccaugguagguuuuugaaauuauaaaucauguauuuuuuauuuuuauuuuuuugagacagggucucacucugucaccuagacugggauguaguggcgugaucauggcucacugcagccucaaacuccugggcuaaagcaauccuccugccucaaccucccaggguagcugagacuacaggcacaugccauuauaccuggcuaauuuuuuuaaaaaaaagguuaguagaaaugaggucucauuguguuucccaggcuaaucacuuauuuuugaugugauacaaggugaauguggggauugguaggaaauaugauugaaaaacagaaacaauaggaaggaccuuguauaucaagccagaacacuugaggcaaugagggaaacuggagguauuaaaauuaguuggagggaaucagaaaagacaaucaguagacacuaauaucaagagguaucugagguuagguauuauuagaugauguuagagcaaccaucauaaaaaugauucaacaagcaauucugaacacauuugaaacaaacgaaaaagcaggaagucucugcaaagaaacagaagauacaaauaaaaaaacauggaaauuuuagaacugaaaaauauaauaaaugaaauaaacucaauguugggcagcagaacgaauguaacagaggaaggaaucaaucaacuagaagaugaaacaaaggacauuacccaaucuuaacagagacaaaauauacuggaaaagaagugaacagagccucaaagaccuugugaaaugauaauaaaagauaaaauguagaugucauagaauuauggcagauuuccgucagaaaccauggaggucagaaggaaguggcauggcauuuuucaggugcugaaagaaagaaaacugucuaccuagaauccuauuucuaggaaaauauccugcaagaaugaagagaaaauuaauacacucucagaugaagacaaacuaagagaauuugucucacuagacuuaccuuaaaagaauggcuaaauaaaguucuugaaaaaaaaaaacaguaaaagaaaucuuagaagaucagaaggagaaaagaacagaaagaauaaaaacaugggcacauacaacagacuuugcuuuucuuaguuuucuaaauuauguuugaugguugaagcaaaaauuauaacauuaucugaugaaguuuucuaugucugcagaagaauaguuaagaaaauuauaaauacggaaggguaaaggaauauaaaagaaauaagaauucuuuuuuuuuuucugcauccaaucauccauuagggaaauaaagauucuauacuucauuuaaucugcaagauguugaaaucaguagauuguaauaaguuauauacguaagauguaauaaccagagcaacuacuaaauaucuaugcaacgagauauauuaaaaaguaacaucaaaaugaaauaccaaaaaauuguuucaguaaccacaggaagacaggaacuuugauacaagcaacaauuuggauggauccaaguugagggcauuaugcucugugaaaaaagccaguuaaaaagucacauacagaucgagaccauccuggcuaaacacagugaaaccccaucucuacuaaaaauacaaaaaaaaauuagcugggcuugguggcgggugccuguagucccaccuacucaggaggcugaggcaggagaauggcgugaacccgggaggcagagcuugcaaugagccaagauugagccacugcacuccagccugggcaacagagcaagacuccgucucaaaaaaaaaaaaaaaaaaaaagucacauacuguaugacuaucuauauaacauccucaaaaugacaaaauuauggagauggagaagagauuacucacugccagggguuagggacaguccggguagggggagggcagugugacuauacaggguagcaugaggaaaagugauaaaacaguuuugugucuuuuuguuuuguuuuuuuugagauggagucucgcugcaacgcccaggcuggagugcaauggcaugaccucagcucacugcaaccuccacuuccuggguucaagcgauucugcugccucagccucccgaguagcugggacuacaggcacgcgccaccacacccagcuaauuuuuguauuuuuaguagagacagcguuuuaccauauuggccaggcaggucucgaacucuugaccucaagugaucugcccaccucuagccucacaaagugcugggguuacaggcaugagccaccgcaccuggcacaguuuugugucuugaucaugugguugcauggaucuauagauguggcaaaaugucacagaacuaugugcacacauuguacuaaugucaauuuucuguuuucuaugcucuuuccccauguggucuaccuccaucacuacagcuuuuuuuuuuuuuuuuuuuuugagacggagucucacucugucauccaggcuggagugcacuggcucgaccuuggcucacugcaaccuccaccuccuggguucaagugauucuccugccucagccucucgaguagcucggacuauaggagaaugccaccaugccuggcuaauuuuuguauuuuuaguagagacaggguuucgccauguuggccaggcuggucucaaacucccaaccucaggugauccauccgccucagccucccaaagugcugggauuucuuaauacacgucucuuuucccgacuuugcuucugcccuucuaaaugccugcaugacggagcuaauuggauaucuuguugcuacucuaaucucagcauaucuuagauuuagucugucaccuccccucucugaccucucauuauuguuuuuccaccuuucuacuugucaccuccaggcaaacaucagucauccuuuauucuuucuucuccauggccucuuauuacccaucacuugauuugucuuacaugauucuuucuuaaauuuauuucuauucucacugucaccaugacagaucagaagcagucaugaacucuugcuugaaacuugacaagaacuuacugauggaccauuaggcuuccaaacucucaucuuauucaccaaccuuaucuagucuguagagcuaauaucagaagauccuuugacacaaaaaauugaagugacuguacagaggacaagaaggggaaauauaaagagauuugaauggaagucaaacaagauauuucucugcaagcaguuaaacauauucaacuuauaggcgacaacgugucuuuuucucucauuagaagugcaaaauacguaccuuaacucuucggccaaugcuaaggaauugacacguuuuaucguaaaguccuuccagguuuucucugucccaguagaaaucaggaguaaucaggaagucugaacucaaguuuauacggugccuuuaaaaaggaaaauuauaacuuuuuauuuaucuugaauuaaaaaucauuguuucuauuguauuuaauauuuacauagugcuuuaugaaaacuuuuuuuuuuuugguaagagagagggucuugcuauguuacccgggauggagugcaguggugugaucacaacucacugcaaacugaacuccugggcucaagcuguucuccugccucagccucccauguagcuggaacuacaggcauguggcauugcauguggcugaaaacauuuguuaaugcugaccuuugcaaaauacugccaacaaacauguaaauaaaauuuacaaaugaguuucaaacuucugaaccaaauuaauucaaucuuuaauaccaacauuauuuaugaaguacacagaaaaaaacucauuuuguuuucaauuuuuuuuuuuuuuuugagacagagucacucuugucacccaggcuggaguacaauggcaugaucucagcucacugcaaccucugccucccagauuuaagcaauucuccugccucagccucccaaguagcugggauuacaggugccuaccaucacaccuggcuaauuuuuuguauuuuuaguaaaggguuuuaccaaguuggccaggcuggucucgaacuccugaccucacgugaucugccuaccucagccucccaaagugcugggauuacaggugugagccaccauucccagccuaaacuuuuuuuauuaaaaauuuuagggccaggcauggugguucaugccuguaaucccagcacuuuggaaggccaaggcgggcagauugcucgagucugugaguucaagaccaaccuggacagcacagcgaaacccuaucucuacaaaaaauacaagaacuagccagguguggugguguaugccuguagucccagcuacuugggaggcugaggugggaggaucaugugaaccucggaggcagaggcugcagugagccaagacugugacacuguacuccagccuaggcaacauagugagaccccaucucaaauaaaaaaaaaauuuaauauguccacacuuuuuuguuuuuuauuuaaaaaauuuuuuuagagauaaugucuucauaugucacccaguuuggggugcagugacacaaucauagcuuaccgcagccucaaacuccugggcucaagugaucuuccugccucagccuccugagcagaucaagauauaaacagguaaaaauugauaaaucuuaacucuuauucuuaucuguaucuuucccuaucaguaaucccuucuaguuuccgcuguauccuuccaguguuuaugcaaacacuagacaagcaagcauaaacauacacacucucucucuuaauuucuacauuuuaauauaagaagucugugcuuacuuuuuuuucugagacagaguuuuguucuuguugcccaggcuggaguguauuggcgcgaucuuggcucaccacaaccuccaccucuuggguucaagcaauucuccugccucagccucccgaguagcuaggauuacaggcaugugccaccacgcccggcuaauuuuguauuuuuaguaaagaugggguuucuccauguuggucaggcuggucuugaacuccugaccucagaugauccacuggccucggccucccaaaguguugggauuacagaugugagccaccgugcccagccuuuuucuuuuuugagacagaaucuugcucugucgcccaggcuggagugcaguggcaugauccuggcuccacugcaaccuucgccuccuggguucaaccaauucucaugccucagccucccaagaagcugggauuacaggcgcacaccaccauuccuggcuaauuuuuguauuuuugguagagaugggguuucaucauguuagccaggcuggucucgagcucccagccucaagcaauccaccugucucagccucccaaagugcuggcauuacaggugugagccaccgugccuggccuuacacuuagauguuuaacuaaauaaaaaucuaaguuaugaaaguacacauaaacugaugugguggcucacaccuguaaucccagcacuuugggaggccuagggaggaggauugcuugagcaaggguuugagacccugucucuacaaauuauuuuuaaaauuagcugggugugguggagcacuccuguggucccagcuacccaggagggugaggcaggaggaaucccugagcccaggagaucaaggcuuuggugagcuaugaucaugccacugcacucuagucugggugacaagcaagacccuguuuaaaaaaaaaaaaaaaaaaaguaacacauacauaccuguucacgauuaaaaaaaaaaggaaaauauccuagagaaggauucagaaaaaugguaggcucucuuaugcuaccacacuacuuaaauccuuuauucuccccaaggacaggccuguagagacacuuugcuguguacuuccagaucuuucuguauucauacaugcaugugugugcaagcaaacacauguacauguguaugcauauaaagauaaacaugaauauuuuuauuugcuuacacaaaugggaucauacccuauauaaauuuagauuuaguuuuuuaaucuaauauuaucugccauguuuauuuucacagauguaucacauuccuuauauuaacaaauaagcauuuuuauuguacagguaaggaaacaggauaguaaaaguaagccuuuauagaaacuauucacaaaccuacguauauuuaguccuaacuauucaguuuggauauuauaauucacuacaucaauuucugcuugcaugaccaagagaacaggagagaagaaucucucuacccuacuucucagagaauuugaggcuucagauaugcugcaggaugcuccugauggauggguuuuuaaguuuuguugguacccugaacuauagguccugagcuaugagagauacacagacaaugaaacacuguaucacuucucuccaggcagagcaucuaaggagaauauggaaaaacaagucuuaggugaacauuugcagugagcucugguaacucauuccacaugcuagaagggauaaacuggacaaugcugccugugagaaaaacaccaacauccgggauguuucauuccguaaauccugggacaacuacaagaauaauaaaagcugaaaaccuuuccagauacuuauuuaaaaugauucaucaguuuuuagacauaguuauucccauuuuaacaucucgaggcaucuuaaaauuaauggugucugacagguggcacuugagacuuacuugucuuugccuuaaauaauuuauuuucuuaugcuuuccuuuucauauaugcccaagagggaaugugauauaauuuauauccagcuaagauuaaaagauauuucaguaaguguaaaauuuuaauccucugauaaaaaaaguauugucauaguuuaacuggcagcaguuuuucucuccaguggcaucuuggugucucagauucaaagaaacuuuucuguagcaauuaagccuauuuagcauuaugaugcagugauauauuuuuacagagaauucccauuaaccaaauucaggaauaugucuuucuaccuucaaagaacaccuacugugcuccuuaauguggguuuaauguagaugaaucgugaucucuuuugcacaugcgugauuucuuucaguacagucuuaacacagcccaacuacuucuaauggguaagaguucucccugcuuauaaucaaugaaaugaaaacagcuacaguucccauaaacguguaaauguuugcucuucaccacagaacuaugggaauguuuucuugagauuguuaaauauaugaaauauuuuauuuagagagaaaacuuuuaccuuagagcaaagaguucaccgauuuucugcauaacuucuucaugagauaguuucacuuucuucccagcuuuuaaagccuaguugagagggaaucggaaaaaccaaaaaaccauguaucucucuuucuaauaagcauuaggucaacagggcaaaaucugaaguggcauaauuuggauccuauguaaauauuuuuuaggauggcugucucccagauuaaugucuuaacucaccuugaaauuucauaauuuuauuagguagaaauuguauauucucuuuuuucauuucccuucucaucagcauuuucaaugauauauacauuccuaaucucuuaguagaaaagcagggccuccuuuccgaaguauaauuagauuacucuuucacaauaaagacacaguuaauuacaauaugaugauuuuuaauguauacugaaauuucaauauaacuuuauauguauuuuucauaccacuauuuuucucauaauuuagcaaaacacuuucuuaaaucaggaaaaguggucauaauuuccauucucagagagaaacauuucacuuuuuucuuuaauucaguuacauuaaaaauacugcaacugacgggcaugguggcucguggccuguaaugcuagaacuuugggaggccgaggcaggaggaucgcuugagcccaggaguucaagaccagccugggcaacauggccagaccccauuucaauuauauuaauauuaaaaaaaaaauacugcaccaacagaggaaacaauuugaaguuuuaaaaaguaaaaaguaaucaauaugaaguuucuuaauuugucauuuuauauguaacugggaguucuuaaguuuacuguaguuuucuuauuguuuguaauaauguuguuguacuccuaaacaaucggcccucuauaaguucugcaacugcagauucaaccaacugcaaauugacaguauuuugagaaaaaagaaugguugcaucuguaccgaacauguacaaacuguuuuuucuuguuauuauuuccuaaauaauacaguauaacaacuauuuacauaguauuuacauuauauuagguauuuuagguaaucuagagaugguugaaaguauacaugaggauaugcauagguuauaugcaaauauauaccauuuuauaucagggauuuggacacugguagauucugguauccaguggggucuuggaacaaaucucccauggauacugauggauagcuauauauuguuauauugggaaauucauauuuuuuacauauaaaaaucaauccuugaauaagcauaaaauugauauaauuaccucaggaauugacugaauagauucaauaaauuuauccagugaugcuucccaaauugccaguuuuacugggaaaaaaauuaauaauggaacauuucuuuaucaucauauucacauguauauaaaauacauaauugcacagcaucuucacuacuauuucaguaauaguuuaagaaaaaguacuaaaaccuugaaaauauaauuuaagaauaguuaauuaucauaaaggacagaauuaaaguggauagaggaaacugaaucgcuuuccaugcccuauuggaagaccaaagcuacauuuaguagaacucuugauuuucuaguauuacaucuuggaaacugaggaggguaggguacaccuugauaccauggguagcucugcagauagggcgcgacuaagacuuuccuggccuccccuucacuccucaggacuaagaguaaaccucagaaaucuccgaagccccucagagugggauggacaggacgcugcagcagccaccuaagguagacugcuggcaaaagaaauucuuaaagaacuuguauaguuuuauucgggauguggaucuuucagaacaaacuuauagccacugugacucugggucccauuccuauggaacacuagaguauguuuuucuacacugggaccugugcccagucacacaaggcugggcuucucugucuggauuagagacuaucuaagaauaacaaucgcauagagagaagagaaaaaaacaaaggcuaauauaaucaucaucuaaaaaauacuuuuggagagguuaagcuuuauuaauacaauuaauaaggaaugaguaacuucagcacaguacuaucuuuuauacuagauauuuuuucugauggagggaaaaaaaggaaaaggaaugcuaaggcuuuguugaguauucugaaaauauaccaaaaucgugacuauuuaaacuucccucagugaaaugacaacuguaguacccuaucccauaagcaguaguaacuuaccagaaaggcauagagcauuggagaaagcaaacuucucuagaauggcaucaucuaaauccagcucugaauuuaacuugauuuccccccugugaaguuuugacuguccccugugaaaagcaaaaagauaauaccuucuaaaucuuaaaaagcacuuuaacuuuuccuuugaaaaagacaccauaucaucuuucuggaggucauuuugacaauuuguaucaagaguguuacaaauguucucauauccuuugguccagguaauucccuuucuaggaguuuauccuaaggaaauaaucuaagaugcaaagaaaaauuuguauacaagaaaacuuuuuuuuuuuuuuuugagacagucucacucugccgcccaggcuagagugcaguggugcgaucucagcucacugcaaccucagucuccuagguucaagcgauucuccugccucagccucccuaguagcugggauuacaggcaugcguaaccacacccagcuaauuuuuuuuguauuuuuaauagagauagaguuucaccauguuggccaggcuggucuugaauuccugaccucaaaugauccacccaccucggccucccaaaguggugcgacuacaggugcgagccaccuugcccagcugaaaacuuuuaaaaaaauggucaguguuggcugggcacgguggcucacgccuguaaccccagcacuccgggaggccgaggcagguggaucacgaggucaggagauugagaccauccuggcuaacauggugaaaccccgucucuacucaaaacacaaaauaaaauuagccgggugugguggcgggcgccuguagucccagcuacucgggaggcugaggcaggagaauggagugaacccgggaggcggagcuugcaguaagccgaaaucacgccacugcacuccagccugggagacugagcaagacucugucuccaaaaaaaaaaaaaaggucaguguuuaagaguaaaaaauuaggaaauaaaccaaauguucaguagggguuggcucaguaauagucacuccacacaagaaaaacuuaaaaguguguuuuggaaggauaguuaauaaaaaggagaacguucacaguaaauuucuaugugaaaaaaugcugcauauaaaacuauauauggaguguaaucuaaaaucacacugacaugaugggguuggggagggaggcaaggaaguugugaaaaaugaguaugugacuguggagaauccuagacaggggacaggggaagagcggaaugugugaauauaaacaucacaagcaaauggaaaaaagacaggguaaaccuucacaaaagaugucagacaagaagugacggccaaagggagggggacaaggggccugauggagggcggcaucugcuaugacagccucagauggaggaaggaaagcaaagacagcagucacaagaggucuuuuuuuuugagacggagucuugcucugucacccagacuggaguguaguggcgugaucuucgcucacugcaaccuccgccuccuggguuccagcgauucuccugccucagccuccugaguagcugggauuacaggagugcaccaccacauccagcuaauuuuuauauuuguaguacagacagggcuucaccauguuggccaggcuggucuugaacuccugaccucaagugaucugcccgccuuggccucucaaaguguugggauuacaggcaugagccacugugcuuggucacaagaugcuuuaugaguaaacugggcccaugccacagagcugagcagaucccuggaaucauggcagaacucacauaauaaccauguagguggcagccaggacagucuuucugacgaaacaaaauaacugacucugggauccuaagcacugaggauuuuacuccucacagacuguacaguaacguguguguguguguguggauaagcguacacacacacacacacaagggucuagcaguaguuggauauggaaguauuugguuggugcaaaaguaaucgcgguuuuugccauuuuaauguaaaccuaauagaacacagaaaggggauucacaggagcuguaucugcaggccaagggcugaguaacuacuaaagauaauaaaacuacaggcugcucauuugcugucucucucagguuuauauccuuaccucugacugcagccaccacugggcucaggcugacucacagucaggugcccuuuggcaagacaggauucaauaaaucucaucggaaagccaguuagcugcaauuauaggguuuuccccaggauuaaaugaaauaauacauggaaggcacuuacuuagaaaaccgugacuggcccuauugguggugagcgcugauuacucagcucuuauccccaucuggucuuucuauagcuagucucugucucucuuccaagucuucccaaagcucugcuuuuaacgcuuuuuuuuuuuuuuugagacagagucucacucuguugcacaggcuggagugcaguggugcgaucucaggucauggcaaccucugccucccagguucaagcaauucucugccuccgccuccgccucccaaguagcugggaucacagacacucgccacuaugcccggguaauuuuuguauuuuuaguagagaugggguuucgccauguuggccaagcugucuugaacuccugacucaguugauccucccacccuggccucccaaagugcugagauuacaggugugagccaccaaaucuggcuaacacuaccuuucuuaagaaccugcaaagacucauauuucacuagacagguaacuccaugaggaaaaagacacuaccaucuuguucauacugccucugucucggcccuaacaucucuucauuuuuucccucuggcugagucaggaaaaucagcuagucuguugccuacccauuuaucuuagugaaacugguacaccaggucccacuucuuccagcacccacacuucuacaagugggucucuuagauugaccccucacuauacuuccuuuucauacccccaccccccaaaaucaauaggaaaaaacuggauuaagagaaaaauuuacuggaauaauuugauagguucauuugauaaaugcauacuauuuuauuggauuaggcugauuagaaacuuaacauuuccauuuuggggcuauacuacugacuuguuuuaacuuguggauagccugagaaguucaaaaaauuauguuuaucuucuaauauuuauuauaugguuuagacuuuguauuuguaccaguaaucuuuuuccucuuuuuuuuugagacggaguuucacucuugucacccuggcuggagugcaauggcgugaucucggcucacugcaaccuccgccucccagguucaagcaauucuccugucucagccucccgaguagcugggauuacaagcacccgccaccauaaccagcuaauuuuuguauuuuuuaguagagaugggguuucaccauguuggccaggcugguccugaacuccugaccucagguaauccaccugccucagccucccaaagugcugggauuacaggugugagcuaccacgccuggccacuuuuuucuuaaaaguaaguuuccaggccagguccaguggcucacgccuguaaucccagcacuuugagaggcugaggugggcggaucaccaggucgagauccagaccauccuggccaacauggugaaacccugucucuacuaaaaauacaaaaaauuagcugggcgugguggugcacaccuguagucccacuuacucaggaggcugaggcaggagaauugcuugaacccgggaggcagagguugcagugagccgagauugugccacugcacuccauccugggcgacagagugagacuccgucucaaaaaaaaaaaaaaaguuuccauaugcauaauaauuugucuccucuauugcuuuaccuaauuuauuccaagugccccuuucauaaauuugaugaaaaguugcuuacucuauuuuuauguaguuaaguucuucauuuucccaguguaccagugcgauuucauagggcugaauuucauguuuuucuagaacuuucaucacaugcuucaucuagaagaaaaggaagauuaaucugaaaucauaacugacucccucaguucaaguauguuaugauuuuaaugcuuauaacagucuucauuacacuuacaggcauuauuucuguugcauguuuuuaaggaaaaggcaaaucaaauccauugugauauuaaaguaaucaggaugacauguucauuuguuuuuacauuuggaaaacacagaugagaauggagaagaaaaucaagguuaucauuaucccacaacccaaggaaaaucacuaguaauauuauaauuuguauucuuuaaaucucuuuaauaaucccagcauuuugggaggcagaggcggguggauccuugagcucaaaaguucaagaccagccugggcaacguggcaaaauccugucucuacaaaaaaauacaaaaauuaucuggguguggugauguacaccuguagucccagcuaccugagaggcuggcuugagccugggagguggcgguugcagugagccaaugucagccggugugacagagcaagacccuaucucaaaaaaauaaauaaauaaaaaauaaaaaguaaagcccaacauacuaauaaaaaauuaagccacacaggugugggaggugaucaucucuuucucucuucuguacugaaauccuaauccccagaggcaaccaugauuaaacuuggugcauauccuuccagacuuuuuauguguauauauguacauauuuaugcugcuuuuuauguaaaauaggaucauauuaugcacaugacauuuucaacacuauuuuccuuuacagacgaacugcaauuuauuuaaccaaccuagguguguccuccauggggaauuuuuucuacucuccauuacaauguugcgaugugccacacuugugcaaaggucuucauggcuuugugggaauacuucuuuaggaauugcuagaucaaaagauauguggacuuacacaauauguauauauguaacagacagggucucaccuugucacccaggcuggagugcagugaugcaaucauagcucauugcagccucaaacuccuggguucgagcgaucccccugccuuagccucccaaguagcugggacuacagguacacacuaccacaccuggcuaacuucuaaaaacuuuuuguagagaugggaucucacuguguuguucaggcuggucuggaacuccugagcuuaagugauccucccaccccagacucccaaagugauacgauuacagguaugaguuaccacaccuggcccacacuuauaauauugcuagccugcucuccaaaguaguuuuuccaaauguagaaucucaacauuuaugaaacuacucuuaagaaaugggguuuaucagccuuuuacaucuuugcaacuucaaauagccaacuuguauuuucuuaaauuuauuggucauuuauauuuucuuuucucuaaguucccuucccgaccaccuacuguguguguuuccuuuucguaaaauugggauuguauaaagcauguuuuuuaaccaguucugagauuauauugguuauauuuuguaacccgcuuuuuuuuuuuuuugaagacaagaguaugccucugucucccaggcuggagugcaauggucugaccuuggcucacugcaaccucugccuccaagguuuaagcgauucuugugccucagcuacccgaguagcugggauuacaggugugcaccaccacgcccagcuaauuuuuguauuuuuaguagacaugggguucaccauguuggccaggcuggucucgaacuccuggccucaagauaccugccggccuuggucucccaaagugcugggauuacaggcgugagccaccaugccuggccguauaaucugcucuuuuaauguaacuguauuauauauauaggcaaucucccagaaauagauauuuuuuuacaugauuucuaaggggaucuauaguauaucuguaguauauggaugauuuaacaaacuauuauuguguauuuugguaauuucuaauuuuugccauuauaaauauugcucugaugaacauuuuuguacaaaaaucaucacgaauaguuaugauuauuuccuuuggauaaauuucuagguguaaaauuacuggguuaaauauaaagcuuuaauguagauuaccaauuugccucuaaaaugguuguauuaaacaaaucuugauuuggaucuugaaaaaauuauuucccaugaguaguaaguucuagacaacuugacuuaaaagaacacucaaugcaaccagcuuccaauuaacugcauacauuuuguauaguacaacaugcaaagucuacaguacuucugucugcaguauaguuaggaugguucugauucuccacaaauuagugugugucuagagaaaggaaaaagcaggaaaucuuaacccaaaauacaauauauuuuggaagaugaaacugauaaguaucauguaaugcagagcaaauaaguugugcauaaucuauuaauuucccuucuaauguuucaguaugugcuaauuaacaauucauucucacaaaacuaaauuuuuauauuuucacauuuuuauuuacacuuacaguuuugucuuucacauuccaaaacacagcagcuccuucccugauuuaaaaaaauaaaagaaacaacuaagauacagauggaauacauucuuuagggucguauauaaaaccauguaacuucuagaauguauacaggaugcgauuuuucaaaauaugaugguacuuacuaauuugauauuaugguccuuaggugaacuuccuacaauaagagcuaaaauaaaauucuugauaaaaccugaccuccucaaaauuuaugauuucucacaugguuugccaaacaaauagccauuauuguaauacuauauaacuucacguauguagacucuuucauaccugguucaauucugauccacagaaaucagaauaaggaaauuuuuugagaccuugucuuagcucucauuaggcagacucuacuaugugcaaggaauaaagggcuaugccuggauuuuuguggaauaaagagauggugguuaauuuaagcaucagaugguuaaaggccucuauggaauaaugcuccccacgcucacagugcuuggaacagaacuacagugacaccacaggaggcccucugaauccgauuauggcuuuaacauuauuuagggucuaaaacuacgaaugcauuuguuuugauuucucaaguuugacguguugaagcuguuucagguaguaaauaaaaacaggagcuauagcucagggucagugcacuggaggaaggaaaggaggaaauaaaagaaagguaaaaauauuaauggcuccacguuauucuugaaacauuucuaaaguacuuaguauauguguggguccaugcuuaguauuugugauagaaacauaaguaugauuucauuccuauccucaaucuagaaaagacugggacugacacuuagaccaccaauuacaauagugugugaucagugcuacaagaguaugcagaguauaccaugagauguacaccagagggaccccuuugcuaaaggacuagcagaggcagccaaaugagaaaacaagaggagacaacauagcagaggggacacacaggcucagagaggaggugggacggagcagagcagcaucucagaauaaacagccaguagcugcguggcugcagauguggucaagcagugggcaagcaggauaaagaggcaagcaggggacaauccagaagggaacuuuaugcagugauagagaauuuguucauaguccguggaaauuuaggcaggagaguguaguggucagaaauggccacugaagaaugacccugcuuacaauagacaaacagacugguggugggugagcaggcaggcagggagacaauaagcuguuacaauaggcagggauaagguuucaggauacggauuugagagguauuucaagccacagccacaguaucaguucagagaaucccuuccaggcagaagagaggucuggugaacugcauauuccuccaaccagaggaaugcacugugcugugcaaugugguacucagaggccacauguggcuauugagugcuugaaacaugccuggugcaaacugagaugcgcuguaaguguacaauacacagcaaaauucaaagacuuaguaugacaagugaaaaaauaucauuauuaauuacauguugaaaugauaauauuuuagauaugcuggguugaauaaaauacauuguuaaauuaauuucauguuaauauguuaagaaacauauuuguguuguucaaaauuaauuuuaucuuuuuaaaaauauuuaaaaugugguuacuggaaaauguaucauuacauaugaggcuugcauuauauuucuuucuuucuuuuuuuuuuuuucuuugaggcagagucucacucugucacuaggcuggagugcaauggcacgaucucagcugaccacaaccaucgccucccgcauucaagugaaucuccugccucagccuccugaguagcugggauuacaggcacccuccaccaugugccuggcuaauuuuuuguauuuuuaguagagacaggguuucaccauguuggccaggcuggucucaaacuccugaccuugugaucugccugccucagccucccaaagugcugggauuacaggcauaagccaccgugcccagccgaggcuugcacuguauuucugcuagacagugcugauguagagucccucacaaaucuaaauuccucacucggaacaacagggaugcuauuacucuacuugaauuaaauguuggaaucuugauucucucuaaagauggggucaaaaggaagguaggcauugaaaggaaaaaagaacuuccacuuaucaucaacuauaaggauuaugaccacaagaacuuuacucaacuuuggauuccuacagaugguccauguguuucuguucugucacguauuagucucaugacuauggguaacucaaucccuaugacccucaguuuccucaggugcaaaauagaccuucaucggugugcugaggauaaaugagauuauuucacacgguucuaucauguuaucauucccaggcagcuacuguggaguauuuaguauugagucggccuuuagauaaaaggaauaaguguguaugugagucuccuagucuaaaaccucuggagagguaagcuaaaacuuuaaagagcuaccaaaggggaagggagaaaaaaaagaaaauggcaagaagagacagcagggagguagcgggaguuucccuggggcaggagucugacaaggggcacuaaagaugaaugggaaauuggcugcuuuccagaaauuuaguccaugaaaauccgaauuuacaaagaaagacaccccggggaagaucauucacuuguuugaaauauucuuuacuuuauaagaggguuuaccagagaauuccuaaaagugacaaacucuccuagauuaaauaagaauuaaaugauaaauuuaaaucacaaauacauuuugaacacauuuacuguuaagaaagguaugccugcaccuuuaaagaccacaauuacuugacccaaacccaucaucaccuaaugggguuucuuuccugucuuaccugaagaagaauauuguuccaggaucaccuucuuuugcagaauuuuccacacccaucaccaaaauauuugcugcaucugugauuuaaaauaaacgaacaaaaaagcuaugucaagguaacacaaguuguaagagucaccuauaaacacuguaauaaaguacuuaagaucauuucuuuauauaccauggagugcucuguaacacaaucaccaucuuucuacuaaggccucugaaaggauuuaauauauaaaaaugcaaauacgaccaccaaaaaaagaucagcaauuacuuuuauaaaacauucaacaaccugugauauuaauauuagagcucauucaugcccauuuugauucaauaaucacuaguccagauaauuaauaaagucuuagguuccauacaacuaagugucaagaauuaaacuucuuucuacaaaauuaaaaauaaaauuugaagaaguauuaauauauucucuuccuauaaauaccauuucauuaauaaugcaauuuuaacauucccaaacuacuacuccugcugaauuuuaaaguauaaaaaguagggcaauagaaaauacacagaaauaaagauacugaccacuucaaaacauaugugauuucaagguuaaucacuacaggggcuaccacugcagccaccugcaacuauuuaaaaaaaaaguuuuuuuuuuguuuguuuguuuuuuuugagacagggucuugcucugucucccaggcugaagcgcagugccaugaucucagcucaaugcagccucaaccuccugaacucaagggacccccccccgccccacccaccucagccucccaaguagcuuagacuacaggcaugugccaccgcaccuggcuaaguuuuuguuuauguuuuguagagaugaggucucacuauguugcccaggcuggucgugaacuccucagcucaagccaucugccugccuuggccucccaaagugcauuacaagcaugagccacggggccuggccuaaguauuguuaaaacauauacuaauauaccaauauucaucauaagaaguugcuuuauauauuaguauagugauauuuaucauaagcauauauuccauaauauaaauuacaaccaauguuaauauaucaauuaaaaaauauacuauuaauuugcaaaagguuguaugucuuaacggaauuaacauaaaauuaggauccucaaagcuucagaaauuucugguaaaggcugggugaugggcaauucagacacagaccaaaacugugauuuuuuuuuuuuuucuaaauuguuaauuacuacauccuacauaggacagaguuugccuacacagccaaaagcaaaauaaaaucgacugaaacaacccagggcagugaagccugcaauucugugaagcacagaccacacagcuggcagccuucagcaucagccaacaauaccuccaggcaaauuuucauaccaaggggcucuagacauagcucugucuuucuaagucaacuaugcuuguuuuugucaccuaaucacacaaacggucuguuuggauuaucacaaugauauuucaacuaucuucuaugggauugagucuuaagaauuuccacuguuauaggaaggcuuucaaccuauuuuugcuacucuuagguaaauuaauaaauguucuggguauugagcuauccugaguuucacuguaaaaguuuaucaaaauguucuaaguaacuuauuuauuuuugagacagagucucgcucugucacccaggcuggagugcaguggcacgaucuuggcucauugcaaccuccaccucccagguucaagugauuguccugccucagccuccugaguagcugggauuacaggcacguaccaccacgcccagcuaauuuuuguauuuuuaguaaaggugggguuucaccauguuggacaggcuggucugaaacuccugaccucaggugaucugccugucucagucucccagagugcaggauuacagguaugaggcaucacgcccggccuauuuauuuauuuuuuaagacagagucucacucugucgcccagguuggagugcaguggcaugaucucagcucacugcaaccuccacccuccagguucaagcaauucuugugucucagucucccaaguagcugggacuacaggcucgugccaccauaccuggcuaauuuuuguauuuuuaguagagaugggguuucaccauguuggccaggcuggucucgaacuccugaccucaaaugauccacccaccucagccucccaaagugcugggauuacaggccugagccaccauggcuggccuaaauuauuuuuaauuaauguaaagcaagccauuucucaagaauccuuccugauuucaccauaaaaauccucaauuaaguucauuuuaauuuucuucuuuuucauuuuuaucuucuaacuaaucguuuuauuauuauuauuauuuguauuuuuaguagagacagggguuucucuauguuggucagguuggucucaaacucccaaccucaggugaucugcccgccucggccucccaaagugcugcaauuacaggcgugagcuacugcacccggcuaacuaauuguuuuaaaguauuagauugagcugguaaauuuuuuuuuuaaaggcucuccccaugucuaucaacuucaugguucuucuauaagacuaaaauaacgggcugggugugguggcucaaaccuguaaucccagcacuuugggaggccgaggcgggaggauuagaugagguugggaguucgaggccagccugaccaacauggagaaacaccaucucuacuaaaaauacaaaaauuagccaggugugguggcgcaugccuguaauccuagcuacuccggaggcugaggcaggaaaaucgcuugaaccugggaggcggaaguuguagugagcugagaucgcgccauugcacuccagccugggcaacaagagugaaacuccaucccaaaaaacaaaaaaaaaaaaaacacaaaacacacacagacacacacaaacuaaaauaacuucuuaaugugcuagaaaugaaguaguaugaccucugaccaccucaaguaauaaugauccuauaaauaaucuuaauaaaucauacugauuuuaaugaguucucuguaaauacauuuuaauucuuaacuuugucaucuuuauaaagagauucaacauccacuuuuaugauacaauccuuucaaaagaaaaugaauugcaaacaaauacauacuuaagauaguaucauaggaaaauuauccaauacauuuuaacauacuuggccccagguucaagaagaaguaccucuaggcaagcuuguuacuucaacauauccgugggaggccagaucuugagacagauuucccagaugauacucaucugccguugcaaaugcugugcagugcauuagguccuguuccagggaaaugagcauaacauggguuaccaagaggcugaagcaucugugacggcugcugagcacccuacuggacuccauucugcaaagcuagaacuccagaauuuucuucaaacaucuccaagggugauacaagggaugggaugaagaugaagagaaugaaguuacugggaggcaaauuucagcucaaucuugaaaagaacuugcucccucccgccaggcaaaaagauggaauggauuauucugaaagggaagccacacucaacugguaguaucucaagcacagauugaaugcaaaauagagaugauuaaggcaucacaugggugacuggauggaauguuuaagucucuccaacccugaguuuccaugacucuuuuucaaagcaacauuaguauuugaggucauuuccuaauuuguaacuacucuuguacaggcagauuccuuuaaauccccaaaggaauuacaguauuuuuacacugguuaacauuuaacaaaaaggucuguaaaucugagcaugugucuugguuugguuuguacuuugucucaugccccaucuugccuuugcacacaugaggaaagucaucuugugucuauauaaaauacagaugguaagcacuauggcucaaugcuguguuuuuucaaacuguaagucacaacacauuagugaguucugauaccaauuuaguuggcccaaaacagcuuuuuuaauaaaacuaaauagaaaauauuacagugcauuauucacaggaaaugcuauuuuaugaaguuuucugucacuuacauguaucuauguaucuacucuaggucgcuauguauguaaaauguuaaauauauuucucacuauaagauguggucaauaaaguuugaaagcuauuggcauaagaguuaagauuuuaggcacagaaguugguuacaauuuuaaaagaguaucagaauaacaauaaugccuacuuuaugggguuguuguaaaguuuaaauaagcuaauaaacaaagugcucaggacuguggcuaacacaacuguucaguaguuguuagauucuaguuggccaaaacaaguuuaugagucacuaaaucaacauuuauucuuaggauuuacuccucucagcuccccaauucuuucccauucuguauauuccugguaugaaauucuagagaaguauauauuaauucauuccuuccucccaccuccauucuguaucuccuggcucuuucucaugaaauggccugaccccauuugcccuuccucaaucuguuccacagcucugaugcgugguuuaaagguagaggaauaacagagaaccugaggauccaugcaaacugaaaaauccaaaaucaauaaaguaucuacucauaaacaaaaugagacuaauccaauuagaaaaaaagucagacaagcugaaauuacuggggaauguggggauaaauggauguaguacccuaauuaugagcagauaacugcuaauuccuuccaaauuagcuaauucccauagucacauaugaaaguaggaacacggggauauacaaauaaaaauguaucaggaguuaccagaguacagggaacaggcacgugcuuaagguuuagaccugugagcacuaguucuuuuuaaggcuucauggaguuaaaacuagcugauguacgauguguguaaagauucggccagcugaaagaaaggaauccuagcaaggggcaucaggcgagacaucggguaggcuccacucugcaagaccuggcaaauucacucaagcuugcuaggugaaaucacaguacauuagguuggaugucagaauuacuucugugauggcuacagcucaugugcuuaguuugggcugaagugggaagagcaagaggcacaaaaaggagauaagcaggucacaagcuaguccacugaaggaucuuccuguagcuguacugaaaauggcagaggcugucucuuuugcuagaaucggaguuguaaacuggcagcucggagaaccauccaacucaagaguugaccuacaucacguuucuaaaauucaaauugacuugucaacaauaaacugagagauuucacacaaaauccagauuuccaucaucaucugaccgaguggaagaucuggcuauaauaauggacuaggauagaguaggggggcccagggucuccagcccacacugucccugccucucccuguugucucacgucugcuucaccaucaugugguacuggccaagcccaucugcacuaagaauguguacuacuuuuuuuuuuuuuuccaaaaaaaacccaaaaaccuuggcaaggcccaaugacucacgucuguaaucccagaacuuugggaggcugaggcggauggaucacuugaggucaggaguucgagacgagccuggucaacguggugaaacccuggcucuauuaaaaauacaaaaauuagccaggcgugguggcacacaccuguaaucccagcuacuugggaggccaaggcaggagaaucccuugaauccaggaggccgagguugcagugagccaaaauugcaccacugcacucugggcgacacagcaagacuccguuucaaacaaaaacaaaaccaaaacacaacuuuauguuccuuuauuggagcaagauucuagauugauauacagugauguauuaacuaaacagagaccugugcagaaauuacauacuaucuauguagacagguuguuauacuucgccuauugauggaauaguuccauuuaucaaguuuuauacaucaaaaagcuuugaauuucaccaggcucuccauuaauucaccucugaaaaaguggcauuuaauuucagcuacuauaguuuacagcauaaaaagcuuaugcaugagagugcuucucugcacaguggcauguugcagacagagcugaguccauuaucccacccggauuuacauuugagagcuuuauaccagagagccaggacaaaauuacuccuaaccaacacagacuucuuacucucagagccuaucuucuuggcuauauuuuauagugccagugaagacaugcuggcaacugucccauauacagcuuggcauuagaguacaaggucuguuaauggcgguggcaggcauuauuauuuuauucuguuuuuuacuuuauuauuauuauauuuuugagacaguuucacucuuguugcccaggcuggagugcaauggugcaaucuuggcucaucacaaccucugccuccccgguucaagcgauucuccugccgcagccucucgaguugcugggaucacaggcaugcgccaccacgcccagcuaauuuuuguauuuuuaguagagacgggguuucuccauguuggucaggcuggccucaaacucccgaccucaucugauccucccgccucggccucccacagugcugggauuacaggcaucagugaccgcacccggccuauuuauuauuuuuugagacggagucuuccucugucgcccaggcgugagggcaguggugcgaucucagcucacugcaaccucuacccccuggauucaagugauuaucccgccucaaccucccgaguagcuaggauuacaggcaugcaccaccacaccuggcuaauuuuuguauuuuuaguagagacgguguuucuucauguuggccaggcuggucucaaacuccugaccucugguaaucugcccaccucggccucaagugcugggauuacaggcgugagccaccaugcccagccaggcacuauuauuuuaaaucaagguaaaaggucaguuuuaaaaaccgccacuuggagauaaaaauaaaaggcucaauauauucagaacugaguuuugggcaaucugguaucccaaauuaugugaauauuccgacacuaacggcaaauugagaauguguacuauuuucaacucucaaggacaggacaagucaaucacuauuuuuaugagaaaauauauucuaagcuccaaauaaauuaugaauaaaucuuuaaacacaaucuguuuucacuuggccauccuaaggaucuuuguuguagguuuuccagacugucaacuguccccuuuccuucucuugggaucucccauuuaguuuggcucaaaguucuauccaaugucacucagcuuauaugguuugcuacacuacuuucuguauucuccuuaaacuucuuagcucugagucuuaguuguggguuucuucuauuaauagaugaacuugacguuuuagacacuuuguuuugguuuuguuuucuuugcuuuuuuuauuuuagccuauuugguaaaaggaaagagaaucauggaaugucuugucugcuuuuuuuucuuuauuaaagaugcuguuguuuucugagcagcuuucauuuuuauacauccuuuucuggauuuuuacagugaauccuuauuaagcauuagcuacauauauauguaaagcauauuuuggguuucaggauggggaucuacaccuuccuguuaaauagaugugucaaaccaaccgauaauaguuaugauauucagggcuuuucuacuucaaaauguuuuaaaaaacccaaaaagcaaaaaccccaaaccacuguauuuuaguauguuuuguuuuucuggccaaagaagacauguuccagcagauggggcuagaaaucuacauaugauucuuguuuuaggagcaucgcaugcucugaucagaacauuuuuuuaaaaauuauacuuucauuuacacuguauuacugaagaaaauuaguguguuacagcaauguugcuucuauagugauauaauacauuuacauuuggucuuuguccuugguucccaguacagacuccuaaaaaccccuguaauuuucuaagugacaggggcauuuuugguuguaguauuugcucuuugccuucaguuacuaacacagagcuucuaaaaaucccuuggaauuucacgagugaugggaacaucuuuuguuuuaaugaggugacucucaguggguccuggacagcuucaggauggggggugguuaccagaaagaccaaacuuugauuagaagcuuagaacuuucagccucacccuuaacuucugguggacggagaggggcuggagauugaguuaaucauuaaucauggcuuacacaaugaaaccuccauuaaaaacacccagaugauggggucuggagaacuccuggguugaucaaugcauccaugugccaggaggguggcacagcccaguucuaugaggaacagaagcuccuaaguuccaggcccuucuugacuucacucugugcaccucuacaucugguuguucauuugcauacuuuauauaaaaaacccaguaaacauaaauaaaaugauucccugaguucugugggccauucuagcaaauaaucaaaccugaagaggggaugguugucauagagcugguuggucagaagcacaggugucaacugggagggcagucuuguggggcugagcuuaacuaacuggcgucugcacuaacucuggcuagugcuggaauugaacugaauugcaggacaccuuguuagugucuggagaauuggagaacuggcugguaggaggaggaagagguccccauauauuugaugucagaaguacugugaguagauagaucauacuaaggaaaaaugccuuuucuccuguaacauacugauuggagauuaaagcuauaaaaacacagauacauuuuacguuaccaagaucacgcuuuauccuguaaguuuuucugacuacaaccuauaaaucauuaaacauaguacauauacacauauaugcuuacacaccaauugccacaaaagcuucacaaaccaguauuuacguuuaucaugagcaauguauucuguuauuuucuauucuauuucauuuuucaaaaaaaugguuaacaguccaccagugauucuguaacacagugcuauuagccugaaaacauucucccuggugucgggcuccaugccacucagaccugccguucccauccucugcuguucucuucaaagacuggacauuaacaagaagcacugcuauuauuguuuucuuguuuguuuagugacagggccucacucugucgcccaggcuggacggagcgaggugcagucacgacucacugcagccuggaacccuggagcucaagcgauccucccaccucagccucuugaguagcuaggacuacagcugcgcaccagcaagcccggcuuuuuuuuuuuuuuuuuuccaagucuuuuagaaaugggagucuugcuauguugccaggcuggucuucaacuccuggccucaaguggucuuucugugucagccucccaaagcacugaaauuauaggcauaagccacuggauccacuauugcuuuuaggaauuguaagccaaagggauguggguugaguaucucagauuaugaucucugaaaaugagaccagguaaagauuuaauuccaacagacagggugacugaaaccucauucagccaacuccagaugcacgcuguucugcagagcugaaaagaugagcugggugcaacuaugggaacaaaauaaaguccacaugcuuucugacacaaagcagagucuuuuccuugucucagucaagaaugguauaaaggguuuaccauuuugaugguauaaagugguauaaaggguuuaccacuaugauggccguauaaaaauggaguggcccucaauuucgggcagaggaaagucagucuuugguccuggggacauauuaccuagucaugccaagacugcuuucucuaugaaaaguaaaaucuucaaaaaaugauguuccaaaauuacauuaucucagaccacuuuagaaacaugauuuucuucucuuuuuuugagacagagucucacucugucacccaggcuggagugcaguggcaugaucucagcucacugcaaccuccaccucccgaguucaagagauucuccugccucagccucccgagccgcugggauuacaggugugcaccacuacgccuggcuaauuuuuguauauuuguagagacaggguuucaccauauuggcuaggcuggucucgaacuccugaccucaaguaaucgccugccugggccucccaaaguguugggauuacagcugugagccaccgcccagccagaaacaucugauuuucuauuauuucccugugcuuucagaaagacagcaugcgacuugcucuugccaaacuccaacugaagucauugucuaucauguuacauaaugucuccuauaacagaauccaugaaauaacuaacuccuuaauuucagugcuggaaaaaguuauuucucugaagauauuuuuauguuuuuacucugcccucucccacaacaauaaacaacaaacacuaaaucccaggaggaguuccucuuuuaauuacugcgcuucucaaaacaaaauguucaacuagauuauucauuucagguacuucauaacauuucucuguucaugucaacuauuugcucuaauaugugaaaguauuuauuaucucauuugaaacuauguugaauguugaaaaucuacuucaaauucuuuccuggaaggaaguagaaaaaaaaaucuaaagaaaaauagauacgguauuuaggaaaauugcuuccaagucuaaggauggcccaaagaaauagccuagggacaucucugaccuaucagcuucuuccuaagaaaccugaugcacugugcugcuagacguuacaaaugaacaaagugaguugagcuuucucuuuuuuggagcugccaugaauucagguuuuuacacuuaaugccaucucggacacuuaaauacugaauuucccagguuaccccaaagcuccagcaaaaggaaaggggaaacaguagcugcacaacacuucauccuucacguccugaguucagaguaaccacacaagaauugaaagcauuccagaauccaacacaaaaaccauucauucauugcuagauucagaaucagaggaugaguaaagguauguauguauaccuuuccaaggggugucagcugcacaguaauaaaaacacagccaaaaugaaacaggcucaggggcuacuuuucagaaucaagacuugaagacagacauucuaaccuguuuucugauagauucagaagucuucaucaaguuuaaaauaucuuuaaaguugaugacuaucggcauuaaagauccucuuauaaacauuuaaguacaagguacaguucuagguauuaugcaagauacaaagguuaucaagggcuugaucuugacccuuaaguuguuacugaaggagaaaugcaaauuguagcagaaaaauucccagaaaccccuuaaggaugaauaaaaaauacccccuuaaaccuuaagaggauaaaaaagcugggcccuccucuccugcugcuuuuggaguccacccuaccgugucauuucaccgccccaugcaacugccacagccuaauaaaggcuuaucugucugcagaguuacaauuuuuuuuaacuugaugaagaauuucuaguuuguuuuuuuuuauuuuauuuuuuuuuacagucccauucuuagacuggacuuaauauugguccucuuuuucaguuuccuuagaccaauaaccaaaucuuuuauaaacucuauuuucauguguuaucaccuguauuuuguuuuuauauguaucauuaauuguuaaaaauuaagauucugaaucccuuuggauauuuauuaggcuucaaagaccuugaugaagaagucugagugacugcuaguucucuuacguuggcgguaaggcuggggugcaacgcacacugguuuagcaugagcaaugaucacuaagcacgagagccacggccaccccuacuuuaccucguucacagacagaacuggaagguugguccuggauggcugucugguccuggaugcuuuuaguggucucuucaccugugggaagucuuguuuuggaacaaauguuuccguugauacagaugagaaaugccucuuuaauauuuuuauaaaccauuuagaacccaacagauuugguuugugggucacucuccugugaguaccaaaggauuucaugguuggaaggugugccuuuucaucuuggcaacgagcagcauuuaauggagacagcaugcugguaucugacuuuuuuugguucauuuccaggaucugagacuuauucaaaccacuagcuguuuuaucaggaaggaacaaauccaagcuuugacguauugucagugugcugcauguuguauuuucaaauuccuuaagugguuuuaacauuagaugaccgauucuucggcacugaugugcuuuugauaauauaugaugagaucuggccacggcucugaggaguguggcuggcauuaccacaucccaagcuaaaagaaaaggaauucaaaguucaaguuuuuaaauuaauguuuaaaacauauauaauauuucccuagguagcaggcauauuucuguuagaaaaauuuguaaaacagauacauucuaaguuaauucuaguaaaagaacaagguuaaaaauauaaguacaguguuucugccacuuugccuuuagcaacauuuggccuucuuccuggaagauuacaagauuauaaagcuacugacauaacaagaaccuuaaaaaaaauagugaugggaccacuucauuuacuucauuagcauaucaaguauauaaaaaucugugcuggccaggcacuguagcucacacuuguaaucccagcacacugggaggcugaggcagguggaucgcuugaguccaagaguuccagaccagcugaggcaacauggugaaaccucaucucuacaaaaaugacaaaaauuuaaaaauuagcugggugugauggcagcucaugccuguagucccagcuacucacaggcugaggugggaggaucacuugagcccagaagacugaggcugcagugagucaugauuguaccacugcauuccagcccuuuuucugucucaggaaaaaaaaaaaaaaaaucaggaaagguucccagaaagaucuaagcugauucuagaaggcgaaggugcuuuucagcuuggggcugggcaugggagugcgaggcaugucagauacacacaugaacauuccagacaagguaaacagaauuucccccuuauuuacaguaugaaauguguuauuuuaaaguuagccuauaguaggccacacaugguggcucacgccuguaaucccagcacucugggaggcuaaaggcuggggggaucacuugaggccaggaguucaaaaccagccuggccaacauggcaaaaccccaucucuacuaaaaauacaaaaaaaaauuagccaagcauaguggcuuuaaucccagcuacucagguggcugagauauagaaucguucaaaccagggagggagagguugcagugagccaggauugccccacugcacuccagccugggcgacagaaugagacucugucucaaaaaaaaaaaaaaguuagaccguaguaaucaauaauucuuuuuuuaaaaauaauauguuaggugcuagagauagaugaaucaaugaucucagaauucaaagucuagcagaggaaaaugaacgagaugcacaaauugcucuaguccagagaaaggagcaugugaagaguguggcauugucacagaggugacauuugaacugagucuugaaagggcagaaggaucagcaaguuaaacaccccaggcauggaguccuauucaucuccccaucucggggagguaggagugagcugcaggagguaaggaccaaaagagccgauggccagaucaccaaaggauauauaaagucauccuaaaaaguuucuacagguggggagaaagcugagcuuuuaacucagagucacacggucaaaugcauguucaugaaacaaauuuuuggugaugauauguaggaggaaacaagacagacucugacaucacucugagcgcuuucuacaugcuaagugcucggcuucaccucauaaugaucccauuucacugauuaggaaacugagguuuaaagaggcuaagugcucaccguuaagaagcugcagagauguaacuaaaauaaaacccaggcuuucccaauuccaaagucaacacucuuacccacuaccuuguauuuacuaccucucuucaggauaaggacaaagaugauucacagugauauuuaggagguagaaccugcugcuuccaaaaucccuucaaaagcucgcauucugugcuucauucuaguccaauuggcuacuguaguucaccuuuaauuaguacuaugccaugccaguugaaccacuuaauuuugaagaaacuauaaaauauuuuagaaguuugucuacaguccuggauucuuuuuauucucuuugaguaaauucuuuuuuuuuuuuuuuuuuuugagaugggagucucgcucugucacucaggcuggagugcaguggugccaccucagcucacugcaaccuccgccuccccgguucaagcgauucuccugccucagccucccgaguagcugggauuacaggugucugccaccaugccuaguuaauuuuuuuguauuuuuaguagagacgggguuucauuauguuggccaggcuggucuugaaauccugaccucaggugauccaccugccuuggccuccuaaaguguugggauuacaggcgugagccaccggacccagcccauuuuuaucacugcaccuucuagaaagccuaagauuacauuugugccuuacacuguuuuucuaucagacagggcccuauugucauuaucaauacaucggaccuccucaucucaguuucauccauuuuacucucuaagcaccaccuccuaucuuugcaucucacuccuucuauuacccaauuccaauaauucuucaaccccaacaggacccacaagucaaugauccaaccaccuuuucacugucucucacuccccaugacuucacuuccuccauauccaguuuacacuccauggucuaccauucuaaccucucccuuauaccccuagaaucccuugcaucccuuucuucccagucuuucccauucaugagcaguaauaaguaucuuuauaacugcuaagccaaaaacgugggguccagcuugacucuuuauucuccauauccaacuucucaguaaaucccaagggccuucuagggaccacugcucaucaucaguaauaauacuaccugauccaaacugcuauccuucccauggauuauuauaauagcuucuuaaccaguuuuccugauucuguuuugggcccccuacaguuucuucucaacacagcaaccaaagugauccuuugaaguugaaucucaacgcgaaaucuagcuguggcuucacgguucacuuaauaaaagccaaagcccuccaaccaggcauggcggcucacgccuguaaucucagcacuuugggagggaucacuuggggucaggaguuccagaccagccuggccaacacggcgaaaccccgugucuacuaaaaauacaaaaaucagccgggcaugguggcaugggccuauaaucccaguuacuugggaggcugaggcacgagaauggcuugaaucugggaggcggagauugcgccacugcacuccagaaugagcaacaaagcgagacucugucucaaaaaaaaaaaaaaaaaaaaaaaaaaagccuggcgcgguggcucacgccuguaaccccagcauuuugggaggccgaggcgggugauucacaaggucagauguucgaggccagccuggccaacauggugaaaccucgucucuacuaaaaauacaaaaaaauuagcugagcguggcggcgggugccuguaaucccaguuacucgggaggccaaggcaggagaaucgccugaacccgggagguggagguugcagugagccgagaucgcgccacugcacuaaagucugggcgacagagugagauucuguaacgaaaaaaaaaaaaaaaagcuaaaccccucagaauggccugcauggcacuacauuaucuguccuuuaucaccacuuugacagcacucuccuuugcuuauuuugcuccucauucuggucucuggaucugugcacuugcuguuccuuacgcucuucucccagggaucugaaaggcucacacccucaccuccuucagauguuugcuaaaaugucuucuacccagugaagccuuccccaaccacuacauuaaaaacacacaaccagcccucucccucucccuccucucccucuccccacggucccccucuccccacggucucccucugaugccgagccgaagcuggacuguacugcugccaucucggcucacugcaaccucccugccugauucuccugccucagccugccgagugccugcgauuacaggcgcaugccgccacgccugacugguuuucguacuuuuuugguggagacgggguuucgcuguguuggccgggcuggucugcagcuccuaaccgcgagugaucugccagccucggccucccgaggugccggguuugcagacggagucugguucacucagugcucaauggugcacaggcuggagugcaguggcgugaucgaggcucgcuacaaccuccaccucccagccgccugccuuggccucccaaagugccgagauugcagccucugccuggccccccaucgucugggacgugaggagccccucugccuggcugcccagucuggaaagugaggagcgucucugcccggccgccaucccaucuaggaagugaggagcaccucuucccggccgccaucccaucuaggaagugaggggagucucugcccggccgcccaucgucugagauguggggagcaccucugccccgccgccccgucugggaugugaggagcgccucugcccggccgccccaucugagaagugaggagacccuccgcccggcagccaccccauccgggagggaggugggggucagcccccgccaggccagccaccccauccgggagggaggugggggucagccccccgcccggccagccaccccgucugggagggaggugggggggccagcccccguccgggaggaagguggggugucagccccccgcccggccagccgccccguccgggagggagguggggggucagccccccgcccggccagccgccccguccgggagggaggugggggggucagccccccgcccggccagccgccccguccgggaggugaggggcgccucugcccggccgccccuacugggaugugaggagccccucugcccggccaccaccccgucugggagguguacucaacagcucauugagaacgggacgggaugacaauggcgguuuuguguaauagaaaggggggaaagggggggaaaagauugagaaaucggaugguugccgugucuguguagaaagaaguagacaugggagacuuuucauuuuguuccauacuaagaaaaauucuucugccuugggauccugcuaaucggugaccuuacccccaacccugugcucucugaaacaugugcuguguccacucagaguugaauggauuaagggcggugcaagaugugcuuuguuaaacagaugcuugaaggcagcgugcugguuaagagucaucaccacucccuaaucucaaguacccagggacacaaacacugcggaaggccgcaggguccucugccuaggaaaaccagagaccuuugugcacuuguuuaucugcugaccuucccuccacuauuguccuaugacccugccaaaucccccucugcgagaaacacccaagaaugaucaauaaaaaaaaaaaaaaaaaaaaacacaaccagcauccauucucuuaucuuccuccacuuugcauuucuccauuguuuaacaucacuugcacaccuuuaauuuuuaguuuauuaauucauacugcaaacgaacucaguucuuaucaugugccagguauuguccuaguugcugacaauacagcugaaaauaaaauagacaaaaauccuaucuuuugaaucuuuugaaccuugcauugggagugacagacaaaacgagguaaaucaguaaaauacgugagacacaaagcuaaaggaaaaaaauaagaggaaagggcagauuuuugugucuuccuuccagaauggaagcucccugaggauacggauuuguguuuuuuccuauuauaucuccugacaauagcgcccagcacauaguaggcauucgaucgaauuuuuaaaaugaaauacaaggcaguuacucaguucccgggcacauuucaacuuuuagagaacaauuacaccaauuaagaaaaucgauuacagcuaggcuacgauucgagagcuaaguggcgcucaucuuugggaguaugccguucaauuccucaaacucaaaauuauuuuaucgauuucuacaguuaccgcggugcacuggcucaaaaaaaggguucauuaauugagugcuuuuuacucccagcuaagcugaccaaagaucacgguaagaggcaaagggucacagccgcacuggcguaacccguaacuguacacguuccgggcggccaggagccagggcgcagaccuccaagccggaccacucgagcugcuaaagaaaaggcaauacacuaaccucuccgccggaagagaagaaggaagcgccagggacgcacgcuuccucggcaggacugcagggaaagagccgcacccccagccucucacuacugcagccaacccaucuccuggaagggcgcucccgcccacccccgcuacugcgcagccgcacugaacucuggucc

SEQ ID NO: 192114 - RNA, 118561 nt, Homo sapiens
uuacagaaagaaaauccauggcauuuaauuagauugcauuuuauuuagauaaaugaaaauuugccccaaacagaacuaggaaucaaauauugucuucgacuagagguaauugcuaagcuggaagcuuauauugaaaacuaaaauuuccagcccuugacuaucuguaguuccaaacaucaaaggaaaauauuggaacaauuuaucuauguacagagagaggcaacucauggguaccauaagcaaaauaaccugagggggaacauuugauauuacaagaaguggugagaguuuacaagucuugcauugcuuucuauuguacauggcucuguaguaaugccaaaaauaacaaaauguaggcacuugcucugacuucugcaguuuacauuagauuauuauguacuucauaaauuaacagcagcuuuagaauuauaaaacaguauuauauuucaugcuacuguugguguucuucuuguuaaaauaauguucucaacggacauagauacagagcuuguacagaaguaacucugggcacauccagauaguacaaaaagcagucauaaagcagcuacucauggaaucgcaacugugauggccagcgagcaccuggccacaggugguaggaaaagacaaacgcggguggaauuuaaacaaaaacgucaauuucccacaaacuacacaaaucuuuaaucuguucaaaacagcacagaaugucuuccugccauagagaggaagucaauaugaacuuguuauaaauugcugucauuuccaaaacucuuuaguugauguucagaacuagaaaccagcacuuggauuucaaucucaguuggccaaaaaaaaaaaaaaaaaaaaauuauauauauauaucagagguuuuuugaauuuggggauuuuaauaaugaugcauggguagcuauuauauauauuugagaauaacuccuaaaagaugacuuccaacuacaaacaagacuauauauacacugcuaucaugagguguuuuacuaauauggccaauuauguaugaaguuagauuuguuagcaaaaagaaacuacuuucaguuuuaaaagcaaacuuucuuuccauuaaaacuaggcuuuccagcuaaucagcagucaaaauuuaaauuuucaaacuggaguaccaaguuugaguaaaaucuggaaagcuauaugccaggccaguucugugugucaagaguagauaagugacacuauucuucgugugacaauugucugacaaaacccuuaauguaggcugaggcaggagaaucgcuggaauccgggagguggagguugcggugagcugagaucgugccauugcacuccagccugggcaacaagagcgaaacucugucucaaaaacaaacaaacaaacaaacaaaaaaacaaacccucaauguauuagcaugacucaucauuuugacauuuaaaaaauuuuccaagauuauuucaggaaaggcauuuuuacuauuaauuaagcuuucuuaaaauuucuuucuagagacauuuguuauuguuugaaaccaaaaauauuaacacaaaaaaauugacauuuucaggaauuaccagaugguacaauuguagcaagaacgucaaucugaaaagcuacugguuuauuucaggaaagcuaucucggccauggcuuccucugaacacacaaaccagugacaagggguuucauguaaugacuacaucagaaaguucuagcuuaucaaucauuaucuuuagaauucuaaugugguacacauaugucccaggcuuccugguaucuaauaaaaccagcaaaucuaagugaagcaaauauuuuauuuaaaucagucgucaaaucacaacuuauccaaaugaauguguugcaacauuguucuuaaaagaauggcacaaauauggcacaaacacaauccaguaucuaucaaaauaccauuuguaaagaaccugacuuauuucaugccaugugugaaugcaguccagcauauaagaguagaaucaaaaacuuacaacaauucuuuucuucauaacauauaaaacauauucacuacuuugccucaggauuaagcacacuuaucgguccaaacaaccauaacaaguaggaaaaaggauguaaaguuaauuugcuaccagaauauaacuucuuucuaaccuccacuggguuagaaagaaaaauuucccaaugacaauagaacauucuguauguuucaaaaugcuuuuuaguuuuagcacacuccguguaauaggaaagugaccaauuucagaguaccacuaaauauggaccucaaucauuagugaauuuuaaagaauuguaccuugaucaggaauguuacaucuaggaggcucuguuuuucguggguuauauaacugaggcuuaaagcuccccaagccugcacuauggcacaugccccaucauauacugugugauacaaaaagcauguaguauccugcacauuuccuuaaacauuaagaaaaaaauauacaauagauacaggaggacuacuuaaaacauacauauaaauauguaaagaaugauacuccaguuucagaagcagaacuagguauugccaacuccaguuccagguuaagaauuuaggaccuuaaaucagaauuuauaugguuaucaagggaaaauuguagguuggucuuggaaagaggaaauguuaaauggcucuagcuccugaugaagccucaggauugucaggggcucucuagaaaugagaucaguugaugugccugcucuccaauucucaaaguucugaaauacuggucuucagucucagcagcagcauucauuuucuucuacuacuugucuucacauucuggucuuccaaacagacaaugaguuuaacuguaggaggaggaagaaucagcguaaauaaaaucuccuuuuucucucucauuuauuaacaacaggauaguugucaaagugaccuaauaauaccauaguuuaacuccauuaaaaaaacaaagauggggccgggcgcggugccucaugccuguaaucccagcacuuugugaagcugaggagggcagaucaugagguaaagagaucgagaccauccuggccaacauguugaaacccugucuccacuaaaaauacaaaaauaagcugggcaugguggcaugcaccuauagucccugcuauucgggaggcugaggcaggagaaucgcuugaacccaggagguggagguugcaguaagcugagauugugccacugcacuccagccuggcgacagagcgagauucugucucaaaaacaaacaaacaaacaaaaaacaaagauagggcugggugcgguggcucaugccuguaaucccagcacuuuaggaggccgaggcgggcagaucacuugaggucaggaguucaagaccauccugggggaaacuccgucucuacuaaaaauacaaaacuaagcugggcauggugguguguuaucuguaaucccagcuacucaggaggcugaggcaggaggaucgcuugaaccugggagacugagguugcagugagcugagauugcgccacugcacuccagucggggugacagagugagacucugucucaaaaacaaaacaaaacaaaagaaaacgaagauggguugagcacaguggcucacgacuguaauccuagcacuuugggagggugaggcaggaggauuucuugaggccaggaguuugagaccagccugggcaacauagcaagaccccugucugcaaaaaaauuuaacaauuagcucggaguaaugacaugugccuguggucccagcagcuauucaggagacagaggcagaggcaggcgauuugcuuuagcccaggaagucaagguugcagcaauccaugauugcaccacggcauuccagccugggugacacagcaaggcucucucaaaaaacaaaacaaagauagggcugggcgugguggcucacaccuguaaucccagcacuuugggaggccaaggcgggcggaucacgaggucaggagaucgagaccuccuggcuaacacggugaaaacccaucucuacuaaaaauacaaaaaauuagcuggguaugguggcgggcaccuguagucccagcuacucgggaggcugaggcaggagaauggcgugaaccugggaggcggagcuugcagugagccgagaucgcgccacugcauuccagccuggaugacagagcgagacuccgucucaagaaaacaaaacaaaacaaaacaaaaaccacaaagauggggaguuacuagcaacugcaaguaacuaacacagugagggucggucauuauaugcgcuggaaaauuuuuaaaaauacuuguuacuacugcuaggggaaaaaaaauccauuuuuucugaaagagcuaucaucagcuauauuucaggcaguuuaauauuagcccauuugggggcacuaguuuuuuuuguuuguuuuuuuuuuuugagacggagucgugaggcaccacgcccagccauuggagcacuaguuauuuuuaaaaaaacucaacaagauaguugagugaacacaauguauuucuuaugccuuugggucaaacacgcacaugugcacacacacaugccguuuuauuuuauucuaaagcagucacauuaggagguaaaacgaagucguucuuuucauaacaucgauaagacuaaauggcauuucaaucaccaaaaaccaugaaacuauccuagaucuuugaaucuaguugauaguuauuuuccucaacugaagguucuacacgaaggcauuaauuauuugcucccgauuccuuauguaacaaauuugccaucuauuggcauaaaagagaaaaauuaucuuagaagacaaggaagcuuaccugcaugauguuuuaagauucuguaaguucugacuuugcagauucucucucuuguuucuguaacuccuccugugcuuggggugugaucgcuuuaucugauucacugugcacuuuuccuuccugcaauucuacuuccugggcauccuccuucucuuuuuguuuugguccauuuguaucuggggacucuuugguuaagccuccugaggcaucaguaucagccagggcugaguucugguuuucagggucaucaacaucaucaccuuuuucaucuucuuucgguucaacuagugacuucucuauucuuucugcuaacaaggcaugaccaucaucuucuggcacagacuuuguuccagcuccaccucccucuuccucagaugggaggacgaccucuuccagcugcugaucauuuacaguggaaccuucuaccucaacagucauggucuuuucugaggcuucacucaugucuuuggaaauaucagaaugugcuugucccacugcgguugacucugacuccucuuuggcugaaguaauugguguuucauccugugcagaggccugagguuccucuccuucuuucuccguuuccuguccagcguccuggcugucagcuuuuaucacgugagcuugugucuguaacucagacgucaacauuucgguggcuguuucuucuguacguacaaacuggucaacggcugucuggaugauguuuuggacaaguuuacugcuuuuggucucaaguuccaaaaucccauuuucaggcucuaaauccucaauugcuacacucacuuugaccuccuggcaagcaaccugcucaucgacuucaucugacuuccacuucagugaugugguuuucucuccuuccaggucggaacuuaagccuuucuugguaguagcagauacuaucacuggugucgauuuugccugacagucgggcccugugggcacagcaucuuccccuggaugagcggcaaagucuucauuuuuuucagaggauuucucuuccagaacuaaaugugcaccugcaggcuccaacguuucaccuguuucuaaaauguuggcaguuucuccuaagaccuuuuccuccucugcagccgcuguuagagugaaugaugccucagagcucugaacuugaauuuuggugcauacugccuccucuugaccuaggcagggaggagggcuuccuuccaaacugcugacuuccuuugccccaucuaugaugggcacauucacugucuggaggagcugcuuacugaccucuucagauacgguaacagcuguuucgugcucaagcuucucuucauucacauggguuggcucugcuucuguuuucucccuuucgacuugaacuaccaucucucucuccacgggggauggaggagacuuagcgugacucugcaguucaagagcaucauccuuuuuacauucagcuucuucugucccuucaccuuuaagggcaacuucagugaccuuuucccgacugacuguuaugccugugucuauagaccccucaaguccuucgaaaaaugguacgucuuugguuuucucaucagcauacuggucagccucuugaguccccucagucuuugacagaauggauacaguuuccacugacaccucuuuaucuguaugcucuagagugucuuccaucuuugauuguucuuuaguuucuuccuggaacacaaaacuggaaggugcuggaggccucucuuucugugcaggaacugccucugcuucugugcccccugacuggguaccagaugcgaccucauucuccucauggauuuccacaaucucgucuuucuggguugugccuggugcgucaaagucggcuacgggggugcuuccaucagucucacugucuguagggguuuccaccgagucaggggggauagccuguuccaucaccaucuccugugauuuuaccccagcuaagguuucggcuugacaagugguuacaagcucacuggacucuaugcucucugugacuugaggagcuuuuucaaagcuuucugggguggucugccccaccaccuucccuuguguaaaaggcucaguuuuugccuccugagcaucuacuuucaacacuacauccgucucuuucuucagacccgacgcuucagccugcucuucuggucuuucugccucugcucucugcacaggcugaagcacaucuucuggcccaccggugccaggcagcugggauuccucuuucacuuuuucugccacugccuggaggaccucuugaguccgccucucuugcucuucuaugucagguacgccaccuuccaccuccugcaccggaguggccuccucuguggugucuggggagucgguuaacugggagacugcugacaccauuucuguggucucuucagcagcagaugcuucgguuccuucuucggcacccaauggcccugcaguuucugcagcugucacagcuucgggggucaauuccgccucacuaacgaccgugucgccccgggccucucuguucucuggcagagguucaguaaccgugggggguucuucuucugcaauuacuucucuuuccaauaccuccucaguuaacagugcggcuucagcuucuacuuguucaagagguucugucacugaagcagauauccaagaaggagaccuuucuucaauaaugguagcugcccucgucccgucagcgacagcugcugccaucauaugaaccugacucucgcugagcuccuuggacaccucaguggcugccuucugcucgggcugcucugcgcuuuuuugggcuugcugugccuccauuuucucccuuucuacagcaucauacucagacagagggaccacggccgggacaucagagucaucuucguuggccccuguuggcccugcgucuucaacaggggcuuguucuuguuucccaucuggccuuuucuuccuucguccaggaauaaacuucuugauugagacccaggauucuucuuuaccggguucagugucuggaguggaauguucuacaccagacccagcuauggagucuucgcuuuucucuuccagcuuggacuuugauuuuuuucuuggcgugacuaaccuuuuaaaugacucccagguggaaacgcccuccccuucgguagggcuuccagcuugcuccggggaggaacuucccugcccuggaucauguucuugggaaccagcaaggaucccgucuguccccgucucuuugucuuuuccggccucaucagcuuucugguggucuccucccauugcuuuuggucccccuuccucaucagaagaggacccucuccuugcucuuuucuuggaugaucccacacaaauuaaagcuucccaagauacugagguauccaccuugcgcuuugguucuuccggcuuuggcucuuccacgcucccuuucauuucuucuugcauuucagaggcugugcucucgguggaagacaagguagcgcucuugaccuuguccagcucaucuucuuuaucacuuuccgaaggccgucuaacacgcuucuugggcgucaccaucuuuuugaaugaugcccagggagugacaccuucucuuuuuuucucuccaucggaaguagcuccuucuucagcuuccccauccugcugcaccucggcuaagcccuuuuccagacacgugaucuccucgggcuccucaggggaugaggcagagcucucgcccuuuugcuccuccuggcuguccggagaaucggcuggaaccugagugugcuccccugauuccucgucuccuccuccucuuuucccuuucuguuucuuuccagaaagcuuuuuuaagccagugcugguaaaaagcuucuuuaguggacuucccugcaccuucauucucuccugugaugacagcauuuccaccucacucacaacgccuucgggggguuuggacagcaccuucucaucaggacugaggucagcucccuguguaggguccucuccggaaacacacguuucuuugagcuucaccagcuccuuggcagguucagcuuccugagguucugcauccauuucaaccaauucuucagcuggcacagacccugcuguuucuuccaccuccguuuucugcucuucgguucucuccuccacggugcugacguggacuucggccacaaccucuucuugguggacuucuauuuucucaucaaacacuucugucgccaacggagcagguuucucuucagaaggucccugcgagccacugacuugcuccucugagggcagcucaacuuucucauauucagcugauaaccggggcucgugggcacuuucugccggcuccugugggugggcuugcucggaggcggucaguuucucggaggcaaccucugccuuuccgucuucuucugugucuacuuuuucuggcucuuguuccuuuuucuucucugaagcuuccacuucauccuccuucggcuuccugaaacuggucuuuuugcgccagccggcccaaccuugagugaagaauuuuuugaagguugauccuguuucacuggucacgggacuagucggagauucugcagacuugcuagguucuuuuucuuguuucucuucuccuuccucuuugcauuccuccacugcuuggccagauucggcugggggagaaauuucugcguggcuuugcucacgcuucagggucucuucggguuucucuguagauuguuuggguucgcuuucuuuggaugcugcuucuccagccccaaggcugggguccuuguggucgccagccccugcugcucccuccccuucaucuuucuucacagugaguagcuggacagugucaggcuucucugucuuauccuuuuucacagugaauuuaaagccaacaaacuuaaacaccuucuuaaauccaauaucauuagccugggacucaguggguuguguuagcucuucuaaauugcuuucugaagaaggaaucuguucgauuauuucgggugucuccuccugcccaucaucugugaugucgugaacaaccgcugacuuaguagccaucucuuuaucggagucucuuuugcucacaucuucagagucucucuguccaacuauuaacaaaaaggggcggggggguggggagaagagaaaaggugauuacaauacaagaaaauuguuuuucuccgacagggccucacucucuugccccggcuggagggcagugguguggucucggcucacugcagccucaaccucccaggcucaaggaauccucccaccucagcaucccgaguagcugggacuacaggcacaugccaccauguccagcuaaguuuuuuauuuucuguagagaugagaucucacuauguuguccaggcugcucuccaacugcugggcucaagugacccuccugucucagcuucucaaagcagugggauuacaagugugagcuauagugccuagcccaagaaaauuaacuuuuuuuuuuuuuuuuuuugagacagagucucacucugucgcccaggcuggagcacaguggcacgaucucgguucacugcaaccucuguccuagguucaagugauucucccaccucagccuccugauuagcugggauuacaggcgucugucaccaugcccagcuaauuuguuuuuuuuguuuguuuuuuuugagauggagucucacucugucacccaggcuggagugcagaggcacgaucguggcucacugcaagcuccgccuccuggguucacgccauucuccugucucagccucccgaguagggaggcuaauuuuuuuuuuuuuguauuuuuaguauagagacgggguuucaccguguuagccagaauggucucgaucuucugaccucgugauccacccaccucugccucccaaagugcugggauuacaggcgugagccaacacgcccagucaauuuuuguauuuuuaguaugggagggguuucaccaugcuggccaggcuggucuugagcuccugaccucuagugauccacccaccucggccucccaaagugcugggauuacaggcgugagccacugcacccagugaaaauuaaauauuuuaaaaauaugaccaauuaauacuuucuuuaaugcgaggcaauucaaggauaaagugagaucuuacagagauuugcaaaucuuaauagauuaaugucuacuucuuuccaaugaccuucaaaaauucagguucaaagagaauuaucugcucuuucuguugcuuguuaaagggaaaguugacaaacuuaacuaucaaaaaauuaguuccacauaaguagucacggcaccucuaagagugagucaacgagguagugcaucuucuguugcaauguaagauggaaucccacaucacacccauauuuuaaacaagaauccaucaaguuuuagauguaacuucccacuuaacaggaaauauaggguuugaggaacaagcuaaagaacaaacaaguaucuacacaaaucuaaagaaggggacauucuaugugguaacuaaguccgaccucaacagguccccaaaagggaccagagcucuuuggagaaauuccaggcugggucagaggacguaugaagaauauuuuguuguaacagaaaggagaugcucaaaagcugauggaggugucaaaaggacacaagaacuggcuugaaggggcucccaaugcccaaacuuugaagcauagaaaagaauaauggauccuuuguauuuuaugagagugacgauuggguguucaugugcaaugugugcauugucaccacgauggcacauuacucgucugaugugaaaaagaaaaagaaagagaaugaugacauugauggguuacaacacauugaauaaaaaaagaauccaugaaucgagagugauacuaaaaaagguaaaugaggagaagggagcgcuucuuuaaggaaaaaagaaaugucaauaaauauagauauaacuuccacuuugauccucaaagucauuauuguuagaauuuuagauuuagaaaaucacaauuuacagacaccauuguaauaacucauucagucaaguaucauaaacugcuaaaaccaucggguaaaaggcugucaggaaacguacauucagaauaccaacauacacauuacuuaauuucaaaaaaaugaccuuggcaauggagaaaucugacaggcaccaccuuaaccaagugaucacauuuaacauccucaauaaugggacagaugccaucgcgcuuccuggugugaagcacugagaaggacaagaauucaucuacguggcauuccugaccaaaagguuuaaugguaucuaaucacaacgacacaaccagacaaauccacagcgaagggcauucugcaaaacaacuagccuggccugaaaugucaaugucacagaaggaugaaaauccagcagaaacacaaaaggauugucugcaaguaacuuccaaauagcuuagugggugguggggcggaugauguggcuuuccauaaauggcgaauaggucaaguguauauaaguguuuacuauauuuuuccggguuuguaauuuuaaaaucacugaggggaaaagucaagucaaugugauuuaauggggggaaguaggagggagauguauuguguuaaauuaagagauuuaaggaacacaacaaccagagguaccuggcaugauccugaauuggauauuuguuagggaaaaacagcaaaaggacauuuuugggucuucuuggaaaauacugaguaugagauuugggauuagaugagaugaauuuuaauugacauaaaaggguagagauuugacugcaaaaagcagguuaccaaacaguauauacaaugaccucauucuggcuuaaaaacaacugucucuccuuucucucucucucucucucucucucucucucucacacacacacacacacacacacacacacacacacacauauacacacacauccuucacauaugaucucugggggaugcgaaugucauuuauuuuaguuuugcuugucugaauuuucuuuuuucuuuucuuuuuuuuuuuuuuaagacagagucucacucugucacccaggcugcagugaugugaucugggcucacugcaaccuccaccucccggguucaagcgauucuccugccucagccucccgaguagcugggacuaguggcaugugucaccacaccuggcugauguuuguauuuuuaguagagaugggguuucaccauguuggccaggcuggucucgagaacuccuggccucaggugauccgcccaccucagccucccaaagugcugggauuacaggugugagccacugcccccagccucuaauuuucuauauaggacauauaucgauuuuuguacuaaacaggucaauuaaaauggacaccaaaaagaucuuaacaaaaccugaaaaaauauacuuaauguuuuaagcacaaauugaagguuaauaauuauaacuagccaggcgcgguggcucacgccuguaaucccagcacucugggaggcugaggcgggcggaucacaaggucaggagaucgagaccauccuggcuaacacggugaaaccccgucucuacuaaaaauacaaaaaauuagccaggcgugguggcaggcgccuguaaucccagcuacucaggagacugaggaaggagaauggugugaagccgggagguggagguugcagugagcugagaucgcaccacugcacuccagccugggugacacagcaagacucugucccccccaaaaaaaaaauuauaacuaguacauacaacaagacuuagaacacagcaauaaauacuugaaaugcagaaauauuuagaaauauagaaugcuuccccaaauccauacauuccuuccaauuauauaaucuuauuacucugaaaacaauuuaauuuucuuauuuaugaaauauuacaaaucuaugucuacaaauugccaucauacuacuuauuugguuuuauuuugaaacugaaccccagaaaguuaaauaaaaaacuaggcugggcgagguggcucaucccuguaaugccagcacuuugggagguccaggcagguggaucauuuaaggucaggaguuugagagcaggcuggccaacauggugaaaccccgucucuacuaaaaauacaaaaaccagccaggcguaguggcgggugccuguagcccuagcuacucgggaggcugaggcaggagaaucucuugaacaugggaggcagagguugcagugagccaagaucaugccauugcacuccagccugggugaccgagcgagacugacucaaaaaacaaaugaacagacaacaacaacaacaacaaaacugccugagguacccaaccaagucagggcaagagugugaccuagaguuuuuuuuuguccuuguaccuuguuauucucuaaguuaugcuaaaguucuuuuuuucuuuucaaauauugcuagauuuuuuggauauucauagaugaauagguuaucugggccucuuauucuucagagacucaauaagggccuuugcuucaguggugaugccauagacucaccaucuguaacagcuucgauaaucagcaaggcucauuuuuucugccaucaguaucuaagauagcauuuaaaacaaaacauuuuaguuuuaccucugagaacuaaacauuucagauagcgaagaagauuucaagaaaaacccaagaaucucauuauuuugaucugaggcgcauuccuaaaggauuucccuuuucucuuuauaaaauacacauuugugaccaacauuagacuuaacaaacaauaaggaaaaauuaaacacucauauuaaacuuugaagcaaauauucaaagagaaaguccagacaucgacgauuuaaacuacuucuacauuuuagauauauacacucuucccauuauuuuuuaaagcauguauaguauucugaaauaagaaaaugcuuuaaguuucuauuuguuccuauuauaaacugacacugugaugaauuuguuuauaguuaaauccaaaggcuuccuuaaguguauuuccaugaacuauuucuuuuuucuuuuuuucuuuuuuugaaccagucuucgcucugucacccacgcuggagugcaguggcucgaucucagcucacugcaaccuccgccuccuggguucaagcgauucuccugccucagcuucccaaguagcugggauuacagguggcugccaccacgcucggcuaauuuuuguauuuuuuguacagauaagguuucaccauguuggccaggcugguuucaaacuccugaccucaggugauccgccugccucagccucccaaagugcugugauuacaggcgugagccaccgugccuggcggucacaaaagaacuuuuugcaaacacuucuaaugccauuuaagagaugugacuuuccuuuugaaaaaguuggauaaaauaauuggaaauauacuagagaaaaaagaaaaauuccaguaacaaacucuauucuaguaugauuucacuaguacagaauacaaacauaaauuacauauccugccagcaagcaugugauuaaaaacaaacacucaucaaccucccuggaaucagaaaaugcagagacauguugcuaauauaggaguagaaagcuggugucacacaaccauuucccccucacuauuuucccuccacucuuaaaucuguguuuccauuggaaacacuucugcuucauucugaaagggccgacauguuuauagucaaaacuagggagauaaagguucgugaaccagcugccagcaggcagaacaaaacagcuauugggccgggcacuauggcucacaccuguaaucccagcacuuugggaggcugaggcaggcgguuuacuugaggucaggaguucaagaccacgcuggccaaaguggugaaaccccaucucuacuaaaaauacaaaaaucagucgugcaugguggcgcaugccuguagucucagcuacuugggaggcugaggcaggagaaucacuugaacccgggagguggagguugcagugagccgagaucacacuacugcacuccagccugggcgacugccaucaguaucuaagguagcuguuacugaacagcuauugauaguucaguacagcuuaacaauaaucaaaugcucucuuuauauagaguaagugaguuaugaguugaacacauaauaaaauguauauagaaaaauuuuaaguuguagcuggucaacuagucugcagucucuuuuaacauaaguaauccuaagagcuacaauugucagaacaaucuucgggcgccuccaugcuuugugcuucagccugauuucggccuccacguacccucugugcuggggcaaucuacucacuccauacaagguaccugcuaagcaaagccuccuaaaauaccgcuucuaucacaucaacaggcuguggacuccuaauggcuuuagggccuagagaauagucuucuaaccuaccuagucuggcagguaccuauaucuguacccgcgcuguugagauccugaccccaaaacacaugcgaucguguggccacccacugggcuuggaacccgcauugaagccuagaccguacuuuccagccugccccaucacugggcuucacacuccccauggcgcagcccaaguguugaggccuguuccauucuguucugcgucccacacuuugccggccuccaggccuuacagugagggcaacuucgcuaaauccuggugacuuuuugaggccugggucauccucgaccugcccugccgcccaccuccccagcugaccgcagccacagccauguccauuccaaccccccgacuccccuuucaagccagagucuucggggagguaggcugcuggcgcagagcguuuuggcaccugucacgggacccagaacgaggccuuuccuuucuagggcugggggcuggggcaagaucaagggcagcgggcggcucuacagccugggcugggaugccacgggcgcaggcccuucccgaccugucccugcgcgccuuggccaguagagaggcuuucccaagccugggacgggaaggaaggaggcuggaaaacccacacacacccaucucgggccgguccuaagggacaguugguggcccucgggauuccguguccgccaucgcugcggggcgaacugccgcuugggugcacgugcuacucacugcagaguuuacuccaccagggcauggcgcgcgcagcccgccggcaggggcagcccaacagccgcccgugaggcccagcgcgccccugccggcugccauagcucgcgaaagccugggcccgggaagccagccgcgaacaucacaaaagacgcagccuccccgcgcccggcgccagcccucgaccucccaggaaacccccggggguccugcggaccgccccaguggggucucuucaaacccaagccugcugaggccgaaaaccauccugcuaaccaacugccaagccgccgcugaacuucccugacacuuaauuuaaaagaaaaagggccucgaggccuggcgcgguggcucacgccuguaaucccagcacuuugggaggccaaagcgggcggaucaccugagaucaggaguuagagaccagccuggccaacauggugaaaccucaucucuacuaaaaauacaaacaaauuagccgggcgugguggcacaugucuguaaucccagcuacucgggaggcugaggcaggagaaucgguugaaccagggaggcggagguugcagugagccgagaucgugccacugcauuccagccugggagacagggcaagacugugucaaaaaaaaaaaaaagaaaaaaaagaaacaaaaacaaacaaaaaggaccucgacaauggagaaaucuggcaggcaccacuuuaaccaagugaucagacuuauccucgauaauggaacagaugucaucgcgcuuccugaugugaggcacucagaaggacaagaauucaucuuugcagcucugcugaucaaaauguuuaacggcaucuaaucacgaggaaacaaucagaugaauccacaaugaaggacguucugcaaaacaacuagccuggccugaaaugucagugucacaggacgaaaaucaagcaaaaacacaaugggguuuugucuggcaauggccaaggcaugguggaaccugcucguggguuuggcuugguuguaaagagcuuuaaguucuugaguauucgcccaugaggcuaucagucaaguucccaucacauucgcccaugaggcuaucagucaaguucccaucacaaagccaucacuuacagagccuuaugggcuagaagguggagcucaccugcucccuccaacugggacuucaaaaauagucaucugugagaacgcaaauggacagccacuugggaggacagucugcgguuuguuuucauacugaacauacucuuaccauaugaucuggcaaucaugcuccuugguauucacccaaaugaguugaaaauuuauguccacacaaaacaucugcacacagauguuuacagcaacuuuaugcauaauugccaaaacuuggaagcaaucagauguccuucaauaagugaguggauaaaguaugguauauccagacaacauaauacuauucagcacuaaaaaaaaaaaaaaaaaccaccgcugggcgcgguggcucaugacuguaacccagcacuuugggaggccgagguggguggaucaugagaucaugaguucaagaccagccuggccaagauggugaaaccccgucucuacuaaaacaaacaaacaaacaaaaauuagccgggcauuguggugggcaccuguaaucccagcuacucgggaggcugaggcagagaauugcuugaacccgggagacggggcucgcagugagcugagaucgcgccacugcacuccagccugggcaacagagcgagacucugucucaaaaaagaaaaaaaaaaagaaaaauuaguuaucaggccaugaaaauacacggagggaacuuaaauguauauagcuaagcaaaagaagacgcucugaggaagauacacaauguaugauuccaacuauaugacauucugaaaaagacaaaacuuuggagacaguaaaaagagcaguggcugccagggguugggggaggaagggaugaauacaugaagcacagaugauuuuuauggcagugaagccauuuugcaugacacuguaaugguggguacacaucauuauguauuggcccaaauccacagaauguacaccaccaagagugagcccuaauguaaacuauggacuuugggugauaaccaugugucagugcagguucauugauuguaacaaaugacccauucugguggggaauguugauaaggguugggggaggcuaugcagacguuggggcaagggacacaugggaauucuccgaacucuccacucaauuuugcugugaaccugaaacugcucuuaaaaacagucuuuuuaaaaacggucauaugacuugaccaacgucauauaggugugugguaucucaggagggccaaaggcuggcuggguagugcuuagagugaaggcacuaaaggagcaaaauacacaguuugucuuuuugaaagaaaagucaauuucauacacuuuuaaagcauaaacauucuuauuuuccauaaaucauuacaacuuuuuauaguucauaagcgccacuuauggcaagaacaaguauuucgauaugucaacuccuacacuuagauggaaaaacugcuuuaugucuaauguggacagcaauuugaauucuauuucagugugaaaggcagaguuuauucacaguuacagucaugcaucguuuugaaaagagugcauaaauccuacccacccacucacagauagugauucaaaagaucggcccgagcauccaucaaagugaaagcuggauaaagcaagaaucaaugggugcuaaagugcuaaauggaggagaggagaggauauuuacaugcuuauuguugaaagggagggagaaaagcccaauucuacaguggagaaauuggaaaacaccuuaacaucagccuacaagggacagauggacaccgcgugcaauacccugagaaggacacaacaucaccucugcaggauucuggcuuagaaugaguaaccuauggccgggugcagcggcucacgccuguaaucccagcacuuugggagugcaagguagacggaucaccuggagucaggaguucgagaccagccuggccaauauggugaaacccagucucuaaacacaaaaauuagccgggcgugguggugggugccuguagucccagcuacucaggaagcugaggugggagaaucgcuuaaacccgggaggcggagguugcaguaaacccagaucacgccacuacacuccauccugggcaacagagcaagacuccaucucggggaaaaaaaaaaaaaaugaguaaccuaaccuaaauugauauaggcaaaagaaacaucaaauaaggaaugaguagaaacggggagggaacuuauacuuugaacauaucaaagucuaaaagacaaaagcuauagaagucuuccagauuaaaagaagcuaaaaagacacgacaacacaaaaucucugacccuaggguggauauuguaaugcaaagaggaaugcuuuaaaauggacauaauuagauuagcugacaaaauuagaagcagauuauagaaaaguucuguaauaacguaaauguaugauauugauaacugucaauaacuguacugugguuaugaaagggaauaucccuauucuuggagaauacacacugaaauauuuaggaguaaaggaccaugauguauauaacuuacuuucaaaugcuucccuaauuuuuugagacaaggugucccucuaucgcccaagcaggaguaccauggcgucaucuuggcucacugcagccuccgcuuccagggcucaagcgauucuccagccucagccucccgaguagcugggacuacaggugugagccaccaacuccuggcuaguuuuuguauuuuuaguagacacagggauuuugccauggcuggccuugaacuccugagcucaaagcaauccgccucagucucccaaagugcugggauuacaggugugagccacugugcccagccuucuccagugaauuuauuaauauaucucauaccuacaugacuuauaacagaaacccguggacugauguuuguuuuguuuucccaacaaaaagaaaguaaauauagcaagcgagggaaaauguugacaauaucccacuauuugggauaggugaaucugaguaaaggguauggguguucucuguauucauuuuaguuuuccaacuuucuguauguuuacaguuaucuuucuuucuuucuuuuuuuuuuuuuuucgagacggaaacucuuauugcccagccuggagugcaauggcgcgaucucggcucacugcaaccuccgccuccuggguucaagcgauucuucuguccuagccucccaaguagcugggauuacaggcgcccgccgcgacgcccggcuaauuuuuuguauuuuuaguagagacgggguuuccacaucucuacuaaacuguagagacuggucucgaacuccugaccucaggugaucuacccaccuuggccucucaaagugcugggauuacaggugugagccaccggaccuggccugaaguuauuuuuuuuaaaaaaucacuuggaagaaugcacucggaauugcagguaacuacuaaaaauuauagaaaacaacaaaauauagagugaugauuuacccaaccugauuuuagaggaggcuauccgauauuugcuucacauuacauaccauaauauaaauuuuaucuacguauuaaacaacaagaaaacgacuuaacuuucccccaccaaagagagaaaaaaaauucaggcagaggggaagaaaauuaaagagcagaaguucuggggacagacugguguuuaaauuuuagcuguaccacuuacuagcaccggguccuugggcaaaaucucuguucuuagacauuucucaaaagaagacauacaaacggcaaagaaacauacaaaaacauucucagcaucacuaauuaucagagaaaugcaaauuaaaaccacaaucuugcaccagucagaauggcuauuuauuauuuauuuauuuugagacagagucucgcucugucgcccaggcuggagugcaguggugugaucucaguuccacugcaaccuccaccuccuggguucaagcaauucugucucagccucccgaguagcuaggauuacagccacaugccaccgcgccuggcuaauuuuuauauuuuuaguagagacgggguuucaccauguuggccauguuggucuugaacugcugacuucaggugauccaccugccucagccucccaaagugcugggauuauagaugugagccacugugccuagccaaaauagcuauuauuaaaaagucaaaaaacaacagauguucgcacagauguggagaaaagggaauauuuauacauugccagugggaauguaaauuaguaagagagcuauagaaaacaauauggagauuucucaaggaacaaaaaacagaacuaccauuccacacagcaaucccauuauuuggcaucuacccaagagagauaaaaucaguuuaucaaaaagaugccugcacuuguauguuucuugcagcacuauucacacuagcaaagucauggaaccaacccaaguguccaucaaaguuugacuggauaaagaaaaugugguccauauacaccauggaauacuaugcagccaugaaaaagaaggaaaucauguccuuugcagcaacauggaaggaucuggaggccauuauccuaaguaaaauaacucagaaacagaaaguaaaaugcugcauauucucauaaaugguagcuaaccaaugaguacacagggacauaaagauggaaauaauagacacuggguacucuaaaagggagggaggguggaagggaagugagaguugaaaaauaguauugaguacaauguucaccacuccggugacggguacacuagagcccaaaccucaccauuaugcaauauauccagguaacaaaccuauauauguauccccugaaucuaaacgaaaaauaaggccaggugcaguggcucacggggcuguaaucccagcacuuugggaggccgaggcaggaggaucgcuuuggggucaggagucugagaccagcuuugggcaacacagucaaaccccgucucuacuaaaaauacaaaaguuagcugggcgugguggugcaucuuauaaucccagcuacuugagaggcugaggcaggaggauugcuugaacuuucgagguggagguggcaaugaguggagaucgugccacugcacaggugacagagugagucuccaucucaaaaacaaacaaacaaacaacaguaaaaauaaaaauaaaaugaaaaucucuguucuuaguguccucaccuauaacauaagucacuuacauuauaggugaggacacuaaggcugguuaugaggaugaaguaucaguuggcuuucuauaaaaauaacaaaaacuuuaauauuuuugcuuguuuucuucagaauagaacgacuuauuuuacuuuuugccaauuccaaacauaaucaguauaaauuguagaagacuuuaaaauacagagaauagggaaaauuuuucauaaguacaacauccagauaaucacuauuuguguuguuuucugaauaaagucuucaaaacuaagaccuaauggcugcacaauuuguuuuucuguccccaugguuagauaauguccaauuuucaccaucacgcuuugucaaaaacauucccgaguauaaaaucauuguccaaaugccugaaugaguuuuggacagaagagggcaguauugaacagcuuucagcucugcugaaccagaaagcucuugauuuucaggaccagaagucacugaaaaucgccaauacaaaauguugaaggccgggcgcggcgguucacgccuguaaucccagcacucuaggaggccgaggcgggcagaucacgaggucaggagaucaagaccauccuggcuaccacggagaaaccccgucucuacuaaaaaaauacaaaaaaucagccgaacaugguggcgggcgccuguagucccagcuacucgggaggcugaggcaggagaauggcgugaacccgggaggcggagcuugccgugagccgagaucgcgccacugcacuccagccugggcgacagagcaagacuccgucucaaagaaaaaaaaaaaaaguugagaugcacucuuuuuuauuuuuuugagacggagucuugcucugucgcccaggcuggaguacaguggcaugaugucagcucucugcagccucugccuccaggguuccagcgauucuccugccucagccuccugaguagcugggacuacaggcacucaccaccacgccccgcuaaauauuucuaucuuuaguagagaugggguuuagccauguuggccaggcuggucucgaacuccugaccucaggugauccaccugccucggccucugaaaguguugggauuacaggcgugagccaccgcucccagcugagaugcacuuucaaaucuugugaagcugaaugugacauugugccuauuuuuuaccacccugacuuccugcaucaacauuucaaggggagaaaaggagcacauaauaguaugucucaaguuaacucccuaucuucuaguuuucuuuauuugcaccauguaaagaugcagaucccuuuucuguuuuuguuuuguguuuguuuuuguagagauggaggaacuggcuauguugcccaggcuggucuugaacuccuggcuucaagugauccucccaccucagccucccaaagugcugggauuacagacauaagccacagagccuggccagaugcagguccuuuaccccaaguaugggucaaagguggccaggacccuucuuccugugcugaccucccccuccucaccuccucuucuucacuuuuuucgcuuuccccagcccaacuguacaugacacaccaaaaucacccccacauuucccagguucuugcugcagguaaagagucccaaacaagaccaccaucauucccuucuaguuuguggugagcagaaaccuuucauuuuuuuuuuuuuuuuugaagucacagucuugcucuguugcccaggcuagagugcaguggugcgaucucgacugcagccuccaccucccggguucaagcaauuuuccugccucagccucccgaguagcugggaccacaggcgcccgccaccaugcccagcuaauuuuuaguagaaacagaguuucgccauguuggccagauuggucucaaacuccugaccucaggugauccgcucaugucggccucccaaagugcugggauuacaggcgugagccacugcgcccggccugagaaaguauuuuuacaugcucccugcaugcugguugugaaugaguuaaagacuguagcuuagugaacacagcgggaggcuguuaaaugcauuauaaaauagccuaaaagaugugggggcggcaggcaggagaggcucagaccagaggcucaacccacucccacugcugggagugaagggagugauugauaagaggccucuaaaaauaauggagggggcuuccaggacaggcagccagugcuaacccgugcaggccuggcacaguggaauccauucacaaccacccuucaucacagcuuuccguuagggcgcuucuuuuaauucaaaacuccuauggaauuuucaucugccuuagauuuguccgacuggcuacaaagaggaaaaccaaaaagcuccaucuuugauuugggaucacugauauguggauguacuuuuuggugccccuaaaaccuccucugauuuuggaguggucuuuuccacacaauguauaguuuuuuaacucaugugugauugaaugaccccgccauuuuuaaacacgcugcuauccgcccaagucucucccaugcccagaaagcccagucguggugcucacguacucacuggugcugagguucggccagaaacaauuccagcaucccacuaggucacaaagauggccaaaauguuaaagggaguggucggugugucccccguagaagccucuggagcccgaauucacaggcaccuccgucuucguacuguccugcuagucacuggucuuuucccacccuguagacacuucaaagcgcaggaaaaagacuaauccuuccaacaggccacauacccaugugugauacagucuuguauugacagggcuuucgacaucaaccauuagugaaacaacaucauccaugccuuguuucucaagagaauauuacuacagaaaccaaauauuucuauacccuucuucuggguggagacaccuaaucacaugcuugugugagacagggucaauaugcugaaaacauuacuuggaaaagauaugauaauuuuaaagaagauguagagaaagcuuucauucacuuaauuuucugaauauacccaagaaggagggaucucugcauggauauagugcauauaagaugcagggcugggccgggcgcgguggcucacgucuguaaucccagcacuuugggaggccgaggcgggcggaucacgaggucaggagaucgagaccauccuggcuaacacggugaaaccccaucucuacuaaaaauacaaaaauuuagccagaugugguggcgggcgccuguaaucccagcuacucaggaggcugaggcaggagaaucauuugaaccugggaggcggaggcugcagugagcugagaucaugccacugcacuccagcagccuggcaacagagcgagacugucucaaaaaaaaaaaaaaaaaaaaacagacccagaacuggacgugcuacucaguagggucccagcuacuugggaggcugagacaggaggaucguugagcccaggaguuccaggcugcagugagcuaugaucgugcuacuaguacuccaaaacaaaacuuuuuuuuuuuuuuuuugagacggagucucgcucugucguccaggcuggagugcguuggugcaaucuuggcuuacugccagcuccaccucccagguucaugccauucuccugccucagccucccgaguagcugggacuacaggugccugccaccacgcccggcuaauuuuuuguauuuuuaguagagaugggguuucaccauguuagccaggauggucucgaucuccuuaccucgugaucuacccaccucggccucccaaagugcugggauuacaggcgugagccaccgcacccggccaaaacuuuuaaaaagaugcaguaaaaauaaaggcuggauauggaugaagcuacuucaugcuacaacauuccggaaggaaaaauaacuugaaguuaucacugccaagcgagaccuuggguaggcuuuugcuuuauguuuuucuaagauaaaugaaaguuauccuuaauaauaaguguggaaagugaaauagaggagauacuuccuggacugaacaccucucacccuauuuuuaagaguauaaacuauucucaauuacaacauuauaaaaaaaauuauaacacuuauucaauaauaacaaacuaggugcuuuuuaauauuuuaaacagcuuugucauaacaagccccuucaagguuaaaaaaaaaaguccuauggaauauuaacggagucaaauaaaugugaaaauauaugaaaaguuacaucuuuagugauguaguaagaaaucaaaacuugaaaucauuucauguacaaaaaccucacuugggccaagaauuacugaaguguuucacacugagguguuguuaccugcuauuaaccuggguuuaucuccagauaaauguucugugaaucccgauuuauaaaaucagucuccaggucuauaacguguaugugcaaauacacauuuuccuuucgaaaaucuccauaaucuccccguccccaaagcugcaaacgcuccaugaucccaagaagggcuaagcuacaguggucccugcuggcuauguguuccccauccgcaagcuccauauaauguagagacagcccguguguucaaaaccuggagcaucaucuuuuuuuucucacuuuuccaaauacuuagcgauuaagagauaaauuauaaauuguuuucuuuuagaggcuuaaaagaaaaaaaaacuuuaaaggaauauguugauuauauacuacaaaauauuaauguuuuuauccaaaacuuagcuaucagguuucagugacaccagcaccaucauuuuugguugagaaaaagaaguacgauacugcagaaacgacauguucauuuuucaggcugagaaucaccagugcuccccauccccaggcacaucaggacggcuuacaguaacaucuggaacuaguuaucuuucccccaagauucguagcauuguccuggaauuuuuccaggaauucucugcauucuaaguccaucccuuauaggcuacacacccaaucucccuuguucuaaagcucauuaaccagaaaaccuccaagcggagauauaugcaaauucauaaaagcaaggaucccauacuggagcauauaggugacaucaucauuggaccugguguguuuuuuggggggugggguagggacagggucuugcucuguugcucaggcuggaauucaguggugcaagugauucuccuaccucagcuucccaagugacugggacuacaggcaugugccaccaugcacagcuaaaucuuuaauuuguuguagagaggaggucuccccuacguugaccaugcuggucucaaacuccuggacucaagcgauccaccugccuuggccucccaaagugcugggauuacaggcauaagccaccgugcccagucccaaucccuggucuugauauugauguuucacgaucccuuaaacaucugggcaggcauguaagaaugugggucacuaaacaaguauuagcaucuucacaacgagaaagaggucuuuugcaagguacucuacaguuaugcucuuucuagcugugaaaccuuggguaauuaucaaaucaugagaaacuuacuuuuaugauagaaaugggguuacagaaccacuuuuugcaggauuauugugaggaauacaugauaauguccacaaagugcugaacaacaccugccagacuaggcacucaggaagugguaguuauuaauccagcaguugugaaaguaucaauuucgugucuccaaagucucuugacaaggaaucugucuccauagcagaugugaaacacccaugugcaagguauuuuuuucucuuguaaaaauuauuugcaucggaaagugcauuauaaauaaucuagaacuaacaugaacguuggaggauugauucuuccccaguuucuacuuuaaagaauaaugucccuguuucucaugauacuucacaguuugcaauguaucaauauuaucaguuucaguaauguggguguuagagaaaagcgaaaagauacuugcuuaauucaaaaagcauuuuuuuggccgggcgugguggcucacaccacuuugggaggcugaggcggguggaucaccugaggucaggaguucaagaccagccuggccaacauggcgaaaccucgucucuacuaaaaauacaaacauuagcggggcgugguggcaggugccuguaaucccagcugcuugggaggcugaggcagggagaacugcuugaacccgggagguggagguugcagugagcugagaucgcgccacugcacuccagccugggugacagagugagacuucaucucaaaaaaaaaggcauuuuuaugcuggcacgccauuuacaguugaguggggaaggggaugaucaucgugucacaucacuuauuucuugucucaaagcuaacuuauugcaaaugagaugugagagaaagagaccccaagaauggcaacaguauguaaugugaauaagcaaucauuucauaauucaauuuccacugcauucauuuuagugguuuguguaaacuggguuguguguguggcaggggggagggggauaauaguauuaagugacagcuuuuccuuacuuucagaaaugcaaacuuguuccuaaguaguuccuacaaaaugccaucaguccuguuaaugaauuguaaaauuuaaacacaggccuccuaaaauaacauaguacuaaagauaacuacaauaaccuucuauaguauuuaagugaauaaucccaaagaugcaaagaccuuuaagauuucauuaaaccuuacugucaauuuaauuuuuuuuuuuuuuuuugagacggagucuugcucugucacccaggcuggagugcaguggcacaaucuugacucacugcaaccucugccucccagguucaagcaauucuccugccucagccucccgaguagcugggaucacaggugcacacuaccacguccagcuaauuuuuguauuuuuaguagagacgggguuucaccauguuggucaggcuagucuuguacuccugaccucgugauccgcccgccuccgccucccaaagugcuggaaucacaggcgugagccgccgcgcccggccaccuuacugucaauuuuuuuuuuuuuuuugagauggagucucgcucugucgcccaggcuggagugcagaggcgcgaucucggcucacugcaagcucugccucccgaguucacgccauucuccugccucagccucccaaguagcugggacuacaggcacccgccaccacacccggcuaauuuuuuuguauuuuuacuagagacgggguuucaccguguuagccaggauggucucgaucuccugaccucgugauccgcccaccucggccucccaaaguccugggauuacaggcgugagccaccgcgcccgguuguuacugucaauuuuuaaagcucucauggcuuuucaagauucugagcaacuauuuaaagaugaugauuaugaaucuuccccaucagaauaacuugcggagcaaaaaccaaaugacagcugaaacucccuuucauuuuuacuuuuuccacuacguaagauuucuugcugguaaauuuuuggaguuaagauuuucugugcacuuucuucuuaccaggaaaaagugcaaaauuuugccauauccuccacacccacauuguaagaaaaguaaauuuagaaagcaauagagccaauuaccugauuuugccuuaaaaguuaguccuucccacuauuuccauucauuuaucacuccauugggauuaucugagccaacuauuacaagcccccucaagugcucccaguuuauuaaccuuuaauuacugcuaaaacuuuagaccaccuccuuuuaccauaggaaucucaguaugcgacuaauugaauagugaauauaauaaaaaucauauuguacccaaaaaguacucagaaaaaagucaugaucucagaagcaccaccccagcugugacucccuacaauacacauuugcauauuucauucauagaaaaguuaaugaucugggggaaaaaauggagauuuuuguguuuuaaauuuuuuucauuuuguacagucuauuuauuaauaguuucgagauauggcauaaacuuucaagcugaguaaaugguagaaagguuagccaagucaacuugggggucgaauuuuaaggaaaucucaaaguaaacaagcuaaucuauaggaagugagagauaauuuuaguauugcugaacuuucacauucuuguaaauuccacuggagcgcauggcuuugcaggagcaguugcauugagaaaauuuuaaguccuagaaauucuacaguugauuaaaaaaaaaaaaaaaauguaggccaggugcgguggcucacgucuauaauccuagcacuuugggagaccaaggcgggcagaucacaaggucaagagaucgagaccauccuggccaacuuggugaaaccccggcucuacuaaaaauacaaaaauuaucugggcgugguggcacgugccuguaaccccagcuacucgggaggcugaggcaggagaaucgcuugaacccaggagguggagguugcaguaagccaagaucacaccauugcacuucagucuggcgaaagagcaagacuccaucucaaaaaacaaacaaaaaacaaacaaacaaaaaaaaagauuuggcagcaaugaucucaaauauuuaaagaauaaagaaguccuguuccuauaaaguuaaauucacaaacggaauuuaauuuucuugaugacaggaagagaaaauacgcagguuaggccacaguacaauggcauaagacuaucaaaugucaaguuagaggagcuguaagagcauucuaaaaguuugaugcguguaaguuauuugcuagaaguaggcaguaaauauuauaauucauacucacggccagauuccuagaaaguaagcuaaagaaacauacuuuuuucuuuuuuucuuuuuuuuuuuuuuuuuacuauuuguugccuaaauaguguugcuuccuagccaccgauuuuauaauaacuauggcuuuauuaaaaccaccacuuaaagcagagcuuaaauguuaguccccuaaaccaccaaguguaccuuuauucaaaguuccuaguaaacaagucaaaaugcaaacacuuguaauuugcccagaagaggaauguauucugucuaugacuacggcaagagauuaagcuuucacagcuuauuuucaaauucacacaaaucugacauauuucuauucagucggcugcuguuguuccucuccacaucccucucucccuaaggggaaggguacaaccccgaacaaaauauacuaaaggucucccauaggcacagucaagaagauuccagcucagccaaaaaugaaacacugagguugucugauucuugcugagcccaagggagaauguucuucugaagaaaaacucaguacacggagagaaauaaaugccaauaacggucccgccacugaccucccgggcuccccaccaaacgcucauucaacggaagaaagccccuuuucgugccccgugccugccguccagggaggacaaaagcgaccuggcuugugccuuaccugugauggugaugguccccagcauauuuuaaguagcacuacuguacaggagaucagcuuagcgggucccugcccuccccggcagacgccuagucuccugccugccaaccgcaggugguuucggcgggaucagagcggacugagcgcccagacacucccggaggaugggggagaaccggaggugcccucggagcugccgcagcgaaaagcagagcgcggaugcauuuccccagauaauuauaggcggacccccacccacgcccccacccagccacccacacgcgggcuggcgcuggccccucccuugcugagcuccaggacuucgggagcgcaaacuuccccgcccgggccgcacaagcagggggucacgugcuucaccuuaaagcccucccccgagcugggcucugugaguggucagcggguucugcagagucccgggaggguuuaaagggugcugggcaugaguucgaugcuggagccggcgcauuggaucuaaacgguuacuucauuccuggcaccgauuuacuaauacuucuguaucucagcuuuuuaagucauuucaaggaaauagccacacagacaguaaauucucccuccauuuuaaagacugcauucugcauccuuauguuuguuuaaagguugguguggugccaacaccucccuucuuggcaucuguagcauuugauauuuucaccaucugugucuuacgcauacacacacguugcacugcucugaagacuggcaacucucaguagugcuguuuccuaaacucuuugagaagggcucucagaagugaacuuguuccuucuaacaagugcugucuucaacacuugaccaaggcaacuuuucaaaagcagacuugagcauggggucuuuuucuaaauggcagaaguuagcuaacuuuuuagaucaaacuaugccauguuccaauuuuuagacacuaucauaucucuaacaugcaagcacacaacucggaaaucaaagccuauguuaaaaguucagaagauuucaggcagcccuagaauacuucaauucuuucucauugaagcuucagguuuguucuuuguaaagacacgagugacgaaugaguugguguggucucacaauuuuaauacacuuuuuuuguacuccaauuuuuuguuaggguggguccguuagguccccuggguuuguucccuucuuucauccuuucccuauuuaucacuucaugccuugccugccugacccauuaacaccagcucuuccccuacacaaacaaaaaggaaaguuuuacuauugcacuucucuucagagaaugaagaucuuguucauuauugcuuggggcagggaggagggaggggagccucggcguagaccacagugggcacagcaaagagaagggugggcgaggaacaggagaaucagggaaaaauggaaguccaggagagcuggcuggcauggcacguaguugcacuuuuugggcaccagggggcgcgaugcaccacacucgggcccagagugagcaacgugaaaaccgcuuccuugcugguaaccagaccuuguuacaaaaaucagcuucagccucuccaaaagccuggcuuccguuucacauccuggcaaauacccggccuggcgggaacagggaaugaugggccuuguccugacucagugagauauugccuggaagcugacucccagacccagccacugagcugcuucccaaccuuuuuucucuagagaagucucaacucuauuucacaaauugcuccaauuuuaauaaugaggcuggugugugugaaaugcugcugguacugaccauccuucuggaguccacagagccaagggggcagggcaacuuggccauuccucuccucccaaucccagccccagaguguccuggcugugcaaaucauggauaaagacgacuugggauguugcaucagggucuacauuaauaagucccuuccccagagaugucccaggagccgugggugaucugggaucugagggcuugguucugcaucauuucucagcaccagugguuggggacaacacaaggcuaucaucuggugccacuucugaaaucgagucugcccuugcagagcagaaugaaucuccagcuccucuccuuucuaucaguccaaauucuaacacugggacaagcaacagcuauuccacugagcuggauaggaagaaaaagaaaaacacacaaaaugucacuaguuacacauuuaauacccuaaacaacauuuucaaaggucacuguacugcuguucaguuuuggcacugaaacauuucuuuuuaugacauucaugaagacgcuaacacaucugauuugauuuuuuuuuuuuuugagauggagucucgcucuugucacccaggcuggggugcaaugacgcgaucucggcucauugcaaccucugacccccggguucaagugauucuccugccucagccucccaaaaguagcugggauuacaggcgcaugccaccaugcucggcuaauuuuuguauuuuuaguggagacgggguuucaccguguuggccaggcuggucuugaacuccugaccucaggugauccacccgccucggccucccaaagcgcugggacuacaggcaugagccacugcguccggccugauuugauauucuuaaagaggcaauuaaaaucacaaggcagagcaauagaucauguggcaaguuguagacucucucagccaaugggucuccuuugaucucuaccucuaagaaugaucaaggacagggugcacggcccagcugcccagcgagccucugugugucugcauuuacaaagaaaagucaucaauuaggauaaaagcaggaguaaagaugagaccuaaggucacuguccaaugcaggagacuuucuuuuaucauuuccauucucuguuuuuguuaaauuaggauuuuuagaggaagacaucaccacccaaagcaagaauuauaggaaacauuuugcuguauaauacauagauggaugauagaaaacguguuuucccaaaucagaaugguucacucaacaaauauuuaccaaguuguugcuccauauuuauuacgcaaaacacccagggaucuaaaugagauacuaucccuggccucgggagcucagucauggauggugcacacacccaguggcaggagugggugguggacacgcccaguggcgggagugggugguggacacgcccaguggcgggagugggcagcucuaguuuggcucaccucugagguagccuuggagcuggucucugaagggaugaggggacacucccuaccuggggcacaaaggaaggcgguccauagggacagacgagcaugggcagaggcagagaugccaagagcaggacauuugggcaaucaugaguggguuccucacagcuaugagguucggaguuuacuuagggagguccgggaguugggggcuuggcggggaagacaacacuggagaugaaacuaaaaauauuuauaaagggucuugaaugacauguuaaagacuuuguaacaaauuauccauuaaaagugagcaaagaaucugaguagccauuucucuaaagaaaauauacaaaugaccaaugagcacaugaaaauacguccaacguuauuagcccuuagaaaaaugcaaaucaaaaccaccucacacccacuaggaugacuauaauaaaaaagaaaaaagacaacagguugggcgcgguggcucacaccugugaucccagcacuuugggaggcugaggugggcagaucacgagaucaggaguucgagaccagccuggccaacaugaugaaaccccgucucuacuaaaaauacaaaaauuagccgggcgugguggcgggcgccuguaaucccagcuacucaggaggcugaagcacaagaauugcuugaacccagagggguggagguugcaguaagaugguaucgcaccacugcacuccagccugggcgacaaagugagacugugucaaaaaaaaaaaaaaaaaaaaaaaaacauaaagcugaugugccugguuuaaaaaacaggggcagguggcggggggcaaggaagaccacaauaacaaggaauggagaagguggaacccucacacaucgcuauugggaagguaaaaugguacagccacuuuggaaaauaggcugguaguuccucagaauguuaaacauaaauuuauuauaugacccagcaauucuccuagacauauaaccaagagcaauggaaauacacacccacagaaaaacuuguccaucaauguucauuacagcauaauauuccuaguagccaaaaguggaagcaaccuaaauaucuaucagcucaugcagggauaaauaaaauugagcuuguuuaauggaaauggguuaguaauaaaaaguaauaagaaauaaaguacugaaacaugccauaacauagaugaauauugaaaaaacuuuaagugaaagaagcuagucaccaaagagcauacacgguuuaauuccauuuauuugaaaugucuacaagaggcgaauccauagacauaaaguaguuagugguuaccuaagacuggggguuuuggcgggagagggagugacagcuaaccaggauggaguuucuuuaugagguaaugaaaauguccuggccaggugugguggcucacaccuauaaucccaacacuuugggaggccgaggcgggcagaucacuugaggucaggaguucaagaccagccuggucaacauggugaaaucccaucucuauuaaaaauacaaaauuuagccagacauuguggcgcacgccuguaaucccagcuacucgggaggcugaggcaugagaaucacuugaacccaggaggugaagguugcagugagcugagaucgcgucauugcacuccagccugggcaacagagcaagacucccucucaaaaaaaaaaaagaaagaaagaaaagaaaaugucccacaguugauugugggggugguuauacaacucugugaauauagcaaaaaccacugaacuguguacuuuaaaugggucaacugcauaguaugugaauuacagcucacaaaagcugguuuguuucuuuaaaaaagaacuuugugcugcugguucugaagacuauagggagccauuggaggcuugaggcaggggaugguggcaccgaauuugacugugauuuagaaaaggcaaccaggcugugaugacgggaggaagagacugaagcaacaaaacagauggaugcaguagugacgaaggugagggaggaguccaaagucacggugcccacaagaugaaagaugcagugcgaaucugugggaucacccgaacggaaugauguccaugaaauaagaauggccuggaacccugaggaagaggaaucugaaaaaggacccugggaauggacagggauuaggggcaaugagggagaaaguggcagcaaagccacauguggagaggauuaaaacauggaaacagugguccacagugugacagcacaaaguagugacacaggccgggcgagguggcucaugccuguaaucccagcacuuggggaggccgagaugggaggauugcuugaggccaggagugcgagaccagccugggcaacacagcaagaucccaucucuauaaaaaacaaaaacaaaaaaccaagcagugacacaggaagagaacgggagaggccucggagugggcagucuggaggcgggaccaguggacagauggcugcaauaaagcaggcuacuuuccucuauuuuuccugaaagggaggggacagggaccacuacacucagaauuaaaaccaauauuaggcucuccaacuuccuccaaggaugcuuagguauuuaacccaaauaugagugucacggaauggaagaauggacuugcacacuaaauucaacccucccuggccuccucuccucucauuuucucuuuaaccuggcaucgcccuuggaggaaaagaagccaaaaaccaguagggucucuuuucuucuugcuggaaaaggacagaugaaauagaacagagaaucgaugccacuguuauuccuuuaaauggaccuugagcgcguguuuggagguucuagcaggggagcgcagcuacuuguacacccuugaccgaagaccaguccuccucuaucagggauggucauccucuucaaccaagugugcagcuucgggagggacgcccauggaguggugagggaggaaggggacacccgccuagccagcccgaucagccaagucaacccuggcaaucaguggggugaccucaccuccuguuauuccuuugaaaugcuccaagauaauuuaaaguugagugaaauacagcuccaaauuggauaacuguaaaagaggagauauaucucuauauagauauauauaucuauaucuauauauauauaucuauauagagauauaucuauaucuagauaguuauagauaguagauagauagauagauagauagauagauagauagauagauagacagacaccugucuuuuagauucaggguguguauagauagauaucugucuguaucuaucuaucuauacacacccugaaucuaaaugacacugucagguuaucuacaggaugggcaggcucucugcugcaugcuaugcacauagauaaauaucaacuaauugaguuuuaugguccaguugaacuggacauguuuguauagacaugguuauugcuauucaaaauccaagauaaauacucugaagaauaguuccucaaaggaauuguuaugauacaacagaaacacuaaaagagaauuuuaaaaucacuuuaaaaagcaacgggaaaauaaacauuaaaaacucaaauaauaaaagugauguagaauaaauauuauuucucuccuugaguccacauauauuuauuucuuuaccuaggcaacucuaugaaauagaccaaaugaaaagguauagauauauguaaaaaaauuucccagaaaugagguacaugaauuuuucuuuucuuuucuuagagacagggucucacucugucacccaggcuacaguguaaauggugagauucauuguaaccucaaccuccugggcucaagcgauucuccugccugagccucuggaguagcuggaacuacaggcaugcaacaccacaccuagauaauuuuuuuauuuuuauuuuuuuguagagacggggucuugcuguguugcccaggcuagucucaaaccccugggcucaagugauccucccaccuuggccucccagagcacuggaauuacaggcaugagccacugcauccagccaaguguaugaguuucuagaccgaaagagcucaaagaaccccgcacauugaauggaaacggauucacguggagaguccucauuacaagauauucagaaaacugaagaccaaaaggaguccaugagcuacauaagggaugaagacucgaaacagcaucagauuccaauggccagacaucuaucaagauaacacugacaaagaauccuaagguauuugaacauacucaacagaaauggacuugauuaggggaauacuuaggaccaggauuuugacaagcaugagaagacaucauacuuuuuguucauuguccuaguccauuugggcugcuauaaaagcaccauauaaaccagguggcuuauaaacaaggaacacuuuuauuuuccacaauccugcaggcugaaagucagagaucaggaggccagugugguugggaucugguaguccuggauucuucuggacugcagacugcucccuguaaccucacauggugaaagggaaggacacuaaucccauucaugagggcuccacccucaugaccuaaguaccucacaaaggcuuucccuccaaauaccacaucaccuuagaguuaggauuucgacauguacguuuagggggacacaaaccuucaguccauaaugcuaagcuuacacggugaggucacagggcuuggcaggaggcugcuugagagcaaaccuuggcucugcucccugacuauuugguuggacacuaucaaucugccacuuuauuuacagcuaacaguuaucuggaaagcaggaauucucuugcucuaaucucuagcuacugcuuuguguaaggcuguaugcuaaucaucuuguugagugaaguaccagaagggugacugaucauuccaggguuaggaauccaugucaacauauauugauguuuucuucacuuuauuugacuucagcucauuuugcaacauccuugagguaagggauucccuuauaccagcagucacauacuucaguaucaaugacucauguccuccagucaauucuuucaguauauaauauuuggcuuaaagcaaacuaaguuguucucauguuuuaaagagucugagaaagaaaugguucuuaaaacuggggauacugaaauugaaacccagugauguuuggcaagcuuccaucaagcacauuccugucugaaauauauauaagcccuggaguuuuucuuuuaaugugagacagguuauuuucucgggagauguuuugccuagagaagaaaagauuaaaggaaagacaugauaaauguuuucaaauacuuagagggcugccauguggaaaaaggaggugaguuuauucucuguaguuccacaaggcagcccugggaacagagaagagcaguuggagggaggcauauuuuagcuccagaggaauaaauggcuuccuuuuauggagaaaacuccgcaaaccuucaagugguuaagcagaagagccuccugcacagggguaggcuccugguucagagccucaaagcucccuucuacuaacauuucucuguucccaaaugugaauuuccaguggaucacucauggaggcgguguuaugagcugaacugugucccccacaaaauucacauuugaaguccuaacucccaguacuugagaaaguuacugcauuuggagacagggccuuuaacgaagugacuaaguuaaaaugaggccauuagccugggcccuaauaagaacaggaguccuggccgggugugguggcucacgccuguaaucccagcacuuugagaggccaaggcgggcugaucacuugaggucaggaguucgagaccauccuggccaacauggugaagaguagaaccccgucucuacuaaaaauacaaaaauuagccaggugugguggugcaagccuguaaucccagcuacucaggaggcugaggcaggagaauugcuugaaacccagagguggagguugcagcgagccgagaucgcgccacugcacuccagccugggugacagagcgauaccgugucucaaaaaaauuauaagaacaggaaauuuggacacaccaagagaccaggaaugugcaugugcacagaggaaagaccaugugacgauacagugagaaggcggccgucugcgagcaaaagagagaggccucaggaggaaccaaaccugcaacaccaagaucucggaccuccagccuccagaacugugagaaaauaaauuucuguuguuugaaccaccagucgaguauuuugucaugacaaccuuagcaaauuaauacagggggauaaugaccuuaugccugcgguuggucuaaauauugcacguccauguuaagacacaugaaagcaaccaguucacucaauuaauucaaucuagcacauagcacuuuucaccugaaugacuaaugcaugcacugguuaacacuagaggucggaggaaaacuaccugauaucaggcuauacugauacuugaaguaaagagcaauuugaaaacaauucgaagcaugauaugcaggaauaaaucuugauuaacaggcuaaacaguuguugaauuuuaagcccagagaauauaucuucagacauuaucaaagcauccuuuucuauaugauaugguuugucuguguccccacccaaaucucaucuugacuuguaguucccauaauccccauguuuaaugggaggaacucagugggaggaaauuuaaucaugggggcaguuacccucaugcuguucucaugauagugagugaguucucaugagaucuggugguuuuauaagggguucuucccccuuuugcucgccacuucuccuuccugcugccaugugaagaaggauguguuugcuuccccuuccgccauuauuguuaaguuuccugaggccuccccgccccugcagaacugugagucaauuaaaccucuuuccuuuauaaacuacccagucuugggcaguucuuuauaacagugugagaauggaccaauacacuauaauacagggacaucaugcucuagacuauaucauugccuuaaucauguaaaaguuacuauaaauuaggugacacugaaauuguuuuacacucaaggugagucaguccuugagaaaaugccuaaaagauuuucauuccauaaauaaaacagccacuacagucugaauguuugugucccuccccacaaaaaauuucauauguugaaaccuaaucaccaaggugaugauauuagaggguggggccuuugggaggugaucagccucaggauggagcacucaugaaugggauuagugcccucauauaagaggcuuaaggguguuuguuuguccccucugcccuucugccacaugagaacacauagguggcaccauccagagaaagugggaccucacaagacucugauucuguuggugccuugaucugggacuucccagccuccagaacuauaaguaauaaauuucuguugcuuauaaauuaccuggucuaagguauuuuguuacaacagccugaacggacuaagacacagcuaaaauaauugcaugucuccauuaguggcuuaguuacaaucagagagccacuccuuguggaccaccucagucccuucaaggaaaagggccuaaaucuuuuuuuuuuuuuuucuugagacagagucucacucuguugcccaggguggagugcaauggugugaucucggcucauugcaacccucgccuaccggguucaagcgauucuccugccucagccucccgaauagcugggacuacagcugcaugccaccaugccgggcuaauuuuuguauuuuuaguaggacgggguuucacuauguugcccaggcuggucucgaacuccugaccuugugauccacccaccucagccucccaaagugcugggauuacaggcgugagccacugugcccagcagaaaagggccuaauucuuagacuguuacuugggcaagccuacaggcugacuugccuggcuccuucucaaaugggccagaacauggacccaauuugaaaguggacuugaguggccuccgaacuauagagauuuauagguaacaucuccaaggcugacugaaaaucuuuagggcaagcagcuauggcauuuaccaacuucuuucccccaucccuggcuauaaccaaucccuauuacauaguccugaccgccagucauucagcagaacacauauggggggaugagaggaugacguuuaguggccacauuugugaagggauuuaucuuauucuuugacaccaagaggauuauguuucaagauauuuuugaauaaaauuccccccuugaacuuuuuguuuaauuaaauuaaaacuucaaauauagaaaauggcuuuuaagaucagauuagaggccgggugcgguggcucaugccuguaaucccagcacuugggaggcugaaguggguggaugacuugagguuacgaguuugagaccagccauggucaacauggcaaaaccccaucucuacuaaaauacaaaaauuagcugggcgugguggugcacgccuguaauuccagcuacucaggagccugaggcaugagaauugcuugaacccaggaggcagagguugcagugagcugagacugcaccacuguacuucagccugggagaguucggagacucugucuccgaaaaaaaaaaaaaaauuagaaaagccauaaaaguauuuuuauaaaaaggcauaacggaauuaccaaguggauugcugccugcuucaggucgcuugggugucuucauuagcuaauccacuauuucauuuuuaguacccauauaacuagucauauugauauuagccacagaauuucggagauggguggggaugcucauuucauagaugaaaacugacuugcaaugagauaaagaaauguauucaaaucaagaucacgcaaaaaguaguaauuaaagcagucuuagccgugucuagcgcccuagaauuaguugauuuacgaaggggagaaagggugaacagaagucuugcuguccuucuuccucacuccuuuuguuaagucagaaggaaaaaaaguucacugcacugucagacuugaauauaguucagagaaaaacaucuugacugcugauuacaggaaaauaaaucucuguuucuuuaaggaugaaggcagugaaauauuuggaccagaaauuugucaaugacauaaguaauuucagugcagccacacuaaaaacaauugcugcagagcaggagaaugaauuaaaaccaguucccagaaaucgcauagcauaguacuuuuaccuaaguucaaggccuauuuuguguguguucccuccagucuucaaaacauuacaaaacaggauacagcuugagaaaaugucaugcaauaauauuguauuugaaauaccaaagugugugcaaggggaccccucucuuuaucuauugggcacuuguguuugauagcguuacuaggaauccacauuuaaucacgugcaggucaggguccuauuucauguuuccaggcaacaccuggcuaaccaacagcaagcaccugugagaacccagcauggugcgauccuggaaagggucuggcuuugucagugcugaugcaacaaaggaaagagagccuuggauaaaauguacaaagccgcagucuuuaagcaggaaaugaauugauacagaguuaaagccaacagcuccuccucaccuagaugauuauaaauguaauacugugaacuccaacugaaaacugugucuucauuuauucauauauuugcugagcgcuaccucuguuccagcuacugguccaggcucagaggauucagcacugaacuaaacagccccccucaccccaucuccugccauggaccacccuccgaauccccaucccaagaaaacucugcccucaugauucuuuuuuuuuuuuuuuuuuggagacagagucucccucuuguagccuaggcuggagugcaguggcacgaucucggcuuacuacaaccuccagcucccggauucaagcgauucuccugcuucagccucccaaguggcugggacuacaggcgcccgccaccacgcccggcuaauuuuuuuguauuuuuaguagagacggaguuucaccguguuagccuggauggucuggaucuccugaccucgugauccgcccaccucggccucccaaaguguggggauuacaggcgugagccaccgugcccggccguccucaugauucuuauauuuuauuuuauuuuuugagacagggucucaaucuguugcccaggcugguacaguggugcaaucauggcucacugcagccucaaacuccugggcucaagucaagcgauccucccaccuuagccucccaagcaacuaggaauacaggcgugcaccaccacguccagcuaauuuuuuuaaacguucguagagacaagggucucacuaugcuucccagauuggucucgaacuccugggcucaagugauccgcccuccucggccucccaaagugcugggauuaccguuguaagucaccgcaccugggcuugauucuuauauuuuagccaaagugugggugagagacagaugucaaaugccagauguuaacaacugguguagagaaaaggaaaggaggaguggagggcuguaaugugggugacaggcacuucuaacaagauaccaaugaugucacaauuugaaaacugaaauagaaaaggaaucaaaucauaaaaauauuccuucugggcagagaaagcagccucuugcagaggaaacagguauggggugggggagucaucuuugaagaggcucagagcaggucuuagggugccuacuauacagauaaaguuauuaaauguucaaagcaaagaagaacgacuuuuaacucagaauggauuuucuguaagguaacaagaucuuuagggagggcugggauuaucuggcgguaaucuuucggccuuucuguuucccagaggaacuguacaccaggagcugguggguucaaauggcaaauuuaauaaaagcagacgaugacauuaagcgccauuagaaaaaugaaauucucuaaaguguuguauuuguuacuauaucugggggaaaauacucagauguagaaaaguggaauccuguaaaacguuaagaaauacauccccucaaagacuucugcuuuaagugacagcauuuugaggguuuuuguuucucauuuuuccccggggguggggggugugaucacagcuggugucacaguggcgguccacgugcacacaccgggagccgccucuauaccguuaucugauuaguguaacaaggccugguucaucuggucacuggcugacaguuuuaaagcagcuagccccagaguggcaaaugccaaggucagagcacccagcugcuuccugcuccauugcugcugguguaaauauccucaacucuggguacacaagaggugugaacagaaauuacuuaaggcuggcugugguggcucacuucuguagucccaagacuuugggaggcugacguggaaggaagcuugaagccaagaauuugagaccagccugggcaacauggcaagaaccuguuucuacaaaagcauuuuaaagaacuaucuggcgcaguggcacaugccucuagucuuaacuacugggaaggcugagccaggaggaucacaugugcccagaaguuugaggcuacgucgaaccaugauugcacuacugcacucugaccugggugacagagcaagggccucuuuaaaaaaaaaacuuucuaaagcuaaggaaaagauugccauugucuguuugcucacagaaacaaaugugaccugugaagguuggagaaaagcugguuuucacaugcuuuaaaauguuugcuguacguacucugcagagacgcaaaucucaaaaagaaaacaaauaacugcauuguaagugauuaauucaaauggaugaagaccugagauaaucacuggauuacuuguauauggcaaugaguuuugcagacacuuuauuucaaaaucaaauaugcuauuaucaaaauaaauaagguguugcuuuuugaguaacugauuuuccucaacuguucggggaaaaaaaaaucaucugccuaacagauacuaagauugaauuucacguuuaaauuucaaaguuguucuaauuaccaaaaguuaaaaaaaauauagagacaggguuucgccacguuggcugaucucaaaauccuggaccccagccucgaccuccccaagggcugugauuacaggcgugagccaccgcccccagccugcaaaacuuuuaaaucuaaaauuggucucagcccaagauacaauguuuuaaaaaucauuccuguuuggguuucuguuuuguuuuuguuuuuuuuuugagauggaguuucgcucuuguugcccaggcuggagugcaguggcgugaucucagcucacugcacccuccgccuccggguucaagcgauucuccugccucagccucaugaguagcugggauaucaggcaucugccauccacgcccagcuaauuuuuuguauuuuuaguagagacgggguuucaccauguuggccaggcuggucuggaccuccuggccugaggugauccacucgccucggccccccaaagugcugggauuacaggugugagccacugcacccaggcucuuguuuggguuuuuaacaaagagaagaccguacaagccauagacuauaaaacgauugauaauuuggguugcggaaagggagcuuuucuuuuucuuuuuuuuuuuuucaucuuuucgguagaagcagauuugccccaaaccaauggcacuugugcagucucugugaaugcugggaacagcacagcaugacagcacuuuuuaguuagggagaggaagcccaguugcauuucuauauaagcuguuuguauaaacugaaaaucccaaagcucagaagaaagggacugcucgccaaggcuaagguaauuaguuguguuuauuuucauuauaaauaaauguuuguguccaugccucauuguguaugcucuuauagaaguccaccaaaugacauaaucaagcccccuccccaaaucuacauauaucagacccugcuguagaguuuagacaauauuuauaugcgguuccuucuuucuaacauuuaagaaaguuuacaaagaagcagaauucuguuuucauuauaggaggaggguugguucugaacuaccaguauuuccaguuuuagaaagagcaagugaaucaaaaugggaaaaaaaauuucaccucuagcuuugucugccacuguaaaguaaaaacccuccaguaggaauggcccuuguucauuauuuucucccaucaguugaucuugcuauuuuaucuacagcaggaccaaauuccacugugggccaguccucccagggaccaaaaugggucaguucucuucuuauuuaaguggacagugguagaaacaaaggugucccaaauccuacaggucagugucacaugccaaauuaugccuuugucuauccuacagcaaacugucauauagaauucugauuucuggaagcaaccauaaagccuaaucaugagcgagccgggcacggugacucaagccuguaaucccagcacuuugggaggccgaggcaggcggaucaccugaggucaggaguucgagaccagccuggccagcauggugaaaccccaucucuacuaaaaauacaaaaauuagccaggcgugguggugcaugccuguaaucccagauaccugagaggcuaaggcaggacaauugcuugaacccgggagauggaaacugcagugagccaagaucacgccacuguacuccagcuugggugacagagcaagacuccgucucaaaacaaaacuaaacaaaaaccuaaccaugagcugucacugaugucaaaagcacggaaaaaugcuguuuaauaaguuaacacgaagauucugucuguauuuacauugucaggcuauuaauuaucaucugccaggcagaaaaaaauagagaaagaaaaaaacagaaggaguaugccaaguugccacagagaaccuaauaaaccaagagaauagcaguuggaccuaaaacagcaaaagcucaccccaaaaguaaggccuccagaaacaccucugguggguagccucuguagcccugggcuaugguauggaggcacaucuaguucuuuuuuccuagaggucaaggccuuuucaagaucuugggaaggacaagguauauuaauuggcuggucacgguggcucacgucuguaauuccagcacucugggaggcugaggcgggcggaucacuugaggucaggaguucaagaccauacuggccaacauggugaaaccuugucucuacugaaaauacaaaaguuagcugggcaugauggcaggcaccuguagucccagcuacucaggagucugaggcaggagaaucacuugaaccuggaagacagagguugcagugagccgaaaucaugccacugcacucuagccugggugauacagcaagacccugucucaaaauaaacaaacaacaacaauaacaaaaaauguauaguaauuaccacucuuccacagcugggcguggcggcucacaccuguaaucccaccacuuugggggacugaggcaggcauaucacuugaggucagaaguucgaaaccagccuggccaacauggugaaaccccauuucuacuaaaaauacaaaaauuagccaggugugguggcacgucccagcuacucaggaggcugaggcaggagaaucacuggagccggaggcgggggaugugcgcggggaggcagauguugcaguaagccgagcucaagccacugcacuccagccugggcgacagagugagacugagacaccaucucaaaaaauaaaaaauaaaaaucaccacccuuccugcaugggggauuugauauuugcucagaccuccgaggccauggucagaagccuaggucaccucagggagacgauggaauagucacaggggagggacugaaucacucacugugaaaaucaguguuuacccacguggcugaaauguaaaagaaaucacaucuggacuaugguaagauaaccuuaagaccuccaguaaacaugccacagauuaaaaaagaauuuccaggcuauuugggauucuaugaaaaaaacugugucccugccccaucccucccuccucuuauacauccuacagaucaccuaagucagacaagaagccuccggcaccccuuugguggcauaguucagugaucacacguuguccacuaaauacuuucuaaacuccacucugcuuucagggcccuguuaucuggccccuuuucccuucugggcuuucauucuacacccuucaauaaaaacucuuugcaggggcuaggcuguuccaacacaccagccuccgaaccugcccggcacagugagagcacagugguuaagugguuuuggaaucugcugaucuggauuugcaucuugggaacaauaucaccuacuucauaggguugcuguaacuauuaaaggugauaacgcacaaaaggcaccucucugggcccuauaauaaaagcacauaaaguguuggcuguuauuauucuccucacuuuugcugacauuccuuguuuacacacaucuaaauccagccucccccuaaucuccccucucaccucaagugacugcuccaccugaacccugcagcucucaucccuugcacaauucauuugguagucaccaaguugccuugucuuaaccuuacagacuuggucauaguaagcucacauguugcuggugcuugacuugauucaaaaguuaacaugggaaagacaaagcuuuggacuugggaauuugaguuggguccauuccaaucauuugggugaaaauuauuugaaacucucacacuaggucaugcaaauacuccgccugugagacuguguauauuucuaacuuuauauugugccuguggugcuauauacagauaaguauucccaccaacuucaaaagcagcucccugcuugaagcagcucugugggggcaucaaacaagaagaaaaacagguuccacauguuugaagaaucucaucuaagugaggcgauguugaaucuccugugaaaggacuuuucccuucauuugucucucuuauucauauuacacgaaucaauuuaccguaugccgaaucaucauuuuacauauauuugauagcaguuauugguuaucccuuuauuuauaauuaaauggaacaacgagcucaagguccuucuucaacaugcagccuuucgcuuuucacaagagacuuacugggccacaugcucucaauucugaccucaagauacgguuccucacccccuauauggguaaaaaucaaaucccaauacuguguccaaacggucacucuucaauaaccauuccucgaagaucucuaggcucaagagcuauaaaacacgcagcacaucauaguuuaagcaaagagggguacgugccuugcaaugcgccuaucagaaagaguuguacaaguauagcaggcuccucucuagagggagagauaaugacucuuuuaaagcaaccaugacuucuguuuccaacaagaauucacauucaacuccagacaagcaguugggacaaagcaacaauaauuuaaaaagcaucaaguuccagauaagaaaaaggaaacauaacuucaaggucuaaguauaggggguauccaaauggucagauaaauacuuccuuuuguaaccaauugauuguuuuugcuguuaacaccaauccaccaccaggcaguaugacagaguauuuucugcugaguccaaaguuuguugcaagugcugugugccuuccaguuccuggaggggcggcuuacccucugugacaaugacuucuucuuccuccuggcuguuuagggcuccuugaccguucagggcuccuuucuggccauuuaggucacccuccuggaggcugagcucaucuugcucagcuacgccauugaugguggacagcugaccauucuucuguaggagcuauggaaaagacaaagccauagaaacuuaauuucaguccucaugaccaagucagaaacaaggcauuaacuuccagaauacaaaccagugaaagaagaaauacagagaaaaggaaguucaaaaacaaugaagaguuaagucuuauauuugucugaaagauccagcuaccuuacaagcagauagggccuuguaucuggguaagugugcccaucagccauucauccacucauuaauucauucauuggaacaccagauacauacauucaccuuuccagaccuauuucaaauauaaccaugaaaaaaucagauguguuucccagagcuuugagcuuacaaauuacuauggaaggcagacuuaaaaaccucuuuuuuacuuuaaaauaauaaauaauguuuccuugugauuagaugcagguuaagcauaauugacugaacaagucagaaggcagacuuuuaaacaaauaauuacuaaacugcagcuguggaaacugucaugaaggaggcauacauagaacaaauaacaauaaacagagcccuugagaaugaaucaaguagguuuuaaaaaaaaaaaaaaaaacagcccugacugaggcuggggguguccaggacuucucugaggaagcaaugguaaagcugagaucucauuuccacaggcaagggcuguguaagaaaaggauaaacggggugcagagaagggaggccgcuuggcgcgaaggccagugcucccagagcccagcaagcaaacaagacacauauaacauguccauuugggucauuguuuuuuccuuaaaaauauuacuacaauggucauuugcaauccuccccauaggaugcccugugcaacugauggcaucaguuucaaaaucagcaggcauggccgggcgugguggcucauguuuguaaucccagcacuuugggaggccgaggcgggcagaucacgaggaguucaagaccagccuggccaacauagugaaaccccgucucuacuaauaauacaaaaaaauuagccaggcaugguggugcaugccuguagucccagcuaccugggaggcugcagaaggagaaucacuugaaccuggagguggaugugggagguggagguuacagcgagcagagauugagccacagcacuccagccugggugacggagcgagaaaaacaaaaaacaaaaaugaaaaaacccacaaaaucagcaggcauguaggcaugcccuuggucauauaauccuuuuuuuuuuuuuuuuuuuuuuuuuuuuuuugagauggagugucacuguuucacccaggcugaagugcaguggcgugaucucgguucacugcaaccuccaguucccagguucaagugaucuuccugccucagccucccacauagcagggauuacaggcgugcaccaccaugccuggcuaauuuuuguauuuuuaguagagacgugguuugccauguuggccaggcuggucucagacuccugaccucaagugauccacccaccucugccucccaaagugcuaggauuacaggugugagccacugugcccggcuugcucuuggucguauuuuuaauccugagaauauagguaaaaaaauuuuaagccaauagaaacaauaaccauuaggaaccuaaauguuucaacaauguaauauacagcaauguuauauauacagauaucucauuuaucuuaaaaccaacauaggcagcugcuauuauuuccauuuuauaauaaugacaccgggacucaaagcaauucugguggggugggguugucuugccccaggucacacagcucaggaaugggggcaucauggcccgaagccaacucuugccaccaacuauuuccagcguuuuucuguuugaggcucucaacauaaagauaggugccauguuuugaagguccuguuacuacacacaauuauaaagauaggugccauguuuugaagguccuguuacuacacacaauuacaaagauacgugccaugcuuugaagguccuguuacuacacacaauuauaaaaugacuuaaaggguauuccaggucuggaaccggucuggaaaaggucugguacagaccugcaugcuacaaagcaaucucaacucugcacuccaucugacaucauuccauccugcuuccaggccaaugaaugacucuggacucaccacugacuuagacccugaacgcugaagggacaguggguucaagacacgcaauccagaagccuuaaguugugcuaaauugauuucaccuggcuguucucggcucccagcaaggcuguccuucaacugcaugagcuuccuccugaaauaauaccacuguaguuuaauacuuacacuacagaugggauuguuggcuucaaaaugcccaugcugaguccauuuauuaaacagaauacucagauuacauuuccacuuaaagucuucucuuaccaaaauaugaaagaugggcauuuuaaaugaaaccuaaagacaaaagcaggggguagggaauggagaagggggcagugugucuccacaaagcccaucugcaaaaaugucagaguauuucuuuuuuuuauuuuuauuuuugagauggauuuucgcucuugucccccagguaguccaauggcaugaucuuggcucacugcaacauccgccuuuuggguucaagugauucuucugccucagccucccgaguagcugggauuacaggugccugccacugcgcccagcuaauuuuuguauuuuuaguagagacgggauuucguguuggccaggcuggucuccaacuccugaucucagcugauccgcccgccucagccucccaaagugcugggauuacaggcaugagccacugcgcccagccaaaugucagaguauucuaacuaaauaucauugaguauguacacaggacuuagauuugauuaguaacaggaagaaaaguugggggaggaaagcaggaaucacauauuaucgugggcuacaugguaacccagugaaucuuaaaccuagaaacuguugacauacacaguuucaugauauggcaaacuaaacagggaacauaaaaaagccaucuuaauaccucaauuucaaugcaauaaacuucggucaauugugccucuuauuuaggaaccagaacucugaaguucuauagaguuuaggguucuaccaaguaccuaaaauuauugaaaaaauucuuauaauccucugugaauugcccaauccaagguaucuuuaguuggagccaaacugagucucuuuaaacaugaagacuauagcacacaggcacaaauuuccgucuacucuuuuagaaauguuacugagccgggcacugugacgugcgcuguagucccagcacuuaggagacugaggcaggaggauugcuugagcccaaaaguuugaggccagccuggacaacauagagagacccucgucuccaaauaaaaacaucauuuaaaaaagagauguuacaccaggcgcaguggcucaugccuuuaaucccagcacuuugggaggccgaggcaggcagaucaugagggcaggagaucgagaccauccuggcuaacauggugaaaccccgucucuacuaaaaaugcaaaaaauuagccaagugugguggugugcgccuauaaucccagcuacuagggaagcugaggcaggagaaucacuugaaccugggaggcggagguugcagcgagcugagaucacgcacuccagccugggcaacagagggagacuccgucucuuaaaaaaaaaaaaagaaaaaaaaaagagauguuacacacacauagcaaaguacauuagaugauaaaaagaaggacccuuaaaaacugaggucaaaugcuacacauccuuacauccuaaguaugauaaugaauacauuaugagauacuaauuuucaguaaccacaggguaacugucccuacuugagaaaggccguagauacauuauuaacuucgguagaaaacgauuuaugacagugacguuacugaaccugaguuuugagucuauuuuacuaugugaauagcuugcgucccgccaggguacccaagcuuugaccucaagggugaugucucaggugagcuuucagagccuaugaggcaccaacauccgcacaaaaugggacuucauuccuagucagauugucacauucagacauguccacacuuuugcaaaucccacguguuguuaaagauggauaauucccuuuauuucacuccaaaucaaaaguguuuuuguuuuuucuuccauccccaaaccgucuaaauaagucauaccguuguuaaaaauucacggacuucugagaguuaucaauaaguuaaagucaccucaaauagaggaaaucaaaccuacauucauuuaagucuuuucuguguuuucuacguguguauauauacaggcacaagcauucacuuaaaaaauaauggggaacacguguuauuuuaugaccugaugguuucauacauuguggguacauuucuuuauuaauaaacacgcaccuugcuuaacuucaaucagucucuccugucugcaacucaaauggccacagaagacaggauuuacacacagcucugcccagagagacccugaaagaugcagacacaacauaguggcacaugggacaggaggcgguggaaccagaugggauucauuggagccagaugggauucgaggaccacccauuucagggaggaaaguaauacugggacuuaacuguuaccaaacaagaaagaaggaggaaauguauauuucacuuuuuccacuccgaagcuuccucgcauagcuuuaucccuccacccugaacuuaguuuuauaaauaguuauuucuuuugagaugagaacuagacuugaaagacacgcuccuuacacuuaaacaugguaagcaccagaaaaccuauuuucccacuggauuugugcuucaaaaagcacaaaugccuccuuugaacaaaucaaaacccuaaauguuuucaagcuuauauccuuugagugggucagccagaguuuauucccaugaaguauuaccacauuacaacuaaacaagcuguuaaaaaaaaaaaagacccuaaaaaccucaaauguuuccagcaacaguguuuuccucucauuucuguaagaacaacaaccaagaauguccaagugguagccaaggcaccacagaaaaacuaggagacuucuccauccacuuccuucuccacaggaguccacaacgugcuagggaccuccuuugcagaguaagaaacaggaguaccaggcuguuuaaugaaguugugaaaugaugagcccuugacagcugucaggaugccaggggcagaggagguaagccaaccaaagcaacccuuuucacugcagaagugauacucccagaucuacauccucauuggacgaccgggugcaaguggcccagcacuccugcaguucacacaguagacgaggcuccaaaggggcaauucgucccaccccgggcaguaugaccaagaagcaaaccuguaaguggccuucgugggaaggaaccagaagccaauauaaccaggacacacccacaaaugaucaaaucaucagacuuaaagauuaucuggaaggaauuuuaaaucccacgacaaaacuuguaaagaaaccucuucauuguguuuucuccuucauucuaauagaaaguguuuugaaaguaaaucuuuaaaaaugucaaacaaaaaaaauaaaaaccagaguacaaaucaguaaacaauaucccuggaaggcaauuuggaaauagggauagaauuuuaaauacgcaaacccauuagcuacaccaugccauucuaauagauauggcauuacauauuuaugaggugcaacacauaauaacuuauaauaggguugggcguggugccucaugccuauaauuccagcacuuugggaggcugaggcaggaggauggcuuuaagccaggaguuugagaccagccugggcaacaaacugaaacccagucucuacaaaggaaaaauaaauaaguaauaaauacuucauaauagcaaaaaaaaaaaaaacccuuaaaugucuaucaguagaggggaguaguuaaauuaugaaauguucaugcaauagacaacaucaaaagcuaugagguagauuuagacacacucaugugugaagaugucccuggcuuaagggggaaaagaagcaaguugcugagaaugauucuuuuauguguuuaaaaccaaacuaaacaaaaauaacccacugacaaagagggagaggaagaggaaaagggagagagaaaaggagucaauguuuguguaagcauuuuuuuuaaagucuggaacaauauguaccaaaucuuuaauaaugguuaccucuauggcauuguuguuguuugguuuuauccucuuagagggaaauugggagaacagacacgguuuccuuuuuacucacuuuaucacuguagaagugaaaauacauugaacccuaaaacucauagauucuuaggcuucaagcauguuaauaaccuugcuugccaggguucauaaaucuuuuaagaucaucuaggccaacaggccacacugcuggagcuuuaacuccucuguuuauaucaucuccaaauguaaauaacauauuaauguccucagcuaagccauucaucaaaaacauugaacgggacggagccaagcauaucacaguucuacagcaggccacuacaggcuccugacagagaacacauguauccuaugcauuauguacccauuucacaaguguguuucauauacauuugcuuccgccuuaaggaaguuacuuucacgaccuugagcacauuucuuaccucccucauaucuuccccauucucuguaaaauggaguuaagaauucauuuuuaggcugguccgaugguaguggguuaucagaaauuaacaucaguguuacuaaagucgguauacaacccuacacugcuaaacuugacuggcuuuuaaaaagaaaaaaauuuuuucauuuuucucucuuguuuuuuuuuuuugagauggagucucacucuguugcccaggcugcagcauaguggugccaucucggcucacugcaaccuccgccuccuggguucaagugauucuccugccucagccucccaaguaguugggaucacagucaagugccaccacgccuggcuaauuuuuuuguauuuuuaguagagacgggguuucaccauguuggucagguuggucucgaacuccugaccuuaagugauccacccgcauuggcuucccaaaguguugggauuacaggugugagccaccucgccuggccaagaauucauuuuuauauaccucaaagaauauuggaaacaucaccaggaacauauuaaguucuuaauaagucaacuauuaacauaaauuuuagcugucuuuguuauacuauuuguucucaauaauuguggucuugggaauuacuuguuccaugccugcguucuucucuaaaaugaaagcucugggaguuauuaccuguguccuuccugcucugcacucaacaauaacaccuggcaaauggcaaaggcaucuaauccuucugauuuucuaggacugggcaggacaaagcggguaaaggugguuuauauaaagaucuaaauggacgagggccgccugugauuuuucuuuucuuuucuuuuuuaaacuauagaaagcaugggggaaacagaagacagcacagcacauacaacgucuugguuagaguccaagcuccucucagcuauggaacuuuacucugagcucaucuucccaguuacaaacugagacuaauacuaucucuguuuuuggauugugugagauucaaaugaaaccguauugggggaaauucucuuucuaaauagaaaagcacucagcagccauuuuaugagacuugguccauuugaucaaaucaagguccacgugcuaucccaguacuuuccaccccuuaucucacacuacggucaccuuuuauaaaugguccucauguuucuguuaaggaggguuucaaaggaggcagcauuuggcuugagucugagaugugaaaugaaaagggaauccaacaaaauuagaaacagcucgguagaggcgacacaucucacuacaucccaggacacacauucacacggggcugcaccucaagacauggguacggcuacacguaacauggccauagccuugaaaucacagacuugcacacaggaagagaaaagaagacacaguagccuuuuuuuuuuuuuuuuuugagacgaacucaugcucuguccuccaggcuggaguacaguggcacgaucuuggcucacugcaacuuccaucuccuggguucaagcgauucuccugccucagccuccugaguagcugggauuacaggugcgcaccaccacacccggcuaauuuuuguauuuuuaguagagacgguuucaucauguuggucaggcuggucucaaacuccugaccucgugauccacccgccucggccucccaaagugcugggauuacaggugugagccacugcgcccagcccauagcagcccuuuuuuuccugagguuccugguugguucagauccucagguugcgagggcaagugauccugcccccacaacacacacacacauacacauacacccagaguugugugguguguaucagugagcccacccaucaauguaacucaaagagcuaucauuaagacugaugauuuauuucauacaagucaauagcuguagcucuugguguauucacucuaaaauugaauacuucaaacagcaauccagacuggcaaaaaaaaaaaaaaaaacccuuuuauuucaaccuaggcauacaauauauuuuccaauguauauuuaaauuucuagaaguaggcugaaaauaagacggaggcuaaaugcagaaauggauuauuccacuggugauccagauuuaugagaaguuuagaugaacaauagcccuaauuuuugugagggaacuggaucaaauucuuuagucucuccauuccuuccccgacagucaugcuuuccaagaaguucagccugaggaugcugcaucucagcugcaggcuagagugcaggcuagagugcaguggcgugaucucggcucacugcaaccuccaccucccgggguccagagauucucccguuucagccuccugaguagcugggauuacaggcaugugccaccacacucggcuaauuuuuguauuuuuaguaaagaugugguuucgccacauuggccaggcuagucucaagcuccugaccucaggugauccgcccaccucagccuccuaagguguugggauuucaggcaugagccaccgcaccuggcugaugugauuuuuaauuaucucaagauauauaguaagcacugcuaaggcaaucaggaguauacauuuauauuccaugaauuuaaaaaaagauuuaaggcaaucugcaaaagaaaaauaugaggaggccuuuuaacuagcaagguuuuuaaaagagagaaaaugaacugcuuaucggguuucagagcuauuaucaaagcauagagucaaaagcucucuccaaccacaugaaauugagaagaggaugcaucccggggugggcaugauuguagugaucucuaaaaauaagaagcccuuaucucugagaaauuggccuccagagcucucuuccugcugccaguuuuccucagggaagaggcagcagauccucuugaggguggcagcaggucccaggucuuaaccuacagaugcuaugaagucucugaucuuuaaauaaagccacugcucguuauaaauuucaugauauuucuuuccauccauauauucagcaaacaaaaccaacaagccaaaaaaguucccuuacugcuuggugacaucacuuuaagcucgacugaguucaucugaaggacucagaaaagggggugaacaucuccucaccaucacccagagucccuguggccccuucccuccagcuccacaggacgaaaacagggcccagcugucugaaccccacguguccuacugcacuuuauccugcaggucuuuauuccaagaugggguuuacagccuacgcuacaucaucccaccaacugccgaguaggagcuauucacccaacagcaacauuuauccacuuucaauaccugauuggcuugguuagaccagcuuugucaugcugucacauucguuuaacuaauuuaauuuaauccuagugcaaaaaugcuaauuuccagaaugccaauauuaauuuuaucuuguguuugaaauggcagugcuugcuauuuaaggaaggcggcuggaacgguuucugcacagcagcagagcuugagggcccaggagugcugcuuggugagggguauaaauacuagacagagaguuucucgccacugucuacaaaucccagauuuuucuguuucucaucauuuucaguaaaauucaugaaaguuaguuaaccauaauuucaggagaaauaacccaaacucaucuuuagacaugagaaagaaugauuguuaagagagauccacuaaaaucaucaguuggcuuuuagcaugcaaaauuaauuccauugaacauuaauauucaaauuguuggaugucuuauuagaaaauaauguaucucacauugcuuauggaaaccccaaaggacuggccacuacaggugaacucauuuuaucaggaauguugucuacaaauuaggccucuaaauucucaaagaucggcauuuaucaaaccggucucugagagcaugaguauacugcguguaucaacaccaacauaccacgcauuaucucagaaguguucugugcuccagguuagcuugggaaacucugacgcagacagaguuaagcagauuuacuuagaauuuaaagacucuuuaaugugcauucugaaccacuaaggaggaaaucacugcauuuucuaaaaugaguuccucaaggaacccucucugagucacaucuacuaacauuccccauaacuaaagacaccacggaugcaugcaguauguuuuaacacacaacacuucagucaaguauucccuacuuuauaaaaaguuauaguuguuuuuaaaaguauuaaaacucccgaguucucugggaaaguauguuaaagaaaacaaagcacucuaaaucugguuaggugggagaucaaccaugcugauuucaggcaaagggaauuuauaagaucucugcuggagaugggggcaauaaaaagcaccaccuaccaaugacagcaauucacugcaugaagauggccugccagaauuccguucugugaaaugccuaccuuguaauguuggcaaaccccacagcauuugggucuuaggacagagagaagcucauuaaauccaacuggaagaaaaaccugugaauccuagaccaagucucugauacaaccgguaucuuccuguguggacacuguggacaguaauuacaggacauggggcaucccuggugcccccaaccccgaccccccauaucaagaaaugugcaccuccccugaggugguggugauaacauuccugguuaagaaccacuacucacagccucauagaaucaggaaagaacuccaggcugaacaugguggcucacgccuguaaucccagcacuuugggaggccgaggcggguggaucaugaggucaagagcuccagaccauccuggccaacauggugaaaccccgucucuacuaaaaauacaaaaauuagcugggcaugguggcacucgccuguagucccagcuacucgggaggcugaggcaggagaauugcuugaaccugggaggaggagguugcggugagucgagauugcgccccugugcuccagcccggcaacagagcaagaccucgccucaaaaaaaaaaaaagaagaagaacuccaagguugaaccugaagaauuuuauucuuuuuuuccccuaagguaacuuaaaccaagaaaaugcaucucuacuuaauuaugcuggauccaugauaugaucuaucuaacacagaccuuaggcaugugagccaugcuugcacuggguguccucucaggggagaagaauauguaauccggcaauuccaagaauucuuguguuaaggacagggaacaagcccaauaccauguuacuuacucucuccuuaagcuucagaggaauacuggaguuccguguuuaacaaaaaagcaccugacuucucuugauuaguuauuuaacuuugggucccagaucaugucaaguuacagagcacagaauacagaccccuagagcuacagcuuuauaguccagugucaugaccugcaucgugaaugucuaagacaaguuccccaccacccgcugcucugagcugaugcaccuaccagcuguccugggcaaauuaauuaccaucuugacuucuuggaccuccacaaauuccaauugcaaaauaagcaaaauguuauugugaagaguuagaauaaugaauauaaaucaucucaaaacacauuucugacaauucuggcaauucucaugacuaguuuuuucuguggcccugcaccagcaaauucauaguagguuuuaucuacagcauacgugcaagucaagaucucaguucucacucaauuccuacacaccacuucauauucaagcaauuacucucacguuaaguggcugcuucucucaaaagaauccucauuugguaguaaaauaauuacaucacauccuugcuuagaaaucugauaauaccaaauguuuugaaauccacugugugccacagaaaggcuaaauaguuucugaguccaagagauaaacaauuucaacagaggaggaaaccagcguuaucccaaguaaggucuugauuuuaaaguucaaaaaauuuuagaggcuaauauuacuucuucuaaucaaaggugugucccuaagauaggaguaucagaagcuccaccaugaagacagauaugagaaauacguaguggcuaaacacuacacaacugucacuugcuuaugggggcaaaggcagagacgggcaagaggaagacagaagaaggucucauaaaaagcucuucucccauccugagaagggauguuuguuugguuuguguuaggcagcccuaggcagcacacaucaacacgccuugcaggcucuucaccaugcugacagcugcaauacagggagguggagacagaaguuuacuccaaacuuugccaaaacagguaacauauuaccauucaaugaggaggauaaucgagaccccuguugaaaugaaauacagucagccuuccguaucugcaguuccucauccggcaaaaacuaucuuuucaauccuugguugguugaaucugagguugggaaccccuggauccagagggcaaacugugggacuugagcauccuuguauuuugguaccaacaggggugggaggguccuggaaccaauucgucuaagauacugaaggacaacuguacuacacacugucugcaaauuuguagcuauacugccuuugaaccagauugcuuaaacugauugcugauuuuuaacuaaaaacccaguuagaauguauugcccaccccauugcaacuucaauucuaaguccaugcuccauucgacugaaagagaaaaagaacaagcaaaauugcuugucuccuuuucaguagaaugcacuugauuugcaaagauggccuaagauaaugugauuuagccaagaaucaacagugauuauccuauuauguucaacuccaaauauuuguagcacaaucaccaaaauguaagauacagaaugaaaaaguagcaaauuucaaauccacaaacaacuguccuguguuugcugacgagcaucuaugggaauuagcaaauggaggcugaauucuaaacugcuuuucaauugaaaugucucugccucacaggcuccuuucugaagcccacuaggcagaggguuccacugccagaaccucugcuggcugcagcauucaagauagaaggcacugcacauggaaggaagggaaagaggccacaagucagcuggcagggaugagcuauguuaagccaucccaagugacuucgagaaaugccuccuuauaugugaaaaaaacucaagaaaguuuccuauacacuguggcauccaucgguuacuuaaaaaacucauuaaacauuuagcugauaauggacuugcagaugccauuguggagaauccauuuaggguccguggaugcuuaauagcaaaauuaaaaugauaaauugaaauggcuuucucugacgugugugcuuagcucccugcgccacggaauacaagcagccuccugcauaccaaaguaagugacgcgaauccagcccugcugcugcuugagcacagccaguguuuaucagucugcuuggaggaaaacagggacuucgccuagggcaacugauuccuaaggggcaggcaaugguaagaccccuucuuagcugguaaugauccugccgugcuucucuggaucuggcauagcccaggacagucaacagaaagagcacaaucugcaagcucacccaugaaaggaaaucucagcuaagccacucaucagcugugagacaugugggcaaauuucucacccucugagccuauagaacgagggguaauacuuuuguggggcuguuguugugguuauauccuaacccaauuaagucagaaucucugggaaaggacccacauauuaguaguuuccaaggcucccccaggugauuccaaugggcagcugcugucucagaggcaugauacugaccaagggaaccugacagguggugaaggggacacuggaugaggugaucugcagcaacuggagaccagcucucaaaaggaaaguaaaucagaaagcagcuccguuuaugugcagagagggggaguuucuaugcagguaagguuacagggagaaccuagaaggacuaacuucugaggaagagaaggggauuuaguaggggagagggugagaaggaaaaacaagaauccaggcugggcaagguggcucacgccuguaaucccagcacuucgguaggccgaggcgggcggaucaucugaggucaggaguucaagaccagccugaccaacauggagaaaccccgucucuacuaaaaauaaaauacaaaauuagccuggcaugguggcgcaugccuguaaucccagcuacucgggagacugaggcagaagaaucgcuugaaccugggaggcagagguugcagugagccaagaucaugccacugcacuccagccugggcaacaagagugaaacuccaucucaaaaaaaaaaaaaagaaucuggugaaggcugggaaccaucagugagggggaugggagaggaagcuggccugugagagguaagaggucuucaaggagucguaacugaacuucagggccucauugucaggggucaaucugcuuggcuucagauuuuugggguaacacccaguggcauggaugucuaaguggagaaagacuguaguugggugagggaugugcuaggagaaugagauaacggugagugcuucuccauucugucugucucagucaccugggacugagcucgucaugguguccaacugaugccacugugggaacuuccacccacccucccuguagggugugcagugaagauguuggccuuuccagacacugcccaguuuuccuauccuccaaaauggccccaaucaagcuaccugaauucaguggagaaggaauucaacaauucuagucccuauaagcauuaauaggugccagaauaauguuucccacaaagaaaugaugacuauucuaagaacacauuuguguuaguccacacauuucuccagucucaaaaggaagcuuccaaaccaucuuguucagaugccucgucccaucggaugcguuaccuucuaaacacgaaaguguaucaaaacacaacaaaagcaaaaugccagccauaaccaugcuagucaucauguuacccaaggaggaaagaauuacaauccaaguuccacaccugaaggauuugcaaauuaaacaucucucagucuuugcuuugaaugagcuaagagccaagcuaaaaccucacaagggaaaguacaucugggaaagcccaccacccucccuuuacaaaguuaaccuggugacagugucucuauucaaaaucccugugcuucuuuuucuuacaggccagccuagaauguauugaucaagacauucuaagaaagacaaauaacagcucuaguuucuuuucuuucuuauuuuccugguuuaacaaaauuacucaauaaaacaguuauauugcacaucuugcaaccuucuuaucaagaccuuacucuacugagaaaaaaagggagaguguuucuuaagaagugacuauguacgagaggcaaagcccuauggaaaccacaucaaccacaagauggguuuuuggcuuuuugcuuuuuuguuuggcugguugguguuugcuaccaaaucuauuuuuucauacuucugcuucugaaacaugcaggcuggucagaauauucacuacuacauaacccaaugcucuaaaaaucagugccuaauuaaaaauacauucacagucuauccaaguauggugaauuugcagaggaccuugaagcugcauaaccaucucucucaacauuagggguggagaguaucaguuugaauuuccccgucugcgcucgagggcuggcugguguugguucugucggagaagggcagugacugugaacuugacauucaucucucacagcauguuuucagcaauucuggugauuugggauuuguugcaaauuuuaaaaagaaaagaaaaaccuauguccagcaauaucuacuaaaaacaaaaauccuccagcaaaaaauacaagccucaggagaaagcacuugcaguagguacugauuacggcuugaauaagugaucuuacacaagugcauuuuccauucuaacaggaauccauuaaccucauuuauaaaucauaaguuauagcugucagaagagcuuuuagagcugccagccgcuacagggcgcaucuagcgaugccauuaaucccuuaauuuuuagcuucaucagcaauacagcggaacacagaccaggccucguuccccaaauaagcacaccugaaaaaugugguccugauuuaggaggcagaagacaguaauuugggagaaauucacucuguccuccaaaagcaugaguugugacuucugaacggggguagggugggagugggaagagugacaggcaguucagcuguaccccaaaucccacaaaauauuaauuaaauacuucaggggcucucuguaauccuucacuauaacucuaucaauuuuauuuuagcaccuauuguuuggaaaguccauuuaaccaaugugcucgugacucuuuuucuuucuuucuuucuuuugagacgaugucuugcucugucccccaggcuggaguacagcggcgcgaucucagcucacuguagccuccgccucccgggguucaaccugccucucagccuccugaguagcuaaaauuacaggugccugccaccaugcccagcuaauuuuuuuguauuuuucguagagucaggguuucuccauguuguccaggcugguuucaaacuccugaccucaagugauccacccaccucggcuuuccaaaguguugggauuaccagcaugggccacugcacccagccauaauucuuuuuuuuuuuuuaaauacuuuaaguucugggauacauguccagaacacgcagguuuguuagagagguauacacgugccauggugauuugcugcacccaucaacccgucaacuacauuagguauuucuccuaaugccaucccuccccuagccccccacuccccaacaggccccggugugugauguuccccucccuguguccagguguucuccuuguucaacuccuacguaugagugagaacaugugguguuugguuuucuguuccuguguuaguuugcugagaaugaugguuuccagcuuuauccaugucccugcaaaggacaugaacucguccuuucuuauggcugcauaguauuccgugguguauaugugccacauuuccuuuauccagucuaucauugaugggcauuuggguugguuccaagucuuugcuauugugaacagugcugcaauaaacauacguaugcaugugucuuuauaguagaaugauuuauaauccuuuggguauauacccaguaacaggauugcuggaucaaaugguauuucugguucuagauccuugaggaaucgccacacugucuuccacaaugguugacuaauuuauacuccgaccaacgguguaaaagcauuccucauaauucuuuaaaauauuaauaaguaaacauggccgggccugauggcucacgccuguaauccuagcacuuuccaaggccgaggugggcagaucgcuggaguccaagaguuagacacuagccugagcaacauggugaaaucccaacucuacaaaaaaugcaaaaauuggcugggcgugcugacuugugucuguggucccagcuacucaggaggcuaaggugggaggaucaccugagaccaaggaaguugaggccacagugagccaugauugugccacuguacuccagccugggcaacagagcaacaccccgucucagaaaaauaaaaugaaaucaaaauaaaaaaaagaaaauagaccgggcguggugguucacaccuguaaucccagcacucugggaggccgaggcggguggaucacaaggucaggagaucgagaccauccuggauaacacggugaaaccccaucucuacuaaaaauauaaaaaauuagccgggcaugguggcgggcgccuguagucccagcuucucgggaggcugaggcaggagaauggugugaacccgggaggcagaggugagcagugagccgagaucacgccacugcacuccagccugggcaacagagcgagacuccgucucaaaaaaaaaaaaagaaagaaaaagaaaauaugcuuaccccaucgcugccaccccaacaacugugggaccuuggucaagucaacagcaguagcuuugguucucaccugacuuguuuuguuuuguaaaagaccugaacucucucgagcucugagcucuaaccuucucugacucagaccacauucgggacucagucaagaggggcaacuuacccugcuuugacgccuggaaagacagaguacaaaguggcucguuugguucauaugcgcuuaaauaaauaauaauagauaacggauaccucaauggaaaggauucauuccuuaaccacuugguucaagaucuguaagcaaacuaaaugauuucaagaaguauagacuauaacugcuagugaaacagucuccaauauucacaugugagugacuagaaagggagaguuucuuuguuuuguuuucuguuuccgaagaaugcaagccgacgccccauccagcgaggguuggcgcuuccucaugaagucgugugggcuucugggaaaugcccccucccugcuguuacugaucuugaaccuugacagcaagcaaaguagaacguauguguguaguaacagcacagaaauggagcagacaggugccagcuuucuugccaacuuuauuugaaaugcaaagaaaaugcuuucagccugaugccauuccugaagcaaguuugcuucugcaggaaaaagggcuuucccuaaacaagugucccaucaaugacucacucucaaauugcuguugccuuaaucuuuuaaaaaaauuaucaccuccauggcuguaaucccagcacuuugggaggccaaagcagguggaucaccugaggccaggaguucaagaccagccuggccaacauggugaaaccucgucccuacuaaaaauacaaaaaaauuacccaggcaugguggugccccuguaaucucagcuacuugggaggcugaggcagaagaaucgcuugaacucaggaggcgaagguugcagagaacggagauugcgccauuucacuccagccugggugauaagcgcaaaauuccgucucaaaaaaaaaaaaaaauuaucaccuccagaagauaaucaugugauagauguagaugaucaaucauaaagccuuugcacuuuugaaccaaauacugacuuacaggaaaugaugugcuuuaaguuuagagcauacacagauuaucuuagaaacuagaaaauacauuuauuucuucaucaaacuguacaaaugacuucuuuuccccuccacaacucacccaaaugauagacugugauacuuuaaauuuuuuuguuuuuguuuacauaauccuccccccuuuuuugcaugaaauugauuuuuuuuuuuaacccaagacauuacaaccagagaagucaccgcaagaaaggacuuugcuauaauacucaauugucucaaacuuucugguuauuguucuuuaaaaaaauccuuuuuucaucuuuuccacaaacucuccauuaagaauuauaagcucuuugguaaucaguagauugaaauagauacacacacacacacacacacacacacacacacacagugaaaugcagcucucugauguguacuuccuggcaaggaaaaaauaguucaauagcaaacucaguaaugugaaucacugccaagacaggaaaacauuauuugguauccacuccuaugacaaugggaaaaauaguucugagagugaaaaguuuuuauaccaauuagguuauguccucuaaaacuguuuccaguuauugcuucuggggacagaggggacaauauauuugcuuugauauguaaguuuucacaauggagcauuagucuuacuuggucucaauacacuccccacucugucguucauaaaucauguucuucacauuaacuauuccuaaaauaaagugccugaaucuugcaguccagacccaccacaugcucauacugcaucuugcauuucauucucuuuguugaccuccaaguucacucuccaaagccucugaauguucaucauuuugcaaaagcuuugguuccacccuggguccccaugcguuagucaacauuugauuaaucccugugauggguuccuaugucaucuggaugcgucaagucaaaaggaagugccacacaucaaagacagaguacuaagacacauaguacuaacagggaggggucucuuucaguucuguugauaagagaaaguguaccagaaaaaguugaguuuugagcuggaucugaauaggcaaaaaguaccaauggcagggaagagagaaauaagacaucgacauguguucauucuuuguuuuugguuucgguuuuguuugagacagggucuugcucuguugcccagacuggagugcaguagcucaguuauggcucacugcagcucugaccucucaggcucaagcaauacuccagccucagccccccaaguagcugggacuacaggcgcacacugccacacccagcuaauuuuuuuguauuuuuuguagagacaggguuucgccauguugcccaggcuggucucaaacuccugggcucaagcgauccuuccaccucggcuucccaaagugccgggauuacagguguuagccaccacacccagccaugcauucuuauuuaucucaugucaggcaauggcaaagagugcaauguggaagugaugccaggaguucugguaacgacaugacucaacgugcagguuucaaagaucacugcauaccuggugaacgaugugugacacugaucugugcagacagaagucagaauguaauggagcaauaaccaggaggagaugcaagggaggcuucuggggcacuggcgagguucuccaaccugaccugggagaggguuacucgugcguucaccuuguaagaacucaccaagcuauacgcuuaagacuugcucgcuuuaucagauauaaauugaccacagacaaacccuaaaaacccccaaaccagcaaucugccugcagagaggagcugaaggagagcaagcuggaggcaggaaggcugcugcuguguccauucaggggagaaaugaagccagggaaggcccuguggacagaaugggucgaugugaaaugucuuuggagaugaggccugcgggacuugccaacggaaaaagaaugacucccggauuugagguuugguuaugucagugacagcuucugagcucucagaaaaacaccugacauugcuuuuaacagugggcuuucugucuuuauacugaauucugucucugucucucccucucuuaggcauucucugaucagaaugccucgccuugagaagaggcccuaccuguaagguuccuucaccucuaggugccugcuuccucauugguacaauggggauuuauaagugucuaucacaaguguaccaagcgcguaggacagacagcaccugacacaguaagcacuagucagugucagccauuaguauuacagaaaacaaaucacugcuuuuguuacccugucccucuauuuucugggucaacagugagaccaugucuuuacuugauaauacucuuuuucaggcaaagaauuagcauccucguuggaaaagccuagaaaccuggagaccaucuugggcuuuucugcaucuuggucauccucaugcucccucaaauccuaccauuucuuuuguguucaaugcugucuguacccauugcuugauuucugcccuaguucaagcuuuagcauuucaugguugauuuaaugcaauauccuaagagcugaucucccugccuuugagugccucuuguuuaguucuaccuuaacgcucaaucugucaugcuggucuccuuuaguuccuaaagugugccuccucaccgucauuaaauggagcccagccuccuuauacaagggccuccacuuuucuaaaaucuccugcuacccacuuucauaaaggcucaguccugggccgagaaguaagaaagaaauccugaauacucuucaacagucaucuaaauuuuuucauaacaugagugcaggcuauacugugggaaauuagcaagagcuuagccaagauaaaaacuaaacuccaugaagaugaagauagcaacuuucuuacaaaucuagcacuuuauacauaauacacuuuauauaguuaaugauuucaaguuugaccagccugaacauugacaguaaucaggaaugaauaaccugauagguagacagcagggaaaacauuauucaaccaauagacaagagaagucggggaaucagcagcugcuucaaagaaucccugugagcaguaacaccaucagacccaggcagagccccucacugcggagagccccauucuggcccuccucuggcuacauccuucccccgcagcaaccaaaagggcaaaccuuccugaaauuaacauccaccuguccugggggcccaagauuuggaauucucagaaccuaugcaagccucuucccugggcaccucuagaccaaagggcuacagcacauuuguuuuggugaagguugggcaugugggcuggaaaacccccaugcgugagcuggaggucccuuaagauguaugggcaggcugggcacgguggcucacaccuguaaucccagcacuuugggaggccgagguggguggaucaccugaggucaggaaaucaagaccagccuggccaacauggcaaaacccugucucuacuaaaaauacaaaaauuagcugggcgugguggcacgcgccuguagucccagcuauucaggaggcugaggcagcuacuacucggcucacugcaaccucugccucccgcucgaaccugggaggcggagggugcagugagccgagauagcaccacugcauuccagccugggcgacagagcaagacuccaucucagaaaaaauaaaaauagauguaugggcagcugagagcgggaacaggagggggaagaggacagcccgcuccugcaucacacauucuggcaugggaggucaugccagacugcacuuggugggucacgccuauaaacccagugcuuugggaggccaaggugggaggaucucuugaagccagguguuugacaagcuugggcaacacagggagaccucaucccuacaucaaaauuuaaaauuagcuggguguuggggaagggaggguaugguguaggccuguauuccuagcuacucagaaggcugaggcaggaagaucuccugagcccaggaagucaaggcugcagugagcaccacugcacuccagccugggugacagagcaagaccuugucucaauaaacaaauaaauaaaacaaacguguguggagaaaagaaugaagccgcaggaaauuggguccuagccucacauagaaugccccaauuccaagacuuaaaauucuauauagcaucaucaaaauacaauggguugaguuaggauuugggaggcuauucccuauguguaggagaaauucuugcaaaugugaaguaucaaccaugagaucugaagcauauaagaagaccucaaaagauaaagugggcacuaaaucugcucauaaccugaaauuaaaauagcgaaccaauacauagaccuacagaauuacaguuaucucuucccauacguuacagaaaugcaaaagucaaggcaaacuuaaaacaccauccuucaccugucaaaguaacacuaccaauaucacugacguggccaaaucugagcacucauuuguucucaguagcauuaaaauuagcacaacuuguaaaaacauauucuuuagcaaccuucauccaguuuguagagggaggcucgcaaguuaagucacuuaucuaauguaaguggcugaguuggggauucaaauccacauccugaacaccacgcacaugccccuucuacuuugcaugaagccuagauguuuacccuaaggaaauaacaggaugaaagcacagaaacacagccacuuccugcagaauggaaagaagcugccaauguguuuacugguaaauuuaaacaugaccuuguuaacuguauauaucuuuagaauuacacauaagaaaugguaauucucuaagugaaagcaaaacgcgaguguuucaagcuaacugcaacucagucaaaagucaaagguuugugaaauaugauugccaaaauggggcauugugaguauuccguaaaguaucuaauauuacaauauuuucaaaaagaaaagagcugggcgugauggccuacaacuguaguccuagcuacucggggggcugaagugggagggucgcuugagcccagacuuugggguuacagugaggugugauugugucccuccagccugggcaacaagaggaagguccuuucucaaaaaaaaaaaaaaaaagaaaaugaaaaagaaaaagaaagaaaagaaaagagcgcucguuugguuuggcagcacagacacuaaaauggaaacgauacauggccccuacucaaagaugagacccaaauuuguaaagcguuccauauuuuuauauacagugugugcugugagcuauugaaagcugaaugcauuaagcauauuuugaaacuuaagucauuccuugguuaacaaguaaaugugucagaaauuuaucauauagaaaaggguggaaggguggggcauucccuuucauccaggaauuaguccuauagaaauauuugcacaagcauaaaugaauauguauauuauacauaauuuucauuuuauauaucaaaauuauauuauauaugaaaggauguucauuucagcauuacuuguaauaggagaucaucagaaucaacuuaaaugucaaucaguaaagagacugguuaaaaauauagaguauauccaugucacugaacauauagccauuaagcagugagccagaucuguguauacugaaccaaaaggugcuuaugauuuccuauugagugaaaaaggcaaguuacgcaacaguauuaucuauaugcauauuuaaaaaaaaaaaacaacaaccgaaaggauauguuuguuuguguauguaagaaaaaucucagaagacaagagggaaugaaggaacuuuuuucuuauaugguggcauuugcacaaugacaauauaccacuuuuaugcuuaaaaaaagauauuuauuuaaaauuuuuucaaguuugauuucacuugcuuauuuauuuacuuuuuuaaagagaccaggucucacuccaucacccaggauggagugcaguggugcaaucguuagcucacugcagacucaaccuccugggcucaagcaauccucccacuucagccuccccccaguagcuaggacuacaggcgccugccaccucgccggcuuuugcuugcuuauugucuccagcccguuucuauuauuuaaaugccucaccgagcaguguuaagggucaauuuuaaaagaaacagagagaaaguaaauuuuuaaaauguuauagaaugccuucuccauggucagauuuuucccaccuuuauccuuuaucguauauuucucguuucuucuugcauacauauuaaaaacugcuguacauuuuuuccuaagucaaggagaguuguauauaaauacacucaccauucuuaaguuaaucacacacacacaaaaauuuaaaaccugaagagcuguucuucaagaucaccuaaaacagucccuuccaugacacugacgagaaccaaauccugaaagaauguuacuugccaagcaucacagaccuuguuaggauuagaaaccaugccagagaaauuccuucucuaucccuacuuucuuaaaaaaagauaacauuuugaugagaccagggaauacaaucuuuuaaaacacuaaaacaacagagaaugucuuccuaaguaaguccgacucagguucugggugugagcccuccaggccacucaagcaguguaggcaguaaugacacuccagguguguucucuauuucaaauccacuauaacugcuuauugaacaauuuauuuuaggaauuuuagaaaacagaaaugaaguaaguuuuaaugaagaacacuuuaaaaaccauuguucuaugcuaaguuaagaacuagauacuaccgccgggcgcgguggcucaugccuguaaucccagcacuuugggaggccggggcaggcggaucacaaggucaggagaucgagaccauccuggcuaacacggugaaacccugucucuacuaaaaauacaaaaaauuagccgggcaugguggcaggugccuguacucccagcuacucgggaggcugaggcaggagaauggcgugaacccgggaggcagagcuugcagugagcggagaucgcgccacugcacuccagccugggugacagagcgagacucugucucaaaaaaaaaaaacuagacacuaccguucauuaauugcaguaccaauaacaucaucucagagagaaagugaucuccaauacaacaguagucaaagaacagaacuucccagaaacugaccuccaacuggauuuacgaugcuaugauucuucuuugauaaaaacacaugacacagccaggugcgguggcucaagccuguaaucccagcccuuugguaggccaaggagggaggaucaccugagguaaggaguucgagaccagucuggccaacauggcaaaacccugucucuacuaaagacacaaaaauuagcugggcaugguggugggcgccugcaaucccagcuacuugggaggcuaaggcaggauaaucgcuugaacccaggaggcgaagccugcagugagccgagaucgcaccacuuuacuccaaccugagugacagagugagacuccgucucaaaaaacaaaacaaaacaaacaaacaaaaaaccaaaaaaaacacaacaucugaauuccccuucauuguaaauccauccacauuaauaaauuauagaccucaaagaaaguuaauacaaaauuaauccauaaacuuuuuaccuacuaccuuaagugauacauuuucaucauuguagauuuuaaauaaaauauaaaagaggacaaauucuauuauuucccuuccacaauaguaagacaaagguagaaaaaaauaaacagacagacacacacacacacacacacacacacacauaaaccuauuagcuauugccuaaggaucugaaaagggaagacguaacaugucuuacguauuucaaugauuaaugcuguauuuaacauuaggaaaaacaucagcaccagaagaaccaauacaguugaagaguaaauccuuacaaaauccacauauuacucuuaaaauuuguuccugauuauauucuuauucacauugaaagugucuuuuauauuuguugaagaacaaaagaaaaaacuaaauaaaaaaugggauuuauauuccuguuaaaauaaaagauuaccaaagaaaauacaaaauaggaggcaagagucugcuugcagguuuaaaccugaucauuuuguaagcccuaauaguuaacucauucaauaaauaucuauuaaacaucuaucauuuaccaagcaccaaauuuugagguaaaggaauuuagcauguauuguuucaaauuauuucaguucuacaaaguucuccuauuggaaacaucuagauguuuagaaacaauacgccuuaccauccauuuugcacuuaaaaaacacuucuuaaagaggaguagagacaggaaccaggauuuuugucuauaggugugguuaucauacgaguacuccucucccccaaaagauaaaauccaggcugucuuuuaaaucaagagcauacauauugcuuacuaaagcaucccagucuacgugacauucauaacugacaaaaguaucuugcaaccucauuaauuaauagccauuuucagacauuugcucaaucucuccaucugcuacgguggacaucuggagccccaguguguagaaacccaccuuuaaacagcugcagaaguaaugacaccuaggaaaggauggauuccuauucauuuucuucgguaucuucaagauugcacagguuguuguauuuguuuuuagguuuguuuguuuucuuguuaacuaaaugaccaagagcaagauuugacuuaaauugcuucaauugauuaugugcccguggagaugcauacacaaagaauuccaccucaaacugccaagaaaaacucaauccuuccauaccauuccauaaaagauagacuuagaggacaaguccccuuguauucuuacuacuaaacagauaaaucaagaaaaagggacagaggcaucaaugggugaucuaaagcauucauaaaagcauacgaucgugauaaagcacaaucagugacuugcuagggggaacaggcaaauaaauaaauaauaaauacauaaguuucuucaagucuuggauccccuaguguuuugugcuccuggagccacucccagcugcgcuggcuucucuuugugcgaggcucagggaggcuccguccacugggagauugcucugcagugacugcaaggcuggucagcacuggaggaaccaaaucccuucaacagccagaccguugacuaagcaaaguuacucuaauuagccauccuuucucaauuccauuacagcccuaagcaaaaacuacagacauguuuugauggguagagcaaaugucugaugcaacugaauguacuggcagcuaugaaaaugucuuaaucacuuucaaacaugaagcaaauuccuggaggaaggaaucuaaauuugccacucauuccuggcucuauuagcaagcacuugcaaucagugacuauaaccaccaggacaccuugcuauuaaaaugaacuuuuacacaauuuuagcuuugcuacauuuaaauuuuauucaagauuuuuuuuuaaaggguguucaggaacauggaaagauuuuuuauuuaaguacaagauuuuuuguucuacacugaaaauugcauuucaaggucuccuuaggcucaaaacuacaccaaaaguauguuuacacacaaaacuccaaucugaucaauguguuaaccaacaacuguuagaccaaggcaaacaaaugcuuaguggugacaucuauuaauaauuauguucagucuaauuuuuauuuaccagcgauuuucuuucugcaaagauaaaugcuaaccaauuaaauggaaccagucuggauguccagaugauaagaacaacuuuccagaucaacgagguauucaauugauuucaucagcauaaaaccauucaacaaaaauaagcauaaaaacagccuuucugcaaucccacacuggaguggaaaauacaaaggcaccacuuggcggcuaagucauacauuugauggaaggaaaaugauacgcaggugguccugcugacaacagaugguaggaaaauaaucccaaaaaaccuuacuccuuccagugaucaugccaucguaaaagauuucucauuuuuaacauccaaauuccuaaaucaauguaaaauguauuaaaguauucugauaaaaaaagacugucaaugauucacccaaaugucuucuacaacaaaauacgaacaugagaaaggugacgucugcuaucguggaauuucugagugaaggucucagucacgcuguuuuguugaccaccuucuuggaggguagauuuguuuuucauaauccauucuucuacagauuuuuuuuccccuuuucuagauggaaaauguacaauuuuagggcaucuguuacucugagggcucaacaucccgaaagcaaauagcauuggaaaccucagccuuuuaaacuccagggacaccaucaagccccagccucucucgaaugcaaaccucucgccuuucaaauguguuuuccagacacagcaagcaagagcugggaagaaaaacgguuuagauccccuugcuggggaacagaaacagugguuggggaguacaaccagugucaccacguuaucacauaugggucaaacauguuugugagaaaaauuacaauuaaaaaaaaauuuuuuuuuugagacagggucuugcucugucacccaggcugaagugcaguggcgcgaucacggcucacugcagccucgaccucccaggcucaaucgauccucccgccucagccucccaaguagcugggacuucaggaaugugccaucaggccugguuaauuuuuauauuuuuuguagaggugggguuucacccauguugccgaggcuggucuccaacuccucagcucaagugauccaucugccucggccucccaaagugcugggauuacaggaaugaguuaccuagcccagugacaauuagaaauucuuaccuccauuuuuauacuacuguuucuaugaccuugagguuuucucaaaaaugccuuugaaguuagaaacugccuauaaaauugugagaugcccccaacucacaaacacuccuuuuuucuaagaacacacaaaagugauaaugguuguguuaaauaggaacuucuauuuuuuguuauauuuuuaaaucuuucuauaauuucuaauuuccauacuuacaaugcuuaaagaucccuaccuucucaaggacagaacuuuuuugcaugauuuaauucaugacuuucuucaggaaaacauucccaacaaaauguuucugauacacuuuaacgaaaucaugaucuauaauuuuaaaccacuucccuacuacccaacccccccaccuccuccaccaucaccacacccccaggugaucuucaagaacugaagguaggccgggugcaguggcucacgccuguagucccagcacuuuggaagaccaaggcagguggauugcuugagcccaggaguuccagaccagcaugggcaaaaugguagaacccaucucuacaaaaagaauacaaaaaucagcagggcguaguggcaugccccugccccuguagucccagcuacuugggaggcugaggugacaggauugccuaagcccaagaggcagagguugcagugagccgagauugcgccacugcccuccacccugggcaaaagagcaagauccugucucaaaaaaaaaaaaagaacugagggaaaccauuuugaccucauucuuuuuuguuuuuguuuuugagacagagucuugcucugucgcccaggcuggagugcaguggugcaaucucggcucacugcaaccuccaccuccuggguucaugcgagucuccugccucaguuucccgaguagcugggauuacaggcgcacgccaccauacccggcuaauuuucauauuuuuaguagagacggaguuuucaccauguuggucaggcuggucuugaacuccugaccucaugauccacccgccucagccucccaaagugcugggauuacaggcgugagccacugcgcccaacuggccucauucuuuuaacuagucuaaaaguaaccaccuagccauucuuuuuccauuaaauaugucuaccaaaagagucuuugaacuggccugcuggaggucucuuuccuuaaguuugacauaaaaguuggaaauacguucaauaacuucauuguuggaaaaaagauguuuaacuuuuaagggaaaacaaagggagagaugaggguaaaaggaaaaagcucaccuauauggaagaaugccagauggagaaauauagaaaagaauaacagaugagaaagucaccauuucacagugauuuacgcgagagucaucacuggaugugaauauacuggcaauggaaucaccgguaugaaacuaccauaguaccccacagggaaacucagcccuuacuagcaucuaacagucaaacucaguaucagcaauaacaggagggacaggcauugucugugauugcuggugugauacaacaguaaagacucacuaucaccgcaccaucacgacagcaucaccuaagugguauucuugcuaagaauguccagccugggcggggcgcgguggcucacgccuauaaucucagcacuuugggaggccgaggcaggcggaucacaaggucaggagauccagaccauccuggcuaccacggugaaaccccaucucuacuaaaaauacaaaaaauuagccaggugugguggcaggcgccuauagucccagcuacucaggaggcugaggcagaagaauggugugaacccgggaagcggagcuugcagugaguugagauugcaccacugcacuccagccagagcaagacucugucucaaaaauaaaacaauguccagccugaaucuaaucauagauaaaucugacaaauccacuacauaagacaacuggccugggcucuuuauaaaaauaaaucucauggguugggugcggugccuuacaccuguaaucccagcacuuugggaggccaaggcggguggaucacuugaggccaggaguuugagaccagccuggcaugguaaaacccugucucuacuaaaaauacaaaaaugaacagggcguggcagcacaugccuguaaucccagcuacuggggaggcugaggcaggaaaaucacucaaacccaggaggcagagguugcagugagccgagguugcagugagccgagaucauacaacugcacuccagccugggagacagagugagacuccaucucuaucuaucuaucuaucuaucuaucuaucuaucuaucuaucuaucaucucaugaaaaacaggaaggcaaagggaguacgaaaaacagaaaggcaaagggaguauucuaguuuaagaaacuagaaaagaaacaugaccaaaugcaauuugguuauaugcuggaccccacuguuuuuuuuguuuuuuuuuuuuuuugaaacagggucucacugugucacucaggcuggagugcagugaugcaaucauagcucacugcagcuucaaacuccuuggcucaagggauccuuccaccuaguccuccuaaguagcuaggacuacaggccugcaccaccacacugggcuaauuucuuguauuuuauuuuuauagagcugaagucucauuacguugcccaggcuagucuuggacuccucaccucaagugaucaucccaccucagccucccacagcgcagggauuacagcaugagccaccaugccuggccaggacccaauuuuuaaagcagguauaaaauauauuuaagguuaacagaggaaguuugaauacgaacucuaucuuagaugauaucauuaaauuaacguugggcugggugugguggcucacgccuguaaccccagcacuuugggaggccgagguggguggaucauuugcagucaggaguucgagaccaaccuggccaacaugguaaaaccccgucucuacuaaaaauacaaaaauuagcugggcgugguggcaagcgccuguaaucacagcuacucaggaggcugagacaugagaaucacuugaacccgggaggcagagguugcagugagccgaaaucgcaccacugcacuccagccugggcgacagagcugagacucugucucaaaaauacacaaauaaauaaaaucaauuaauguuaaaguuuuucaguugugggcugggggcguguaguggcucgcacauguaaucccagcacuuugggaggccgaggugggcggauugcuugaccucaggaguucaagaccagucugggcaauauagugagaccccaucucuacaaaaaauacaaaaauuagcuggacuugguggcacaggccuguagucccagcuacuccggaggcugaggugggaggaucacaugagacuggcaggcagaggcugcagugagcugagaucauuccauuuuacuguagccugggcgacagaaugagaaccucucaaaaaaaaaaaaaaaaguuucuucguugugauaauggcacuggggguaagcagaagaauguagggauauauucccaggagacgaugcugaacuaucugggagugaagugucugauaucuaaaacuuacucuaaaaaaguucagcaacaacaaaaaggaugcaaacaggagaaagaaagcaaagauggcaaaaagauucugaccuguaacuaacagaagaaacugcuucggcauauuuggugggaaacauacuuaaccaaccaccagcaaaccuccucaccaucaccccucccuaccauggagacauuuuauuauuuuagcaacuaacuccccaaacuagaagcaguaacucuauccaaauacuaaauuagaacucuaagaacuguuauucagaagccagagaagucugcuucgauugcuacgagugcauaaugcucacuuggauucaucaugaugucugucauauacacauucauuucagaagucauuuuuaauuuuuagcuuuaguuuggcauacgagacuaccagauauuucauucacuaaaagcaaaagggauccacacaauuagcuaucagggaaaugcacaucaaaaccacagugagaugccacuucacacucacuaggaugucucuaaccaaaagggcagauaacaaguguuaccaaggauauagagaaauuggaacccucaaacacugcugguuagaauuuaaaauggugcagcugcuuuggaaaagucugccaguuccucaagagguuaaacaaaggguuaacauacagcaauuucauuucuagauaaauacccaagagaaaugaaaacauuuacguucaggcaaagaauuguacauuaguguucauagcaauauuauucaugacagccaaaagguggaagcaaccccaaugccaaugucuaucaacugcugcauggauaaauaaaacguaggauauauccauacaacggaauauuauacagcaguuuaaaaaaccagcugggcucagaggcucacgccuguaaucccagcacuuugggaggccgaggcgggcagaucaccugagguugcgaguucaagaccagccugaccaacauggagaaauuccaucucuacuaaaaauacaaaaaauuagcccagcgugguggugcaugccuguaaucccagcuacucgggaggcugaggcaggagaaucacuugaacccaggaggcggagguugcagugagccaagaucucgccacugcacuccagccugggcaacaagagcgagacugucucaaacaacaacaacaacaaaacaggaaguacugauguacgcuauaacauggaugaaucuugcaaacaccauaauaaaugaaagccagacacaaaaggccacauauuguaugauuccauugauacaaaauguccaaaauaggcaaauccauagagagacagauuuggcucugugguuacugggaaugaggggagugggaaaugcagagugacggcuacuggguaugggguuucuuuggggagugaaaauguucgaagaucaugacaguuaugcaacucuguaaacaugcuaaaaaccacugaguuguacucuuuaaauggugaauuguacaguacgugaauuauuaucuuaacaaaguuaucugaaaaaccuggaagaauuaauacuuuuccagcaauugagacuaggaaaauaucucagaggaagagugcucggaggcaaagugauccagagauaucuuccugggguaaauguaucugcuccagaguauucauuuccuauuaaucauaaacaagaacuacaauggaacuacaaugccucuugaguugagcaacacugaagugucauggcaaaucagauucaagugcuguugauuccuaaaggaaauaaaauacauucuuuaauuaugaaauccuccccagaugucuuggcaaguucuaugaaagaaagaaguuccuuuuccacuaaauuuggagaagacaaacaggaugacaaacaagucuaaaaugcuauugagaaaaauucugcacugaauaauaaaaaauuuuagaaaaaaauauaaaauugaaauacacacaaaaaaacugaaaaugccacugacauuuugggauuaucauccauccuugaaugggaccguuacuaaugggcuacagcugucuucaaaaagaccugccucaaaauuuuaaaaaagccacuuguacugucuacauucaacuguccacagaaaacuuuugugagaaagauuucaccuaagacugaacaucuuucaucuugaccaugagauuuaaucauuagauauuaaauguuucucacaccugguuuaagcccaauuuucaacuuucccucuguaauauuaaaguaaggguuuagauguugauuaaaaaaaaaaaaaaaaaaaaaaaaaaaaaaaaaacaggccgagcacgguggcucaugccuguaaucccagaaauuugggaagccaaggcggguggaucgcuugaggacaggagucccagaucagccuggccaucauggugaaaccccgucucuacaaaaaauacaaaaauuagcugggcaugguggcacaugccuguagucccaacuaacucaggaggcugaggcaggagaaucacuugaacccaggaggcagagguugcagugaacugagaucaggcugcugcacuccagugugggugacacagugagaaucugucuuaaagaauuuaaaaaaacucaaacaaacaaaaaaccacaagucuuuuccaaaauggaaacguuacauagaauuggaaguuuccauauaauauggguauuugguuagaagucuuaucuucccuuguaagcaaaaagaacagauucaugcuaaaucuaguuuuauauagcugccaaguguuauuuuugccuuaaauacauauauuugagaacauauagucacacuauuuuuuuguuuguuuguuuugagacggaguuucacucuuguugcucaggcuggagugcaauggcgugaucucagcucaccgcaaccucugccucccggguucaagcaauucuucugccucagccucccaaguagcugggauuacaggcacgugccaccacgccuggcuaauuuuguauuucuaguagaaauacaaaaauacaucuccauguuggucaggcuggucucgaacucccgaccucaggugauccgccugccuucgcuucccgaagugcugggauuacaggcaugagccaccccacccagcagucacacuguuuuaauaacgguuacuugugggucccgugaggguuccuagauccagcuuagaaggaaaagauaaaaugggaguuggggauggaaggguauggcaucugucagguaggaaggugacacucaaggagcaugcauaggagucagggcaacugaagagggcacaaggacgaugaccauucagcccacucuaucagcaaacgccgagagagacagguuugggugccugaggaacgaugucugucucccggcaauggaaaaauccggugaagaaaccacauccaccuuccauggaaccuuucacacuguaacuuccugccauuaucccugcuauuuuuugccuaugaaaagccuucauuaaccauagugauacauagcgauggugucuuuuuauggcuacauucuagaaauguaauagguccugaaaacagggaucagaaaugguaaauaauaacuauagacacaaaaucuuguuguuuguucuacauaucuaugacugucuuugcaaaaaucgucagaggaaauggauuggugcucugaaaaccacccaauagcccuacuccacaccccacccucucucuguuggccaggguuuggcauucuguggacucuuccacacugugaugugucuacugaugcuuugacaacugucucucaaacagcugaaaacugaaugagucuuuuaagguccaaaaucuacaugucugacuuuaaugcagcaaugccugacauuaaaaugugacuaugucaauuaaguacaauaguccaaauagaugcugacuggugcaaacaacaguaugguguuauuucuauuaauauggcauaagagucuauucaaaaugcucuauauuaaccaccuucucacaguugagauuacagugaauauaaaaucaauuaaacucccagcuaauuuuuaaccuucuccccuacuuauaagcuauauucucccucauccucaauuccuucccguugaucugucugcugguuuuuuuuuacaaaaucucaagaaagagaaaugaaaguuuugaaaagaugaaacaaucuaaaacccuaucauuccaacacuuugugauuuucauguucuccuuuuuuuuuuuuuuuuuuuuuuuuuugagauggagucucgcucuguccgccaggcuggugcaguggcgcgaucucggcucacggcaggcuccaccucccggguucacgccauucuccugccucagccuccugaguaucuccuuucaaccuucagccacauacaugcguuuuuuaaauacaauuacuauuguggaauacaguuuugcauauuuucccauuucacagccauaaacauuucuccuaguagcuaaaauuucuccugugccccugaaugacaaugaucagguauauguaccauacaugauucacugaacugaucuuucaacaucuucgacaaggcuauggcaaacauuuguaacaaacauuuuauggaauacaguuuuccuuccccuguguuauuuauuuguugaauuuccagaauuagcagcacuggagcaaaggauaugaacacuuauauggugagacauguugccaaauugcuuuauaauucgaucuucuaaaaugcacaggaauugaugcauuucaucaggguguuuuucuucuauucuaccuagacuccucccuccucuguccuuccacagauccagugccuuccuccuuacgccaucuucaagucugacugcucugcugcacugagagcuaacacugucuuuccucuuuauaccaaaaugcuggcaccauaucuaaguuugaaaaauauuuaaauaggaguagugaaagaaauaagcaaugacagaagauaauugaaguaaagaucaaaaaauuuaaaaaagaaagaagagaaaaauaugugauccagcaucagcuaucuauccuaacuuuuaacuuuuuaaaucauuugucacuuugagauguccgucuucacuucucaugcaaguugauaaagaauuaacccuggcaaggccaaggagaguuuuacagcagacagcucugaccaggaugaucaauuacauuuauuccagauauuuugaucagcccacauuuagacagagcugcugaaugacucaauuuugucaaaucacuuuggugaaaugcagaaucaccaucaucaguccagucccccaaauccuggaguccaggaaccugaaaacaacaacaaaaagaccaacuaaaggaagaacgaaaagaauauuacauaaaugucauuguugggcucauccuuagugaacccacacugacuccuaacgaucaccaauuucuuuucucacacaguuguugaguaauccacugaagcccaggaagguuauuauaaucaucauuaacuaugguuccucuggugacagacugaugagggauggaugggaaaggacaaagagcagcuuuuauauaccuuugcauguacuguuagauuuuuaacaagcauuauuauucuugacuuuuaaaauauugaauuuaaacuaagugguccuuuuucccuaaagguauaauacuguauguuuauuuucuuuuuucaaguugguuuucuucuguuauguuuuaaaucuacuggauugaagucaguuuagcuaauugauuuccugggucacuauaucccuacagugacuauuuaaaguucaaagagcaauagcaguucccuuccuacauucugauuuuuggaccauuuuuagaaugggcuagcugaauuccugcaaaggaaaaguuuuaagcagucauaugaacauaagucagaccaguuaacaaauaucugcuuccaguuguucaauaacacuuuucaacuaagaaugcuuugauuacuaaaacccacugaccuguacacuuuaaagggguaaacuauaugguaugugaguuacaguaucucaguaaagcuauugcaaaaaaaaaaaaaagaggcuugauuuacauguauaaauuuaacuuugucccuaagauauaaacuuuuuuuuuuuuuuugagacggagucucgcucuguugcccaggcuggagugcaauggcgugaucuuggcucacugcaaccuccaccuccuggguucaagcaauucucccgucucagccucucgaguagcugggauuauaggcacccaccaucaugcccggcuaauuuuuugucuuuuugucaagaaaggguuucaccaguuggucaggcugcucuugaacuccugaccucaggugaucugcccaccucagccuccgaaagugcugggauuacaagcgagagccacugcgcccggccaacauaaacuuuuagacaaaaauuauuuucccacagauuuaagcuuucaacaaaaucauccuuugcaaaugaaugagauguuugaagcuaaauuaauuuauuuuugucaaaaacauuacagauauauuaccuaaaaauguaccucuaauaugaauuuuuacaucauacuauuuaucuuuaauucuuuuuuuuuuuuuuugagaugaagucucacacucucacccaggcuggaguucagugauacgaucuuggcucacugcaaccucugccucccggguucaagcgauucuccugccucagccuccugaguagcugggauuacagaugccugccaccacaccuggcuaauuuuucuauuuuuaguagagacgggguuucuccauguuggucaagcuggucucaaacuccugaccucaggugauccacccaccucggccucccaaagugcugggauuacaggugugagccacuaugcccaagcuuuuuuuuuuuuuuuuuuuuaagagguggggucuuggccagguauaucuuauucuuuuaugaugucaguggcacuuugagcaaaacuaauaauuugcuuuaaacauacuaguuuuagagccagcaggcuuuggccucuuguccucaaggaaugucagcaguucauucacgucuccuucccaaggccgcacccugcuccacuuucaucuuggcaugcuuggauauugagccccagccaagcggauguucuccauucucuuccuuucuuuuauucaaucccuucugcauaccauuagcuuuccucaugaaacagugcccccuccaccugccccaagcuggagagugcauugacagggaugagaacagacaguguagauuugagcugggugggcucagcuuaaaggggcaagacaaugaaguagaggcauccuagguggagagaugcagagguuugggauucaucagcacauagauguaauggaagccaagaacaucgguaagaucucucaagagcugggcguguuggcucaugccuguaaucccagcacuuugggaggcugaggcaggaggaucaccugaggucaggaguucgagacuagccuggccaacauggugaaacccugucucuacuaaaaauacaaaaauuagccaggugugggugcggaugccuguaaucacaguuacucaggaggcugagacaggaaaauugcuugaacccaggaggcggaaguugcagugagcagagaucacgccauugcacuccagccugggcaacagagugaaacucaaaaaaauaaaaauaaaaaagaaaagaaaagaaaaucucucaagagaguauagugaguaaaaaugaagaaugugaacugaagaaggaauuuauuauuaucuguugaauggauguuucaacaaccaguuuugcauggauacagaguuagaggaagaguucugaguuaguggaaaagcaaagcuuucaggaaguuaagugguaauucuccugccacuaaguuaccuagacucucacaaaaucauagugagagucaaagagaaaaauuaaggcccagaaguggugacucaugccuguaaucccagcauuuugggaggccaaggcagggggauugcuugagcccaagaguuggaggccagccugggcaacauagcaagacccuaucucucaaaaaauguauaaauuagccaggcauggugguacaugcccauagucccagcuacucaggaggcugaggugggaggauugcuugagaucaggagauugaggcugcaguaagcuaggauugcacuacugcacuccagccugggcaagagugacacccaucuauaaaaaacaaaauaacccccgaaaaggaaagaaauccaaagguuaacuuaacuucagcuaaucaacuaccuuuuacaugcaggcaaagaaaaugugcuugaacucuggaguauaagggaauugagacccagaaaaccuuagauuugaaguuguagaaugucucucuuagcuuugaaaaaagaacagcaggagggaccaagcaggccugugagauggucuucacuggugaaacaguccuaaggaaggcuucagcaugaugcucccuguacuaagucuauuauuuugugauaaaaauuacaaaaagcuuuaggaauuuucuucuuuuuggggguggggagggaagaagaaaaacaaagaucuucuaaacuuuaguuaauucaugccagauauucacuugcuaaaaaugaaaaugccaacaaaugaaguguuugaacuugaaguuuuugaacuucaaguguuugaacuugaaguugaagucauuuagccauguuucugaugcagacagaauucccaaaauaaaagccaaccugauaaugggauaaauuuagagccaaaggacaaucauauauaaauaugaucaagauucuguagucugcauuucuuagaggacacccaaggugugggaaaguugacugcauuauguagacauuuaucugaggccaugacaccgcacuacgugaaaaaguacuuaaaauaaacaaaagcaaugagcagagcuuuuauuuauuacuacaugcacugacugaacagaagaagaacguguagcagaccagcaagaaaacaucuaaaaaccauuguuuugggccgggcgcaguggcucaugccuguuaucccagcacuuugggaggccgaggcggguggaucaccugaggcggguggaucaccugagaccagugugaccaacauggagaaaccccaucucuacuaaaaauacaaaaaauuagccgggcaugguggcacaugccuauaaucccagcuacucgggaggcugaggaaggagaaucucuugaaccugggaggcgguucaagaucucgccauuccacuccagccuggcugacagagugagucucuguaucaaaaaaaauuuuuaaaaauaacaacucagccacccacuugcauuaauuuauucacuagucauucauuugcuauuacuuugcucccaugugaguuuuuuaaauuauuaucuuaacaggcuaaauugcuaucuuaacaggagguugcagugagccgagcucacgccauugcacuccacccuggggaacaagagugaaacuccaucucauaaauaaauaaauaaauaaauaaauaaauaaauaaauaaaauaauaaaaaccacuguuguucuuguuuguuuuugagauggagucuggcucugucgacaggcuggagugcaauggcaugaucacggcucacugcaaccuccaccucccggguucaagugauucuccugacucagccuccuaagcagcugggcuuacaggcacccgccauaaugcucggcuaauuuuuguauuuuaaagacgggguuuguauuuuuuagagacggguuguauuuuugcguggucucgaacucccgaccucaguugauccacccgccucugccucccaaagugcugggauuacaggagugagccacugugcccagccaaaccauugguuuuuauuuuauuuuauggguuuuuuuuuagauggagucucauucugucauccaggcuguagugcaguggcacaaucucggaucacugcaaccucugccucccgguucaaacgauucuccugccucagccuccugagauugcaggcgcccaccaccacgcccagcuaauuuuuaguagagaugggguuucgccauguuaaccaggcuggccucgaacuccugaccucaggugacccacccacgcuggucucccagagugcugggauuacaagcaugagccacugaagccggccaaaccauugguuuuuagaugccaacccucaagaugcaaccugaggagugaaggauaagggaaugcacaggugcaugcuggaagaaaaagaguuuaggaaaaguauggaggaauauaaacagaggguccugagucacagggcuccagggugcaguggcacgaucucggcucacugcaaccuccaccuccccgguucaagcgauucuccugugucagccucccgagcagcugggacuacaggugcgcaccaccacacucagcuaauuuuuguauuuuuaguagagacagguuucacauauuggcuagguuggucucgaacuccugaccucaggugauccgcccacugggggccucccaaagugcugggauuacaggcaugagucacugcacccaaaauaaagagaaaaaugugcaguaucaauucucguuucagacguacgaucugcauccaaacucaaagagcucuuacagccuggcauuagccaccucuaaaccaugacgggcugggagaagugaggacagggucugaaacaaggggcuggccuuauuagaucaucauucaccauuuacuugacagcagaucuuaguaauacauccugaaauaccuaggaaggcagagugcacagggaucuuaggagcugucugacaucccagaaguuaauaaugagagacaucuccuauucggcagcauagccaaggccccugucacacugcagugaucucaucauacccaugagcuccaagucugagagcugcccaaacaggagugagaccucuagcauugaacucaagagcgaucgaaucaaaagcuccaacuccuaguuaaauuuccacucuacuggcucauuuuaaaaacgggaaugauaccagucaccucacaaaagucauaaacuguugguaacauagggaauagcauguguaagugcccaaaaacaacugcuugguaccuaauaagcacucaaacccaauaaacguuagcgaacugacaguaagaaaagagacuguauguuuauauuucuauaugcaccugauucuuuauuaguugauucucuacaaguuucaaccuuguaauuaacacaaaaauacacaguaaaacaacuguguuaggaacccucagacacagguggaaugccccaaauuggcucauccaaucccauguccuucauucacauuguuaaugcuuugugcaaggaaaaaaaaaaagagaaaguuacauugaagaaaagggucggcugggugcaguggcucaugccuguaaucccggcgcuuugggaggcugaggcagguggaucacuugaggccaggaguucaagaccagccugggcaacaugcugaaaccccaugucuacuaaaaaaacaaaaauuagcugggcaugguggcaugcaacuguagucccaggaacucgaggaugaggcacaagaauagcuugaaccuggcagguggagguugcaaugagucuugacagugccacugcacuccagccugggcaacagagugagacuccaaucucaaaaaaaaaaaaaaaaggaaaaaaagggccaauaagugggcauauuaaacguguguguguguguguguguguguguguguguguauauauauauacauguauauguguguguauauauauauauacauguauauauguguguauauauauacacauauauacacacacauauauauauacauauauaaauauauaugcuauuuuuuaaaagaaggaguaccuaggaaaauauguuauuuuaaaaaauauaggccgggcgccguggcucacaccuguaaucccagcacuuuggaaggccaagguggguggauuaccugaggucaggaauuugagaucagcccagccaacauggugaaaccccaucucuacuaaaaauucaaaaaauuaacggggcgugguggcaggcgccuguaaucccagcuacuugggaagcugaggcacaagaauugcuugaacccaggagguggagguugcagugagccaagauugugccacugcacuccagccugggugacagagcaagacuccgucuccaauauauauauauacacacauauauuuauuuuguauaaauauauauauauacacacacacauauauagauacauuauguguauauauacauauauauauaguguguauauaaacacacacacacacacacacacaggcugggcacaguggcucauaccuauaauucagcacuuggggaggcugaggugggcagaucacuugaggucaggaguucaagaccagccugacuaacauggugaaacccugucucuacuaaaaauacaaaaauuagcugguguagcagcacacaccuguaagcccagcuacucaggagguugaggcaggaggaucacuugaacccaggagccaagauagugccacugcacuccagccugggcaacagagcaagacccugucucaaauaaauaaauuaauaaaauaaaauacauauaguuuaguagauauuuauuaagaagcaggaaucaguagaaugagcucuuccucuuuauguggccaaaaguaaucuuacaagaauagcccuauguugauuuuuagguuuuacaaagaaacaaccuucuuaaaaguuuaguuuaguuacagucucagaauauaguuauuugcuuuucuaugagacugucagugaucagacucaaggaaaaaauaaaucaguguccuucucaaguucuucuccaaugcugaaaaaagccagcuggucagcucacagcaaaggaaucacaagcuuuggggauuuuucccucuucaugaccauaaaaagcaacaaacucgugacauuucccuuuacuuguauuugccagaggaagaauuugcaacuccauucaagaaggcucugugugaccuuccccugaucuucguucaaguucacauacaguuacaauaccuccaguauucauugcaggagcggcagagaguuugaggacacaauaaucuacagcuuuucacuccacaguaguccaauugucucuggccccagaaaauaugguuaagggagaguuuguaggcauaaguggcuugccccaggaggguuagcuccacaugcaauuacgugccauagaaauuaguucuacaaacaguuguuacuggagaccaaaaaauaaaaacuaaaucuaaugcaaauuaucagaauuauuugaacaaugaaauccauccaaagugugcucaaugcaaaaaaauuuuacuuauccucauuuucuacuccucuuucucuuccacccaauccccaaaguaucagcaagucuagacagauguaacuuaauaaggagauuaaaaauaugaaaucuuucaucaggauaaucuaaggcacuucccacauacuguaaauuuaaaaguugugacaugcagccauaaaaaagaauaaaaucauguccuuugcagcaacauggaugcagcuggaggccauuauccuaugcgaauuaagccaggaacagaaaaacaaauacugcauguuaucacuuguaagugggagcuaggcugggugcaguggcucacgccuauaaucucagcauuuugggaagcugggguggguggaucgcuugaggucaggaguucaagaccagucuggccaacauagugaaacccugucucuacuaaaaauacaaaaauuagccaggcgugguggugcacaacuguaaucccagcuacucaggaggcugaggcaggagaaucgcuugaaccugggaggcagagguuucagugaguugagaucacgccgcugcacuccagccugggcgacagagcaagacugucucaaaaauaaaauacaaauaaaugaauaaauaaauaggagcuaaacauuaagugcucguggacagaaagauggcaacaguagacacugggaacuacuagacaagggagagagggagggggcaagaguugaaaaacuaccuauuagguacuacgcucagcaccugggggaugggaucaauuguaccccaaaccucagcaccacacuauauaccuagcuaacaaaccugcacaugcauccccugaaucuaaaauaaaagcgaaauuauuuuuuaaaaaguuguggcauauuucauaucuuuccauuuaaccaaagauuaaagaauaagaaucucucuauauuugguuaauuuaaaguuuauauauauauauaggccgggcgcgguggcucacgccuguaaucccaacacguugggaggccgaggcaggcagaucaccugaagucaggaguuugagacgagccuggccaauaugguaaaacccgucucuacuaaaaauacaaaaauuaggcaggcaugguggcacacgccuguaguuccagauacuugaaaggaugaggcaggagaaucucuugaaccugggagguggagguugcagugagccgagaucgcgucacugcacuccaggcugggugacagagugagacuucaucuaaaaaagaaauaaaaaauaaaauaaaauaaaauuuauacauguguauauacacacacacacauauauaaaaaauacaaucaucuuuauaggaagaaaaugaaauuccacccuuuccccuuccuaaagaagagaaaauuuucuuuaauaucuuaagauuauuuucucagucccagauuagaauauaaaguuagguaauuauuggcuuuauauugcagaucauaauaaaugcagaagucacacccuacuguucaaaauucuccacagcagagccacaaaauacuacuaaagccuucugaauugcuauucuaauugugcucucuucucuagccuggccuuuccaaacuguauuuggguaaagaugcacauuccauuuccccuuuugaagauuaauaauuaauaauauuaacauauuaaggguucuggaaaguucugcagucuggaaaauccaagcuuuaacucaacuuuuccuagacuauuuuucaaucaguauuucuuccaacaggcugagguuccuuccugccucauuauucagugguucuuucucucgugcaucuccauucugcaaagacucagcacaaauuucucuaugccaccuuuccugguacucaguaucucugagcacugucggauuggugccucuuguccagcacuuggaugcaauucagggcaaaaccugguacaugagcauguuuaaguccacaaauggcuggguacaugcucagcuggguccccugcagugcugaacacuggcagcaaagaaagaccccaaguucaaguucaguuaaaaggcucucucugguuuucccuucuuccuaaauuuauuuacacaucaauuguccauuagcgcuugcuuuuugcucuuuaaauaauuuuuuuguuuuguuuuuggauaaccugucauccaggcuggagugcagugguucaaccacgacucacuguagcccagaccucccuggcucaagcaauccucccaccucagccuccugaguagcugggacuauaggcacaugccaccaugcuuggcuaauuucuuguagaggcagggucccaguauguuggccaggcugguguuuaacuccugggcuugagugacccuccugccucggcuucucaaagcacugggauuacaggcaugagccacuacgccugacucuaaacaauuuuuauuccaggaucccacaauaaagaaacaacauuuaucaaucccagccaggcgcgguggcucacgccuguaaucccagcacuuugggaagccgaggcagguggaucaccugaugucaggaguucgagaccacccucaacauggagaagccucgucucuacuaaaaauacaaaaucagccggcgugguggugcaugccuguaaucccagcuacucaggaggcugaggcaggagaacugcuugaacccgggaggcagagguugccgugagccgagaucgugccacugcacuccagccugggcaacaagagcgaaacuccgucucaaaaaaaaaacaaaaacauuuaucaaucccaucuacuguuuuuccagucaccugccuauaacuguaacuucauuuuuguugacaagggugcaggcacaugugcugaaucugugacuuucaguccagcccuccuagcggcugggaaguuaauucagcccccaaauuugccuacaacuaaagcauucugggcgaagaacaagcuggguucugaagaucacagggacugcuugagaaacuuucucugacaaauguaauacuuuaacaugaccuacuucccugaauacuuaagcauucuuugcauuccucccugucaugcagagauuguuuaucaggcacaguuccagaagugacuugaaaucucugucauuguugcgauucaagauaaaauuguaagcccucuucagucaccagauucucaguuuaggacaaaaauucaaaaaccucaguaagucuuuaacgaauaucaaacgaauaaccgaucguugucuuaaucaaggcuaaaugagcuuucuguauuaucaacaaaaugaagacugaucuaaggccaggcgcagugguucacaccuuugaucccagcacuuuggaaggccgagguggguggaucaagaguucgacaucagucugaccaacuuggcgaaacccggucucuacuaaaaauacaaaauuagccgagugugguggcgcaugccuguaaucccagcuacuugcaagacugaggcaggagaaucucuugaaccugggaggcggagguugcaguaagcagagaucacacaacugcacuccagccugggcaacagagugaaacuccgucucaaacaaaaaagacuaaucuaaaacugccaucaaacugaguucagacuaaacuuuaguuccugaagguuuuacaaagaaaauaaaucagcuauaaaaccaaucaacuggguuuuugcccacauuaaggucaacuauuuuuuguuuaaauuuuauuccacugcuuuugucaguggaauacaaagauuguaauggucaagacuaauuuaguaaacuuuuguagugacauguuccacugcuuuucaauagcuuauuucauguaaaacagagcagaacaagaacaaaaauuuccauuuaaauauuuagguuaacaauauaggaaucaggaacucaugucuaaguauuggauaaauacgucauuucuggccgggcacagugguucacaccuguagucccagcacuuugggaggcccagggaggcagauuaccugaggucaggaguuggagaccagccaggccaacaugguaaaaccccgucucuacuaaaaauacaaaaaaauuagccaggugugguggcucacaccuguaauuccagcuacucaagaggcugaggcaagagaauuguuugaacccaggaggcagaggucacagugagcaccacugcacucuccagccuggguaacagagcaggacucugccucaaaaaaaaaagucauuugugaaaaaaaucaucauagcaaaauuggcuaauucuuagcaaucucuuguagacuacaauccuauucccccucucccucccaguuuguacugcagugcauaucaaguguaaguucaaaguagauaggccaccuaagguugaaguuucuauaggauucaauauauuauugauguugaauaagacuguuuuggccgggugcaguggcucaugccuguaauuuuaauuucaggaggcccaggugggacuauccuuucagcccaagaauucgagaccagccugggcaacacagcaagaccugucucuuuuuauuuuaaaagaaaaaaaaauuaaaacgaacaaaagacuuuuacauauguauccaaaugaaaaacaauuucaaacgaaaguuucuaaagacauauucuuugaguaauuuccuauaacuuugugaaaaauuaucaccaagaacugaaaacauaaagagguuaaaaacugugaaaugcaucaacaaucuugucuuacguaucacaacaaaauauacuuuacagagugaagaaaacuaggagccaaugaagcaugucuucacuaaaaguggucaauaucagggagugacaauagaaauucaucauuguggcagguaaaacccagggccuguaauggcucaauucaauaaaaaaaucauaggcucagacacaaagaaaaauaaaucauaaauuguuuucugaacaacaaaccaaagggcagacacuggggauggaaaaauuacaaagcgaaaaugucuucucuggagggaaagacacgcauuccccaagcaaccucauuucuuugccuacaaauggaaggaauacagucaaugaccaggcucuuucauuuuuuaggugcacccagccaugcugggauagaacagucacuguggcaugaugccaucacgaucugccaacugcucauccggcggcaucucuuuuaucucguuuucucaucuuuuuuuuuuuuuuuuuuuuuucccagagacaggggucuugguaucuuguccaggcuggucucaaaugccuguagucaaaugaucuucccaccuuggccucccaaaguacugggaauaccagguccaccaugagccaccaugcucaccucuaguccucucuucuacuaagacucacuuugguuccaccugcacuucuccauagccacuaucggggccuucaguguugaucaucucuuuuccuaaaaaacuugacuuucuggccaggcacgguggcucaugccuguaaucccagcacuuugggaggccaaaacagguggaucaccugaggucaggauuuugagaccagccuggccaacauacugaaacucugucuuuacuaaaaauagaaaaauuagccaggcaugguggccugcaccuguagucccagcuacucgagaggcugaggcaugagaaucuugaacccgggaggcgggggugcaguaagcugagaucgcgcugcugcacuccagccugagugacagagcgagacuccaucucagaaaaaaaaaaaaaaagaaagaaacuugaccuucagcugugccucccuugcccaauacuccaaaagccucgauggccuccaaugccaguggucucugcugugacgcagaccacuauuagagaaaugcuuugaguucacggaagcccucugucauuaucuagagagucugccucaaaccucugcuuuacuucuauuuauuuauuuauuuguuuauugaggcagagucucacucacgcuguugcccgggcugaagugcagcagagcgaucucaacucaaugcagccuccgccucccggguucaaggguuucucgugccucagcuucccagguaggugggacuacaggcgcgugccaccaugccuggcuaauuuuuguauuuuuaguaaagacaggguuucaccauguuggccaggcuaaucuugaacuccugacuucaggggaucugcccgccucggccucccaaaguauugggauuacaggcgugcgccacugugcccggccaaaccucugcauuacuuuaaagucccaaguuguuauuaucaagugauguucucuguucuaaagguacccuuaguauaaauuuuuuggcaugguuuguuacacaccaguagauaacugaaaccaacaucauggaguagauguucuugucagacuauuggagaaauagagguacuccaucuuccaacucuuaaaaucucauuguuugugacuuacccccaugccaagccucuacccugugccaaaucucacugccccacugauaucugagaugucacuaccacacugugaaaaugcuugccaacauaaucucccugaagucacccuuucuagucacacuucccaccacuuuacugugcggauguuaucucugccuuauacaagagggucucccagggguucacgacgcacucaccugguauuucugaaacuuuguuuuguucauugucaaaagccggcaguggcucucuauugccucugcagcucuuaacaucgacgggcugcaacuuauccucuuucauuguuuccuuaagaacuaccaacucaauacgucuuguaccagaaggccuccugacuaauggccucuuaucugccuagaacacuuucccaaaaauucuuuuuuuuacaguaguacuaauggcaauucuucuauuaccuagccaacuuauuggaaucuuugcuguugaauauuucaucuagaaaggccuuaccucaucucaauuaugagguguucaaggguaauguuuuuauuucuuuaucucccaaagcaucuagaacauaaguaugugguuagaaaauaucugaccauuuuuggccgggcgcaguggcucacgccuguaaucccagcacuuugggaggccgaggcggguggaucacgaggucaggagauugagaccauccuggcuaacacggugaaacccccaucucuacuaaaaauacaaaaaauuagccgggcgugguggcgggcgccuguagucccagcuacucgggaggcugaggcaggagaauggcgugaacccgggaggcggaguuugcagugagccgagaucgcgccacugcacuccagccugggcaacagagcgagacuccgucucaaaaaaaaaaaggaaaauaucugaccauuuuuaaugaaugcuauuacauaccaagaaaacaagcuaagcuuaaaagaacacacgauucccauuuucuuauuuuauuuauuuauuuauuuauuuuaagauggagucucacucugucacccaggcuggagugcaguggugcaaucucggcuucacugcaagcuccgccucccguguucaagcgauucuccugccucagccucuagaguagcugggacuacaggcaggcgccaccacacccggcuaacuuuuuuguauuuuuaguaaagcggaguuucaccauguuggucagacuggucucaaacuccugaccucaaaugauccaccugccucagccucccaaaugcugggauuacacgcgugagccacaacgcccagccuauuuauuuauuuuuuugagacagggucucugcagcuucaacuucccgggcucuagugaucuucccaccucagccucccaacuagcuggaauuacaggcaugugccaccacacccggcuaauuuuuaaauuuuuuguagcaguggggucucacuaugcugccuaggcugaucuugaacuccuaggcucaagugauccucccacccucaccucccgaagugcugggauuauaggcaugagccaccaugcccaccaggugugagccaccaugcccacgagccacauguugguauuuauguauguaugaacucaccauagccaugaaagagacaaggguaacacuugagauguagaauauaaaacuauuuuaaaccaugggcuugcuauuauaauugaucagauguuuagccacucccacaaugcuuucaguuuauugcacaaauagacacagcagaaaaaauuuaaaaguaaaaggaaaucaauaaacagguuuaugcauauauggaaacuugaguuuuaacaagagguaacuuuuuaaucaaugguacuggagcaauagguaacccauauaaaaaugaauuuaagauuucuccuucuagacaucaucaguagcuaguggaauaaagaucuaaauauaugaaagagagaacuuuaacuuuuuuagaacugaacuucuguuuccccaguuccuagcacaguuccuggaguacagaagcuaguaaagaaguauuuaugaaauggccaggcguagguggcucacccuguaacccagcacuuugggaggccaaggcaagaggaucacuugagcucaggaguucgagaccagccuuggcaacacagugagaccuugucucuauuauauuaaaaaauaaauggaagaaauuaaaacagaaauauuuaugaaaucaagauugaauaguaaguggcugagaaagccagaacucuauucuucaacaacuugguagguuuuaaaauuucuuuacagauuuuuggaccagucaaaugccauaaacuaagcccuuagcuacugucuacuuauucagcacaagggaaguuuuaaaaugauaaauaagggaagagggcuuaggaggcaaugagauggaaggggaacaccgaaaagucacagcuucuggcucaguagggauacgggcauuucacugaacaccuacuuaccuugaauggcacaaucuauuuuaaaaagccuccguuagcaauccacuuuuuuuuuuuugagacagagucuugcucugucgcccaggcuggagugcaaugaugcggucucggcucacugcaaccuccaccuccuagguucaagcgauucuccugccucagccucccgaguagcugggauuacagguacacaccaccauacuggcuaauuuuuguauuuuuaauagagaugggguuucaccauguuggccaggcuggucuugaacugcugaccucgugauccgcccgccucggccucccaaagugcugggauuacaggcgugagccaccaugcccggccagcaacccacuuuuuaauauagucaaacaaaggaaugaaauuauguggaagaaauauuuuccuuuauuuuauccuccagaugugugaaggaaaaugcuacucuuucaucaugugaaaccgucccucucacccacacaaguuccaaucucagugaaaucugcacaugcuaucacccagugucaccuagaccugaaccucucccuggcccuuauucagcucuuacgccuacuccuuccccucccuuaagguaauggagcccacaccccacacauuagaauaucugaugagcauuuuaagacuacagaaucccagcacaguggcaggagcugguagucucaguuacucaggaggcugaggccaaaggauggccugaguccgggaguucaagacuagccugggaaacacagugagacccugucucucaaaaaaaaaaaaaaaaaucacagaaucccagacccugagauugccugggauucuaauucaauaaauccaggaugagguguaggggugucuuugaaaagcucucuaggugauucaauagcaccaccagguuugggaauuaggaaaaauuuaauccuucaauacucccaguuugcaguauuugcauauaacaaauagauggucagccaauaaacugcaguaaucucuccuucuuaaauuuugguuuauuucguuuugaaaucaaacaugaaacugacaugcuacuacaacugggauuaagauuaggcagagagaaacuacaggguuucccccauuuaaaaaacaucacagagaaaucacagggaagacaaaaagcuuugaaccugaaaugaauacuuguauuaagaggugccuaauggugucccggugucccagaugguuuccugugcuuugaacaccuacauuuuucucagaaaauccauguauaccauccaguuaacagagccaggcuguuugccgugagaacgggagaggaucccggguaagccuucacucuauuguuuucccaagagguggauuucugcugcuuccaaucccugaucucaacauuucacggaucaugaccacaaaguaauuucuggcaacuaaaugauuuuagauuguuccaagagaagaaauuuuaaaagugauagcuaaagaaguaggucauccuccaagcaaauaaauuuaaagaugguucauuaauuuggaaaggaaaaggagcaaaggagaguaagacugcucuaccucagcugcguuuuuauucuugaacuugcuuuuuuccaauuugauuaauuucuggggaaaaaguuuuuuuguuuuuuuguuuuguuuuguuuuuuuaaauagagauagggucuugcucugccacccaggcuguagugcaguagcaugaucauagcucacugcagccucauacuccuggguggaagcaauccucucaccucagccuuccaaguagcuaggacuacagguacacgucaccgcacccagcuaaauuuuuuauuuuuuguagagauggggucuugcuauguugcccaggccacucuugaacuuucucucaagugauccucccuucuuggccucucaaagugcugagauuacaggugugagcccccacaccuggcuagaaaaaaaaaucuuuaaaaauuaauugggcagggcaugggggcucacaccuguaaucucagcacuuugggaggcagaggugggaggaucacuucaguccaggagguccagaccagccugggcaacacagugagaccuugucucuaccaaaaauaaacaaaauuagccaggcaugguggugugcacuuguagucccagcuaccugguggugugugccuguagucccagcuacucaggaggcugaaguaggagggucauuugagcccaggaggucgaggcugcaguaaaccaagauugcaccacugcauuccacacugggcaacagaaugagagccuaucucaaaaacaauaaauaaauaaaauuaaaguuaaaugaaaaugaaaaugaaaauuaauuaacagugaaacaaaccauagccuuucaugcucugacagccagaccagugcaugaucagauggcaagcacauggcagagaaacaugaugaggcauucaacuucacaguuaaaaaugcaccaaggaaacugagguaccauucuucaccuagcacauuggcaaguauuggaaaaucugauacccaugaaggcaaagcaugggaaaacgagugcugaucuccacgguggaacugcaaagugguagaaccucuuuggaaagucaauuuaggaaggguuaaauuuuuuguuuuuguuuuuguuuuuguuuuugagacggagucuugcacugucacccaggcuggaaugcaguggugagaucucagcucacugcaaccucccccucccagguucaagagauucuccugccucagcuucccaaguagcugggauuacaggcaccugccaccacacccagcuaauuuuuuguguuuuuaguagagacgagguuucgccauguuggccaggcuggucucgaacuccugaccuugugauucaccugccucggccucccaaagugcugggauuacaggcgugagccaccgcaccuugccggguuaaauuuuuaaaugcauauaaagcuugcaauucagcaauuacacuuauggacgaggacaaucuaaauauaaacccaaggaauugguuaaaucguuacagggcuucaacccacaaaagggaaauuuaugcacccaaauuaauaagaaugggggcaguuauuuauguccugauaugaaaagacauccaaaaccuaaaucuauaugugauaugaucuuuuucuuaaauggaaaagacugugccauuuuuaucuacuuucaugugcaugaaguuuucgaaagaauauguaagaagccaucauauuggcuucaaauuuuacuuaaauuugugaguaauuuacccuacuuauaaauuuaaguucucaaucauuaauuuuuuuaaaaaauaaacauuaaaugaauauugcuaugcaaugacuuuaaauaaaaaucauuaauaaggguaaacacaugcuuuugauuuuuuuuuuuuuuuuuuuugagacggagucucucucugucgcccaggcuggacugcaguggugacugcaguggugccaucucggcucccugcaagcuccaccucccggguucacgccauucuccugccuuagccggguggaucacgaggucaggaguuugagaccagccuggccaacauggugaaaccccaucucuacuaaaaauacagaaacuuagcugggcgugguggugggugccuguaaucccagcgacucggaaagcugaggcaggagaaucgcuugaaccugggaggcaaagguugcagugagccaaaaaaaagaauucgguucaaggaaauuuaguugcuuuuuuuuuuuucaagagauaaacguacuggcuuaauuuuucuuagaaugcuuagugcuauaaauucuaauuucuaacuucgcaugaauggcuacugcauauagaauuauagagaugggggaugaugccauuuaguuugaguuuuccugcacugguguucuuuaagcacugaauauguauuaaaacuaacuaagacaaaggaaaauaaauaauuuauuagcauuuuuaaaaacaaaacauuuuauuuccauuuuguuaauuaucuuacaagauccaaacuagaauaaucuuauaaugucagcuuaaagcuguaaaggcauagaaauuagucaacccaaagaggaugcacauuucaaggccuuuucuucauagaaggaaauauuucaagagaaaaucuccacuuaucuuauucauccacuagccuauaagcuguaauggauuuaaaggaagcccugcgauuccugcagucuaucgguacccaaaagaaucauccccacauccauaucuccaauuuuuggucucuguucugaucagaaauuagcagcucuuauaaucugguaaaaauccacaggaauacaaguagccacacacagagaaacaucccucuauuaagaaacauauaauucuugccuuaaauucuggcccauuuuuguaacacuggugauguagucacuuugaggccaucuucguucuccauuuccauugcuaaacaaguggcaaauaggaggaagcuuaugggaggaauuaugaaaugcagcuggccgccucaauugucugguuuuguuuguuuguuuguuuguuucuuugagacagagucucgcucuguugcccagauuggagugcaguggcgccaacucggcucauugcaaacuccgcuucccgaguucacgccauucuccugucccagccucccgaguggcugggacuacaggcgcccgccaccacgccuggcuaauuuuuuguauuuuuaguagagaugggguuucaccguguuagccaggauggucuggaucuccugacuuugugaucugccugccucagccucccaaagugcugggauuacaggcgugagccaccgcacccggccaauugucuguuuuaaugcacgagggucaaacacauccuuaaauuuaccagucagacaacggacucuucuauucgaguacaucuuuauguuuuggugauucaaggcucuuguaaucaaauggagcuaacaagagcccccaucuccccaccugccagagacaauggccucacccuguugcaacagaccauuguucaauguccagcauugaaaucauucaucaggcaauacauauagaaaggcuaauuaauugauuguccagacuuagucuggagccuggcuccagaaaucaagauuagccagagacauggaagucaguuugucacuggucaccccacccucuguugccaccugaauauguugccaccuuaauauuuuuuuaagacaaauuuuuaaaaacagacaauuaaggaauaaugugaagugugaggcuuuacuuaccaccagcauucaggucaucuaaucuucccgcacccugcaguugugaaacggccaugucucaaaauuaaacccuggcagauaacagaccaagccauucccccugcccccgccuggaucuuacauauaaagacuguaaaagauuuccagucuaucucuggaucuaacggaaaaaauaaagauuacaaaagauugaauagaagauaaagacuccuuccauuuuacagaaaugaaccauagauaaaaccaagacuucugcuuuagugcaucuaaacguuaagccugaguaaucaaaagcuuguuuaacucuccauuugaccuaauacaagugauaauucaaccaguguaaugucuguucagauaagggcacuuagugaauaacugguaacuaaaacuagcagaaaaaaaggaaaguaaauccaauugcuaaauagauagcaugcaugugauauaaaugucagcuauuagauagaaaaagaucugccuacaaccuuuaauuaaugaccacauucuauccaaggagggaaaaaugauguauuagccuaaaccuccccaaccguccacagacacaucaaggaaguucaagauguaauccuaaguaacucaggguaugaaauggacucauuugagccauaugcacuucauauauuugucuauuuaagauaaaacgcaauuugaaauugcaaugcuaacaagucacucuauaucuagagaaacagaauccaaagcccccaaaucugaaguuuuuggucaaacuauucacuugaucuauuaauaaccgaacagacugacuugccuuagucacuaucauaaucagucucacgugauaaugaaaugaucaaggguuaaauuguaguaaaaucagauaggucaagguauucuccaacuugauauuuuccaaucaaaaccaaggagccaauaucaccccuuccucuuuccacaaguauuccugagagcugccucugugccaggcaacauggcacgcaugaaggaacaccguuggucggcacaaccaggcguguucccugccccugcgaaguauucacaacagcaagaacacuaaacccacacaugugaaaacugcugggacggguccauggugccacggagccuagagugggagaugggauuacuuggaggucaggaauuggagcuuaacaagaagaggggaggcaagggccauggugcugagucauucuuaauuggggaguccuuuugaaaagacauuuguguucaaagccugagugauaaauuuggcuaguucaaaugaaaacuaaauacauuccaaggauacauguaagugcacugauuugucuccaaauugauaacugggcauuaugccaacaaguucaaugauauucuggaugucauuuaagugauuuuuuaaaaggagguuguuugguugcuucaagacgguuggcaacuuggaaagaggaaaaggauaagguuauggaagacggaaaaagagaauggaaggaauauuuuuaaauaaacaaauucaaguuuacugggaagggauuaaaucccauauuucagggugaacaguuaguaagaucugaaggaguauaaaagccggggcgguggggggaaugucacccaacugcaaguuuuuagcaauuauaccuuaaaauuauuuucaucgcuagacucugaccacugguuacagagccacuuugacaguagcuggcaucaaaacauuaugugcauacaguaaguauuaaaaugcgacuugaaucucaaaaggacaguacauuccucaggccagaagcuuaagcaucucuuagaaaaaccuacauagcacagagacacaguuaguacuuaauaucuagggaccauggauuuuacaaguaguuaugaaucaaagacuggcgguaaaaacuauauuauuaacagcagucucucagcccaaaagagacuagggcagcuaaggaggucaaggcaauuaggucaugguuguagguuccuuuuuuuuuuuuuuuuugcauauuguaaacaucuacaccuccugcgauaacucacguacucuauccucaaauuugacauaccgcaaauuuaacuauuaaacaugguuauccacaucuuucuacaagguaucacaaggguaccuuugugauacaaggguaucacaaaaucaguagagugaagccuugcuaaugaacacaugcgcuggaaaauagaucuaaaauaccacgaccagaacaagccacagucuuggcggcuguccuggcccacaagaaauauuccagccuugaagacugaagccgauaaaaugcagucguuucagcacugcguccagggaagaguacccggaaugcucguuacacugaccccauccuuugagaacuucuagccacucuagcguguguuuggccaacugagucugcaggcaaagcgcugagcgaacgcgagggcgcuggcugguuugcgaaaccugucauuccuucuggaaacgcagcgccugcccagguuuuuccuggcucugagcgagcuacaccccaggcuuucucugccucgggaaggcggugccugcucgggccgcugccgcaggaggacuggguaccaaacccgcucgcuccaggcaccgcuggcauccagggcgguacgcgacggggaacccgaggguggcugggcuccccggcgggcuccaccacgaguccuggccucacagcugacuuuccgcaucucggagcuccggaggcccggcccgggguccauucuccacggaucccccuccgcgcagcuccuccgccucgggcugcauggcucccaccggaagagugcgcagaaaggcucagccgccgugggcagggcgcggguuuuauuauugcgcauggcgcagucgccuccccuggagacccgcgacaaagaugcaagccccccgccgcgcucgccgcugcucuggccccgccccggcgcgaaagacccugaaaagccuccaaagagggguucgcacuccugaguuugcagaugcggcuggaugggcugggaaguucucucggcggaaaucggagggacccccccacccccacccccacccccaaagacccgcgccucccggcgcagguggcccggcacgcccguaccuugguggcgggguccgaggcagcgauggcgggguccgcgguggugucuggcgccgccucggccgaggggccgccgccgcugggcucgggcucagccggcguggagcuccccucgggcggcugcuccgggcugcgcugcucgguggagcucccggcgcccauggcuccuccgcacuucucccgcgccuagccgccggguuacgccuuccccaagccgcagggacaggggcaagagccaaaagacgcgcgcccgcgaggucccgagagcgccuuccuucgccgccagccgacugcgaacgcgcccagccugcgaaugaaggagacgcgcucgcggcaaacuccuuaaaagaaaaggaaaaaaaaaaaaaggccaccucuuagccuccgccccccuccccccgguuuuucccucgcuucaucacaugagcacagccccagacacgcccugcagcagcaucugcccccaggcugccgggaccagaggcgcugcgacgcgccagcccagguccaggcagccgcccacccggcccucgggcgccucccguuucuaacagggcgacuagagcugcggggacgacccagggccucagaaggcaagagagcaggggagcaaaaagccugccggggacacuggauucucugggguuuauuaaaugauggaucacccaaggcaggagcuucugcugcagccgacuuucagcucgcccaggagcgaguccgaguccc

SEQ ID NO: 192115 - RNA, 236209 nt, Homo sapiens
ccccuaggggccccugggacgaggaggaagcgccagguccuucccgccgccgccgccgccgccgccgccugcuccccuggcacgcgccccgccgcccucggcagccgcagcuccguguccccugagaaccagccgucccgcgccaugggcacgcgucugccgcucguccugcgccagcuccgccgcccgccccagcccccgggcccuccgcgccgccuccgugugcccugucgcgcuagcagcggcggcggcggaggcggcggcgguggccgggagggccugcuuggacagcggcggccgcaggauggccaggcccggagcagcugcagccccggcggccgaacgcccgcggcgcgggacuccaucgucaggugagugucgggucuggcccuggcccaggucuccagcggcuguggccccgacccaggggcggagcgcccgggaccgccguggggagcggggcgcggggcugcgaguguuuggugccaacucauuaggggggccgggcggugugucgggaaacgcgggcuugggcacugcggccgggagcgcuggcggagaacgggggauccaguacccgaccgggcccgcagcgcaggugggcgugggcaucuccaaugggcgccuagcggcauggaccgcacgcccggcuccacgugcgcagccggccgccggcucugaugcaaucgcgccgggcgcgacccagacgguaaaggggcggugcggcuggggcggaaaccaggggagggggcgaggagcaggaggagggcggggcugcggcucggcgcgccggcuggcccgggguucgggaagggcaagcggagcucgggagaggcgggcucgggcccagcgccgcccgcgcgaagcucccugguguugugcgcccuuccccgcgcgcggccccuccugcugggcuggggucuguggcugacguccgcuuuucccggaacggcaaagguggagccgggcccccgggacagccgccggggggaauccgagaggucucagcgcugguuuccagcuucgccgcgcagcgcccacggaguccccgcgcagcuggguuugcaggguuuucugcgggcccagagcgaacugggagccccgggcccggccuuucccgucccgguccccgccccugggcuccagccuuccccgcccucgcccagaggggcgcacgggucucgggccuugcagggcgagcccuucgggacaacuuggggguggcaagaaagccccuuccgccucccucggaacugggauuaggaacgaguuccaggaugcgguuuccccggccagcggaccaccuccuccauucacauccucuucccuuuccuucuagccuucuuucuuagucauugccugcuugccuuucucucugccuuuccuuccucccucugcucucccauuuuccuccccacuccccuucucccaucucaguaaaauacguuuccuaggcucuuuauuauguggcggaugauuuuaaggggccauuuauuuaguuuuucuuguucucugucuucuuuuucuuuuagaaauggagucucgcuuuguugcucaggcuggaguucaguggugccaucucggcucaaugcagccuccgccuccugggcucaagcgauucucccgccuuagccuccaguguaacugggaccacaggugugcgcuaccaugcccggauuauuuuauuuuauuuucauagagacagagcaccacucuguuaccaggcuggucuggaacuccugggcgcaagccaucaucccugcccccaaaagcgcugggauuaauuacacgucaggucauuagguuuuaaccugcacguugcugagacucaucuuaccgguuagagucugaagccaggauaggcggcaaaaaaacuucucccgucaugcuguuuuauuuucuagguaaacugauuauuaccugaaacuuccuucuuugcucauuucuugucugucucacccaccuggaauaugagcuucaugagacagccgucucuucggugcuauauccuagguccuggagagagugcccagcauguaauaagcacuugugaaaugguuacagaaggaaugcuucaagauuuggggucaucuguggguuuuauucauacauauucuuuuuuuuuuuuuuuuuuuuugagacggagucuugcucugucacucaggcuggagugcaauggcacgaucuuggcucccugcaaccucugccucccagguucaggcgauuccccugccucagccucccgaguagcugggauuacaggagcacgccaccacgcccggcuaauuuuuguauuuugaguaaagacaggaugucucaccauguuggccaggcuggucuugaacuccugaccucaggugauccgacugccuuggccucccaaaguguugggauuacaggcgugacccaccgcgccugggcuauucaugcauacuuuuagguuuaaagccaugacugccuuagagaugaguaaagagguuaguagggggcuuuagggccugcacuggguucuccaaacucaauuccuucaggaaaaugggaggaguaacaguacuuaccucaagggguuauggaaacaauuaugugagaggacacaugcaaaauacauagcccaggacugucacauacaagacaagucccucaacaaaugguggcuauuaauuuuuuuuuuuuuuuuuugagacggaaucucacucugucgcacagguuggagugcaguggcgggaucucggcucacugcaaccuccgccucccggguucaagcgauuccccugccucagccuccugaguagcugggauuacaggcucgcacuaccacgccuggcuuauuuuguguuuuuaguagagacgggguuucaccauguuggccaggcuggucucaaacuccugaccucgugaucugccugccucagccucccaaagugcugggauuacaggugugagcuaccaugcccagcaauauuuuuacaauucacuaagccagggguccacagacguuuuauauauaaugggccagauaguaaauauuuuagguuuagugauccuagaggcaaaucaaaauuauuaguagguacauuuauaacaagagaaaagacaaauuuaggccaggcaccaugguucaugccuguaaucccagcacuuugagaggccaaagugggaugaucacauucccaggaguucaagaccagccugggcaacauagugagacacccaucucuguaaaaaauuuuaaaaaauuaacugggcguggcgcgugccuguaguuccagcuacucagaaggcugaggcaggaggaucacuugagcccaggaggucaaggcuacagugagcggagauugcgcuacugcacugcagccugggcaauggagugagaccuuauuuuuuauuuuugcaauuaaguauuuuuaauuaagguauguacauuuuuuagacaaugcuuuugcacacuuaauagauggcaguauaggguaaccauaacuuuuauuuuuauuuucuauuuuacuuuaaguucugggaaacgugccgaacgugcagguuuguuacauagguauacaugcgccauggugguuugcugcacccaucaacccgucaucuagguuuuaagccccacaugcauuagguauuuguccuaaugcucucccuccucuugcccucccacccccugacagacccuggugugugauguuccccucccuggguccacguguucuuauuguucaacucccacuuaugagugagaacaugggguguuugguuucuguuccuguguugguuugcugaggaugaugguuuccagcuucuuccaugucccugcagaggacaugaacucaugcuuucuuauggcugcaauuuuauuuuuguagagaugaagucucacuauguuggccaggcuggucucaaacuccuggguucaagugauccugcugccucagccucccaaagugcugagauugcaggcaugagccaccacgccuggcuauauuguaccuuucaauugaguuaugugcaugguuuacugaaacucuagcccugaauugauucuccgaggauuggagcaaagugggugggggugugugucagcuagaagucaccuggaauagacauccaggagcggaaguguauuagucagaaaaauuaaagaaugagcucccucaaaagcauagugaccuguuguuccuggugaugggacuagaugaccauaaucccucagccucccaaguagcugggauuacaggcaggcaccaccacacccagcuaauuuuuguauuuuuaguagagacgggguuucaccauguuggccaggcuagucuugaacuccugaccucaaaugauccacccgccuuggccucccaaaguguugggauuacaggcaugagccacugccccuggccaguaauaauacauucuguauaauagucacaguaauggugaaaauaacaaagcugcugcugauggcuuaguucugaguuuuagcuacacauggcaaccuagcuagagagcucacauuccuucccacuguccucaaccaaaguggaagcucacaaggccauuuuucugccccaaggacaugaaaaucucugauuagaaacauuuaugcuacuuuuuggauuuauugagccuaaugacuccuuuuucuuucuugcuuugucacuguaggaaugaguaaccccaaaaaaugaaacauuacacauauaacaaguuguagggagcaugaaccuauuuuguuuuauuagcuugggugguaguagcguugaacuccuuuacauaccuguacaggcaccccuaagauauuguggguucaguugcagaccacugcaauaaggggaauaucgcaguaaaacgagucacacaaauuuuguaguuucccagugcauauaaaaguuauguuuagacaauacuguagccuauuaaguaugcacuagcguuuugucuaaaaaaaaacccauauauaaggccgggcgugguagcucaugacuguaaucccagcacuuugggaggcugaaguggguggaucacgaggucaggaguucgagaccagccuggccaacauaguaaaacccugucucuacuaaaaauacaaaaauuagccaggcaugguggugugcgccuguaguccuggccacuugggaggcugaggcaggagaaucgcuuuaacccgggagguggagguuguggggaggcggagguugugguaagccacuacacuccagccugggaaacagagcgagacuccgucucaaaacaaaacaaaacaaaaaaacccaaaaaacauauauauauauauuauauauauaaaauauauauaauauaauauaccuuaauuauaauauaauauaauuauauauaccuuaauuuauauauauaccuuauaauauauauaccuuaauauauauaccuuaauuauauauauacacaccuuaauauauauauaauauauauuaauauauaucuuaauauauauauauaagguaauauauauauacaccuuaauaauaauauauauaccuuaauuuuaaaauacuuuauuaccaagaaaugccagugaucugguggaggauuugccuagauguugaugguuauugacugaucagggugauugcuaaagauuaggguggcuguggcaguuuuuuaaaguaagacaaugagguuugcuguauugauggaacucuuccuuuccuggaagauuucucuguagcagugcuacagagaaaaugguaacauuuuacccacaguaguaggacuucuuucaaaaugggcgucaauccucucaaacccugcaacugcuuuaccaaguacuugauaucaacuacuguaaucuuuuuuuuuuuuuuuuuuuuuuuugagauggaaucuugcucugucgcccaggcuggacugcagugcugcgaucucggcucgcuggaaccuccgccucucagguucaagugauucuccugccucagccuccugaguagcugagacuacaggcgccugccaccacgccuggcuaauuuuuuuguauuuuuaguagaaacgggguuucaccauauuggccaggcuggucucgaacuccugaccuugugauccgcccacuucggccucccaaacugcugggauuacaggugugagccacugugccugccuaacuacuguaaucuuauaaauccuuuguugucauuuuauuuuauuuuaauuuuauuuuauuuuauuuuaauuuaauuuuauuuuauuuuauuuuuugagacagucucacucuuucacccaggcuggagugcaguggcgcgaucucugcucacugcaaccucugccucccggguucaauaaauucuccugcuucagccucccgaguagcugggauuauaggcgugcaccaccaugcccugcuaauuuuuuuauuuuuaguagagacgggguuucacuauguuggccaggcuggucuccaacuccugaccucgugauccgcccgccucggccucccaaagugcugggauuacaggugugagccacugcgcccggccuaauaaggcuguuuucuuaucauuuguguauccacgggaguagcacuuuuaaauuucuucaauagcuuuuccuuugcauucacagcuuggcuaacuguuuggcucaagaggccuagcuuuugaccuaucuuggcuuucaauacacccuccucacuaaguuuaauuauuucucgguuuuuauuuaaagugagagaccugcaacucuucacuugaacacuuagaggccacuguaguuacuaauuguccuaauuucaauauuguuguuucucagggaauagggaagccagaggagagggagagagaagggggaacagccaguccagugaagcagugagaacacacaccaucaugaaccaucauggccacgguuuggccaacacaauuacaacaguaacaucaaagaucgucaaucacacaucaccagaacaaacauacuaaaaaugaaaaaguuugaaauauuguaagaauuaucaaaaugugacacaaauugagcagaugccauuggaaaaaugacucccauagacuuaaaacacagguugccacaaacuuucaauuuguagaaaaacacaguaucuguaaauugcaguaaagcaaagcacaaaaaaugauguaugccuguauuuuuuuuucuauccacauccaccccccaacuuuuuuuuuuuuuuugguagagaccaggucuugcuaucuugcccaggcuggccuugaacuccugagcucaagugauccucucaccucagccucccaaagugcugggauuacaggcaugagccacugcgcccagcccccauccccaacuauuuuaaaagucuaauuacuuuuugacgauugccgacuuaccuauagaaguguuccuuucagcccggcgagguggcucaccccuguaauuccagcacuuugggaggccuaggugggcggaucacgaggucaagagaucgagaccacccuggccaacuuggugaaauccugucucuacuaaaaauacaaaaauuagugggacgugguggcaugcaccaguagucccagcuacucaggagacugaggcaggagaaucgcuugaaccugggagauggagguugcagugagccgagaucgugccacugcccuccagccuggaaacaaagugagacuccgucucaaaaaaauaaaaagaaguguuccuuucaucaacuaugaauggaucaagacuaugaauguuucugagaaaauuauugcuguuaguaagaauguuuuuaguguuuaaggguagcuuuggggcacagaaaaaaacaaacguacauuuauaagaaaaaggggaaagagccacuguaguauaccuguuuuacagaugaggaaucugagacucuuagagacuuguccacgcuaguaaaugaaaugcccaguaccaauccugggccguauuuccacuuagugucucagaauuaccuggacucuguuaaaaaugcacauuucugggcuccacugagacacguugaaucagacuuucuagggcuggaacuguuauuuuuuuugagacagagucucgcucugucacccagcuggagugcaguggcaugauuuuggcucacugcagccucugccuccuggguucaagugauucuccugccucagccuccugaguagcucugggauuacaggugugcaccaccaugccuggcuaauuuuuguauuuuuacuagagaugggguuucaccauguuggccaggauggucucaaacuccugaccucaagugauccauuucaccuuggccucccgaaguacugggauuauaggugugagccacugcaccuggccuggaaccuuuacuuuuaccaaacucuccagugauccuuauaccaugaaccgcuugggucccacacuccggugcuuuccuggacccagacaaaaauaagaacccagcauagccaaauuaacagucacgacaggcuggaaagagugcgguauaugggccucagucacccauuauuggauggauggauuuuagugcuuauuuauaaggugauuuguaaacuuucccauauggucacauuuauucagcacaauaauacaauuaauucccugggaaugaaguagcuuuaucccaaguguuuccaaacaaaacuaacugaaauguucccagguuauagacaguugccugcacccaguccaucuguuccggcccagcuggcaguagaaagacugguccugguugugaaucugagcagcucucuccccuaaagccccgccugggaacugcagugccucugguuccauuugucagcugugucucucugaaaacuggggaaagcuucccgaugccuuucugcucuuggcaguguaccguugauggcauuggcuggaacuucuucaccccgcauuuuuguuaggugcagugcaagacccugucggagacugaaaacaaaauguaaagguggucuuagcacugaagccugggggcuccuguggcugcgccuuuggucuauugugagagggggaaaagccagcucccagugcucaugugcugcugagaacauaucauagggugguggcgaagguagccucugcagucacucaucccagaagguuccauaaagagcugagcuccuaacacuuuuuuuuuuuuuugagacggagucuugcuguguugcccaggcuggagugcgguggcacaaucucggcucacugcaaccucugccucccagguucaagagauucucccgaguagcucagauuauaggcgccugccaccacacccagcuaauuuuuguauuucugguagagacgggguuucaccauauuggccacgguggucuugaacuccugaccuugugauccacccgccucagcuucccaaagugcugggauuacaggcgugagccaccgcuccuggacuuuuuuuuuuuuucuuuuuuuaaaaagaaauugagucuugcucugccacccaggcuggagugcaguggugcagucauagcuuacuacagccucaaacucaugggcucaagcgguccuccagcuucagccucccaaguaucugggacuacagucacgugccaucacgcccagcuaaauuguuuauagagaugggaucucguuauguuacccaggcuggucucaaacuccuggucucaagcaguccuaccgccuuggccucucaaagugcugggacuacaggugcaugccaccaugccaggccuucuaccacuuuuaccuaggccugcucaccccaggcuggcaccucccucagaggugggaggugaagguggcugcugcugggcauuuaggagguacaggugcagacuauguuguggauucucagaggacugagaagcucucugucucucucucuaggaggcuuugauaguguuaucaaagugggucuccaguguuucuggaacuuuccuccccuuccuuccuuaccuaauuccuucuuuaaauuccaggaccuggaauuuauccugucucgacacuucuuguccaacagugagcccccugucuucaccccccuaauccccugucuucacaucccucuucccacuuuauuugcuuuccccauggacccauacucaggguuuugggaggauggcagcggaguaugguggaggagagcgauuauuuaaaguagaaacccaaagcuuuuauuauaguaaacuuggaaaauacaagagaaaaauucaccccuagaaaauuauuguaaacaucuaguuuguuucccucugcauauuuuaaaaacuggauugccgcauuuuaccuuguguuagugucuugauuucauuguuacgccgccuacccccuccacaguguacacuuggagugcguccuucuguggucuaguuauuuucacuuggaggaaggaacuuucacagaaaauguguugugucaguccuuucuacucauuaaccaagaaaucacaauguuguuuucuuucucaauguagagaagucauucagaauucaaaagaaguucuaaguuuauugcaagaaaaaaacccugccuucaagccgguucuugcaauuauccagguaagccgagaacaagguucaguccuacuauuuuaggaugccuuucaauuuagaaaaugauuguauacaaaagagcagcugcauuucuugccaaagaggagagggcucaguuggcaaugcuguuuucuuuggucuuuugcuucuuuggggucacgggugaaguacugcccugcuugagugugucuucuuuugugaauuuuccucucugagguauggguagcuuucagaggucuaggagguaagcacuuacaugcauugcauuacacaggauauaucgugguccauguguccucacaaaugcuuaccaaaugugauuugaaggugcugggggaaaaaguggcacuuuguuucaauggacacagaugcuagaugaaacauggauauuugguaaucuuuuuacucuaucuuuuaaaaccugccauaaacuuaaugggacaaaagucauuacccugucaaaagggcuuugcauuccacauacuucuuuuggcugcaggcucugguucugagccacaguuggccccaguugccauccugcuuggcacacuugugugauggcaggugcugagaaauaaggaggugagccaagccuggaagcaaacacagccugacaguugggcugcuaccgcagggcuuggcaugcccuuagcguaucaaaauagcagccucugguuccaccgugcugcguauuucaggauuacagagcugugcucaaguuacuuacauucucugggaucuguagccacaucuuguuacaaagaaagacaaguuagaacaauagaaagaaaauuagauuagggcucgggccuccugggaaucugcuuacucccuggcuuuccaucuaaaggcaaaccauuucaacuccuaccuuugguauccccauuuuuuggcuucuuuuugugauggggucuugcucuguugccugagcuggagugcaguggcaugaucuuggcucaccguagcuuugaccuucugggcucaagugauccucccaccucagccuccugaguagcuaggacugcaggcaugcaccaucacgccgggcuaauguuuguauuuuuuguagagaugggguuucaccauguugcccaggcuggucucgaacuccugggcucaagcaauccaccgccucagccuucugcagugcugggauuacaggcaugagccacugugcccagucgguguccucauuuuuagagaggaaagcuggcuagguuacuaugucuucuaauaggagggauauuauuuuccuuaaaaaagugacauaauuugaaggccugaggaauuacucuguuaaauacuggccccaagucccuuuuuauaagcagcaagauuguuuuucugcaccuuccauauuaucuuuguaauuagaucaucuguaaucacaaaauucaucucuggauuaucuuuugugccuuuucaagcuauuuuuauguuguuauguuguuuuuaccuuccuaaggcaggugacgacaacuugaugcaggaaaucaaccagaauuuggcugaggaggugaggacugcugcuuuuaaaaaauucacuauaacuuuuaacaauacauucucuuauagugacgaauaaccuuguguuccuuuuucaggcuggucugaacaucacucacauuugccucccuccagauagcagugaagccgagguaauaauggcagagcucuaaacucuugcuucuucuuuccucuugagacuuaauaggcccauuggcgucucuuagugguggcugggacagaucuaagauuugcuugugacugaauguuagagggaagacuucacuucuuuucucuaggguaaaugcuucaugauauccuuguuucuugucauuuguauguuucuacugaagacuugaguugcgacuuguugaguucgguuguguuucuucagcugcgguggcagcgucaucuaguggaaauugucaggccgaggcgaggaaacuggaccuuggaccacagaucccugugccagggcccggcccuucugugguuagcuuuucuuccuacuggcuucaugugacagaaaaccucaaauaauggaaucuuaaauaauguacaaguuuauuucucucucucucucuuuuuuuuuuugagauggaauuuuacuuuuguugcccaggcuggagugcaauggugccaucucggcucacugcaaccuccgccucccagguucaagcaauucuccugccucagccuccugaguagcugagauuacaggugcgugccaccacgccuggcuaauuuuuguaucuuuaguagagaugggguuucaccauuuuggccaggcuggucuugaacuccugaccucaagugauccacccuccuuggccucccaaagugcugggauuacaagugugagcuacugugcccggccuagaaguguauuuuucugggacaugaauaaaguuuggaaguaggcagucccugguuggugauaucaccaagucgcaggagcucaggcuccugucccucugcucugccgccuuugugguuugguuaacaagcacuuuguucugauugaucagugaggcccagcaggucugcuagucauuugugagacaaagaaugggaauuuguagaguuuguaucuggccuugugcuauguaaacaagggggcauuggugagucuuauuugaguccuauggagaagagcaguucuuugcaguacacagaggcugcagggauuuguuaaccuucccucuuuuccaggaucacagggcucagguaaaguucguugucaccaagaagaaaaaggaaggacaaagacaggccccugcugucuuuaaagacauuuccugaaagucacaguucuacauccaucccguuguccccuacuuaguugccuggccaacugcaaaggaggcugggaaguguaguuuuuauaccaggaagccuuagaucauuuauuagcaagcuaaaaaccaagaguuuauuacuaagaagagaaaggaaacuauauacugggcgauaaguguuugccacacuugccauuguagcgugguacaaauaugaaguguuaaauauguaacaaauaccuaugauaccagcagugacagcaugcaaaggaaguuguuguucauuugcacgauacccacugucugcagcagaauuugcuuuucuuucuuuuuuuuugagauggagucucgcucugucaggcuggagugcgguggugcaaucuuggcucacugcaaccucuaccucccggguucaagucauucuccugccucagccucccaaguagcugggauuacaggcgcccgccaccaugccuggcuaauuuuuuguguuuuuaguagagacaggguuucaucauguugaccaggcuggucuugaacuccugaccucaggugauggccugccucugccucccaaagugcuaggauuacaggugugagccacugcgcccagcuggaauuugcuuuucuuuagguuguuuugccacugguguuuuuuuuuuuuuuuuuuuuucugagacggagucucacucugucacccaggcuagaguccaauggcgcaaucuccucucacugcaacuuccaccucccauguucaagugauucucccugcucagccucccaaguaacuggguuuacaggcacccgccauuaugcccagcuaauuuuugcauuuuuguagagacgggguuucaccauguuagccaggccguucucgaacuccugaccucaggugaucugcccucccuggccucccaaagcgcugggauuacagguaugagccaccucaccuggccuugacacugguauuaauagcccuugauuuucgucguuguuguuuauaauugacacauaauaauugugcaugugugugggguacagugugguguuucgguacuugcauauguuguguaaugaucaaaucagguuaguuacauucaucaccuagaacguuuaucauuucuuuguggugauagcuuucaagaucuuuucuagcugucuggaaauauacaauacauugucauuagcuuuagucacucuacuauguaagagaacacuggaauuuauuccuccuaucuaaguguaacuuuauaccuacugauggaccaaccucuccccauuuccccucccccaucccucuccagccucugguaaccaccauucuauucucuauuucuaugagaucagcuuuccuagauugcacauguaagugacauccuaugauauuugccuuucugcaccuggcuuauuucacuucauguuauguccuccagguucauccauguugccacaaaugacaggauuucauuccuuuuuaugguugaaugauacuccauuguguauacacaccacacuuucuuuauccuccauuaaugggcauuuggauugguuccaucucuuggcuacugugaauagugcuguaacaaacaugggaaugcagacggcuucucagcauagcgguuucaguucccaugcguauauaccuaguggugggaauggcugggucauaugguaguuguuuuuuuaauuuugugagaaaucuucauacuguuuucucuaauggcuauauuaaucugcauucccaccaacaguguacaagagcuccccuuuccacauauccucgccagcauuuguuauugucauuuuugauaauagccauucuagcuugauaucucauugugguuuugauuugcauuucccugauaauuaaugauguugaguguuuugucauauaccugcaggccauuuguauguccuuugggagaugucuguucacgucuuuugcacauuuuuuauuugaauuauuuguuuuuuuguuauuaaguuauuugaguuccuuauauauucuggauguuaaccccuugucggacgcauacuuugcaaauauuuucucccauucuguagguugucucugcuuuguugauuguuugcuuugcuaugaagaauguuuuuaguuugauauaaucccacugauguauuuuugcuuucguugccuauuuuguugagguccuauccaaaaaaaccuuguccagaccaaugucaugaagcauuuccccuguguuuucuucuaguaguuuuaugguuugagaccuuauauuuaagucuuuaauuccuuuugaguugauuuuuauagaagugagcgaugagggccuacuuucauucuucugcauguggauauccaguuuucccagugcuauuuauugaagaggcucucuuuccacaauguguguucuuaguaccuuugccuugacuuauuuuuugacaaggaaucauuuauuccguauuuuucuuugggaaaauucucauagagugaauuuguaugguguuauauugaaaaagaguagguaccuuaauuuauuaguuaagauuuguguuggcauuuguugcuucuaccaaaugcuugguacagguggcaauaguuuccucgcuucauucuggucucugcuuggacaucguggccucugaccacccuccacccaucaucacucuguuagccuuuuaccccacugaaccuuuauuuuucugcaugucauuuauucuuuccagugauuuuauuauuauuauuauuuggaagggaggaacuucccuccuccacuagaguauaagauccacgaggacaguuuuguuuauagcuguauuuccuuuacuuagaacugauacagaguaagugcucaaaccauuuguugaaugaaugaaagaaugccaaaugaaugaaacaaagcuuucuuucugauuuuguaccucaaaugguuuccccugccacugcacagguagugauuuuugcuaggcaaugaaacaaaaaugguaaaccaacccuuccccagagccucugagugagaucuauaugcaaagauaaguaucuucucacuugugagcaaauauuuuuguuaagugagaugaaucaggaucuuaucuccuggcauaaaauagacagagaggacaaagcauugcuuauuuagagacacacccagacauuuauuagcuucccaaaauguagcuuggucuuuuuccuaaauagugaauuauuuuaguguuucccauaaaaggagcugugcaugcuaagaauuuuucuagcauaagccuuuggaaaggcuucuugugugucauugagguccagauaacccgagggccucugugacugcuuggacgucaugauuagugagcuguguugaacacauuguguuugaaacgcacaggcuuagcugggccagauuggaaugcuucagauucaugcuuccuguccuuccugaaaacuggcaguguguuuggcuuaaaguaugcuuguugacagagaaguguccuuugucuaucuaaaccuuaauagcuguugagcuuugguuuuguucuguuuugucuuuuucuggcacagaguagagccauagaaaggcagagaagucacuaaaaaauucagccaagccuuuuaauuuuuuuuuugagccuuguacacaugaugaaaagaaaaaaauaggcuuuuuauuaugcuuuacaccaaguuuccaacaaggagcaaaacaacaacaaacuauaacagaugcauuuucaugaauccacuuuuuauauaaagcuuccuuuguugggucucauuuucacaaaacuaauuuuuauuuuguuuuuuuguuuucucuuuagauuauagaugaaaucuuaaagaucaaugaagauaccagaguacauggccuugcccuucagaucucugagaacuuguuuagcaacaaaguccucaaugccuugaaaccagaaaaagauguggauggguaagaaaauaaaaucaaauaaucaaccuuuauggcuaaaucacuuuuucuauugugccugcuuuuauuuuucuaaauuucuucuauuuauuucaacugugucaguaauuggauaaaaaaaucauuuuaaauauuucaggagucuauaggauuuuuuuuuuuuugagauggagucucgcucuguugcccaggcuagagugcaguggcgugaucuuggcucaccacaaccuccaucuccuggguucaagcgauuuuccugccucagccuccugaguagcugggauuacaggcaugcgcuaccaugccuggcuaauuuuuguauuuuuaguagagacgggguuuuaccauguuggccaggauggugucuaucuccugaccuugugauccacucaccucagccucccaaaauguugggauuacaggcgugagccaccgugucuggccaucuguagccuuuuaaaauucugcaugcaaaaguuacauauuuuggaaaauacauuagcccuuuuauagugcuucaaugccauaugaucuuacaccaucagauucauuuaauaaauuccggucugacuuauacaaucuuuagccagcucuauucuucuaauaguuuuuuccuugguaauucuaccagaccagagaagaaaacuuagaaaccugauuccccagcaguaccauauucugucuuagucccaggccaguugagaaaagcaaaauaaauacuuuucuuaaugacacaagguuuuauuugaaauuuggaggggaacaucauaacuauugggugcuguaauguuggccugugauucaugucauggagugacauaagcuucauagaacaaaggauaccggccgucuccagugggggauaagcaugcuuccuggggauuaaaaccccauuuuccuccauggaaauauaggaaguguuuuguacuguggccaaaaagaacacaauguguuaaugguuauagguuguaagcagauuuauaaaguuagauuccagauccgguagacccugcaggggcuggauggggaggcuaccaccuuccugagacacccagcaaucuuccauucuagccuuuuauugugacuugaguagacccaaacacaggcugaaaaggugucaugaacaccuccaguccuggcugggcacaguggcucacaccuguaauccuagcacuuugggaggccaaggcaggaggaucucuugaucucaggaggucaagaccagccuggacaacauagugagaccucaucucuauuuuuuuuuuuuuuuuuugagacagagucucacucuguugcccaggcuggagugcagugacacgaucucggcucacugcaagcucugccuccuggguucacaccauucuccugccucagccucccgaguagcugggacuacaggugcccaccaccacaccuggcuaauuuuuguacuuuuaguagagacgagguuucaccguguuagccaggauggucucgaucuccugaccucgugacccgccugccucggccucccaaagugcugggauuacaggagugagccaccgcgccuggccccuugucucuauuuuuaaguaaauaauuaaacauuuuuuuaaaaaacgacaaucuccaguccugucguagacuaacuguaaaaggagaagaagcacuaauccaugagaaaacuuucagaacuugaagguccuagggcauaguuucaagucuuucauaaaaggaggggaauucaugcugaggcccagccaggaaaaaccaaccaaacaaaaacaacagagaguaaaaggagaaauuacgaaaaugguucuaaaugucuccauucuguuacugagauugacgugcucaguuuaggcuagauagcuguggaauguuuuguccuagauuugaacagggaaaggcacagaacccuucagaaguguguggucacucauuuuuuccacugccccccaccccgacuucucaaggagauaaauaucgaggucaaguugaaaucagaccugugaccugugccucaaucccaggucuuacugggucacuccagauuuauaggauugguucuggguuuugaguggacugcaggaccaugcuucuguguaacucuagggaugcuaguccauugggguccauugaaaggagcucccuggaguugcgaagugaagcccuguauggcuuuaggcuguguccugguauauuggcagaaccggaacacccaaugucagggccagggugaaguuuccuaagguacugccuuagaauuuucuaagaccuuuauugaauggccuuuauugccugcuuucucuuuaauucauuuuuuauggguuuuuuuuuuuuuuugagauggagucucgcucuguugcccaggcuggagugcaguggcaugaucucaacucacugcaaccucugccucccagguucaagcgauccuccugccucagcccccuaguagcugggauuacaggcacgugccaucacgcccagcuaccuuuuguauuuuuaguggaguugagguuucgccauguuggccaggcuagucucgagcuccugaccucaugugauccacccgccucagccucccaaaaugcugggauuacaggcgugagccaccaugccugguccucuuuaauucauuuuuauguauucugucuaucaaacauugacuuggauguuauuugggguuaauauauguacauuacacgugagugauuuuuuuggcugggcuuugacuuaaccuacuucuuuauuuucugauucagaguaacagacauaaaccuggggaagcuggugcgaggggaugcccaugaauguuuuguuucaccuguugccaaagcuguaauugaacuucuugaaaaaucagguaggaugcuccuugagaaaugccgcugauuucuauuuauugguauuuacauuauuuuuaauaaggauuuguuuggggaagaauuaaaaauuuuuuuaaauuauuauucugauauccuuuuaggauguuucuagaagauucuaauugaacauagaagugauauuucacguugacuuuuuuuauuuuucucaucuuuugggagauacagaugaauaccuagaaacuuuuucuaguaagaccaucuuauaaauuaaaagagaaauuaguagagauaaacgauuagcccuguuuuaaacaugcucaauuucucucaugaaacagucaaaauaaccacaguaaaauaugcuuccaguuucagcuuacuaaaucuaucaauauguagccuuagauaagacuuacguugaagacuuaaaugaggccaggcacagcggcucaugccuauaaucucagugcuaggcgaggccaaggccagaggaucacuucaggccaggaguucgagaccagccugggcaaacauacugagaccuugucucuacaaaaaaaauuuaaaaauuagcuggguaugguggugugcacguguagucccagcuaugcuggaggcucaggcgggaagaucgcuugagcccaggaguuugagguuacagugagcugugauugcaccacugcacucuagccugggcaauauagcaagacccugccucaaaaaaaaaaaaaaaaaaaaaaagagaagaagaagaagccgguagauguaguuuagggcacaggagccuagguugggauuuauuggugagcagcuugcuuuucaguagucaggacuuaauuuccauuguuguccccuugacuuggcguuuuuaugucagugaaauagaaaugaauauuuucucuuucuucauuauuaaguuuaaugaguaaauuacuaccaaguauuuauauauuuaagggcuuucugagaacauaaagauucaacuaauugggccggcacaguagcucacaccuguaaucccagcacuuuguggagccaagaugggaggauugcuugagcccaggaguuugagaccagcuuggggaacauagggagacuccaucucuaccaaaaaaaauuuuuuuuuuaauuagccagguguggugacuugugccuguagucccggcuacuugggaggcugagguaggagaauggcuggagccugggaggucaaggcuucagugagcugugaucacaccgcagcauuccauccugggcaacaagcaagauccuaucugaaaaaaaaaaaaaaagaaaagaaaaaauucaacgaacuaaaucuuuuucucuacuccaguuugaauagaaaugaagcaaaugccccucccuaccccugaacauccaacaaucaaagaaaaauuucaaaaauauauggcaaaguuuuauuaaaagguuaacauucaggauauauaugcuuuuuggacaguaauauuaagcucaaaucuaugaaauaauccauauauacagugcuuuuucauuacguggauuaucaagaugaagauucugagccacuucauuagaaaguacucaaagaaaagaguaaauuaggcuggugaguuauaguuacauauuguggaaagaaauucagcaacaggaauuggaaccaaaaggguuugaauagagaauuuuuguugauuacaacaccccacuccuaguuccuagucauuguagguuggugcugagaaaguucaaguuuuaaaaggguuuuuuguuguuguugagacauucuugcucuguugcccaggcuggagugcaguggcgugaucuuggcucacugcaaccucugccucccagguucaagugauuuuccugccucagccuucuaaguagcugggauuauaggcaugugccaugacgccuggcuaauuuucuauauuuuuaguggaggcgggguuuuaccauguuggccaggcugaucuugaacucgugaccugaagugauccgccugccucagccucccaaagugcuggaauuauaggcaugagccaccacacccagccuaaaagggucuuuuuuucuuaagauaaaguucuuaaaggaaggaucugaaguuuugaguauaauauugaauuuucauuugguuaguaggugucaaccuagauggaaagaagauuuugguagugggggcccaugggucuuuggaagcugcucuacaaugccuguuccagagaaaaggguccaugacaaugagcauccaguggaaaacacgccagcuucaaagcaagguaaauuucauguuagaaacauacaucuugaaggcuucuguuagaacagaagaaagucuagaaauguauaagcuaagugcuuaauucaagaaauuagaggaagaaaauugaauagacccauauccauuaaagacauugaaugagucuacucaccagacaaacaaacaagaaaaggcaacaggugguuuuacaaaugagcucuaucaaacaaagaacagaucauucuaauacaauccuuuucuccagcaaauggaaaaagaaggaacguggccuaacagacuuuaugagugccaaaaccaaagaaggguaacaugcuaaaggaaaauuaacaggccaguuucagcuaugaauauaaaugaaauaaucgugagcgaaaucugagaacaccaaauacagcaggaaguaggguuuauuuuaggauuuccaggugauugaacaugagaaagucugucacuguaauucaccacauugugauuaaaaacuaaauucucaccauaguaaguacagaacagucauuugguaaaucuaauaugcauuaugaccuuuugaaaguaauuauaauuuugaugaaaauuauuaagaagacccauauaaaagcagagguaucaucuucauggagaagaugcaauaucuuaaagauacuaauugucugcaaauuuuguagaauuugacagucugauucugaaauccaaauggaagcauaaaggacaaagagagucaagacaauuuuguggaaaaacuaggugggagacauucccagccacacagugugaauuauuaugcacuuacaguaauuaggauaauaugguagacaaacagacgaucggaacagaagaaaguggaaauuuaugcauauauggaagcuugagagcagguaccacagaucaguggggaaaagauuaacuauuaaaggccgggcgugguggcucaugccuguaaucccagcacucugggaggcugaggcgggcaaaucacuugagcucaggaguuucagaccagccuggccaauauggugaaacaccgucucuacuaaaaauacaaaaaaauuagccgggcgugucggcgcaagccuguaaucccagcuacucgggaagcugaggcaggagaaucgcuugaacccgggaggcagggguugcagugagccgcgaucgugccacugcacuccagccugcgcgacagagugagacuccgucucaaaaaaaaaagcuaaaacauuaacuauuaaaaauggugcugacuuaacuaguuauguauaugagucuagcauaggauuacuaaccugccacuacauauaaaaaucacuucuauauuaaaauaccuaaauguggaaagcaaaacuguaaaacuuauagaaaaaaauauaggcguaugcauuuaagagguuggcguuggaaggauagcuuaagagaccccaaaagcacagauugcuaaagaaaagguauauaaaucugacugcauccaaauuuuuaaaaaccccaaaguuuuucuuucugaaaagaaguucuuaaaaaagugaaaagacagcuauaguguagaagauauuuacaacaaacauuuagccaauaauuagugucuuauaaaagauuccuacaaaucagugagacaaagacaaucuguuagaaaaauggacacaugacagaccacuaacaggugaggaacccgagguuuaaaagacacgugaaaagcugucugguuuccugcuguuuuugcucaccagucauauuggcaguagguaaaaagugccaguuagccauauugacaaaugucuggagcuaugggaauucauauauugcuggcgggaguuuaaauuugaaauaggcauuucggaaagcaguuuaauggaguuugagcuacucuuugacccaggaauuucacucuaaauauauaugauauggccaggcaugauagcucaccccuguaauuccagcacuuugggaggcugaggcaggcagaccaccugagguugggguuucaagaccagcccgaccaacauggagaaaccccaucucuacuaaaaauauaaaauuagcuggaugugguggcacaugccuguaaucccagcuauucaggaggcugaggcaggagaauugcuugaacccgggaggcagagguugcggugagccgagaucacaccauuguacuccagccugggcaacaagaacgaaacuccgucucaaaaaaauaauaauaaaaaguguauauauauguguguguguauauauauauauaauagacaaaacuugcccauauauauacaaagguguguuuacaaauggucagagcagcauguuuauagugcaaaaaguuuuguuuguuuguuuaagacagaggggcaguggugguucugugggucuuggccccuuucugcugucagggcugaguuggcuccaugaguuggugaaagcgguaucuagccagguucaagggagacaggggcaggauuucgccuucacugaugggcaggccagcgguccccuguggaacggugacuauugaauauugagaggacaguaucccucccugagcaucuucuggagcuugaugaccacuagggaauguaucugagucacgcgcaccaaauguguuaccgguggcagcuauucgaguuaucccgaguucgugcugguguauccguacaguucugcagcaacuucagcucuugccuccucggaagaaagaauuggacugagggccauaaggcagaaggagagacugaggcaaguuucagagcaggacggaaagucuagcaaaaagcucuagaacaguaaggaaaggaaagaaggaaaguauaacuuggaagagagccaagcaggcgacuugaaaaaccaagugcacugcaacaaguauuuaaacagugaucuaaaugcccaucagggugaaaggauaaaucaguauaguugcauguagaguaugcauagucauaguucauaaaacaaugauauacaagcagugaaaauuaauaaacuagagcuguagauagcaacauguuuucuuguuuuguuuuuuguuuguuuguuuuuuugagacgaagucucccucuaucccccaggcugcagugcaguggcgcgaacucggcucacugcaaccucugucuccuggguucaagugauucuucugccucagccuccugaguagcugggacuacaggugugcgccaccaugcccagcuaauuuuuguauuuuuaguagagacaggguuucaccauguuggccaggcuggucuggaacuccugaccucaggugauccgcccaccucgaccucccaaaaugcugagauuacaggcaugagcuaccgcgcccgggcuggaagaauuuuuuaaaacacuguucagugaacaaaaacccaaguugcagaaggauguauuucauacaacaccauuuauaugugucugaaagcaacacaacauauauauauauauguaaucuaauacauacauacauauaauauguauuacauauaauccuuauauauauauagaaucuuaauauauauauuuaggucaggacauuuagaucacuguuuaauauauauauuaggauuauauauaauauauauuauauuauuauguauuaauuauauaauccuuauauauauauuaggauuccaugcaaaugaaguaaaaauauaaagaaauaaugcaaacuacgaaccaaauccgaaaagcauuuauugaggcaaggauguggauauagauggaaaggaaaccuagacaccuucaugccuuuuuucuuaaacugggcaauagguguugucuagguauguuagguuauuguuuuccauuucuaugucugaaaugauuguuuuucauuuuaaaaaaugaugguacagcucacagaucuaaagcaaagugaaguuuuaaaugaaugcauuaaguacaaucaguaacuacagaaugugaucuaaaaauacauguuccucauguugcagggugagaauggaaaugaggaguaaauuguaaucgugccagggaagccaggugucucagcagauuuggaaucuuugcauggcagguggauccaauuuauguaaugcuuggguuaagacagcucaggaaggcagccuugcaaugaaacgugaaccugugugcguuuuuagcagucaccacaugguggcagccuauccaagaaaauucaagggcaauaguuugcacuugagagcccagaaauuuugauuuggaagcucaguggaagaggaaaauaaaccgugcccugcacugaacagcuguggugaagagagaaaauaccuuccuuggcaauugaauguuuucgcagcugucacagauacuuuugcuaguuguaucuauauuuuugaaaaacaaagacauuuuucaaaguacuuuuuuauuacgggaauaaaucaccuugucucuguacuuugggaugaaucucaucugaacuuugagaacgauuaaguggcuucacuuucuggagaaucuggucauuggguaacauucuuguuuucauauggaccagaagguucucuuucauaguugauguugcacacacguuuuuuucccuaaguccuugguauuuauaguggcaccauugcgaauguuagaggcuaucaacuuucauucuuauuauugcuucaucuuuguagccaaaaauaugggaagaaauguucauagccccgccccauacuugucccccucuaccuggccuaccuaccuacgucaggcuccugucccaccacaaaugacagccugugucuuucauguuagcagcuagucuuucacuagccacauacuuccccguaacccauaugccucccugugucugccugacguuugaauugucacuauucuguuguuguauuuuuacaagaagaauguauggggcagaaaacccuugccauucauuuccugaguaggaauucuagccuuccuuggagucgugguaauauggagacaugguaauauguggauuguaccacucaauggcugucuggaggccacaguggugcaaaaagccaccuaggcauggguuaguguccuggggcacccaaucaggacaggacaccuggcacacccuuggaaaagcuucacugugaaaaacacuggaaguaaaaauuuuaacaacagauagggauuuuuuuccccuugagacagaggcucacucuguuacccaggcuggagugcaguggcgcgaucucggcucacuaaagccucugccucauggguucaagagauucucaugccucagccaccugaguagcugggauuacaggcgagcaccaccaugccuggcuaauuuuuauauuuuuaguagagauggaguuucgccauguuggccaggcuggucucgaacuccugaccucaagugauccacccacauggcccucucaaagugcuggaauuagaggccugagucacugugccuggcccacauggggauuuuuguugcccagcuuaaucaaccaagaauaaaagugcauuuuaagauuauaaucuauuuaacuucuccuuauuggcaaugguaaaagaguuaaggaaaaaagagaauaagcuuaggauuauggcuacuaaguagaaggacguuaucuuugacgggcauuucuguugugcuuauuuguaccugacauggaacaagacccccccauccccucaacacauaccugcugugggacaucuggcuagagauuuccaaagcugagggugaaagguuugggcaucggugugacuguguaacacuagaguucuaucuaccaucucuuaaacuacagguagucuuaccggugugggcugaccuuccgguuaucaggcagccugcugcaaccacuagaaacugccuuugaagguuuccaguccggcacaacauuuguguucucauuaaacaguagagcauaggcuuuggggacacacagcucugggcucaagccuuagcuguugcugcucugagccuguucccucgcguagaaaggcaaucauaauacucccuacuuuauggggcaguugugggaauggaauuaaaugcuaaugugggccgggugcagugguucacgccuguaaucccagcacuuugggaggcugaggagggcagauugcuugagcccaggaguuugagaccagccuggcaacauggcgaaacuccaucucuaaaaaaguacaaaaauuagccaggcgugguggcuguagucccagguacuuuggaggcugaggugggaugaucaccugaaucuggggaggucgagguugcagugagcugagauugcaccaccgcacugcaaccuggagugcaggcuggaggaagagaaauauaugggucaauuaggcaaaucacucagaucguaaguagauauacuaguaaaauagcgugacuuaggguccuucacuggaagccugguauuaaugcuuccauugugugggugggggaaggagagagugucuccagcucucugucugugaggucucccagccgaauauuggccaagggagugaaaccagaagcaagacuaccaugagacaacguuccagagaaaggagggacuaaccagagcaggugcccagcuuuggccagucaggcucaucuuccaguccucaguagauuauuaucaacuuuaagugaugucacagacucccuuccuccaaagcuguggaccucuuccuucccaugccucuuguuacuuggaagucacucuacuuccaaacaugucggcuggagaucccugaugggccaguuacuacuuucaggcucuguagguuuaaagaaugguuauauccaguuaguuacaaauagaaaucgauccuuucucuguccgucugucuaaacggaaggauauucuguggacgcugauuagguauaaaaucuccacggagccugagcaugaagaauugaccuucuuaggguuccacagaaaccagaauagacuucuguguuugguagcuuuguaacuuacgcccguugagguguacgguugaaaauugagaauaaauuuccuguucuguuucugagcaucuuuuccaggcuuggagaugcguugagcauuuccacggagacccuagagguggggaggggaagaacgccugggcauuuguccaaauuagccauaugcuguggagugucacaugucaggaagccaaggcacuggagcuaguguuuuugggcagggcuagggaaccccccgccuuuccuccacccaaacgcaggcccccacacccagcguccugggcccugcaggggaaugacacuguugguuucacucucaggaaugagccuagauuuggagguaaccucuuccugaccccgaugauuucacucugaugccaaaaccagucugaagugggugugguuuugcauuugguguuuacaagguggaguggugcccucugcacggaagggagaggugggcagguacggcagggcccugcucccucgggagucuccucugaaccugugguuagggcacagcuggacaaugcugaaauggucuccagcugggagaugagguaaaccucagcugcaugccgaagaaauaaccuagaaaucagagaaccguuuuauuuuguuuuucucagaggaucucauuucucccucuccuccugagcacagagacccucaaaacugguauucacagaaggaaaaaauauaggucuuucaccuuugaaggaucaaagugucuaggguuuuuugugguuuuuuuuuuuuuuuuuugaacaaagcugaacuauuacaaaguccuuuucaguuuaaauuuagugcauggcauggcucaugaaagacuuuuaaaagugaauuggaaaauucuaaauguacuuguauuauacaugugaaaggaugacuucuuaaaaaaagaauaaugucugucccaaacgggagaaggaaggaacucuagcuuuuaaacugcacuacauuagugaguuacaugacaauucuccuuuuaacaggauggaaugcacuuaaagcaguaaugugcuauggugacaguaaugacagacaauguuaauugacagaauggcuacucugaaccaggcacugucuuguacuccuguuaucucaguggucuucacacuuauucuguuaggcaggacugucauccuccccacauuacagaugaggaaacugacugaggcuuagagaggagacuuugcaaagaucaugugauuaaaaaaugguagagguggcaaaacagccuguguuuuuaacacugucccaugucagcucuuauuccagaucaucacauaaagucuaaucucuaaucuugaaaaccgaaaagcaccugccaccucagauaagagagaccaagacccuagacauucgacuuguguugaauucacucuuauuuuguuuugauguuuguaaucccagagccauacuuguuaaugagcugaaguagagugaaugcuguccccucccugaggccuggggcucaucaucagcucuccaggcuccccuuucagaggggauggugagcaccuucggagagggcagggauggacacacaagacagccucaguuaugugaguucauccccuccccugccugcugugggugagauggagaaaaaagcacuggacccuccugggcaucacagccuuguacuuagcgaguggcugaggucaucaguagcccaggucaucaguaguguggaauuaagugcacugaauaguguuggccccugagcuuuguuugacagauuuagggggucagcucaccacuuuccccucuugcuucugucugaucauugcucuguuuguuaauaccaaggaagaaagugaauagaacuuuuuagagagccaaaaaaacuuuauuagacuuuaugccauucauuauacuuagcaguguugagggaaggauuugugagacgauauauucaaacuaaugggcaugagaccaagaaggggcuguguggcgggcgcgguggcucacaccuguaaccccagcacuuugggaggccgaggcagguggaucaugaggucaggaaucgagaccauccuggcuaacacggugaaacccugucucuacuaaaaaaaaaaauacaaaaacaaaauuagcagggugugguggcaggcaccugaagucucugcuacucgggaggcugaggcagaagaauagcaugaacccgggagguggagcuugcagugagccgagaucgcgccacugcacuccagccugggcaauagagugagacuccaucuaaaaaaaagccgguuggggugggggcauguaauuaacagacugauuggucuuagguggcucagaauuuaagcugagaaauuaagauugagaagaaaugauguauugucguuauaucaaauaugugaguaaaaacauaauuaaaacaccaucuaucuccaguuuucccaacauuaccucccuuuuaugaugcccuuccuguaccuuauuaggcaaaauauucuaauuucagucucauuggauuauguucuaaauguuugaagguuggucugaacauggaauguauuuucucauagauauaauaguauaaaugguguuagggucaugggauugcgaagccaguuccacugcaguagaaucauauugacuugcuuuccgauuuuucugugggaaacuucaucuggagcuuuaaugcacuucuuagcugugggguaaguuucagccuccaugacgcuuguguuacuuuguagucaccuguggccaaccacaaauaaaucuuuguggucaucaggggccagugaaguguauacugcacaaaagagagccuaccccaauucuggaagaagggcugcaggccugugucccacaaagaacaggcaggaagcaucaccuucagcccacuggcagcaggucaucucccauuugcuuuucugcacuaucagcagagucuggcuuccuuuuccacccccucuccaaugugaaugcuuuuuaaggucguggaauuagaauuuaaaaaaaaaauuuuuuugagacagaguuuugcucuucucgcccaggcuggagugcaauggugcaaucucagcucaccgcagucuccgccucccagguucaaaugauucuccugccucagccuccugaguagcugggauuacaagcaugcgccaccacgcccagcuaauuuuguauuuuuaguagggacagaguuucuccauguuggucaggcuggucucgaacuccugaccucaggugauccacccaccucggccucccaaagugcagggauuacaggcaugagccaccgcgccuggccaguauuagaaucuuuuaaugggaacgucuuaaacauaaccuauaacaaugaagcaccuuauaaguguguggagauuuccuuuucauggcuuuucauauaugccucgcacucacccagcaacccugcaaacuggauguuauacucaccagagagccuugacccugauugucacuggcaaggagcagugucuggacuugaacgcaggucgcaggacuccacucauggugcucuccccacugcaccucaauuccucacuuuucaaaggaggcagcggaagccuggagaguuucucaaaggaaacggaaugcagaaaucugucugugugcaaugugaggcucagaacugaaaaccauaaaugucaggaaaugcaaagcagaauuuuccccugcaacggcaguuugcaugaauaugaagacgcuguauggaugaaaguuuguggcugcagcaugagcauaaauccucggggcugcuguucgucuaggagccugacuugccugguguugcccugagaacugcaacuugagcauuuccuuaauuuuguacuaaaggaaccaaaaugagguauuuugguucuaagucuuugucaugugaaggaagcuuccuguuaccaccccccaucuacauacacauucucuuucuuagccccacguuugaauuuuauguuuuuccuaaaguauagggaagauuauuauuauuauuauuauuuucuuuuucagacggagucucguucugucaccaggcuggagugcaggcgcgugaucuaggcucacugcaagcucugccucccagguugaagugauucuccugugaaagggaauuauuuuugaugagucauuaaaguauauccauucccagaauggugcugcauuuuuccuuuuaucaucugucaugacuuuuuuaagugugaagcuuacuuccagaggaauugucuuuucuagcauuuuggacacaacuaaauaucuuugauauuuucuucucauauguugagcaguaaauuaaguugaauggugaagucagaggugaacuuaggaacauuuagaaaaaggaaggucauuuauuauuuuucaggggaaaaguuugguagaaaaaugcuguaauccuaauucccagauguccauuuggcuuguagucauuuugauuuaugaaauaaucauaagaaaugucuucaaauuuuaaaagccaauaauuuguucuacuaaucacagaugagaguagaaauaaaagaaacacacccaauuccugaaaggaaaaaaauucucccaggaugagaucacuggguggacgugaaguggguaaaauaccuuuugcugcaauugucauccccuuaucuugccaaaguacgacaacaucugaaugaagaugguuugauguucuuaguuuagaguaguuauacuauuauuuuaacauuccuauuuaaugauauguuuuaauacugcaggggaaagguagauacagauucauagcuacaaagcaauacucuuaugaucaauguucauuuaauuucaaauacaaaguuagacauucagaguuaaaaaaaauuaaugcauaggcugggugcaguggcucacgccuguaaucccagcacuuugggaggccgaggcaggcggaucaugaggucaggagugugagaccagccugaccaacauggggaaacuccaucucuacuaaaaauacaaaaauuagcugggugugguggcaugcgccuguaauccuagcuacucaggaggcugagacaggagaaucguugaacccaggaggcagagguugcagcgagcugagauugcaccacugcacuccagccugggccacagagugagauuccaucucaaaaaaaaauagauauauauauauuuuuuauauuauauuauauauuauauauuuauauuuuuauauauauaaaugaauaaacaaggcaucugcuuaugaaacagucugccugaaugaaaucuccauuugcaggcaacacagucuacaguaauggcaggacuguauuaggcaugguuccuaaugcccauuucuguagcaaagucaccaguaguuccuaauugccaaaagugagucaccgguaguuccuaauugccaaaaguguauuuuuugcuuuuaucuugcuugaccacagcugucauauaaaccuguuggccacacccuuuucccuuagccugaaugaaaaugccccuuccugcccuucguagcuccugagccaccaggacaugguggucuccaucaucuguucguuaucucuaaccauuuaagauuagugcuccccaaggaugucuguuaaccugcuuuccuucccauucugccaguuuccccuggggaauccacacuucugguuuuaaccaucaccuaaaugcugugugucccgacccgcauccgcaugcucccaggccauucucaguuccagacccgggcccccagcuuccugcagacgccuccuccaggagaucucaguaucuugcuuuuccuccuaccccuucuaaggcauucucaauccagcuuccagaggaaucuuccuaaaacacaucugacugugugagccacauacuguagcccaaccugacagcuucuuuucuauauuaagaaaaagugcggccgggcgcgguggcucacgccuguaaucccagcucuuugggaggcugaggcgggcagaucacgaggucaggagaucgagaccauccuggauaacauggugaaacccugucucuacugaaaauacaaaaaauuagccgggcaugguggcaggugccuguagucccagcuacucgggaggcugaggcaggagaauggcaugaacccaggaggcggagcuugcagugagccgggaucgcgccacugcacuccagccuggacgacagagugagacucgucucaaaaaaaaaaaagaaaagaaaagaaaaagugcacacauuuugacaucugagaaaagugauguuuuucuuagaaaagugacaucuaacucuuuauagaaacuuugccacaagguagucuaggaguccccuuacuaccuaagauuuucauggacaugcccugucugaucauaaagcauguggcacaguggcucacgccuguaaucccaacacuuuggaaggcccaggcgggcagaucacuugagcccaggaauucaagaccagccugggcaacauggugaaacccugucucuacaaaaaauauuuaaaaaacaaaaugaacugagcauggugaagcacaucuauagucccagcuacuuagaggcugagguaggaggaucgcuuaagcccagaagucagggcugcagugagcugagacugcagugccacugcauuccagccuagaggacagagugagaccccgucuccaaaaauaaauaaauuaauuaaauaaagccuugugaagaaucugccguggagcauaauguaacccauaaagccacuuaacugggcgcacauaaacuacauaaacuacagugugucccaguucauugagagugaaaaucaagcaagggaccaccucagugugguagagcccccucccugcccuccagacccugcucuguucucugugucugaccauugacuggccaucacucaggcacuaguugagaaugccaaugucuuuaguuauuguaauuucagaagcacauccuugcuggacaaagaaccuaccuguuaauuuuuuaaaguaauguucaucauuuugaacauuguuuucuuucuuuuuuauucagcugacccucaugaggaauuuaacuugguuuucugaacuguguugguaacauuugaaggacauagaaacaguuuucauaggucucaagugauauaaaccacaauucuuuagaaaauaucuuuuuuuuuuuacccauucuggauuuugaaauauauacagaucucauaccucagauucucauaugauaugaacuguuucaaaacacauugauagcagaagauacauacugucuucuagucaagaggguagcgcuguauuuaguuuaaaacauuuuaaugcauuuuauuugcuaaauacaaaauuauaauauucuguauaacuuuccaaaucucaucuguccucccuuucccccaucucuuuauauucagaugcuugucccuccagcuuaaaaauucaugacuuugagaaaauucgucuucauguuaucuaaacuacugcacccccacacgcucccuguuaagugucugcauaucugugucuuacuguuguuuaaaauucacuugucugccuggggaguggggugguuugcuuuaagcugcuccacucaagucucagcagagaaagcaauaauuuguuaugagauagaguuuuaagccaagcuuuggccagggucucucccauuugggaggaggaaaauaggaacaagugagaugauaauuuuccuugaauuuuagcucauuaaaaucuucccuuguccugggcaggcuauuuacugauuuaagcaucuagcacuuuuccuuuccagaaagaauuaacaucuaugaugcaaucauugcuaagggaggagguuuuuguguuuucucuguggaauuagcuguucuccaguugcagaugagcacagcccacuuuagaguuguguguagguauggaguugaggggucggaaugagauuuccaagauuuauagguaaugaaaagaacagguuguaucaaagacaccacguguaggaaacuaacuguucuuaggggacuugugugaaccugugauccuuggcuuucuccaaaaugaacauuucagccuuguucauauuaaccuccuuuuuacaguuguuuuaccguguucugguuuugcugcuauucugccugaaaaucuagcaaaauggcguuucuuaucugcagaacugcgacaaagcuuaaacauuuguauuucucuugaggauuacugugguugaauuuuugacaguacuauauauaaaugaagaaauaaaauuuuuuauacagauguuuaaaauccucuuuccacuagaacauuucuuucucccuaaauauacuauuaccuggaacucuagcuguuuuucagaucuguagagaucauagguggcuuaagggacuagauugcuggugauauuggcugcaaaauuuuuuuuuuuuuuuuuuuuuuuuuuuuuuuugagacagagucuugcuccaucgcccaggcuggagugcaguggugcaaucuuggcuucacugcaaccucugccucccagguucaagugauucucauuuggcugcaaaguucuuagugagguuuagugguauuuuggcccuguggcacagaagaaugguuauuuagcaaauguguuuugcuuuugauuuuguuuuguuuuugagacagggucuugcccuguugcccaggcuggagugaaguggcucgaucacagcucacugcagccaugaccuccugggcucaagcgauccuuccaccucaaccucccaaguagcuaggaccacaggcaugccucaccacaccuggcuaauuuuuauuuuauuuuauuuuuguagagacagggccuuacuauguugcccaagcuguucucaaacuuuugggcucaagcagucuucccacccuggccucccaaagugcugggauuacccagcauggcagcaugagccaacaggucuggccucggcaaagguuuuaguagggcuuucucuuuucuuuugaagaugauuaauacaguagauucauacagccagaagcugaaaagcagggaauacuguuuggcuuauuaauggauaaucaaucaguguuaauacacuuuucccuauuuacauggucaaauugaucaaauauuuccaagguauuagcuuuuaaaaguugacuuugucagcucuaugaaaagacaugcauuuacauuuuuaucgugcuccuccucugucaggggacuuggaucuguccuugaucuuggcuuuucuguucauaaaccagguaggacugucauggguuugcucccauuaccaucucuugucccaagauuucuaaaaggcaucaccugaugcacccuuuugcccaaauaguguuaaaaguccucaggcugaggagcuguccugguucuucuacaggaucuuuaaugaucagccugucuaagcugagaauggauaaggguguccccaacacguuuauuuggugguuugguggggguagugacacuggggaugcuuuuguguguuguaaucugccccucugucuguuugaccccagagacucugugguuaguugcaggacaucaaaauacgcaggaaagacagugggggaagagaccaucagucgcccucuugcugccuagguucacuagaaucucuaagacugaauucacuaggagacacaggacauaccguagagcuguuuaugucuugagagccccaguuuccuagucuguuaaaugagcauaguaacaccaaucucacuccuuuggaauauucaaugguguaauacuuacaacaucuagcugaccuguacaauuauagcuauucucuucugcaagucuaauauuccuauucaccccucccucugcauagggauccaguuugaaaucaucaguugcucaguagggccuggggagcuagcuggucauucuuugguuaaagucaaagccaaccucuuugccuaccuuuuugucuuaaugucaacuuccuaccagacauguuccucccgcacuggaugaucaaaaugcaaauaggauggacacgaucaaugcauuuuguuggagugguugcauucuuucuacuuucuuagggcaaaaaaaugaaugguuggacaagagacuaaccaaggccucaaagaaagugaaauucuuucucaagcuccugaaaguccuuucauggguauaguaacaguucuauaggggucucauugugauggugccauuauacaggccagcaagcccccugugugagccagaccucauggccuuagcccuuguuuuccucuuuuuuuuuuuuuuuuuuuuugagacagggucucgcucuguuguuggagugcaguggugugaucucggcucacugcaaccucugccuccuggguucaagugauucucgugcuguagccuccugaguagcugagauuacaggcccccaccagcacgccuggcuaauuuuuguauuuuuaguagagacaggguuuuaccauguuggccagucuggucucgaacuccugaccucgugauccaccugccucagccucccuaagugcugggauuacaggugugagccacuaugcccggcugccccauccuuuuucuugauauuauaguuaguggugaaaacauguaaaugauaauacuccaugcaguauguaugcugaagugacuacccugaagacauuuuuuaaguccuauuuucuuuucuuucuaggauaugauaaucauuuucuguuuguauuaauacaugcuugaaaggaauuaguaaagcgauuccauccuugucagcagcuuggaacaaagcuguggaucugggauuguguagaacucauuugacaucaguaguuacuugugucuuuaugccucagaucaagaugugcguguuuuuuucuuucuccuuuuagcuucacgaggcugacauugugguccuaggcucaccuaagccagaagagauuccccuuacuuggauacaaccaggaacuacuguucucaacugcucccaugacuuccugucagguaaaugucuucacauugguguugagccacugauuaggucagauaguucaaagaaauguuaaccuuuuccuaagagguuauguuucugaaauguuagcagucgucaacauuaauauauaggguaggaaacuuagacugugggcuaccugauagaaccaugcuguugagcaaagagagaccaagauggcgguugaggugucugcucccacagugaagugcccccuacuggccucuagcagucaggucaguugugaccucaaguagaugauuuguaugugugugagguaaacuagaaauagcgguuuucacaguuucuuaaaaauuaguaaaacccuuucuuccaaagaaaucuucguggaaucucacuauguaaaagcagaugagcgccggauuguugggagggaugggaauaggaucagccugugugucucccugauuuccucuugcauugacccaugaagcacauccuuggagccccagagucaucucagaacaguaugaaaaucaccacuagaugcagaaacuguuguaggauugguccugcuauuugauggcauuuugccaagguauccaggaauacucaagaccacaccaggcccacuuugggggcagcccaagcagugcccgcaacagggcagccagcagccccggguccagcaggagccggcccagaguggguuccuuuuuccaguucguagaaggacugaggcuaagaaagccuuggagcacacccaggcccucagcaagucccugaguagcacaggugagccagagacgauggcacagggaggcagaggagagccccucuuccugauuccuucuggcuuuggccuccaaauguuuguguggaagagaggacugugcugagcugggcuggaggacaggggcagcuuuuaucccuaaagcugggcagaacaugcaccaagguuggcagccucugcucuccuucuccuccaccaggaccauacuugagguugaaaucuugaaaccuuguaggcagcuccauaaaagcaugagcccuagccagagguuguuacugacccuccucucuaggaaauguagcuccugccagaauugaccgaucagauuaaaaaccccuugggggcuggagaggguggaauggaacagaguccaaggaaagaggcauuaagagcuguggcccuaauggcucuuuuuaacaaacagaaagcauguacuaaauaacauuuuaaaaauauguguaauuuauucauauaacuuuuuuuccccugaaaaaaaaaaaaaacaaagccuaaccuauuaauaguggacagggcuuccucuguucagcaucccagucagauuaggaaaaucaguuccaacauuuguuucuuguaaaugaaugcugcuuugcuguaauauuuacuugcuguguuuuauuaaaguuuucauguaggacaguuuuggcagucauggcuggagauaggagucuacuuugauguucuggaaucucuuugagcucugugguuauaugacagugacauauauuuuguuagugaaagugcuuuauuuuuaauaagguuuccuuuuaggacccuuauuuuugaaaaaaaguauucccugaaauauuagauaucaauguaaugauucucugggggaaaaaaagaccaaggcguuacagauguuccucgacugaccaugggguuaugcacagauaaacccaucagaaguugaaaauaucauuaguaaaaaaugggcauuuguagccaggaugggaugugaaaacagaaaacaacguccaaaaaugcuggcagcacaguacgcuguagaguauugguuguuuggccucgugauugcauggcugaccggaaaccacgauuugcugucacugcugcccagcgccucaagacagccuuguucuuuguauagcuggccugggaaaagaucaaaauuuaaagcacaguuucuacugaaugcaugucccuuucccaccaucauaaaguggaaaaauaguaagugaaaagguuguaaaucagggauggucuguguauuucaaaaugauucuauaaguagaauuuauuugaaauuuaucuggcccaacuguaauaguuuucuuguugguuuuugaaugcccaguguccagaauaguaccugacgcuuaguaaccgcucugugaaauuuuuuuuuuuuuuuuggagacagagucuugcucugucacccuggcuuuagugcagugggugugaucuuggcucacugcaaccuccaccuucuggguucaggugauucuccuaccucagccucccaaguagcuaggauuacaggucccugucaccacgccuggccaauuuuuuuuuuuuuuuguauuuuuaguagaaguguggaugcaccauguuugccagguugguuucgaacuccugaccucaagugauccacccaccucggccucccagagugcuaggauuacgggcaugagccacugggccuggcuaacucugugaauauugaguguuugacaaguuaauaagcaugaaucaaaauucuacucugcuuguaguuuuaaguuaguggcauguuuagaaacauuuccuugaauuugucucccacuuaaagauggggcugauggccaggcacaguggcucacgccuguaauccuaacacuuugggaggccgaggcagguggaucaccugaggucgggaguuugagaccuagccuggccaacauggugaaacucuugucucuauuaaaaauacaaaaaaauuagcugggcuugguggcaggugccuguaauaccagcuacucgggaagcugaggcaggagaauggcuugaacccaggagguggagguugcagugagccgagauugcaccauugcacuccagccuggaugacaagagcuuuuuuuuuuuucucaaaaaaaaagaaaagaaaaaaaaaugggcucaacuaggcagucauugagauaaagaugaggaaugcuauguugaugaaacagaugaacaguuucgggguggugcuacccauaauagcacauuucuaaauagucuacaaguuuuaauuuuagcaacuuuguuuaguaugaaaauuugaucuaggaauaauggagaaagguuuuuuuuccccucuuuuuuucauaaucccacuacuguaaagaaaugaauaaacuuuuugaaauauuaaaaagaaaagagcucuuauuuaaacuuaagaugagaagaacuuuuaauaaacuuguggcugggugaagacagaguuuuauaaugaaauuuuuauucuuaccuucaugguacagagucccuccuccuuacccccguaaaaauagaugggauguugugauuuaugaugaggcaauucuguagagacauuuuauggaauacguaauccuaggagagauuuuccugauggcuaauaucccagacacagagcucagaaaacaauuauacccagcuaguugguucuguucacucuacuauugcaugaguccaauguuuagauuuuaaaacaaggaaauuucaacauucuguuuucuagcuguaagaguaacuacuuuaaaaaaaaaaaaaaagacaaccaaaaaaaccuauuucuuagaaaaagucuugcucuguugcccaggcuagaguacaguggcacgaucacagccucaaacuccugggcuccagcaauccucccuccucagcuaauuaaaacaauuuuuuuuguuguuguugaggcaggguucucacuguguugcccaggcuggucuugaacucccggccucaaauaguccucccgccuccaccuccaaaaagugcugagauuacugguguaaaccaccaugucuggccuaaaaaaauuauuucaaaugaaaaaacuacgcacugcucuuguagugcccugcuugcuaaacagcagauuucaucauaagcaaaaucauuuuguacccuaaauauuaggacuuauuuacugauguaacaaaugggaccaaggagaagcuggucuuccgucuuaggcucagaaaacaguaucaaaacagcaacucuguggcucagaguaauuuauagcaucauuuuaagcuaauguaauucuauuuaguguggaagaggggaagagcccugggaugcugaugugcugggggucccgagggaccuugagacuuucucucguauggcucugaagggagacauuagaacuuacuggaggcugggcgugguguggcucaugccuguaaucccagcacuuugggaggccgaggccaguggaucacuugaagucaggaguucgagaccagccugagcaacauagugaaaccucaucucuauuaaaaauacaaaaguuagccgggcaugguggcaggcaccuguaaucccagcuacuugggaggcuggggcaggagaaucgcuugaauccaagaggcagagguugcagugagccgagaucacgccauugcacuccagccugggcagcaagagcaaagcuccaucucaaaaaauuaaaaaaaaaauguaguggaaagaacauggacuuuggagucaggauuaaccuaacucaaggacaagggagcuguuuuuguaaaaaaaauucuuggccggaugcgguggcucacgccuguaauccuagcacuuugggaggcugaggcaggcggaucaccugcgguggggaguucgagaccagccugaccaacguggagaaaccccaucucuacuaaaaauacaaaauuagccgggcaugguggcgcaugccuguaaucccagcuacucaggaggcugaggcaggagaaucgcuugaacccaggagguggagguuacggugagcugagaucgcgcuccagccugggcaccaagagcgaaacuccaucucaaaaaaaaaaaaaaaagaaauucuuaauugcauugcacuuacaggcugugugacuuugaggaaauaagcucucugauuaauuaauaagauucccaauuucuuuguggguaaauugggagcaaggcuguugggaggaaugacugagaugauaccucggggcagugccucuuugaugguagcugccaauaaaugcugguccacuuccugcauuccucccuccacuuccuuguugccaugucaccugcacacaaaacagcuuucagacuccaucuuggcacaauauacauuuauauuugaaaaaucaaacccaagaaaggaagaaguccaaugaaauucugaacauguaagaaaagucagcuuuagagaaauuggacauccguguaauuuucauuaugccaaagcaauugauauaaaauuaggaucuuugcuugugacucuugaacuuuaguaauuccaaaauccauuguaccuaucacuguuuucuuuuauuuauuuuuuccuguaaauucuggauauucuagaucuaucccugaaguauauugccaguuuuccauuucaaauuuuaauuaguucucaauacaauguauuuaauauuuugcuuuuuuuaaaaaaaguaaagguucaugucauuuagaauaugcagcacuguauaaauuuccuuguuaauuugguuucagugguccaaauuaaguuauuacuaauagcuuauuaguaucaguuuacuaauauuuuaauuuuuuuaaucaugucuuacauugcauucuuuuaaaaacuagugauaugcugucauuugacaguaagaauucaaauaauuuaaacuaggauugcaacucucaagaacacugucacaaaaauuuuaccaaaugauauguauuaguccauucucacacugcuauaaagaaauaccugagacuggguaauuuauaaagaaaagaaguuuaauugucucacacuuccacggacuguacagguaguaugaugcuggcauuugcuuggaaggccuucuggaaggccucaggaaacuuacaauuauaguagaaggggaaggggaaucacauauaucuuacauggccagagcaggagcaagagagagggagggcguauuaguccauuuucgcacugcugauaaagacauacacgagacggggaagaaaaagagguuuaauuggacuuacaguuccacauggcuggggaggccucaaaaucauggcgggaggugaaaagcacuucuuacauggcagcagcaagagaaaaucaggaagaugcaaaagcggaaaccccugauaaaaccaucugaucucaugagacguauuuacuaccaugagaagaguauggggaaaaccacccccaugauucaaauuaucucccacugggucccuccuacaacacgugggaauuaugggaguacaauucaagaugagauuuggguggggacacagccaaaccauaucagaggaggaggugcauacuacauacuuuuaaaaaccagaucucaggauaacucacucacuaucaugagaacagcaccaaugggauggcgcuaagccuuucaugaagggccacccccaugauccugucaccucccaccaggccccacccccaacacuggggauuacaauugaacaugagauuugguggagacacagaaccaaaccauaucaugauacucauuuuauuuauugcauuuuacuuuauauccuacaaagucaauauauuuaacugaaaaacuggcuaccaguguuuuuguuuuuuuuuuucaaguucuaccuguacugauuucuaauuuuuagccauuccugauuuuaaaaccucgcauacauuuuggggauaauuuguucuccuagauggcgagaaaauauuuaagucugugggcuuggagaaugcuuuuuugauaagaaggaugcccuuggccagacugcauagaagcugagauguuuccgcagagccgagauggcaugaaggcugaagaauuuuccugcaucccucccacugcagugauuguucuggcaaaguucccaggguggucucugcacugcucauauuagugaaagggugguucugauuucugaggaaggcaugauaacacuuuggccuuaaauuuucuuuuugcagaaaguuugauuaucauuagaagaauggccaucuuuuaaagugauucauugacuugucccuggagaaaucaugaguuagaugagaguguuuagugggaagugaaaagacccguccacgguuucggaugagauccucguuggacugugaucccaggauauuacccaggcccagaucguagacaaccucccaauggaguccugccccuacacgggcagggggugaaauaaugauucccuuucuuaauuuucuuuagccaugaaauuuauuaaaaauguaugucugauucugaguugccagucuuaauugcuugagauucucuggauucagaacuuauuuuuauuuuuuuuauuuuuauuuuuugagacagagucucgcucugucauccaggcaggaaugcaguggcgcaacugcaggcccacugcauccugagcucaagcgauccuccugccccagcccccagguagcugggacuacagacauaugccaccaugcccaacuaauuuuuuuuuuugaggcagagucucgcucccucccccaggcuggagugcaguggcaugagcucggcucacugcaagcuccgccucccggguucacgccauucuccugcuucagccucccgaguaucugggacuaaaggcgcccgccaccacgcccggcuaguuuuuuuuuuuguauuuuuaguagagacgggguuucaccguguuagccaggauggucucgaucuccugaccuggucauccgcccgacucggccucccaaagugcugggauuacaggcgugagccaccgcgcccagucccaacugauuuuuguaccuuuucuagagacgagguuucaccagguugcucaggcugcucucgaacuccuggacuuaagcaauccuccugccuuggccucugaaagugcugggauuacaggugugagcuacugcgcccagccugaaugcagucuuaaaacugaauuagaaaaucugagugcaggcuagaguuauauauaauuaagagaguguggguuuuaaguugugucuuaaaauuguguuguuuuuggucgagucugguggcucacacuuguaaucccagcacuuuggggggccuaagugggcugauugcuugagcucacgaguucgagaccagccugggcaacauagugaaacucugccucuacaaaaaauacaaaaauuaagcccaggugcuguggcucaugccuguaauccuagcacuuugggaggccaaggcugguggaucaucugaggucaggaguuugagaccagccuggccguggugaaacccugccucuacuaaaaaaauacaaaaacuaaccaggcgugguggcacaugccuguagucccagcuacaugggaggcagaggcagaagagucccuugaacccaggaggcggaggcugcagugagccaagaucgcaccacugcacuccagccugggcgacagagcaacaguccgucucaaaaacaaaaaacaaaaauuagccaggcauuguggcaugcgccuguagucccagcuacuugggaggcugaggugggaagauggcuugagccugggaggcggggguuacagggagcugagauggugccacuguacuccagccugggugaucgggccagaccuuaucucaaaaaaaaguguuuuuaauuacuuguaauuuuaauugcuuguaauuaaaaaacaguaauuaaaaggaccaaaaguuaauuuugcagguaguaaaccuuagccuacuguacguaaaaaucagaaggccaaggcaggaggauugccugaguccaggagcucaagaccagcuugggcaacauagugagaccccgucucuauaaaacaacuuaacaaugugccaggugugguggcacacccuugcaaucccaacuacucaggaggcugagguggacggauugcuugagccugggaggucaaggcugcaaugaucgugaucacaucacugcacuccagccugggcaacagagcaagacccucuguaaauaauaacaguaauaaucagaaagcaacacuguaugugaauaaagucaccuuaccuagcugccgguggacagccuuugguguuucaaggacuuaguuuuuaugcguuccugcuuucgauauuuguugacugugagcuuugggcuuauccaggguccaugaagaagaaauggcucuuccuuaucucaggcuuuuguuauuuugggguguuuuaaauuccucuccugugguuacucaauccgacccuacuugccucucucuuccacaaauuucucaaaugucauucaugguacccuuuuaacucuuacggacuuacuuguuuuuaacauaucuuuuauucacuuugaauggaguuucgacuggaaauagaggguaguguuguguguaccaccuaccaucuucagcuagacacuuucaaagaguuuguuuuguuaauuauaucuucuuacauggcucauuaugcuuguugaaauuugcaagaugcuuuaaaccaauccuguccaaaccacagccugugggccgcauguagcccaggauagcuuugaaugcagcccaacacaaauucauaaacuuucuuaaaacacgaaauuuuuuuugcaauuuuuuuuuuccuuagcucaucagcuaucauaguguuaguguauuuuauguguggcuauggcccaagacaauucuucuuccaguguggcccagggaagccaaaagauuacacauugcugaaaacuuuagauguaucaggaaucauauagcuuuucaaaauaaaauauccacacuuuugcuaaguucuaugcuaugcaagugacugaacuauaccaggacuuaucuuguaaacuuggaagugaaauauucuucacucgcaaggguauuuugugauuaaauucuggaaauaugcauuuauaaguugauaccagcuccuggaauguaacuuuuucuuuuuucuuuuuuucuuuuuuagauuuuuugagaugaagucucacucuguugcccaggguggagugcaguggcacaaucuuggcucacugcagccucugggucccgaggucaagcaauucgcuggccucagccucugaguaggugggacuacaggcaucugccaccacagcuggcuaacuuuuuuuuguauuuuuaguagagacaggguuucaccuuguuggccaggcuggucuugaacuccugaccucaagugauccacccaccucggccucccaaagugcugggauuacaggcgugagccaccgcacccggaugcuuuuucucauuucuccaucgcuuaaagauagaggauugagagaggcccguuuguggacacgaucuuaaguacagaucucuagugguuaaaacgaaacacaacaauucucucucauccucuagacucuuggcuuuugccuaaauaugauucauaaagcugaaguguugcuaaucuuuaaauaacacccaagggauaugauuauaugauuacccaacacccuaauacaguuuaagaauagagugauccaaagaaggagaaaauagugucuucaaaaauguugcuauuagaaauauuucuuuucucuaagggaggaugcaggcuaaaguauuuagcauguguguuuacuuuuauaaauuuucuaagugaugaaggaaggaagguagaaucuuuuuuuuuuuuuuuuuuuuuuuuuuucagauagaguuucacucuuguugcccaggcuggagugaguggugugaucucggcucaccgcaaucuccgccucccagguucaagcgauucucugcuucagccucccuaguagcugggaucacaggugugcaccaccacgcccagcuaauuuuuuuuuuuuuuuuuuuuuuuuuuuuuuuugguauuuuuaguagagaugggguugcaccauguuggccaggcuggucucaaacuccugaccucaggugauccacccuacucggccuccuagaguccugggauuacaggcgugagccacuaugcccugccagaaguagaauucuuaucaacaucuuucuagguugauaaucagguaaucccuaaaguuaauacccuaaaaugcaauuuuuuaguuuugauggaaaauugauucuaucccuuuuuuuuuuuuuuuuuuuuuuuuuuuuuuuuuuuuuuuuuugagguggaguuuugcucuuguugcccaggcuggagagcaauggcacgaucucagcucacugcaaccucggccucccgguucaagcgauucuccugccucagccuccugaguagcugggauuacaggcaugugccaccacgccuggcuaauuuuguauuuuuaguagagaugggguuucuccauguuggucaggcuguucucaaacccccgaccucagaugauccacccggcuuggccucccaaauugcugggauuacaggcgugagccaccaugccuggccgguucuauaacuucuaugauagagaauuuuuaaauuaucaaaaaagccugaucuuucauguaacacuuugaccagucuuacccugugaguguuuucaucugccuucucacgcuuugcauccacaagugaaagugcuucuauuuuucuauguauuguacaguaaagauuuuagagcuuucuaggccaggcaugguggcucgcaccuauaaccccagcacuuugggaggccgaggugggcagaucacugaggccaggaguuugagaccagccuggccaacauggugaaacccugugucuacuaaaaauacaaaaauuagccgggaguguuggcaggugccguaaucccagcugcuaauaagguggagguugcggugagcugagaucgugccauugcacuccagccugggugacagagagagacucuaucucaaaaauaaaaaaaaaaaauuuuuuuagauccuucuaauaagaugaagcccacugugucaaaaaaaaaucuaaagguuaggauaugaagucauucugacagauuaugcuguggaagaauauauaucccuguuccuuucuucugagccuuacuuucauguuaauaguuuaaacuacauacuauaugccaagaacuuuauauaccuuaucauauuucauuuucacaaaauuuuaggagguugauauuacucacauuaauuaacaggcccaacaucacaauuucuagcaagaggaagagguaugcuuuuaaugcaagucugacucugaauucuguggccuaaucugcagucuauguugcauccacauguuuuaaauguucgcuaugaauucucuugagcuauuauuucuaucucuaauuaugccauaauuuaaaaaucagaauacuugggcucgugugaagagauggugugccuagauguuucuuccuggcucagugugagauaugauuuugaaagcacaugaugugcuucauuacauuuuuuaaauccauuuaucccagguuaauagcuuagauggccuuuuuuuuuuuuuuuuuuugagauggaaucuugcuaugucgcccagguugcagugcaguggcgugaucuuggcucacugcaaccuccaccuuccagcuucaagcgauucuccugccucagccucccaaguagcugggacuacggguacacgccaccauguccagcugauuuuuauauuuuuaguagagaugggguuuugccauguuggccaggcuggucuugaacugaccucaggugauccaccugccucggccucccaaagugcugggauuacaggugugagccacugcacccggccagauggccauuucucuaauguaaaaugugaagcaggcccaauggagggccccaagccugugccagaggugaccagucugcagccgugccccgacauccuaacuuccuuggugaaaaaugagaccacuauucagugugcuagcuguuuacaaggagcaauugguuagaaaugacaguguacugaaagucuuuuuuuucccuccaauuuuuuacagggaagguuggguguggcucuccaagaauacauuuugguggacucauugaggaagaugaugugauucuccuugcugcagcucugcgaauucagguuuguucaacauagcugucugagaaucuugaguuuggaaguuugauuaauaguugcuaacauuuugcaagugguuucuguuuaccagguacaguguuaaacacuucacacacaguguuaggcccauuugauaagugaagaaauggugauuuugaaaaaugaagugaguugccuaugaucacauggcaguguggggcagggacccauccuggggacuguguauguuaucuugugcuguguaauaaauuaucccaaaauuuagcaacugaagcaacaaggcauuuauuaucucacaguuucuucaagucagagauuugguaguagauuagcagauuaggugguauguuaguccauucuugcauugcuauaaagaaauaccagcuacucaggaggcuaaagcaggaggaucgcuugaacccaggagacagagguuguggugagcugagauugcaccacugaacuccaaccugggugacagagggagacugaaaaaaaaaaaaaagaaauaccugagacugguuaacuuagaaagaaaacagauuuaauuggcucacgguucuuuuuuuuccccuugggacagagucucacuuugucacccaggcuggagugcaguggugcgaucuuggcucacugcaaccuccaccuccuggguuuaagagauucucaugccucagccuccugaguagccgggacugcaggcacacaccaccacgccuggcuaauuuuuuguauuuuuaguagagacaggguuucaccaugucggccaggcuggucucaaacuccuggccucaugugauccacccgccuuggccucccaaagugcugggauuacaggcaugagccaccgcgccugaccuggcucacaguucugcaggccuuacaggaagcauaacacaggcaucugcuucuggagaggccucaccaagcuuccaagaauggcagaaagugaagggaaagcaggcaucucacaaggcgggaacaggagcagagagugagggauggugcuauauacuuuuaaaugaccagaucucaugagaacucauucacuaucacaaggacgcuaccgagggagaugaugcuaaaccaucaugagaaacuagccccugugaucccaucacccuccaccaggccccaccucuaacacuggggauuacauuucaagaugggauuugggcagggacacacauccaaacuauaucaaauuguuuaggcucaggaucucucaugcauuugaagugaagaugucagcuggggcugcagucaucugaggcauuaacuggggcuggaggaucuguuuccaagauggcauacucacauggcugugggcauguguauuucauuccucacuggccaucagcaggaugccuugguuccucaucauguccaccucucuguagggcugcucacaguguggcagcuaacuucccccagugugagcaauccaagggaggcaaccaggaggagucugcaguguggaugaccugggcucuaaccucaugugccgccacuuccuuuuauccuguuuguuagaaguagaucacuaaguccaguucacauucaagagaaggagaauuguccucacuucuucaagacaggaguauuaaaguauuuggaggcauuuuuucaaaccaccaccaccugugugaccuaaaggcgaaggucaucaguguuccaccauauaagcugaguguucucauggugcuggagccugcagcagugguggccucuggcagugacauuuaguucauuucuuucuuauguacaggguaauacacaauugaaacucuuuaccucaaaaugggucauuagacauuuuuguaaggauuauaaguuacauuuccaucaaagccaaauuuuauuuuuauuuauuuuuauuucauuuacuuauaauuuauaugcauacauaacacuacucaguaguucaauuugcuugcucuuuuauaccaacuauggaaggaugguauuuggaagcugggcauccaagcugaucauucacgcaguccuauauuuucuucauuuuucuuuucuaaauuggaugacgaaccuauucaguauaaguuuauccauguacaugaugucuuuugugaacacuuaaucuauuuauuuauuuauuuauuuauuugagacggggucucacugugucacccaggcuggaaugcaguggcacgaucucagcucacugcagccuccaccucccagguucaagugauucuccugccucagccuccuggguagcugggauuacaggcacaugccaccacacccagauaauuuuuuuuuuuuuuuuuuuuuuuuuuuuugagacagaguuuagcucuuguugcccaggcuagaguguaaugucgcaaacucggcucacugcaaccuccaucucccgggcucaagugauucucccgccucagccuccugaguaguugggauuacaggcacaugccaccaccacgcccggcuaauuuuuuguauuuuuugagauggaguuuugcucuuguugcccaggcuggggugcaauggcacgaucucagcucacugcaaccuccaccucccggguucaagugauucuccugccucagccucccgaguagcugggauuacaggcgugugccaccacacccagcuaauuuuguauuuuuaguagagacgggguuucuccauguuggucaggcuggucucgaacucccgaccucaguugaucccgccuaccucagccucccaaagaggauuacaggcgugagccacugcaccuggccuaauuuuuguauuuuuaguagagacaggguuucaccauguugcccaggcuggucuugaauuccugaccucaagugaucugcccaccucggccucccaaagugcugggauuacaggcaugagccaccucaccuggccuauuuauucauuuauuuuuaaagagacagaaucucagcuaggaugaaguacaguggugugaucuugacucacugcagccucaaacuucugggcucaaacaauccucccaccucagccucccgaguagcugggauuauaggugcgcaucaccacaccuggauuuuuuaauaguguauuuucucacauuuuccuguuuuucuuuuuaaaauuuaacaaaaacaaugaacauagucagaaguucuggccugugacuugaaauaacccuggauguacauuuuuaaaaacauucucagauucauugcuguaaguaugaagagcuaauagucugcaagggaacuauagaauuaagcuggaucaucaaguucaugcaugcauauuuaagaaacagagcagcuucuuuuaauacuaucaaacucuucagugcgauauugaauaguuguauaucuaacuagugguuuucacguuuuccuuuuuaagaaaaaccuacaaaccuaguuacacgugaauaaaaauauuccuaauauccuccuggcuuauugugcgacucgauaaucuuguuuuguaacauccacaaacaauauuuccaugguuuaagugugugcccugucagcuuuuaccauucuaacauguuuuccccucuaucccugcugaagaacauggucaguaguggaaggagauggcuucgugaacagcagcacaggcgguggagacuucacugcuugaaacuucagccucucuccccugugccaagguaacacugguguuuuauuuacacugaugucagcucagcacagugccuuagcccuaguuagucaugggggagaagcacaacucaugguacugugguuuugaugguagauaaguuucucuauucauuaaauugccacccuauuuucucuauuguaaauucuccaaaauuaaaucauaaugaauguauuacuguguucugucaauucuaagaaggcauauuuuuuuauuucaaugauguuuucuauauuaaauggcaguuuuuuaaugauguuuuaaaauuaauuuauauuaauuuaauuucaaugauguuuccuauauuuaauggcaguguuuuccccccccacccuuuuuuuuuuuuuugagauggagucuugcucuguugcccaggcuagagugcaauggugcgaucucggcucacugcaaccucuaccucccagguucaagcgauucuccugccucagccucccggguagcugagauuacaggugcacgccaccacacccagcuaauuuuuguauuuuuaguagagauggggguuucaccauuuuggccagccggucucaaacuccugaccucaggugaucugcccaccuuggccucccaaagugcugggauuacaggcgugagcgaccacgccuggccuggcagugguuuuucuucuuagugguccaugaaguaaugguuuuaaauuugacaaaauaugguaauguaauauuuggaauaugcuuuucaaugucagaaaugcccaacacguauauauccgccugguguuaagggccauauagguuucuacucuggggauaaaggaccguccaaaccaaacauuauuccacgugggaacugagcucagcuuucuucagaacgaucugauagaauagucugugcucgucaagguggauauuuuccucagagugcucucugaugaggucugagcuacauauucuaucuauaaauuuggaaauauaaacuguaggucauagucucagcuugugguuuagaaugauuggguagggaugaugucugaaucagacagcugcauuuuccagccugaugaugagucaucugugucugucccacuccaaggaauuggccccacccccauuauccaggugugcauaauacuaggugugcauccccagguaaucucauccagcaacguuggaaugcacacagugccgaggagauaaaaucccucuaguaacugacacuuuauuuauuuauuuauuuauuuauuuauuuuuucuuuuuuuuuuuuuuuuuuuugagacagagucuugcucuggucuugaacucuugaccucagguguuccaccugccucggccuaccaaagugcugggauuacaagcaugagccaccgcaccggggcugacucauuuuuuaccugauaaccaguugcuuuauagaauugaacuccauuuccuuggacagucagaugaacacccugguucaguucuacccacuaggagggugugacccuccuggacauguuuucaucccugcaauagacgaaacaucucaguuaugcucucuguucauuaauuauauaaguugcaaugaggaauguuauucuuuguaauaucaucccugggcuugugcaaucuguuucauaaaauaucuuauuuuagaguuauuuuuguuguuauaagaccuuagauuuuaaaaguaaaucaauaauuucuacuuacaaagugcuaaaaaagauuaagauagauuccaccaaauuguguaccaaaguuucaaaguaaauucuucuuguuaaauaauuaaauccuuuucucccccaagaagaauuuacuuugaaaucauugauuucuagacccacugggcaaagagaagcaggcugaguaguuuauaaaucaccccaaaaaucggaugaugucucugugacuagcuaguaaagagaaaaccuuacagguguuuguuuuguuuuguuuuugagacagagccuugcucuguugcccaggcuggagugcaguggcuucaucucugcucauuguaaccuucacuuccugaguucaagcgaggacaucuggcuaauuuuuguauuuuuaguagagacaggguuucaccauguuugccaggcuggucuugaacuccugaccucaagugaucugcccuccugugcucccaaagugcugggcuuacaggcaugagccaccaugccaggccuguuuuguuugcuuguuuguuuuuugagacagucuuauucuguugcccaggcuggagugcaguggugcaaucucagcucaccucaaccuccgccucccagguucaagugauuguccugccucggccucccgaguagcugggacuacaggugccaccaccacaccuggcuaauuuguuuguauuuuuaguagagacgggauuuugcuauguuggccaggcuggucucaaacucauggacucaagugauccucccgccuuggccucccaaagugcugggauuacaggcgugagccucugcagccugccaaaagcuuacacauuguucaagauuaagcucuucaauuuaggagauugugggaagagagagacagaaaaaaacuauggccaggaaggcaaaacaaaguaggaggcuagaaaggaaaggucggauagguggaggccuggaaaggaauacucagcgguacuugagggggguaaccugaacuccuaguuucucuggugcccuuuggagaagucuggguggagguguguuugcuguugccucuuacccccgggucaggccccuacaggauccuggaggagagucuaggguggucugaacacugaggguagauuaccugcaguagcuacagaaacagucagggccaaggggcugacuaaaguccacugaggggguugaucugcccaccgcaaggaggcagaccacaacaaaaauaaguguucuggggugagugaaggaauagcuguccucucugaugcaaccuuuaaggguagucccccgccgcguggucucccgggguuagucuugcugcugggggaacaggugugccuuccaucucucacucucagacacaugaagggccugacugcccagcaaagaaaugacugagcacaugagccccagaggaaagaguccagcauuacacaugcugguauccagaccacuccuguaagacgagcagugguggccaguaaaauagaagaguucaguuacgugcccaaugacucucuggaguuccuacaauuuccugucugaacuugggcucagggcacuagguccuuuuaccgacaguuauguaauuaauaaaacauuuugaaauaugauuuuagacuguaaauagagagggggaaguguggacacagauaaaacgaaauagcauuuccacauuuuuucuuuuuuuuuguacuuaaucucuaaugugauaguaauguucacauuuuugaauagccaagagaaacauguggccagcccgaucggagauuauuaugcaaugacccucuauucaucgcuaaugaauaccaugauggcccauacagagcauuuugcucuguagucgaaucacacuugcaggaggguuuuggacacauuauaauaugcuguucuugucucuaugccauagguguuauacuuccaccuggacacaauucuaggaucuuugugaguuuuuuggaguugcauuucuaaaaugauacaccauuuucucauacacguuaauuauuagcaguugugcuuauuacugccugggagaaaggaccccaaaguaauugcauugauuucaucguuggcgugauguguggcuguuuucacuccaguugugaccaccuaagcugagaagccuuuucucucuuucguauugucuuuccccucagugacauugagauuucaagaggacaaacuccaaaagcuguggauguccuugccaaggagauuggauugcuugcagaugaaauugaaaucuauggcaaaagcaaagccaaaguacguuuguccgugcuagaaagguuaaaggaucaagcagauggaaaauacgucuuaguugcuggguaagacaccaucuaacaucuacuugaucaagcagacauauuuacaaaacucuucccuauuuaucucucuccucguaccccucaauccauccuauucucacauuugacauuucguccauuucauuuggcauuucuuuauuuggugugagauaaguuuuuauuuucagugcagagcaaacuagucgacucuacacaagauaaagucaaacaaguugcagugcuuuaucuuuuguuucucauauuauguuguuauuaccccugcuccuccuugacuuuuugaauuucauuuuucauuauaaaaaucaaaauaggaauugaaaguaaacuauuuugaacugagcaguuuguuuugugcguucuacuugaaauauuuucguggaaaagguacagauaaucauaugaaacauguuuuccuguuaauauccuugaucuuaccuacauauucacauuucaaaagcucauuauuucccuuuuucugcauuucaaaacuaauguugggccauuuucauuuguguugguuauuuuauaaaagacaaauucauaguuuuugugaaaaggaguguuugccuuuuuccccuucuuuuuaaaaaaagaaguacauucacuagcugaaaagaugauagaaagcaagggauuucaaauauuuauucagugugaccugagggaacaucaugagaccauauaaauuccuuugcugccuugaaauuucauuucagugacuauugcuuaugauguauacaaagcuucaggcacaaaaccuauuugucaggcagagacauuucuuguaauuggaauugacuccuagguaacuuuguuuuuacguauuuaauuauuaauguaagugcuuuuuucuuuauuucuuuuucugguuauaaaaagaauguaguuucauuguagaaauauucuaaaaauucagaaaacagaagugaaaaaguaaaacaucccaaacccaagcacucagaggaaacaacuguugaccugcgaggacuguuuugacgcugauagagucucucagccaugaggucacacucacaugcuauuguguaagcaaccugauuauucaagcauauguggcauacugagcuccaugugagugaauauugagcuaugucaccauuuuucaugacaacauaacauuccaucacucacaucccagauucuuuuuuuuuuuuuuuuuuugagacagagucuugcucuguugccaagacuggggugcaguggugugaucucagcucacugcaaacucugccucccggguucaagcgauucuccugccucagccucccgaguagcugggauuacaggcaugcgccaccaugcccagcuaauuuuuguauuuuuagucgagaugggguuucaccauguuggccaggcuuuucucgaacuccugaccucaagugauccacccaccuuggcaucccaaagugcugggauuacaggugugagccaccgcaccuggccacaucccagauucuuaaacauguuggggaagcaggggcugggggaguagcaaaaugcccaggaugaggguggagaucccaucuuacacaucuucuggcaccucuaguuccaucaauaagugcuacccugguaguucugaguguuucuaauuguccaagugcacugaugcagaaaaauaauuugaacauagaauagggauguuccacaacuuacuugaccaauuuucuauugaugggcaaucaaaguguucccaauuuuugccauuuuaaacugcuagaauuaacaaccuugggcauguggauuugugcaucuguuuaauuaucuccuuaggaaaaauccccggaagugaguucaauuauuuauaaccacaaauaaagcaaaaauauuauccaaaacaggccaagcgcgguggcucacaccuguaaucccagcucuuugggaggccgaggcagguggaucacaaggucaggagaucgagaccauccuggcuaacauggugaaaccccgucucuacuaaaaauaccaaaaaauuagccaggcgugguggcaggcaccuguagucccagcuacucaggaggcugaggcaggagaauggcgugaaccugggaggcggagcuugcggugagccaagaucacgccacugcacuccagccuaggugacagagcaagacugucucaaaaaaaaaaaaaaaaaaaaaaaaucaccucuuuaaugauauagugauuucuucaaauccuuuuucccuccuccugucccacuuuccuguccuccucuuucuccuucucuuuguguagcuuuucuuuuuuuuuuuugagaugaagucacccaggcuggagugcacuggugcgauuuuggcucgcugcaaccucugcccccuggguucaagcaauucuugugccucagcuucccaaguagcugggauuccaggcaugcacccccacgccuggcuaacuguuuuuguauuuuuauagagacgggguuucgccacauuagccaggcuggccuugaacuccuggccucaagugguccgcccgccuccuccuuccaaagugcuaggauuacaggugugagccaucaugcccagcuucuguagcuuuuuuguaagagggacagacagccagggccucucugaaucccucagcaguuggcauuguaaggaauucauccuuugcuccacaccuugguugccuguggcuucacccuucucccgcaggcuuccaggcucacugcaguuagauuccugagccccuuuccaaccuagaaccccaaacuuaauguccccauaaucgagugugggaaaguuccuggcugaggggagggguuggcuccaccugcaggcacccucugggcccacacccugcaaggagcugccucugguuagauuggcuccggggucucugaguuuagggcacaguuuagucaggguuguuuuauggcaguaugcuugaugcauauuugucugcaauuaauaaacaaacucuuggccauuaagaccuugaaaaagcauuugauuugugaaauugguuccuuucuuccaggcuucagaugaucuugguagguggguuugcaggcuuucucacccuguucagauaggaacacuuaaggaaaacuugguaggauguguugucuguuuaugaaggaagaauccugcagcagauuuucuuauccaguccuugugcuuuacuccauuuugggcuugucaauaaaaucagaaauccagauauggauggcucugaccuuagcuuggaacacaaaacugauacuucuaaaacaaagcugugaugauacuguuuucagguuccuuacuuguaaacaaagcugggccuccagccucaugcuggagaaugcuagcuagcacgacugccugggguuacagccaaugcaguccauggccaguagaacauuucuccacgcuggcuuuuugcuagcauuaauauguauaaucaagcugaaauuggccugccauguuguaaauagaaaagaagacuaaagaugaauuuucaagaacagauuaaacaccaagggaucaacaauucuuuuucugaaauucuaaguuucuuuaccuaacaaagaccuuugaaggaacaaaaauuaaauggccugucucuuuuuuaacuguaguggaaaaaaauaaccgugcugguaagauuaugauauauguaugcauuuguggcacagcuugaagauuuuuaggaaauagccacacuggauucuauaagggaagaaugaacagccccuucuccccaacacaacaaaugauauauuuuuuagggcuguaaacugucaucaguaucuaaucccuuaauagcugaauauugauaucaguuuagaucacaggcaacuauuuuaucgauagccuaaagugggccuggcaugacggguugugccuauaacccaauuacucuggagacuguggguggaucacuugaggccaggaguucaagaccagccugagcugcauagcaagaccccaucuuuaaaaaauacaaacaaacagcaaaaagcagcacugguuuaaagcaacauuuguaaucuaaagugaaaagucaauuugaaauaaaaaucaucuucauauuuuuacauuugaccaggucaagcguuagggggaaaugacuguuaucaaaccauuauaugcacuguugcaacuucuuuaaaaauauaaaugaccccuccauuaaauggagaauuauuuccuuuuucuaaaagucuuuucuaauucugaaaauaauauuagcuuauuguaaaaaauuuaacauaaaguaaaaaggagauaacuaggucucucauaacucaauauuuuauuuauauauucaucuuuuuacacauugagaucaugcuauaaauaucauuuuuguccugccuuuuucucugaacacuguaacauaaaucuuuuuccaugcuuuagaagaauucaaauacccaaguaauuuuuaaauaauacuaaauaacaauauauuuguuauuacauauuuuaauuuauauagaaaugugauuuaaauauaucagcaaugggauuaaaauauaaaacaaugagauuuuuuuaaaucuucuauuauuaauaacucaaaugcagaacagauuaauucuuuuaaaaagccauucuucaaacuuuaggauuucuuauucagucagaaucaucugcauuucaucaacuacauaucgcaugguauuuacaccuacacaucacuuuauuugcuuugccugacaaaaugaaaaguauugggaauuguucagggaaauaugccaaaagaaucuuagggacucaugaguuuuacauauuuucccaguuacacuaaugaaaaggaauuuuguuugagaacuugacuuggagugcagcugcagggcauuugaaucucagucuccaucaggccugcacccauuucugugcagaaguuucuagaauuucccugaauugguuggacagagcagcuaaaaaagcagcccaaacugaucugggaauagacugaauuucacauuaaagaaaaauuugaaucauucacaucauuucaucuuuuuuuuuuuuuuuuuuuuuuucugcagagggccaaauacccgauuggauuuuuuaaaaauguuucaacccuuuauuucgguacaauguuaaaauaaucugacuuuucuaugauuuggcuuuucugccuugaguaacuauuuaaauaucugugugauuuucuuuuauuugugcuacuucuagaacaaaacagagguauuuagaagaaaccacuucccacagggccuuugaaccguuuaccuaagucaaguguaaugagaaacauaaccaaaugcaccaugggguuuauuguuagauaauaaaaggcuuaaaaagccccuagacccuaaagaugccugggauggaugauuuauguucauaugcuacuugagcauguaguuuuggagugcauggugaggcccauggcuaauggcaguggugcuauucaacaagauucugggucuuuagaauaguucaaaguuuuaccacuucucucuggauaagccaucuuuuugaccuuugaguaaauuauaaacuucuuuucagauuguguccaaauggucacagguacuuugacaguuuuuacuguaacugccaauaaguaauacucaucuuuaaaaagacaucauucuggcagggcaugguggcucacgccuguaaugccagcccuuugggaggccgaggcgggcggaucauuugaggucaggaguucgagaccagccuggccaacauggugaaacccuguuucuauuaaaaauacaaaaauuagcugggcauggugaugggugccuguaaucccagcuacucaagagggugaggcaagagaauugcuugagcccgggagguggagguugcaaugagcagagaucacaccauugcaguccagccugggcaacagagugagacuccaucucaaaaaaaaaaaaaaaaaaaaaaaagcaucauuccauugucaacccuuuuuugcuguucugugcccugaacaggugaugugauagcggugcaaagagggugagcauuguccuuuaccucaacaaguguguggccugguaggcgagacaggcaugucagaaugcuuaucaugaagccaucugaaaaauucuagaauaaucauauaaucaaugcucuagauaucagagaggggguacagaaaucugccgggagaaguggaggaauguaaugaacaaaaaucacaguuccaucucuaugaacucuaagcucccauagaaaaagaaauuagagggcugggcgugguggcucacgccuguaaucccagcacuuugggaggcugaggugggcggaucacaaggucaggaguuugagaccagccuggccaacaaggugaaaccccgucucuacuaaaaauacaaaaauuagccaggugugaugacgugccuguagucccagcuacucaggaggccgaggcaggagaauugcuugaaccugggaggcagagauugcagugagcugagauugugccacugcacuccagccugggcaacaagagcgaaacuccaugugucuccaaaaaaaaaagagaaaggaagaaagggaggaagagagggagggaggaaggaaggaaggaaggaaggaagggagagagaguaauuagauuaccuuaaggaaagaaggaaggaaggaaggaaggaaaagagagaaagaaagagaaauuagauuaccuuggugcucauucuuucguauauccccguugaugauuuggaaucugagcuaaagauacuggggggaaaacuaaaccaaauuuugauaccaaauacaggaaggaggugaaauaagcuuuuuuauuguagcucuccuuuuauugcucacaauaaauacuuccuacuuugugauuuucccgaacuguauuaguuggcagaaagcugagcaguccuguguuucuaauuaagaauuggaugguuagcuggaguuuugaggaggucaucucugggcgugucugcuuuuggcuuucuugggcagcuaugcuagcauauccuugggaaugaaaauguaauccuucaugugacacaguuuagguaaaccacuuaguccuuugcaaacaccaaaugcucagugcgguacuuaaaugacaccauauuugaugccacaguuucuuuacaggcucuucuaagauuguaaugccugugggcuuuuaacugcccuuauugauguuguauccaagaaaacagaaaguugacuccaagcagaaguauuaauaucuuuguauaacuuucagucuucacguugaccccacugcagaucugcuguuuagacagaugcagaggugacugauaagccggggucauguggcuucaggagucuuagguuucuccaugcagcggugucaggauaggcucaccagcuccuggccacaguggguaccagcgaccuccuuguugcugaauccaccgaccacucucgguccucauccugcuuccugccucaguggcguuugacuuuccuguucuggaaacagucucauccuuggccuccuucugagacuuccugucauguucugccuucuucuccaggguccucuuauuuuuuguguuuuuagagacagggucucacuauauugcccaggcuggucucaaacucccuagcucaagcaguccuuuuaccuuggccucccaaagugcuaggauuacaagcaugaaccacugcacacagccggguucucuuauuuuauacuacgccuucuuaguuuccuuuuggacucucuucuucugacaacucauuacaagcaaaugugcuuaacucuucuguccuuaucccuuuucucacucggugcacuguccuugggugaucuuacccauuccaugcuuuaaauggcuauaguuaugauuuccauccauggagaaccugguuaagucagauggcuggcuuugccucccagcucuacugcuuacuagcugugugacugucggcaaguugcuuacacucugugccucaguuuccucaucuaucaagugagcguacaaauaauuaaccccauaaauaugaagcauagcaccucuccuauuaacugccccaauccacucucaguuuuaucuaguuaacauuuauuaauuugccgggucucaccuaagauguuacuuccuacaggaaacauucccagauguucaaaucuaguuagauccuuuuuccauguacccucauaauucagucugacugcccuauuucccugucuuaguguuugucacauuuaucguaauugcugauauauucagaucagcuggaagcucgugaggauagagaugaagucugacuggaucaucauuuuguccccagcgucuagcucagugccugguacauagcaguacuugacaaauauuugcugaaugaaugacucauggaauuguaggguaugaugacgccucuaaagacauucuuucuuugugguuacauccuuagguuuuguagaucagaaaacucuauuagauugguugugguugaguauccuugacaacauggcugacaguaacucauggaagaccaaacuguaaacccuaaugacagccuuuaaauuuuuuaacgaugcuugagagcuaagcuggaaggacguggggugcuuaucccucguagaaaugccugccaaugcuuucucauuuggacccaaacuccagaucgggagcagucuuauagcuggaucagcuaccaagagaaauucuaaagcaagaagagaaaagcauuucaauuugggacauuuauuugcaccuggaaauggggaaugggcuaucagaccagacuucuauccuguccaaccugccuucauucaguccuuccacauuguuauucuggguuuggacugugcuggaaagacaacugucuuauacaggcugcaguucaaugaauuuguaaauaccauaccuaccaaaggauuuaacacugagaaaauuaagguaagcuugggaaauucuaaaacagucacuuuucacuucugggauguagguggucaggagaaauuaaggccacuguggaagucauauaccagaugcacagauggcauuguauuuguuguggacucuguugaugucgaaaggauggaagaagccaaaacugaacuucacaaaauaacuaggauaucagaaaaucaaggagucccuguacuuauaguugcuaacaaacaagacuugaggaacucauugucucuuucagaaauugagaaauuguuagcaaugggugaacugagcucaucagcuccuuggcauuuguagccuaccugugcaaucauaggagauggccuaaaggaaggacuugagaaacuacaugauaugaucauuaaaagaaaaauuuugcggcaacagaaaaagaaaagaugaauaucaauaucuauuauaucuguguggaguagguuuucucuggucugauuuugacaaauagaagagugucuacagcgugguuugccugucugcccuccuggaugcuauuaaagcuuuguuuuguugaacaaucagaugcccaacucuguugccuuguggaagaugaguaaaugcagugcuucuuaaagugguuucuucucccuaccccacacaucuuuugguacuaccauuuggggaagccaagcaaggauaguaaauugaucagaacacaguugugggaauuuggccugaaguuagugaaauaaaacuuuaaagaguggaaaaaaaaaauuuuuaacaaugcuugugauguacuaaagaacaauuuuaugaggccuuacuugguaauguaauaggcucucuucaauaccuaauacugugauguuaugaacaugggaacauuugguuuugcaaaguguugucaucaacaauaagauucucaagagcagaaguuuccgccauaguaugcacagggccuguggacuuuuugaauauuugaaggacugucauauggaaagggaucaggcuuaguguguaggacuccaagagcuaggacacaacaugaaugcagaugccuucucucuagaacaaagaacuuuugaacuguaacagcugucuguaaaugagugggccaccccagaggucaugaccuuaucaccaucuguguucaagcauggcagggagaagcccugggcagggauaucuggaaggagaaggacaaguggggacuuuagggucccuucuaauccugagagucuggcagugcccuacucacccaaggaccguugagcuaggcccuguccccaaaccauaggcccugugcccacacccugccccaauaaauggcucaggaagaacaacugcuauauacucaucagcaagaaaugccccaccaucagcugaauuauuuaaaccauuuugaugagugguuuuauggccuuucuugaaacugauguuguuauuagcacugccuaauaccuuuuccuuuuuugguuucuugguaaaggugugucuguaucuugacuuuagcuuaugccuguccugugugaugugaguagaccauaauagcccgagaaaauuaaauuauggagugcauuuugaaaugagcacccucagauuugauucuggugucuucggcugguuuugcauagguugucugggaaauauuauaaaauucacuuucuccccccgaacucaggaucacacccaccccucuuggagaagggaagagcacagucaccaucgggcuugugcaggcucugaccgcacaccugaaugucaacuccuuugccugcuugaggcagccuucccaaggaccgacguuuggagugaaagguacugucuuuaacaacuaguguacuuuucagggcaaaguuggggggagagaauuguaaaaagaacauugucaacagauaaagaguuaagacuuuucaggggacuugguacauuucuucacugcacacucaguacauaguggucgccccauguugguucccccgggcaugaaaaagagcagugggagccgccagggcuucacuggaugccucaggagccuguuccuggggcugcguugcucaaggcucccgccucgagugcggucucccauuucaucagggccuucuuugccaagugaucuugaaacacggccauccauaucgguguuugaucaucccagucccggggaaaggucuuucccucugcuuuagucucggcucauuggaguugcuguguggggcccgcagagcucucuggagacggacuggcuguggacagcgagucgugaugaaauuccuccuuggccguggucgggcugauaucuggcacuuccccauucauuacucuuucuucccugauuuaucaugaaaucauuccuuagcucacuuuacaguggugguuauugcugcaauuacaguuuguccuuggcacuucgugauuuuuuaagaauauugcauuuguauuacuguuaaacauauuaauaacguaucucauaaaguacugauaacgcacagagugucaugcaucguguaguggaaugaacacuaggguuggagcgagaaagccaagguuuuggucacagcuguguuuccuaccgccaugugacccuuggccacuugagccagucacaaccucucggagccgcaucucuaaaaguccaaaaugcugagagcggcaccaggcucacccaguuguugugaggaucaaaugagaaagcacguaaagaacgagggcuacugucaaaugauacacacaugggcgguguuguucugcuuuaggaaagagcaguccuuuuacucuaacaaccaacauuuugagggauacgcagcaugacaaaucucacauacuauuaucugaaauaaauugaaguuuauaauuuacucauuugaggugguuaugcggugguuuuuuuguuuuuguuuuuguuuuuguuuugagacagagucucacuugguugcccaggcuggaaugcaguggugcaaucucggcucacuccaaucuccgccucccaguuucaagugauucuccugccucagccucccaaguagcugggauuacaggcacccgccaccaugccuagcuaauuuuuauauuuuuaauagagauaggguuucaucauguuggccaggccggucucgaacuccugaccucaagugauccgccugccucagccucccaaagugcuggguuuacaggcaugagccaccucgcccagccacaguguauuuuuuuuaaacaaaguuugcucagauaugaaaucauauacaauugauuuagauaaaguauagucacagagaucuaauaauaaauuaucaaaauauucucauauccugguauguuuuacaguaaugacaucugcucuauuuuuaccuuuuuuuuuuaagcaaagaaacagagguauaguuagacaaagugucaacuuuuuuuguuguuguucugcuuggauauaaccauuagugucucucacugccuuuuguuacuucaucuugggugugacgccucucuguuggguuuggggagcugugucccuuggccuguguccaucguggcagcuguacuuggugacccguuugaaaugccucuugcucuguuguuuaggaggagccgcgggugguggauaugcccaggucauccccauggaggagguaagaccuugaagagaugcgggucagcuaucacuguguuuccuuccugacaucuugucucugcucccauccacacaggcccacagacccucauccauaaucccaaagucauuaaggcucugaaaccccaaaauguuugcauaacucaugcagugacaaacccuaguauuuacugugaugagcuauaauuauauggauuuuguacgugcuacuuggcgugaauauucauauacauugcuguggaaaaauuauuuuugauuaacaggugcugaccuagccccugcuugggguguuuuacaaauaaacuacauguaaaucacacugccuuccuaaacuucaaaaaauucagaaucuugaaacccugcuggccuugcgggucuggaugagagaaugugggucugugccucccuugaucaucugcuguacugccaaguucacgaagacuugacgcuuccccucugucaauucaggcucuagugcgugccucggcagcauagauacuaaaacuggaaugacacagagaggauuagcauggucccugcacgaggaugacacacaaauuugugaagugucccauuaaaaauaaaagaccccaaaauaaaagaguuccagaggaaaaugggcaaaaagaacugacguuguuaauucucacuucuguaagaacuccaccuuuguuccacauaaccucuuuguugccuguaacuaaccagugaccagcucuuuucaguuucacucucugcaucagccuuaucauucagggccuggacaaucuuccaaaacccaaaucugagcaggucacuuuccuguucugucauuuccgccguugccugucacccuccagcacagcacaggagguccucguggguggcugcuccugcuucccuguccacaaguccccaccugccuucucucuacugcgucaagcuccuugcagacucuuuuuuuuuuuuuuuuuuugagacagaguuuugcuuuguugcucaggcuggagugcaguggcacagucucggcucacugcaaccucugccucccagguucaagcaauucucaugccucagccuccugaguagcugggauuacaggcaacugccauugugccugacugauuuuuuguauuuuaguagagacgggguuucaccauguuggccaggcuugucuggaacucgugagcucagacaauccacuggucucagccucccaaaguguuaggauuacaggcgugagccacugugcccagcccuugcagacucuuuuccuguucucucuugguuccaggauuuucccaugccuggaacauucuuccuuuucuguccucuuuacccaguuuagucaagguuuuuugucaagguucuucucuaccccacagacucccucuguguuuacggcuaucugguucaguuggcuguggcgaguugcgggccuuucuugaggucucaggucccagcauugagcagagugcccagcacauaguaggaacucacuagaaaguacuuguugacuuuguuaaaggaauagaaguguuuacccauggaggucugagugucagggaagcuaaagagaaaaucuguaggaacuucaaguacugggagugggggugagaaagaguaguccaaggcacugcugaaaaaaaucgucccaggccucaggucagaauggggauggguaccauucaugagccagcaagacccagaaccaggaggccaaauuagaggugguguacaaggggcauacacaggggaauggcucggguuuagccagcaaauuggaaggacauuggugucccgcugguuuagggcaucagcugcguggcuuggaggagagagcuacuuuuauuuuauuuuauuuuauuuuuugagauggagucucgcucugucacccaggcuggagugcaauggugcaaucucggcucgcugcaaccucugccucccagguucaagugauucuccugccucagccucccgagaagcugggauuacaggcaccugccaccaugcccagcuaauuuuuauauuuuaauacagaugggguuucaccauguuggucaggccggucuugaacuccugaccucaggugacccacccaccucggucuucaaaagugcuaggauuacaggcgugagccaccgcgcccagccaagaagacuaccuuaugaggguagagugggccagacacacucaggcaauuuguuccuugaaguugagugccuccagucuuuucuucaucuguauccucccagcucugagcaccgugccugacacuugguggauguuuguugacugugugccaggcacagacaauauguacuggacggaacauaauaaaucaccauaggggaaaauguuagaauaaauuccagaugggcugaggaauugaaagugaaaacacuaugacuggaaggaugggaaggagccggccuugugaagaaugagggagagcauucagccagugggaacugcuggugggaaaguccugaggcaggaaaggguguggccuguucagggaacuggaggacaccaggguggcuggagccccgugggccagcgggaguuggggggguugagguagagaagugugcaggcgccagcucugucgagcgauugcaauuuguagccaagaaccuggauuuuauuugaagugccaaggucagccauugaagggaucuugacagauaacacaaugcagauugaguuuuauuaaaaucacccugucuucugugugaugaaaggaccaggggccucucaguagacacgaugaauccaggaggaagacuauggaaguagccuagggaaagaugucagugacuuggcccaggaugggggcagugaggauggaaaagaggaaaaaacaguuuaagauuuguuugcugauguuugcaggauuagauguuggggguuagaaaagaggaggauucaaggacgacauccaggguacuggcuugagcaacucaguagacucauuuguugaggcagagaacaggggagugaugguaugagguuugaacugugugguguggggugugguggagggugguagucagaaggagggagucaguuuagaggccuaugaaacaugcagguggacaucaaguagacggcuggaaagaaaaacuuacauuccaguugugaaauggccaaagaguucaauagaaacaucgaaaaagaaauauuaacuaaaugcauauucaucuucaccaauaaucaaguaaauaaaucuacauuaaaaccacuaucaggccgggcacgguggcucaugccuguaaucccagcacuuugggaggcugaggcgaguggaucaccugaggucaggaguuugagaccagccuggccaacauggggaaacccugucucuacuaaaaauacaaaaaguagcugggcgugguggcaggcgccuguaaucccagcuccuugggaggcggaggcaggaggaucacucaaaccugggaggcagagguugcagugagccgagaucaugccacugcacuccagcccaggcaacaagagcgagacuccgucuccaaauaaauaaauaaauaaaaauaaaaccacuaucaguuaccauuuuacuugucaaauugacaaaauuggauuuuucaaaauaguuaugauaccaaauuuuggcaaagaaauugaaauggacucccacacacugcuggaaaguguauguugauaaaaacacuucaggaagaagaguagaaauacauauuaaguguuuuaccgugcauauccuuuggcccaaauaaauucauuuuuaguguacccuaaggaaaaaaugaauguaugggaauauagaucauuuuaaauuaaauauacccucacauaguuuauaacauuaaaaaauggggggauaauaauaggacaucagguuaacuguauuuugaagaaucuuuaaugauguaaaaaugcuugcuauguugagaguguaagagcuaaaguauaaacuguuacgauguuaugauuccaauauuuaaaaguacaaauauauauuuauaaaauauauauacauauguaauuuuucauguuuucuccaguuaacauuauuuuauguuauaaaguaaaauuuuaacaagaaaauauuuaaccuuccaagaaauuaaggaaaugcagcuuuaaaaagaauaacacuuucucaacuauuaaauuauuucuuagucuaaaaguuacuuuauuucugaaguaacugaucuacuacuaguguuuugcagaugacacuucaucucuuucaaaaagcaauuuggugauauuaucaagaucucaaaggccggaugugguggcucaugccuguaaucccagcacuuugggagucugaggugggcagaucacaaggucaggaguuugagaccagccuggccaacauggugaaaccacaucucuacuaaaaauacaaaaauuaaccaggugugguggcaggcgccuauagucccagcuacuugggaggcaggagaaucccuugaaccugggaggcggagguugcauugagcugagaucaugccacugcacaccagccuaggugaaagagcgaaacuccgucucaaaaaaaaauaaauaaaauaaaaauacuucaucccuuucaaaaagcaauuuggugauauuaucaagaucccaagggcugggcgugguggcucaugccuggaauccuagcacuuugcggggcugaagcgagaggaucacuugaguccaggaaucugagaccaaccugugcaacauagugagacugugucucuacagaaaaaaaaagaaaaaaaagaaaagaaagagagcucauuuaaccuaguaacuaccuccugaaaauauauuacucauuagcaauuaauuuuuuuaauaaaaggaaaagcuauuuguguauauucuuuauaacuguggccuuucuuguaaaagugaacauuugguaguagcguauauauccagccugaaacuuuugguacaucuaccguauacagcuucuauaaacuauacaaaagauuauuauagaaaaaguuuugugaaaaacgaaacuuggaaguuuguaggaagaugauucuacaaaugauaaucgagugugcucaugagacuggaaggaaaauaacagaaugaguagagucaugaggguaaaauacucuauuucuccaaaguucuguaauauuucauauuauuuuauuguuacuguuuauuuuaugcccugccucacuccaaaguauauuugauaugauacuguuuucuagauaauaaaacaaugaauaaacguagugagugacuauaaggagauucauuauuaaaugcaucagaauguuuugccuuaaccugaggauggaagaauuuaugaucugaguaauugcucaaagguucuuuguugucacguggaaggcuuugaccuugauuuucugauuuaggcauuccuauagacucagcucauuauaaggauauguaauuugcaugcuauuuuauuuauucaguccuuaaauuccauaguuguuuaaaacaaauaggaagaugucuuagccgagcacaguggcccaagagcucauaaccagccuaggcaacauagcaagacccccaucuccacagaaaauucaaaaauuagccaggcacaauggugugcaccuauagucccagccuacucaguaggcuuaggugagaggauugcuugagcccaagaguuugagaauacagugagcuaugaucaugccacugcacuccagccugggcaacaaagcgagacccuauuucugaaaauaaauaaauagaaagauaucuuauuucucuaguucaaccuucacuugacuggagacauccacgccaucaccgcugccaauaacuugcuggcugccgccaucgacacgaggauucuucaugaaaacacgcaaacagauaaggugagaaggaugccuugcuagccauuuuggguauuguauccuggaauuccuggauucuuaaggaguuuguggaaagaauucuggugucugcaaacucugaaauguuauucaauucaauuuugugauuuuuacauaugucccuguuucccaaggagaaggagccauccuuugaucagauucucaaauggguuuaugagcacugccaaguuauugggagaauuguaguauguuguaaaagccaaauauucucuaagaugagucuuuaguuuuaaagaugguagguagaccaguucucuucauucuggucauagguccaaucucugaucuguucuaaggggauuggacagaugucguuuuaagacuaauguuauguggagcuauuuuagaugugcugaaaagaugucagagacccuuauugggcuucaugugcuuguagguuaagaguuaaaccacacccccaaaggggacagcccaccagaagcuaauuccucacagauauaggacauagauaaaagggguaccuucuggcacauuuuacaacaaggguccucacuuucuuuaauuaaaguaguuccuuagugagucuuugcuacauaauccagauacaucuucauaugguaguuguagcgauauagaucaagaaauauauuuaugcaaacucuuugcaauguguauuauuucagaucuugucaguuuuaugaaaaugacagaauuuaagucaacauuguuuauauuagcccacaaauuuuaauagggucuuuuaucuaaauaguucgguuauaaaugcaaugaauuuuugucauauccugugaauuguccaaguucauggacaacuaacuuuuguguggucucauuuuuguuuuguguuuuuaggcucuguauaaucggcugguuccuuuagugaauggugucagagaauuuucagaaauucagcuugcucggcuaaaaguaaguuuccaguuagcaauucuuuaaaaagaaaauaucguagaaacgcaucagaaagauugucaaagccugaaauuuucaacuugguuugauuuugguuuucagauauccuuuuggguauuaaacucuauagagaccgaacacuggagcagagagagcacaguguuggaagccugaacccugguucuacacgaaagagccagguggacaaauuaauuaaccuuuuuuggucucaguuucuucgucuaugaaaugagaggacuguuuugcuaauuuaugaguacucuagucaacugacaaguuagcugggcacaggagcacauacauaccuguaguccgagcuacucaugaugcugaugugagagguuugcuugagccaaggaguucaagguuuauagugcaccaugauggccccugugaauagccacugcaugccagccugagcaacacagcaagagcccaucucuuaaaaaaaaauaacaaauuagaauuuuuggugaguccuucucuuucuaaagugaaauauuuuuaugaaauuuguuaaauuucuaggaaauuauaggauaaccuuugaaaacucaucuaucucauuugugguuuucuguuuuguuuuguuuuguuuuuugagacagaguuuuacucuuguugcccaggcuggagugcaguggcaugaucuuggcucacugcaaccucugccuuccugguucaagugauucuccugccucagccucccaaguagcugugauuacagacacgcaccaccgcaccuggcuaauuuuuguauuuucaguacagaugggauuucaccauguuggccaggcuggucucaaacgccugaccucaagugauccauccaccuuggccucccaaagugcugggauuacaggugugagcuacugcgcccagccucaucuacguuuuuguugcagcaaacacuacaauuauacuugcguaugccaucuuaauucuuaaaaccugucuuaucuuuuuucugaugccauuugcugccucuggucuucuaaucauauugcuugcuacuagcccuguuucagagacuaaaaaauaacccuaaaugguauaacuuaacaaccuuacugguugguauuaagugguuuuaaaaauucaccuccugccucuuacugaaccaaguucaguguguugaauuagugaguaauuccauccucggcagcuauaacaacaugcaguuucuguuucccagaucuuuuuuaugcuucauuaaaaaucacuauuuugccaggcacaguggcucacgccuguaaucccagcacuuugggaggccgaggcaggcagauccugaggucaggagauugagaccauccuggcuaacacggugaaaccccaucucuacuaaaaauacaaaaaauuagccgggcgugguggcaggcgccuguagucccagcuucucgggaggcuggggcaggagaauggcgugaacccaggaggcggagcuugcagugagccgagaucgugccauugcacuccagccugggcaacagagcaagacuccaucucaaaaaagaaaaaaaaaaaagaaaaaucacuauuuugugugugugugacagucuugcucuguugcucaggcuggagugcaauggcacgaucucggcucgcugcaaccuccgccuccuagguucaagcaguucugccucggccuucugaguagcugggauuacaggugcccaccaccaugccagcgaauuuuuuguauuuuuaguagagaaggggcuucaccauguuggccaggcuggucucgaacuccugaccucaggugauccaccugcuucagccucccaaagugcugggauuacaggcaugagccaccacacccagccaaaaaucacuuucuuaagauguuuuauuuacacaaaauaaauaggaagauuucuuggcuuggugugguggcucaccccuguaaucucagcacuuugggaggccaagacaagaggauugcuugagcccaggaguucaugaccagcccaggcaacauagcaagacccccgucucuacaaaaaauuuaaaaauuggcugggcauuaaaaguuuuaauuuuuuuuuuucuccuccauaaauuaggaauaacuuacuuugaaacauaggaauaaacuuaacuugaauuacugguauuuguauuugaaaaacuaaagaacugcggcaucaauuauauggacagacagcaguuuaugucucuucugagcagcguacaugguggccacauagagcagcccaaggagccccuggcuaacgcagccagcagcaggcacaagugguaguuagcuguaugcuguccacugcaggacaucuucagaucaauccuuuucagagucuauuacgaacucacaguaucuuacucguagaagaaaucuggccauagguauuugucugacuuggccuaaccuauaauucacucaaaguucaguuuaguuuaguuuuuuuuuguuuguuuuuuguuuuuuguuuuuuuuugagacggaguuucacucuuguugcccaggcuggagugcaauggcgcaaucuuggcucacugcaacuucugccucccagguuaaagcgauucuccugccucagccucccaaguagcugggauuacaggcaugugccaccacgccaggcuaauuuuguauuuuuaguagagacagaguuucuccauguuggucaggcuggucucgaacuccugaccucaggugaucugcccaccuccgccucccaaagcgcugggauuacaggcgugagccaccacgcccagcuuaguuuugauuuuuguuuuuugguuuuuuuggagacagagucuugcucugucacucaggcuggagugcaguggcaggaucucagcucauugcaaccucugccucccagguucaagugauucuucugccucagccucccaaguagcugggauuacaggugcucuccaccauaccuggcuaauuuuuuuauguauuuuuaguagagacggggauucaccauguuggccagucuggucucgaacuccugaccuuaggugauccaccugccuccaccuuccaaagugcugggauuacgggcaugagccaccgcaccuggcccaguuuaguguuuuuuuuguuuuguuuuguuuuugagauggaguuucgcucuuguugcccaggcuggagugcaauggcacgauuuuggcucaccgcaaccuccgccucccagguuacagcgauucuccugccucaguuucccaaguagcugggauuacaggcaugcgccaccaugcccagcuaauuuuugcauuuuuaguagagaugggguuucuccauguuggucaggcuggucucgaacuccugaccucaggugaucugcccaccuuggcuucccaaagugccaguuuaguuuuuuaaaaggcuuuaccaaucauggagaaaauaaaauuagagggauaauuuuggugacccuuugcuuucuguuucuucucaaacuucucaccuuuuuucuucuuaaucauuagaaacugggaauaaauaagacugauccgagcacacugacagaagaggaagugaguaaauuugcccgucucgacaucgacccaucuaccaucacguggcagagaggugggugcuggggagaugccagcaggcugauggccagguggggaggcguguucgagccgaagcgcuuaaauucagaaacuuacaguuugauccuguccagugaucuucccagccugugcuucauauucccaccauuuauuucaguuacuauuaucguaccacccucccuuauccuugccuccaauuaaaacaaaaauucuguccagggucaaucccaucuacuccugugucuucuaaauuuccaaggaaaauuaccuaauuuucucuucuguuucucucuccuuuggccucuuguaucuauauuaagaaaaaaaaaaagaaacuuuuuuuaaagaccacgccucccuggcuuuguccugcuccuccuccacccaccaucccaccuucuucuguucacuuccuuaccacuggcucucggcagcucucuguguguuuccagugcuggauuuuccuccaagucugauaugugcuuucacccacuuaacgaggcaucgcuccacugcuucacaugcauccagguggaguccccgugagcuccccaccaccucgacuucccugcuucccucucaguugugaaguccccuuccuucucccacacugcccucagucucaucgcucacuaugggaugagacagagggaaaugcacuaaacaggaaguuaggagcccugagugugugucuccccugccacugacucacugcaugaucucgagcaggucgcaugcauguucuuggcguuggagauggagauggucacauacgcugcacagaaacacggcaaccacauuuuaugaacccugugcaacugcagaaauguucaauggcauggaucccugauucuuccuggauuauucuucucauacuugugcccucauuuaccucuuuaugcucacauuuggaacauauuuaucagaugcgcauuuuauagcaguucccgacuaauagauuaucuugcuuccguuuccaucccccaguucagaggguucacauuaacagagauaucccguugugaucagaggccuccaguggcuccccacauccugggugauacaguugccaucgcagagcuuggucuucaggacacccgcaguggcuucccucacucugcucccugccugcuuucuagucagcagugccgaccuccauccuccugccagcccuagcugggccaucuccauccugucuccugccuaggccaguguugcccucuaagaugcacccaggucucgucccuucagggagcuucccuucugggaauccacccagccaguccauuaagaauuuaguguagucccacaaaccaugagguagagagacaaagaccagagacugagcguuggcucugcgguuuaugggcugcacaacuuuggacagacugcucacucaguuuccucaucuuuaaaauggaaucauaauuccagcugccuugcugggaggcuucacugaaacauaagcauccuuuccagacccaaaagcucugcccacacgaucaucagaagucacuguggugauagcuguauugaguagaguuuuuuguuuguuguuauuuugagacagagucucacuugcccugucaccuaggcugaagugcaguggugcgaucuaggcucacugcaaccucugcaucacuggcucagucgauucucuugccucauccuuacgaguagcugggauuacaggcacacaccaccacacguggcuaauuuuuguauuuuacuagagaugggguuucaccauguuggccaggcuggucuggaacuccugaccucaaacgauccgcccaccucagccucccaaagugcugggauuacaugcgugagccacugugccuggcuuggguaguuuuuuugagugucuuugucucccaaacuaaacuaaaaucuccuuggaaacuuuaugguuuuuuuuuuguuuuuuuuuugagacagggccucauucugucacccagguuggagugcaguagugcaaucuccacucacugcaagcucugccucccaggcucaagcaauucuccugccucagccuccugaguagcuggaggcugugcgccacaacacucagcuaauuuucguauuuuuaguagagaugggguuucaucaugcugcccaggcuggucucaaacuccugagcucaggugaucuuccugccucggccucccaaagugcugggauuacagacaugaaccacugcacccagccuagaaacuuucaaggauacauuuuucauuuugaaauaaguaauaacauuauagagauuuuggaaaugucucaaaagaauuuuaaaaaccuugcuauacuaauaaaacuacuauucauaguuuuuugugugcaucuaguuuuuugguauaacucuaguuauaacuuuaguguauagauuuuauauccuacgaguuucauucauuuauaucauaagcauuuuguauuuuguuagcucuuuguuguaauggccauuuuaaauacucuagaauauuccuuuguggaugaaccacaacuuacuuaagcaaggcucaguucuugaaaacaccaacagcauuuuaaauaauggacaugaauacuuuaagcauuuuauugagaagccuacauauuuucuuugaaaauuuuuuuuauaacuaggaagauuuauuauuaaaaugucaucauguccaaaauguauugucaucuuuuuuuuuuucaaagcauuugugauuuuguguuacucuucaaaacuuuuuuggagguuuacugaugauaggaaaaucaggaagguggaaauuaguguauuuuaaaccaagcauauggaugugcuaaaagagaaaguuuuaugccaauugguauucuuuggugucugcuuugggguuccagccugagcagccaucagaaacagggcaauggcuuagacauggaucuuggaagagaaaggcuacaucaucuuuuauaccugggucuggucugcaauugguuucucucuggagccaggaaggacugaaguguuuugugguugugaaucacuuuuaauggaagugacaacuuuacaaaauucuuccggaaaaaaauuugaauuccauuauuguucagggcacugaaguaaagaaaacuuuauugcuguggacaagcuaccugggucagaggaauuuggaaugacauuugauaaguaguuuggcucuuaugaccaugaauuaauaacagaaauaggacucuucaucaaaagaauugagaacauuugcuaguaggguuuuuuggcuuaaaccuagaacuaauguaacccuugugaugaaauuggauccuuauuugauuugacaacuagagcaggacagucagggugcacgguggugggagugagacccucuucucaggccauauggauguugcgccauuuaaugaccaccccuuccuuucagccuguguacaaaaucugaugauuguuucaucuuuuuuuuugagacagagucucacucucuugccaggcuggagugcagugugcgaucucggcucaccgcaaccuccaacucccuggaucaagcaauuauccugccucagccucccgaguagcugggacuacaggcaugcgccaccaugcccagcuaauuuuuguauuuuuaguagagacgggguuucaucguguuggccaggauggucucgauuuccugaccucgugauccgccugccuuggccucccgaagugcugcgauuacaggcgugagccaccgcguccagcagauuguuucaucuuaugccucauaccgaaaguuuaaaggccucauguuccuggacccagaguggaacaaggaacccacagaccuuuccagaaauacuuaacauaagcagaagaaaauauagacauacagccauuuuguuacagagcauaauuuugcacagaugagccucugccuguccgagccccggggccucacaggcuugccgucucuccaucucccucgcaugcccaacuccuggccauggaccaagggcccacaagccucccucagccucagggaaucaaccaucaaguggcugguuccuugccccaacaacacucuagggaaucaguaccgugucuuccacuggggccgaaacaguggaccugccccugauugaacaccuuguacugccaggcucuuggccaauauuggcuguuucaucagccauuaggcauacuguggauguuccuuaggacauagucagcacuguaguauagucagcacuguaguacuaaaagggaugguccagagcaaaaaauaagcaaacagaucucccccggcugccuccacccccacacccacuggcauuguccuagcaugccuuacauaagaggcuggcacugucuucacuauaucucuguacagcuggcucgggacuaggcacaaguagccccucaauacauacuccaggagugaauaaguguuucuuauuccaccuuuaguucuaucauucagagaccaggaauuccauuuuggaucacuaacuuaggguuacuuucuaguaucuuucuugugggcuggaauuuaaccuucacauuucuuauguaucacugaugcaucacuuaccgggccauguuaaaggcagaggugggcuuuggaggccacugauucuaguugaucuugccagacauuuuuuuuucuuguuuucucuuugcuagauaaaaaacagcugaauuucucuuguugauuuuaaagaaauuugauaaaaagauucccucaaucuggugccaagaucguguauacuacagagcaggaaagagguuuuuaguugauugacuuugcaccccauguacaucuugggaagaacagugguggcugaggauacuauugaaaagcaggccuuucauuuuguauaugcucugcuuauagcugaaaaacucauaaagaagguuucuguguguuuauaugagugucaguugguguuugugugagggugugagugugucugagagagagggagcuuguuauaaagacuaacaacagccgagucagggaacagccauaggccaagagggcaagcuggccugcuggugcuuugcguaugaaagaaaagguuaacuuucuucauccuacggaugccuauaguaccaaauacguaauuuccaucaccauuuucauaagugcuguaucguauacauugaguaaaguggaucuaaauugucaauguggacagcuuguuauuugaagcugcauaaauuaacaaagucaguguacuggcuuuguuuuguugcauugguauucacuaaaccaaaccuaauuuucacaaaauguaaauaacugcaauucuuguuuuguuuuguuuugagacagggucuuggcugggugcaguggcucacgccaguuaucccagcacuuugggaggccgaggcagguggaucacaugaggucaggaguucaagaccagccuggccaaaauggcaaaaccccaucucuucuaaaaauacaaaaaauuagccaggcaugguggcaggcgccuguaaucccagcuacuugggaggcugagacaggagaaucgcuugaucccaggaggcgaagguuguagugagccaagaucacgccacugcacuccagccugcaugacaaaaaaaaaaagagagacaaggucucacuuccaucucccaaaugggagugcagagacacaaucauggucauugcagccucaacccccaagacucaagcaauccucccaccucauuuuuguauucuuuguagagacaaggucucacuguguugcccaggcuguucucaaauuccuaggugacccucccgccucagccucccaaagugcugggaggugugugccaccacacccagccaauaacugaaauucuaauaagccagugaagaaaauaaagagaacugguacuugcucuauucaccauucacccccgccaccccccacaauucuacuuuauuuacuuuugcuuuuuaaaauugugguaaaauauacauaacgaaauauuuuuccccauuuguaagcacacaauucauggcauuaaauacauucacaaugauugcacuaucaucacuaucuauacccagaaccuuuucauuauccccaacaaaaacuccuuauccauuaaauaauuacuccccucuucugccccugccuauucuaggugccugauauaaguggacucauauaguacuugccuuucugugucuggcauauuucacuaugcaccauguuuucaacauccauucauguaucaacaugaccuucuuuuauagccgucuaauauuccauugccugucugugccacauuuuguuuauccauucaccuguuggucgcuuccuccuuuugacuauuuugaauagugcugcuaugaacauggguguacagauaucugagugucuccuuuugguucuuucggguaaugccaagaagggaaguugcugguuggguuuuuuuuuuuuuuuuuuuuuuuagagggggucucacucugucgcccaggcuggagugcaguggugcaaucucagcucacugcaaccuccgccucccagguucaaguaauucuccugccucagccuccugaguagcugggacuacaggcacacacaaccaugccuggcaaauuuuuauauuuuuaguagagaugggguuucaccauguuggccaggcuggucuggaacuccugaccucaaacgauccacccaccucagccucccaaagugcugggauuacaggcgugagccacugugcuuggccucuaguggauuuuuuuguuuguuuguuguuuauuugauucuuucucuaugucuacccacuagauggucagcuugggggagccugaccuuuucucuuucacccucugcaacuuccugagcaucagaacaaugccagacacacaccagguggcugguccauauuugucgacugaaugacuaaucuguucucuuucaguauuggauacaaaugaccgauuucuacgaaaaauaaccaucgggcagggaaacacagagaagggccauuaccggcagguagguggugcuuucuucccggguguggcucuguucuuacguucauuucuacuggccugggagcucacucuuugccuuucuugucucauccccaaccuguuguggccagugguucucucacuguuuugggugcucagcagggcugggagaggaucagaagacauagaggcuccagugucuuuuuaccaucuuuucuauguauguuuauuucauuuucuuuuuuucauguauguuuccaauuguguuuccaggaagagccacucaggguauucuuugaauauaaauucucacuuauuuuauugggaaccauccagguaauacuacaucugcauaacugauaaaugaaaaucucagacacauuacucaaauuucauauaucaaagaacaaacaccuaguuauuagacuuaauagcaugaggauuuuuuaaaggauaauggcuuauuaauacaaaaauggcuuauuaauaaaauacagagaaugcagaagaaaaauuaugucugacuucauuguaauagauauuggaugugcgucaauggcacuuagggaauacaaauuaauuccuaugauuuuucauccaggcacagugggcuucuaaauuguguuguguuuuuuuuucuuuugaauugauuauaaacuguacauuuaagaacaguuuuagauuucuguccuuuauguuaaguuuuuauuagugaaaaaagagucaccuuacuauaauaaccaauccuuacgccaaauagacuugugaccuuuugaagugucuugaauuaaaaagugaauguagguauuggauuaagaagagaaacuuaaguucguggaccucgucuccucccaguccuguaacuuacacacacacacacaaacagauuucaaauauccaugcuagcaaacuggaaucauugccaugaaguuuuagauaguucugaaaaauaggaagauggaauuagauugaugauuaaaaggacagcccaaaauaugguggacuuccauccuuaacaagcauucuugcuuuucauguucuuagccucuccugcuaaagugggagcuuuauaaaagcagagguuauuccccuuuuuauuugcugcuguguucccuauguucagaacagaacuuuguuacauauagucguaaguguucaguaaauaucuguugaacaaaugaguagaauaaguaaaagacaauuuauggauacagaacuaaaaugccaacauaaaaagauguucaugaauaaucauaaaacugcaaauugaaacaauggaguaucauuuaccuaggagcuugucaagugaaaauaguagguacuaaaugcuagugaggaugcaaugaaaugggggcauuuaugcagcguuagugggaguagaaauccuuuuuggaugaguuuguuauuacuaaaauuugaaaugacccaacaauuacaacuuuggaacuaaaaauauuuuaaugaaaagaacaagaaaauguguaacguacaggaaaaaauucuguguauuaggauauuuguugugccauuauuugcagcggugaaaauuggaaacaauccaaauguccaacaguagagaugguugcauauauuugguccgccauuuugucccaugggagaguugaaauuaauaaaugugcguaugggugucuugacaugaguagagagcucucauacaccauuggaaagguuguaaaaaccauuuuaaaacuuugaaguaaaauacugauauuguaaaccuguuuauguuaagaaaaacccagcguguuuacuuacauuauaggcacuuacaacuuauuuguguauauaagugccuagaaugaaaaguagaaagauguaugccaacuguuggcauuaguugccuguguaauaaaagcgaguauugaaaaggcccuuucucugcauaguuuuuuacuguuuagguacuggagagauggaagauucacaguggccuugauuucagugccuacucugugcauuguauugauaguuccauuacauauauuagcacaguucauuuguaaagcugauuugcaaaugaggaaauugggauguuauguuaaaaaaacuugcccaagguuauaucuuguguugcuucgugcauagauauuuuuaaguaaaaagggguuauaguguauuuaagagcuuuaacugcuuuuuauuuaucauaagacuguagugaagacaucuuuuuaugucgauaaagguagaccuguaucuucauuuuuaaugaccacaucauaucucauagagguaccauaguagauucagccauuucccuguuaaugaacauguagaguguuugcaguuucaggcuaucacaaguaagcuguaguaaguauacacauauauuuguguguauacuugauacuauccuuaggauauuauuccagaugugugauugcagaguccaagaggauacaaauuuccaauguugacauauguuuugacauuaacuuccaggaaauucauaccaauucacauccuugccaauaucccauauuggccuuuguuuaaaugugugcuaaaucccucauuugcccuaucgugauuauuacacauugcauaccuguaucagaauaguucaugcaauccacaaauauauacaccuacuauauaccuaaaaaaaugaaaagguaaauacuaaaucaauaaaugugugauaagcugaugaacaauaacguuuucauuggcaucuuuauaugauuuugaaauauuuuauuugcaaaacagaaaugagcagccuuccgcuaugcacgucauuuagucauuaaagugaaugacagugauacuuuaauugacccaguguguuucauuuuuuuuaugcucaagaugugaaauuuuguaauuguaacaauuacaaaugaagagcuugaauaucgauuauauauuauucuuauuuacacagcuaauauuucaagaauguuucuagucucauguuuuguacagaaaaucuccauauuuuuuagucauuuucucauaugcacuguuuauaauagaaugguaguauagagaacccuaaauuucauacaaugaaagaccacuuauguuuggaaugaguuauauugagaauguaauaauugaauauaguuguauuugacuuucagguaauauuuuuucacuaaaucagugacuaaugcaaucucaaccaggaaguagccagaaagcuccuuauuuccuuccuuuccuuacuugucagugauggaaauggauaauaaaaugucucauaaggugaucccaccagggcacagccauucucucucugcguaagcuugaacuugucuggcucacacuccccuugggaagaagagaauuaagcuggggcguaaugaagugguucuguccagagaaacauuccuaguggcugaauuaugaggaggaggaaguacacauuccugugucccuuuuauuccauguuggacuucguacaacguggagccacagccaagagaugggaauaggaaguccuagaacuuuuugcaaaaagucugugcucucuagcuuucacuacugaaagcuucaagaucugauguggccauauccuccugggcagcugaaaauugagucugugccaccaguugacuggguugcccucccugcuguguugagauccagcucugggaaaguagccucacaugcaggaagccagcaucuuucacugccccuuaucucugugccagacagacaaugcagccuucuugacagaccuauuacuaacaagggagguggcccguaggcuagucauuaauucaucugaugcauauuguaugccuacugggucucaugcuccgugcuggggauucagaagugaaccugccuaauauagucccugccgucauggcacuuacgguccagugguagacugauaaugaccacacuagacugauaaugacauuaguaaucaauuaagucugagacaugcuacaacagcaaaccaugugguagugcugugagcggguguaacagggguccuaacucagcccacccuuugcugagcagagcauggcaaagagcacauuccgccugggaggccacccuagggagcaccaggcacaaacccugcaugguccagacacgcagaaaacugaugggauugcaugcauggccuuuugaggguagacucucugggccugugguugcuucauggcugaaguccagcuccuugugggaauggccaucccacuggcacugucgcugaccacuaccuguguuugggcugguucaggcgcaguuugacaucgcaguggccagcgagaucauggcggugcuggcccugacggacagccucgcagacaugaaggcacggcugggaaggauggugguggccagugacaaaagcgggcagccugugacagcagaugauuuggugaguguuuccaacucggaagcuucagggaguggacgguccucguucuucguuaccagaaaaagaaagguuuucuuccuuuuaucagugaguguaaugaggauacagaaaaaguuuccacacacacauuucuuccccgacaagcauguuugccuaacugcuuccuaauguucucauagucauauaugacgugcuuaugccuggcugcaacaaaaacaugugaaauuuauuucaggagcuuuccaccauccuugccaauccugaucucugcuucugccugggcuggggaggagucaccccccugcagucacuuggugacuuuuaaaaaauguaccuucuaugccugccugaaauugagggcaaaucaccuuuccaaggaacagaaggaaguggcucugcuuccaugaacaggaagauaaaguuaaaauuggcacauuucuggcaccagccuggcuuauuauuuaauuuggggccuuagauuuggguuuuguauuauaaaagcaaaucucugccucaaucagucuugcuuuucuaguuccccuuugaguaguuguggugcuuucuguaaagcuuccauggaacaccauuuccuuuuuuagugcuuuuucuaauuggcaugcuagucuucuuuucuucuucgucuuucugguauaauaacaaccuuuccuguuaacuuuuuuuuuuuuuuuuuuuuuucugagacagucuggcucuguugcccaggcuggagugcaauggcacgaucucagcucacugcagccccugccucccggauucaagcgauucuccugccuccgccuccugaguagcugagauuacaggcgcacgccaccacgcccaguuaauuuuuguauuuuuaguagagaugggguuucaccagguuguccaggcuggucucgaacuccugaccucaggugauccacccaacuuggccucccaaaaugcugggauuacaggcaugagccaccacaccuggccuuuuccaguuaacuuaaacuccacauauuccauagguguuuuguuugcuugcauuuuuguauauaagugcauggguguggacacaggccucuaagauagccauuacuccaaauuuaaguuuacuuucccauauacugaaucuccuacaauaauggaacuuaaaaugcacacuggugauugguaagcaguugugaacagagagaggcaaagucauauuuuauuaauuucaagggcuuaggguauaauuugaauucuuuuucaaaguguccggauuguuuuucagcugcuuuugaagaaaugaaucuaacucaucucagaagucuugucaaguaaauucaauagaucaacguaugucgcagccuauggaauacuuaguauaaaaauugaagagaaaacccucagguugcuauaaaagugcugcuuuauuaaaauuaccaaaaucucacuauuucuaucuaaacugacauacuacaguuucugucuaaauacauugcucuguauuuuauuaauuuguauggcaauaaauaugugucaggaacaguuuuaaaacuuaauccucaaauacugcuuccuuaaaucuauuuauuuauuuuuauuuauuuauuuuguuuuugagauggaguuucgcucuuguugcccaggcuggaguacaaugccgugaucuuggcucacugcaaccucugccucccagauucaagugauucuccugccucagccucccaaguagcugggauuaugggugcccacugccacacccggcuaauuuuuguauuuuuaguagagaugggguuucaccauuuuggccaggcuggucucgaacuccucaggugaucugcccaccucgaccucccaaagugcugggauugcaggcaugagccaccacacccagcccuuaaauguauuuuugugugaguguaugauaaaaaucuuggaucuggaacaaacccaaagauuacucuuuuuaguuaccuuuuuaaauaaacucuuuauuuaucuuuuuaauaaacucuuuuuaguuaucuuuuguguuucuuguuugcaaaaaguaacuaauuuauuaaauugugcuucauccagugggagcuauugagaguuggccacccauagaaaauugagggaggauuuuaggaacugcugaagguuucugccacaugcaugauucugauauacccuggaagaauccaucugagccuuccccacauggacacagaguguggaaugcuagcagcacacagaggguggcagagcuugcccugcacgugacagcacaggcgcugagaugugucccagaaaaaugagcagguagaagccuaccugagacauccaacagaaacaucccucuuaacuuccuuccuccuuuaguguuuugaaucaguuuauuugguugggaaguguaagcaaggauaguguacagagaaguaggaaaacuacuccucuucuuccaccugcucugcauuagcacaacaggacaacucucacugagccuuccuguccugaagauuucuuuuuucuuuucuuuucuuuuuuuuuuuuuuuuuuugagauggagucuugcucuauugcccaggcuggaaugcaauggugcaaucuaagcucacugcaaccuccaacucccagguucaagugauucuccugccucagccucucgaguugcugggaugacaggcaccugccaccaugccuggcuaauuuuuguauuuuuaguagagaugggguuuugcuauguuggccaggcuggucucgaacuccugaccccaggugauccacccgccuuggccucccaacguguugggauuacaggugugugccaccaugcccagccuguccugcagcuuucaaagugaaccaucuucguguauguauaaugaguggguugcauucauaucauguguguuuuauacacugagguagauuccaguuacguaggaauauaguuaguaauaguguauuccugaaaauugcuaagagugguuauaaaguauucucaccaccaaaaugauaacugugagguaaugcauauguuaauuaacuagguuuaaucauuccacagcauauacuucaaaacaucauguuauacacaauaaauacauacaguuuuaucugucaauuugaaguuaaggaagaaaauagauuggauuuucuuacaccuuuuaaaugauuaaauauuauaaaaauagaaaccaaucacaugagagaaacauuuacuacuguuguugauaaaaguacggggagaauguaacgcacuuuagagugaggaagauucucuggauucuaccacugcaucuguuagcgccauggcauacugugguaaaauggcacuguuuuccgaugcuauguacagcaagggauagcgcccuguuuucccccccuagagcuaccguuacaagcauuugcuuauguuauagccuuccaauaacuaauauguugaaaacaccaagacaccacuuaaggucuuuacaaagugagaaggaauugggaaaaaaagaaacaaaggccgggcacgguggcucacgccuguaaugcuagcacuuugagaggccgaggcaggcagaucaugaagucaggaguucgcgaccagccuggccaauauggugaaaccccaucucugcuaaaaauacaaaaaaaauuagccgugugugguggugcaugccuguagucccagcuacuggggaggcugaggcagaagaaucgcuugaacccuggaggcagagguugcagugagccuccagccugggcaacagagagagauuccguucucaaaaaaagaaagaaaagaaugugaauauugacaucacauuaaaaaauaauaacaaacuuuagccuuguggccuuuuuuuggcacauguuuuccgcuaguucucaugcaucaucccuauucucucucuucucugucuuuucuucauccaggaacagagaaagaggacuuagaaggaacucaacccaguacuuccuaggauuggaaggaagcugccuuauuucauguauaaguggcaccagcuugacuguaggaagagagauagcgugaagccuuucacaucuaaacuagaaagcuuuuaaacgugguaguuuguugaguuauucucucucuguggaaugaaugauguagagauggugagaaaucagagugggugauuuuagacauuucccuuuacccuacuucauuccugcucuguacagagccuuguuucuguucuucaccuuauuucuuugagcaagaguaaagccucugauuaugaaaauacacugugcauaaauagccagaaaacacauuuucuugcaaugaaagauuuguuuuauggaaaaucucauaaacaccaucaaggaagguuuuggaagaaggucaaauguccuucaaaaugcuauuaccccaucaccauucacaucuuagugugacugacauccguucucagcucugguggggagagguggacagagacagcagcacuguccccuguggcccaggguugccuguggggacgcccacccaagaagcaggcuggagagaagugccaagggguuaaccauugccuggaugauauuuugucaggaaucuaauguuuuucucucuccuguagggggugacaggugcuuugacaguuuugaugaaagaugcaauaaaaccaaaccugaugcagacccuggaaguaagugguuuucuucuuauaguaauuguuugcauuaacuggauugccacacaaugugaacauuuuuagccaauaugaggcaggcauagagcaugccuggggcagcagugugcuuugcaaucucaggcagaaagagugaggaucugguuaggaaccuguauuaguccauuuugacauugcuacaaggaacuaccugagacuggguaauuuaugaagaagcaucagaauaacuucuuggccaaccaaaaaaaaaaauuuuuaaguguauucauagcuucuuuaauauaagucaugucuuggcuuaauugacccgaguagaaacuuagaaagucaaugucugaggccaggcgcggcggcucaugccuguaaucccagcacuuugugaggccgaggugggcggauuaugaggucaggaguucaagaccggccugaccaauauggugaaaccccaucucuacuaaaaauacaaaaaaauuagccgggcauuguggcacacaccuguagucccagcuauuugggaggcugaggcaggagaaucgcuugaacccgggaggcagagguugcagugagcugagaucgcaccaccgcacuccagccugggcgacagagcgagacuccgucugaaaaaaaaaaaaagagaaagucaaugucuaacauuucaauagguuguauggccauguuuacaauuuauuuucuguguucccuuaaucucucauaaucauugaguuguggauuuuuugguuugcuuuuuuauuguuguuuguuuguuuccaagcaaaauacaauaaaugccaagacuuuccaggaaagcauuugccaaaggcaagucaauaaacacacagcauguuaguuggugguaaggucuggagaagaaaaaucagaggucaugaggggcagagugaugugggguaugugugucugugccugcccgccuguuaaagcaguaccagcacagagcugaguaaaccaagggggugagccaugcacgugucuugaagaacauuuggacagaggguuaccuuuagugcaggggccuugggcagcaagguguuuugcaauuucagacagcaagagcgaggaucugguuaggaaccuguauuaguuuguucucgcauugccguaaggaacuaccugagacuggguaauuuaagaagaaaauugguuuaauuggcucacaguucugcaggcuguacaggaagcauggcuggggaggccucaggaaacuuaucaugguggaaggcgaaggggaagcagacaagucuucacauggcagaacaggagagagagggcgaaggaggaagugcuacacacuuuuaaacaacuagaucucaugaggacucacucacaaucaugagaacagcaagggggaaauucacucccagaauccagucaccucuccccaggccccuccuccaacauugaagguuauaauucgacaugagauguggguggggacacagagccaaaccauaucagaaccaauaugacagaaauggggggauuggccaggcacgguggcucaagccuguaaucccagcacuuugggaggccaaggcgggcagaucccuugaggucaggaaccucgagaccagccuggccaacauagugaaucccaugucuacuaaaaauacaaaauaaauuagcugggcaugguggcacgugccugaaaucccagcuccuugggaggcugaggcaggagaaucacuugaacaggaggcgaagauuacagugaacugagauugcaccacugcacuccagccugggcgacagagugagccucuuaucuuuuaaaaaaagggaauagaaaaaaauggggggaccauuucugaaggugcccagugaggaugcagacugcagguguccccugagcugaggaagggaggacugaacgccuuugaacaggugucugcagccccgggggaggggugcaggaugcacaggugccaaggccacacccuucugcggcagguuguccuucccgucuuuccucuccccugaucauucugccagcaugcacguauccucagagguaggccaucuuaaaaagcaaacaaaaacauuucaaaaaccuccugcccccaccugcauccucaucuagcuucugcccagcucuugucugucacuggggucuccauguuaacugaccucggguuccaccucuccugacugcccuuguccaggucacuuuucccuuggagacaccaagucuuuguugcugugcccuccucagagaagcucagcagaguuugacacagcugcccuugucuuccuucaggagcaccugguuccucuggcgucuggggucccccccuccccaggccugcucgcugcuccuccuccgcuuugcuggcuucucugaugaccccucaccuuuuuugccccguucuccuccagaauuagccaggugaugacucccaaacucuuguuuggaauaucaugcaccuggaauuucagacuugcagguauaguuaccaggagccacguggguggggaaaagccauuucaaacugauacauaaaccaggacccaccuccuaccuacuuccuuccagcucgcugcuucccugaaaccuucccagucauucaaggcagaaacccgaggaugauccuagaggccuguuuucccuuccccucuuccuguguccaucccugcagaguuguccuugguuacaugacucugcccuguccacgaugcucaaugccucccuccuuccugcuuuagcugccagcacgccccaccugcacgagugcagcagccucccaaccagucucucugcugcuacucuuuucuuccaaaauacucucuccucagcagccauagagacugaaaccuaaugaagcccuguugccuuccuacuuagaguucuuccaugauuuacccauguuuccaccccggucugaaaagcccuagggaucuggcucucaccccuucccgcuccuugucccuuauccucaucucucauccucugggggaccuuugcacggcuaacaccacuaccugggccacuuccugauauucucauguccagcuccuucgccucccucuguucucaugucauguaagcaucagcugcucagagaagccacaggaaugugcagcccccgucccucugcugucauugcaguacauggcacagaaugcugagagcuuccuauuuccuuaucuguuuucuguauuucuccucccaccgagaugacagcaagaccuuuuccauccuguucaccaccguaucuccagcuucuagaaagugcccgacaccuauuagagguucaguaaagacuuguugaauaauuaagugaauguuuauuauuuuuacuacauucuccuaaaaauacacauuuauuaauaaauaacugaauaagagaaaaaauacgaagugaugugauauuccuucauaacacuucucccucaaagaugaauacuuauuauuagggauaaucauuuucuuuauuguuguuguuuguuuuguuuuguuuuguuuuguuuuuuugagacggagucucucccugucgcccagccuggagugcaauggugggaucucggcucacugcaaccucugccucccagguucaagcgauucucuugccucagccucccagguagcugggauuauaggcgccugccaccacacccggcuaauuuuuguauuuuuuuuuuaaguagagaugggguuucaccacguuggccaggcuggucucaaacuccugaccucaggugaucugcccgccugagcccccaaagugcuggaauuacaggcgugagccaccaugccccagccaggauaaucauuuucuuguuuuaaauaauucuuuuuuuuuuuuuuuuuuugaaacggaguuuugcucuuguugcccaggcuggagugcaauggugugaucuuggcucacugcaaccucugccuuccgguuucaagcgauucuccugccucagccuccugagcaucugggauuacaggcgcccgcuaccaugccuggcuaauuuuuguauuuuuaguagagacaggguuuuaccauguuggccaggcuggucucgaacuccugaccucaugauccacccaccucggccucccaaagugcugggauuacaggcgugggccaccacgcccagcaaauuuuuguauuuuuaguagaggcaggguuucaccauguuggccaggccagucucaaacuccugaccucaggugauccgucugccucugccucucaaaguacugggauuauaggugugagccaccgugcccggccugagcacuuuuuaaaacauaaucuaaaccuguuauuucuuugcugccuaauaaaucagagauucagaacccuuaaaaagcaaauaaaaguaagggcaauaagaccugcugaggcugaggcaggagaauagcuugaaccggggagguggagguugcagugagcagagaucaugccacugcacuccagccugggcgacagauugagacauaaaauagacugagacccugccucaaaaaaaaaaaaaaagaguccucaaacuguucauauacaggacugggcuugcuagggaaagaagggggaauucuucagacuacuuuacaaggacacaagaacuccucaaccuaaacaaaguaugaagguacauagacaaguuucuuguaagucggaaaacagagaaauccacaguaacuauaauacaucccuuaaaggauaagcaugcauuuguaggaagcaaacaaagcuuuccauagagaaaccacuuccaccagaugauuauauggacuuggguuuuguuucugcaucugucacuuggcaaaugaagauaccaucuucaggauguuccgugucaucgauuucauuuaaggcauaggcuguuuuaagauuacuuuaaaagauauggaccuuuuuacaaaauaaaacacugcauucacuuaaaauauuugcagacgugaacucuuguacccugauccuauguugucacucuggguuuuauguaucuaaucauugacuaggaaucuaucucagcagauaauccaaaaaucuaguuugacuaguugguagauuaugcuuucccgcucacaucugaacacaccugguuguuagucugguaggaggucaucaagggccacauccuuacagguugccaggagaccaguaguucuuaauccugacugcacuugagaagcuccugggaagguuuaagaauauugauugauugaugccgggcuccccaucagacccagugaacguaaugucugaggauaaggcuuggguaucauguauugccagacugaggaagacuuaagacaagaaaacagugagagcuguuaacauuuucccacagguuagccgugugugguguugauggaaacuucacaugcgagagcacacuguccaauauggcggccacuggacauguggccauuucaaucuaaauuaccuaaacuucaauaaaauuuggaauucaguucuucagucauuuuagccacauuuccauuuaugcauuuauuuguuuauauuuuacuguucauauuuaagugcuuagaacucugguaagcuaacaauuacuugaaauuacuugaaauauuaaucuuaugaaauguuugaaagggccauuauggagaauauucauagcaagauaguuccugccuuauuuuccugaguguucugcauguaaaauaaaacccagaacucaagauaaauguguguaugccuuugaguuagucauagaauuuuuuaagcaacauguuuaauuugauguacuguaucuuauagcuauauccauguuugagugugcaaguguguguguaccuguguuuggaagucuaacaaugacauuccaauauuuuuuucucaccaacuccauacugggaguuuuaaaaccagagcccuaaucuugacuuaauuauuaauuuccuccguggcccugaagaauucccuuagccucucugggccuuaaauuucuggauaaagaaguuggcugcuucgugcucucaacauuaucugauucugugauuucuagcuaaagcuacauuuauacaaaaauauaaagugcuuuugcaaaguaaagaguagaauagugguuaucagaggcagugggggauggagaaguugaccaaauaauacaaaauuccaguuagacaccaccuguguauucauaaacaugugucccuagguuuuauuuauuuauuuuuauuuauuauuuuuuucauuuuugagucagagucggucugucacccacacuggagugcaguggugcgaucucagcucacugcaaccuccaccucccagguucaagcuguucuugugcuucagccucccgaguagcugagcuggguuuacaggagcacaccaccacacccugcuaaauuuuguauuuuuaguagagacggguuucacuguuggccaggccagucuugaacuccugaccucaggcgauccgcccaucuuggccucccaaaguacggggauuacaggcgugagucacugugcccagccaauuguaaugauuuuuaugguuaccuuuucuugaauggaaucauuucuuaauuaaaaaaauaaauauaccuuuuauaccaucaggguuuaauuucauucuuuuaaaaaaauauagugcauggcaacauaaaauaagguaaauaauuuauuucauggucauugaggcaacuaacaaaaugguuuaacaauauuuuggaaggaagugacuguauucucacaguuuugucucucagguucagcauuaaauguagaauaacauuuuucuagaauccggagggaauuugguccuuugauugagucaggguguuuugacugucuuugaaauauuuuaugcauuaaauaugcaguauucauaaaagcuuuccuaccccauuugccccaaauugaucuugguuuccaugcuucuguuugucuuuugggauuuugauuugcuuuuucacuucucuaggggacaccuguguucgugcaugcgggcccuuuugcuaacauugcucacggcaacucuucaguguuggcugauaaaauugcccugaaacugguuggugaagaaggauuuguagguaaguuauuucuuuuaaauuuaguuguuguagaauauugaagaaaucuaaaagcugaugacuggaauggagugauauccauccugacaugaaacauauucuuucaggcacccucuuucauagagggucucaauaauggaaaagcccuaaggucuggucuauacucgugaaauuaugcuugugcuugaaucauagagucugguaucaaguacauauggguuugaguauaaacucugacucuugcaaacugagugacauuggacacauuuuaauuacuacugagcuucgguuuucuuguguguaaaauagugauaacaauacuguaucaaaccuuuuaggguuguuaugaaaacugaaugagauauuuuagucauucagcaaauguuuuuugagaaccuaccacuuagaaggcauguuagcuagggauccagugguaagcaaaacagauaggcgcaguggcacaugccucgcuacucaggaagccgaggcaggaggauugcucgagcccaggaguuuguguccagccugggcagcauagaagacccugccucugugaaaaaauuaaaauuaaaacaaccagccuuagccccugcuccuguggagcguacugucuaaugguaauugaauaagagaaagugcucauugacugucagccauuacuacccuuacuauguaguacugauaacuugaagucguggguuuauuuccauguacaguuucuccuuguuuuuugugagcuaauauaggagagauucccaaccaguagacuuagaaauguuaauugguaguacugcacaccuuuugcugcugucaaguucuuugcagaaccuguuccucuuuggcuuuucuugcauauuccagcuagaaagaaggggcaacucucauagaguuuacuaagucagugccagccccagucucacccacaauacuaaggcagcaaggaaacaaaagacaaaaccaaaacacaggcauucauggaggagucccuuaaucugacauaugagggacugcauuggcagauuucccaugcuaacagguaauucccauuaaccacacguauaccuauaaucggagacagcaaucucuucuuucacucuuaucaucagcuuuggaucaaacucaaaagaguuauuuuauuagaagagagugugcuggacaaaagaacuuggcacugcauuuuaugcucagacaucacaaaguucauucaguguuauugagacucuuuuaagaauuccuuguggacuggcagucaggaucagaugaggcuugguggagcuccacuccuccaugaucuguuuucugcagcucucauguacuuugcuccuucgguagcaaauccacugcaagaguggcuagacauacugucuaaguggauuugcucaauugaucgcugccuaauuguagagcuaauggacgaggaggcugggucagggcgggcacuggaaaguugggugcuuaagugaaguggugguucugaugcaucagcucugcaaauaaaguagcuucuagaaggaagcacucuauuuuaugcugacagagaucucugcccauaccaguucuuacuuugucaaacacauauuuauaaaauacauguuaucauggcagaauacuuucaaagauauaaacugaugauguaugcaaagcaaacgagcccucugugugaccuugaacaagccauuagccucucuggguguguccccuguagacauucucaucugaaaaaugagaaguuggaccagaugaggaguuggauguggauguguagccguggacucagaguuagacacuguggaauuggagcccugacugguaguguguuuucauuucucuagggcucaauuuuuuauuuaauaaaaagaauacuucuguauuuuaaugaauaggaucaagugagaaacugcuuuguaaaauaugaacuauguucaggucagcaauuauacuaauucuuucuaugaucucaucuagucuaagaugccguaaguggggggguuuuucaugaggaugaaaucuguccguugccagaugguucaaagggcaagcccuaagucagagguuuuaccucaacugcuuucaagucacagauaaccuugggcacaugaacccuucucuuccuugguuucccuaccuguaaaauagggcuuuggauagggcuucccucucgaaaggacuugguagguuugaaaugaggcaucaaugagaucaugggguugaguccuggcaccugacacaugguaagacucaauccuucuuggccacuccuggcugucauuguuacccccacuauugauacacuacugaugaagguuacauuuucuuuuuucuuuggaucuuuuuauuuuuuggaugauuuuauuuauaguuguuauaaaauacacguaacaugaaaguuaccaucuucaccauuuuugaguguacguucauuagugaaguacaccuucauuguugugcaaccaagcugcagaaccgaagucccaugcccauuaaauauuccucauucuccagccccuggcagugcccuucuacuuucugucucaaugaaguugacuccuggauaccccaugugaguggaaucauguaguauuuguccuucugugacugacuuauuucacuuagcauaauguccucaagguucauccauguugcagcaggcgucagaauucucuuccuuuuuuuuuuuuuuuuuuuuauuuuuugugagauggaguuucgcucuuguugcccaggcuggagcgcaauggcacaaucucagcucacugcaaccuccgccucccagguucaagcgauccuccuaccucagccucccgaguagcugggauuacaaacaugcaccaccacgcccagcuaauuuuuguauuuuuuaguagagaugggguuucuccauguuggucagucuggucucaaacuccugaccucaggugauccacccauaucagccucccaaagugcugggauuacaggugugagccaccacacccggcuagaauucucuuccuuuuuaaggcggaauaauauuccaucguauggauagaccauacuuuguuuauccacucauccuacauuggacauuugacuuguuuccaccuuuggcucuuaugaauaaugcugcuaugaacauagauguacaaauauauuuuaaugucuaaaaaucgugcucuaugaugucuaaauaugugauggcaaugacuuauauucacaaauacguaccacggaacucuagcccuguaauguugaacucucccgaaggugguguguccaugcuguggcucuguuggaaugcugguggcaaagccaguguauugcacagugggaacgggguguggucaggagacaguguuccuugcccauugcuuggucaagccugcacuguggggcucguucauuccuugcccuuggaugaaguuuauaauaguucccucucauucucaguuaauaucuagucccucuaacacauauauuuuuuaauuccucuggucacuuucaaucauaagaauagccccuaaaauuaaaaaugcauauccaguuguauaucaaaaccaaaaacuccaaaugucacucagacuugagcuccucuccuccccugucugggccuccucuggcugacagugggaaggggaagguggcugcuugcuucucugccacccuugucuugcacuugggcucgcccuggccccuccuagguugaagcuuuggcaugaaauggugcccauguagccucuaccagcagacguccucacacuuuuggcagaagcccccugagcaguaccucauuuagacuuuccuaccucugauuccacaccuggucucggguaccacagaccucugaccucuggcuggggacacgcccugagccuugccaacuggucuucugguccucacuuguggcuuaagggggaagcggggacgccaaggcggguggaucaccugaggucagguguucaaaaccagccuggccaacauggugaaaccccgucucuacuaaaaauacaaaaaaauuuagcggggcuugguggcgcaugauguaauaucagcuacucaggaggcugaggcaggagaaucgcuugaaccccaggaggcagagguugcagugagcugagaucacaccauugcacuccagccuaggcaacagagacagacucugucucaaaaaauaaaaauaagggggaagcagcuucgcaugcucuucacugggagcugggaggggagcuggauguggcacacugauaacuuucuuugaagaaauucuuucccagguucuaacccgucaacccuuuugaagccucaaugggcuaaggcauacaaaaucuauuucaaacugcuuugcaaacccucccaggucagccagcaccauccuuuggcaugugagcaaauugacaccaauuugaggcccgaaacaaaagugagacaaaaagacguucauuucaacauccuucuacagaaguuaaauagaguaggcacaucugagguguaucugaagucugagcaggaauucauguucuucaaaaaguugucguuuauaguagacuaucuuuaugaccucauaauagggaaggaucucuuaaaauaugaaaagcucaaaccauagagaaaaaugucgauaauuuggccugcauuaagaaguaaacuguaugugauaaaagauacaaggauaaaaaacaagugacagauuggaaagaaacguuugcaaagauaguagacaaugauuagcauugagaauauguaaaacacuaaagacuaaagacugauaagagaaagacaaauaauccaauacaaaaauagagaauuugaaaaggugauucgcagcaaaugagcaauuugguggaauuucuagguagaacugaaaaugaacaaaugauuuagcaauuucacuucuauguauacucuggaaaagaaguagucaaaaauauauuuaaguccuuugaaauaauugacuucaguaccccuuuaaugagcauuuauuaagcuucugcuauaugucaaguacuaucugcuaggagcugggaaucaaauaugaauaagacagguuucuugcccuccaguaauugaugaugugcugugagagacaagaacuucaaugguaaguacaaugcacuugauuaaguacuauauuaguuaagguucuuaacuaagaauuucaagggaugaugggcaucucuuagauagaacugucuccauauuacugguuuugcugauuuagucuaauuuuuguucuaacaaaaagcauacacaaggaaggaauuauuuugucuauucugaauaauuagucuaagauaauagaaucaguaguccauuuagacuuaaaacagagugacauuuauuuuaaaaaagcaugaauuugcaaaacacuuuaugagaauuuuucaaaaacugcugugaucacuguuguggcuguuucuuccguuagucagcaguccucaugggaguucaccuaacuuccauuuacaugcuguaaaggcaaacagauauuuggcaucgaauucuaaucauguauuacauuuaaaaaauaaagcaaaaggaaagaaagaaaggaaaaagcaguauugaguuccuggauuuuaaaaacauuauuaucucaucuuuaaacuauuuguaggaauuucaaacuuacccauuaacuuaggauuuuuuaauuuguuuucugcucucucaguugguuuugauuccaguuuucagauaaagaucuugucuuugcagaggagugcagaaugcaauuguguauccuuauaggcaggugucauuaacugagggucaccagccacugguggacuccuggauagacuucgaucuacaacucugucccauaauuaaauauagguucgugcauauggagacauauauauauacaccuuuuuuuuuuuuuuuugagauggagucccacucugucuuccaggcuggagugcaguggcgugaccucagcucacggugaccuccaccucccagguucaagcgauucuccuaccucagccucuugaguagcuuggauuacaggcgcaugccaccacacucggcuaauuuuuguauuuucaguagagaccugguuucaccauguuagccaggcuggucucgaacugaccucagguguuccacccgccucggccucccaaagugcuaggauuacaggugugagcugccgcaccuggccaccuuuuuuuuuuaaccuggagaaaauuacacaauucuuggauucucacaggggaccaugacauaagagagagaaagaacuguuggugcauaucucaaagccuagcucuacuuuugacgguagcuuucgaugucccauacacauuuggcauuuauuauccuuauccagaggugcuugucaagaagcuaccuaauugauugcaacucugcugcuugcucucuguagagaaucacacagaccuggcuguguuccccaggugcuuccuggguacaugagcauaaacacucaugcagcagaggagaaauaugagacaagugcccaauuaaaacacagggugaucuuugccucagacauuucaggauuaggauuuagaaaucagaaugaaucgacuuagcaguuccaagacaaauugaaugggauugggaaacaaagccuuguuaauauuuucauuaaaaacgcccccguuucugagccauuccugagcauuagaccggugcugagacuaucauauaccuucucacucaauccuuaaaaccgucugugggaucaguguuacuauccucaucuuacagaugauguaacagaagcuuagcaagaugaugauacauguccacgaucaaucagagaguaagugacagaggacgugaccugagggcuccuccucgccaaagcuugugggugaucaggcggcuauugugcucaguguuuuucucaaugcucuuuaccugguugccacccucucccauuaaaaaauaauuuuagcugggcgcaguggcucacuccuguaauccuagcacuuugggaggccgagguggguggaucacuugaggucaggaguucgagacuagccugaccaacauggugaaacccugucucugcugaaaauacaaaauuagccgagcgugguugugggcccuguaaucccagcuacuugggagggugaggcaggagaaucgcuugaaccugggaggcagaggcugcagugagcugagauugugccaucgcacuccagccugggcaacaagagcaaaacucugucucaaaaaaauaagaagaauuuugggugagcugucuacagcagauggucacaguuacaggaaguaccaauauaacuauauuguaccaauauaucguaaugugcgccaacaguggugguccuuuuugguccuuuuuuucuuuucuguguucuacuuuaacauuucuuccucccaaguagguuacugauugaagaugaccuuaucgagucccacuguuuccuugcucuaccucucaaccuguauuuuugggggacaguuuuuuaauuuuuuuauuuuccuuuuuugagacggagucucacucugucuccuaggcuugaguucaguggcacgaucuuggcucacugcaaccuccgccucccggguucaagcgauucuacugccuuagccucccaaguagcugggauuacaggcacgcaccaccaugcccggcuaguuuuguauuuuuaguagagauggaguuucuccauguuagccaggcuagucucaaauuccugaccucaggcgauccacucaccccugccucccaaaguguagagauuauagcugugcaccacugcacccagccuaggggacaguuuuauaaucagucuucuuggccuucagaggacucugcugguggcuauacccagcuaguggcuuguucucucuuuccacuuuuauugcccugaaauucuaaauauuccaucauuuugguagaagaaaaccagaccaaacuaaacauucucaugauuucauccaccuuuaaaaaaaaaaaaaaaucugacgucaagugauccugcagcucuaagcuguaauucucccagaccuugcccuguuuacauuauuuaaaaacacugaucucagccugggcuccacuuuuguuauuaugaugcuuccagguuuuuugucuuuaguaaauuuauucauaauuaaaucaagguugagaagugcuggcuuauuagagacucuggcugaaggucaugugcgaacucaggaaacugcuaaucacaggucguguuuuucagccccugucuucaggaaggcuuaacucuaagggaggguuguuuugugucaucuccagagcucucauuucuccuguguggcuuggugccgaagcucauucguccccucgcugucuguucggcccuuguccuaccuccccuuucucuuuccacgcuuuuguguaaaguagcccucuuucaagcugcuccucuguccuuugaaaacaaaugaaaaagcaaaauguucuucauauacacuaaacaggaaaguaugcaaaguaauguuacaaacacccauguucccaccacucuguuucaucaaaaucuuaacaugucgcuguguguccuuuaguuuuuuuguuuuuuuaaagagauacguuuagcugggcaugguggcgcaugccuauaguccuagcuacuugggagucugaggcaggaggaucaauuaugcccagcaguuuaauucuccugggcaacagagugagacccugucucuaaaaaaaaaaaaaaaagaaagaaagaaaagaaaagagagaagagaagaaaucagauauuagagacacaguugaaguucccguggacccuccugaucccguucuuuuuucugcuucucuccugauuugagugauuaucguuuccggguguguguuucuacuuugaccacacacauauauguacacuagagaucuguagcggagguucucagacuuucucugcucgugaccauuaauggcccagcaauuuuuuucaugguaccgcccgggcaagagaaauaccuaacauguccauuuauuaaauagguccaaacaacuuaaugaguauuuauguccuuacaacuaaguggccaccugaaaaaaaaauacauaugaauucgaaggaaaaaauaacaucauuucauuuuuaaauuaccaccauauguuaugaaugagauguguguccuugucaggcaccagacaacuucugacccuuuguaaccaguugacacccgcaccucauuuccuguuccacguugauuuucacacgauuuuugcauuuugcugcgguaccugccaaaaacuuugcuuugcaaauauaugaugucauggaaagggauguagagcacuauuguugaagcagugaaaaaccucacaugaguaguauuugcaguguccaacggauguccuguauuaccgcguuuccgucaaaaauuuaaaauaccccacggugccucugaguuugcugcaaugccucacggcaccucauugcacauuagaaucacagaugugcggcuuuucuugguauuuuuuauguguuuucaaauuuuauauauuaauagauauuaacugacugcauuguucucuaaugaggucacugcacuuuuucuguaaauggcaagaucauaaauaguuugggucacagagucucugucccaaguacucaauuuagaaagcagccauagguaaagcaugaauucauaaacuaguccauguuuaggaaugagucuggcuguguuccaacagauguuauuauugguuccuaacauuugaauuucauauaauuuucacguguaauaauacucuucugauauuguuggcaacauuuuaaaagguggccaggcacaguggcucaugccuguaauuccacugcuuuuggaggccaaggugggaggauugcuugagcccagggguucaagaccagacugggcaacauagcaagaucccaucucuauaaaaaaaauuuuuaauuagccagguuugguggcacaugccuguaguuccagcuacucgggaggcugaggugggaagaucacuugaguccaaaaguuuaaggcugcagcaagcuaugaucacaccuagcuacuugguaagcuacuauggacaacauggugaaacccugucuugaaagaaagagagagagagagggagagggggagagagagagauaauacuuuuuaaaagagaaagaaagaaaagaaagaaagagaacacuuuuuaaaaggauaaauaauuuuuaaaaacuuaauaauuuaacauguaaaaaaaaaaagauguagaccauauacaaaacccagaggcaccuggauuuguccugcuagccauacuggccaaccccugcucuauaacuugauauuuuugugcaacauaacaguuuugcauuucucuaugucacugugauccaaaaagccucauuuugccugcaguuuagccuucugugcgugcauguagcacgugcauuugugcauuauuugucaaggggcuuucagauugcuuccaguguucugcuguuacaaauaaugcuacgggggacauucuuguccaugucucugagauuuagucuaaaaggucuucuagggacuauauacaggagugagauuugggggguuaaaaguacgcuuagcaacaacuuaauagauaaagccaaauuguucugcaacguaauaccaauuuauaucacuaccaauugugugugugagauuucugaccucuccacguuuguccugacacuucuuuuuuuuuuuuuucuugagacagagucucucucuguugcccaggcuggcgugcaguggcaugaucucagcucauugcaaccuccaccucccagguucaagcaauucuccugccucagccucccaaguagcugggcuuacaggugcacaccaucacacguggcuaaguuuuguauuuuuaguagagaugggguuucgccaaguugaccagguugguuucaaacuccugaccucaggugauccacccaccuuggccucccaaaguacugggauuacaggcaugagccacuaugaccggcugaacgcuucuauuguuagauuuuuuuagcucuugcuaaucugaugguaguucauuauaguugugagauuuagcaucuuuauggcuguuucugggcauuugugaauugucuauuuuguauugugcuauuuaccuuuuucuuacuaauuaauggaaauccuuuauagauuccgaauacgaauacuuugccauuaugaguuacaaauaucuucuccccuguauggcuuaucuuuuaaauaugcuuguuguaccuuuucuuguccacccuuuucuuuaugauuucugcuuuuggagguuauaaagauaaucauuuguauugccuuauaacuguugucucuugcauugaggccuuuaaucaucuuagaauuuguuuguguaauggugucuuuuuuccuuaacucuuacaguuugugagacuuuucugcccuggugauaugugcaucagugguuguuagcccagcccuaugaaaagggccagcuggccuccauagaucuaaggcagccgagagugcuguccccuuugucccaggcucugcagcauccaaggcgagugcagauggggccagcuguucuuccaaaaccaucaucucuucuuuaccugcuccuucugagcuucaccugacauggcugugcaguccccaggaaaaagaaagucucucuugucuuccuacuuccuaagucaauccuaggaacuguuacguucaauuccaagcaguugucauaaaagaaguuuccuuggaacuuugaaaacaaaagaaaggguuuaauuuucuucuuuucguuuuguuuuguuuuguuuuuaauuuuuugagacagagucucguucuaucccccaggcuaacagcucacugcaaccucuaccuccugggcucgagcgauccucccaccucugccuccugaguagcugagacugcaggcacaauccacuacacccagccaauuguucaauuuuuuucuggagaugaggucucacuacguugcccaggcuggucuuaaacuccugagcucaagugaucgccugccucagccucccaaaaugcugggauuacaggcaugaaccacugcgcccauccaaaaggauuuaauuuuauggucaaauucuacauugucuauugacuuuaauauuuuuauaaaauucuuuaaauaaaaugucuuuaccuggaauaccuucaauguacuuacuggauuagaggcagguagguccuguuuguauggcuaguauguucauuaaauaugaaaguaauggaaagauguuuaugacauaaggagagaggaaccuucgccugucaggauaauagaaauugaaagauuuuuaugaccuggcucagcagaaaaaggaguauaugauguuagcaauuuuuuagaauugauuuuucagaagaaacaugcaaaacaaaugagaauuaaguagcuagaaagccuuuuuccccccuuuauucagauaaaguaacugaagacuuuuaaugagaagccugguuucugucuuucuacacggugcacugggaauaguaagcuguuagaagucagugcuuagaaguaccuaccauccuaaacacaggaaccaaaaacaagggaaaaaaaaaaaaaaaggaagauaaauaaaguaaaaguaaaaaaguaccuaccgucccaaauuuuguauaugaugauguucacguuuuugaacuuacacauauucuucuguauaaguaaaauauuucauaaaauuaaaaauguuuuauaaaauuaggaacagaauuucuuaaagaucaacaugguacuaauacaucuuacaaucugucuuucaaaguuucaauagacuuaacuuagagucauuuuuuaaauugcauuuugaugccaauauaauucaugugucauuuuccgcuauaauacaaugaaaauccagauaauggagauggauuuucuucugaguagccacgcauauuagguuucaggcuccaauugccugguuuugaauugcucuuugccaugugcugucugugaccuugggugggucacuucaccucccccaaaucuagguuucuccaauaccuaccuccaggcuuguucuaggcaugaagugcagugaugauggagaaggcauggacuguggcacaaauagaagagucagggguuggcagcuccuauucccacuguacgaugccaaggaucuuuaccuauaggauaagccuucagaaacauaauuuggucuuucaagugcugaauaccucugugaguauacuuuuuuccaucuuuuuucuuuugguaaaugaaacucacugagaaauuugacuucugauaaugggaaacagugcugcuuauguguucuccuuguacaaaggugucugggaccauuauacuuagaggugaucugagaaaucggaggggcucugauuguuuugaaaacucuccuuugaggucgggcacaguggcucaugccuguaaucccagcacuuugggaggccgaggcggguggaucacuugagaccagcuuggccaacaugaugaaaccugucucuacuaaaaauacaaaaauuagccgggcuugguagcaugcauuuguaaucccagcuacuuggggggcugaggaaagagaauugcuugaaccuggaagguggagguugcggugagccaagaucacaccauugcacuccagccugggugacagagugagacucugucucaaaaaaaaaaaaaaaaaaaaagaaagaaagaaaaagaaaacucuccuuugaauuaagguaauccuucuugaaaggcuuguuuaaaauguuuccuuguuaccugggagagagcaggaagcacugggaaauagcacgucacuggugccucgugccauuuccgugccuuucccugucuugccucagccuugcacuguggaaugcaaaagaguagaagaaacuccaacgugaaaauugucgacaaacaaugcagagaaucuucgguggcauuaaacauuaaaauuaaagacacauggucuuaaauucagcugauauacuugacaccucagauauacucuuggugccaaaagggauguuaagcaaaauuugagggauuugacuccuuauuugggaaagaccaugacuaccaaggggagagaaaccagaggcaaaccuuauugaaaaauggaguagcuaagucauuuuguauauguuacuuuuacccagccaaguacagucuguaguuuuacacagugaauuugaucuuuacucuaaauucuuuuccuuuaaugaaagugcuagucaguaaugcagaacuugggcaaguuuuauaaauauguuugcuuuacaaccagucuuauuaagucaggguaucaucuaagggcccaaucaaggacuuuucauuuaaaaaagaaaaacucuaaauugcauugugauauaacccuuaaauuccaacugucauggggaaucccaagaccuacaucuguauguaugugcuguguucuaaacacugcuccccaaccuuuuuggcaccagggaccggugucuuggaagacaacauuuccgugguuuugggauuaaacgguuccaccucagaucauaaggcguggguccuagaucccuuacaugcgcaguucacaguagcauucacacuccuaugagaaucuaaugccacugcugaucugacaggagguggagcucaggcaguaaugcucacuugcccgcugcucaccuccugcugugcgacccaguuccuuacaggggcugcagaccaggggguuaggggucucuguuuuuguuuuuuuggagaucaagucucacucugucgcccaggcugaagugcaguggcacaauaucggcucaccacacucuucaccucccagguucaagugauucuccuguuucagccucccaaguagcugggacuacaggcaucuaccaugcccaguuaauuuuugucauuuuaguagagacugaguuucaccauguuggccaggcuggucucgaacuccugaccucaagugaucugccccccucagccucucaaagugcugggauuacagacgugagccaccgcgccuggcuggggaccucuguucuaauaugcuuaccaugccaaaugcauuaugaagaaaaacagaaacaaggcuuuuaauguuaaagucuuauuuucucgcuacugaaauaggcaaaauguuucaauuuugcaaaaauaauauaguauuguguauaggaucuucccuaaccugcuuuuuacauuuaauuaggcuucuacgagucauucggguaguugcaucuagcaggcuauuuauccauucuuuauagacccuuuagagguuugagaccccuuuauagagguuugagagcccuuucuugccccaguucucuugucuguaaagcuguaggaaauaauaugaccuaacauacaaggcagugugaggacagcagaagugacuucuguaaugcauauggugcuguuccaggcauggauaaaucuuugcuaacagucguaagaguuuaccuccugugaggaccuggcuacgugcugagcacccugcuuggugcuuuguacauugugacucauucaguugcucaaacaacaccaugaguaguuuaccagaauuacccccaucuugcaggugagaaaacugagcauccgagugaguuaguaguuugcucaaaggcaggcagcuagcgcaagggggagcaggaauuugaaccugagugucggccccacagccuuugcuuuuaccaccgugcuuugccaccucugaauguucacuuucauuccauagcagcaucauacagcccugugcauaacaggaagugcacguuuguuaaaugagaaacuaguaacacuucugguagcugaaugacuuaacuacugguaaaccugucugcauggccacuaggcuuuuuauggugaacacaggcauauuuuccaugugcuguguugaagcagcaauuaaauaaaucagguaaaagaguaauuaaauuuaaaagguaaaacguuuuggaaggaguuuugagguuuagggcugucuaaccugaccuugacuguuucucuaugugcuguaagaugcagauugauuuucaaugagauauucagcccaucccugcuuaugauuuauauauauucuaaguaauaugcuuagaauguaguucugcuuaccaucauaaaauguggaguuaaaauaagauccuugucaaaacauugucaugcagagauuagugcuaugaaaguuaacauuaaaugauuuuaaaaugugauccagagguuaaacugaaguuuugaaauucauaaaaugcauaagcuuuuugagaauuuuuaaaaauauccguuacauaauaacuuuaaaauuacguuauaugauugcuaucuuaccccaucuuagccaagagcauucagccugaggauacucaaaaagagucaaauuaccccuuccuuguauaagcuauaguuuaggauauugcaauuauaugaggucguuuuaaaguuuuuagcaacguuugguauaauuacaauauugugcuguucuuacacaaagaaaacauaacagaauuuugagcuaggaauauugggaaaccagccauugcuaaaggaagaugcauuuaguguaucuuucuauguaccucuuaacaucuuuugugggguguagaaaaacagauuauuagggcuuucuuuuuuuguggggggggcgggagcggggauggaguuucacucuuguugcccaggcuggagugcaaugauguaaucucggcucaccacaaccuccuccucccagguuuaagugauucuucugccucagccucccaaguagcugggauuacaggcaugugccaccacacccggcuaauuuuguauuuuuaguagaggugggguuucuccauguuggucaggcuggucucgaacuccugaccucaggugaucugcccaccuuggccucccaaagcgcugggauuacaggcaugugccaccauacccagcuaauuuuguauuuuuaguagagaugggguuucuccauguuggucaggcuggugucgaacuccugaccucaggugaucugcccaccucagcuucccaaagugcugggauuacaggcgugagccaccacgccuggccuauuagggaucucuaaaagccgcaagccucuugcuagccauagcugugaauguugucuuaaccauuaaugcuucaguauaaauaauaucaauuuaaaagcugccuaagauuuaaaaguacuaugcaaauuacaaacugcuuggguaucuagaucaaaauaaagcagagcaaagaaguaacuuuaggaaugaaaggguaucuaaguggaaugauaaaggaagacuucaugcaacagaagaauuuaaguaaaacugaaaaacugaaacuaaugugaucauggcauuaaauaguguaacccugaagacgcauccaguauauaaggaacaccacagcagugccuauacucaccguuauuauucaucauuauucugaagcaugaauaagaacaauuucaaaaauuauaaauauuggaaaggaagagacacauuuuauuauuuauguacagaauaauuauauaacuagaaaauucaagagaggcaacugacaacuuauuuuaaguaauaaaaguuuuaguuugcuaguggaugcaauguaaauauguaaaugucaauaguuuucuuuuuuuguuagccauaaauacauacuguaauagagaaaauguccuacuuauacaugucccccaaaggauagaauacuuaggaaauaaguuuagcaagaaaugagcacauagaauaaaacuauaaaacuuuauugaaagacaaacaacaagaccugaauaaaugguaagacacaugacauacucuuagaugggaauaacugguauuaaucauccuuccucugucaaacuaacaccuaaauuacuauaaaauuacuauacuauaucaugccacacuauacuauacuguauuuacuguaaaaacugcagaggaaaaugaacuucgugguuaaauuaaucacagcauuugucuagauucugcaagaaugaauucaugaggauggauuuaaaagcuuuuucaaggccgggcgcaguggcucacgccuguaaucucagcacuuugggaggccaaggugggcagaucacuugaggucaggaguucgagaccagcuuggccaacauggugaaacccugucucuacuaaaaauacaaaaauuagccaggugagguggugcgugccuguagucccagcuacuugggaggcugaggcaggagaaucgcuugaaccagggaggcagagguugcagugagccuagauuguaccacugcacuccagcccggcgacggagugagauucugucucaaaaaaaaaaaaggcuuuuucaagaaccaugauggaugauuaaacuaauuguaaguaucagaacaagauaacccuauagcaaaacaguuaauagcagaggaauacccuggaguguccugagauagauuucuuccaguaguaauuugauaagaugacauuuuauuuuuauuuuuauuuuuuucuuuucuuuuauuuuuuugagacagaguuucacucuucuugcccaggcuggagugcaauggcgugaucuuagcucacugcaaccuccaccucccagguucaagugauucuccugccucagccucccgaguagccgggauuacaggcaugcgccaccaugcccagcuauuuuuuuguauuuuuuaguagagacagggcuucaccagguuggccagccuggucuugaacucccaaccucaggugauccaucugccuuggccuuccaacgugcugggauuacaggcaugagccacugcaccuggccagaugacauuuuaaauuaguggugaauggaugggauacugauuaaaugauguuggaacauuugacuaauaauuuuaaaacauaaaccauagaguuuguuguuguuguuguuugaaauguagucucgcucugucacccaggcuggagcgcaguggugcgaucucagcucacugcaaccuccgccuccugcguucaagugauuuuccugccucagccucccugaguagcugggauuacaggcacaugccaccaugccuggcuaauuuuuguauuuuuaguagagacggaguuucgccauguuguccaggcugcucuugaacucgugaccucaggugauccaucugccucugcuucccaaagugcugggauuacaggcaugagcugccaugcccugccaaaauauaaaccauagagcuuuguaucacaauauauucaaaauaaagauagagugacuuuuuacuuuuuagugugcaaauuaaacauaaagcuuccaggaaaaagcaaaaaaaaaaaauuauuguugguauccuaucaaggcuaguaaaaagaauagauaaauguauacauggaacaugggaaaacauucacaaaauauaaaguuaaaaaaaucagguuguaaaauaauauaucuccaauuuguaugagauuuauaucuauauauggaaugaagagauauagaaguauaucaaaugauuauuuuuguuugccuggagguaauggaaucauggugauuuucacuucacacuuugugauuuggcauucucaaauuuuuacaauuacuguguauuacuuuuguaguaguuuuuuuuauaaaaggaaaaaaugacuugaaaaaucaaguaauuugacauguagacacagggaaauuacauucgaggcagagagcaaacgacaggcaugugacuguagcugacaagugucagcagauugugggcauaguuuagagucuaagacaucugggggagaugaguuucaucauuagaugaagucauauucuggaggggaauaaaugcuaaucugaaauacuaugcuuucaauugccagugaggagaaauugacaguuuugaaauagugguuucaggaaggcucuccugagaagauggcacugaggcgagccuugaagaaggugagaggggagaaagauuggccuguguucaaggaaucaaaauaguucgcuaguucagagacaggguaaagcaaauagacuggagucucauucaaugucuuuaaaagucauggagaagaguuaguauaguuucuaauccaugaggacuuccugaaugauuuugccaggacuguacuuuaagauacuguuucuuuccaaccccccaucagauaagucauaccacuuuucugaagucgaauaagugaagggaaagaguggacaaauuguuaucuaacagggcucccuccccaggaaaggacuccuucgucaguaagagaugugcacgugguauaaccaacaaugcuacuucuggguauguccacacugcuggagcucagaaaugcacaaugaaaaaacaaaacggguuguggaaguguguauacaaucuguuacauuuuugaaaaacacauaacacaaugcuauauucuguuuaugcaugugugcuuauguagaaaaagucugaaaaccugaucugcauaagcucugaguucauaggaguuaugaccaugggaagaaguagaggggugggaugagcgcaugggauacugaacucagcuaugcugcuuuacuucucugaaagaggaacaaucuuaaguaaucaugguaaaauguuaauguuuguccauuucaggguggggaaggaaauuuaggucuguaauuuaggagagagguugaggccagagccaagauuggcaguugugaugaguaugugguuacaucuucacuuuuuuuagaacuaaaucuggaugucaauggccauguuuagugggccaggggccuuacauuacuuucuugcagcacugauggcuuuuguuugaggcugcacaaauuccugcauuucccuuggguugaaugguagggaugcgggcaguuggugacugggugaaccaccugacuugagcagggcuacgacucucucugcaaacgaaacccagagacaugaacagugcugagauuucucagugguuucccauguaggcugcuuuccaagggcagcaagcauggcuucaucacucacccagugcuucugauucagcacugugaugcucgguuaaguuuuaaugagguuuuaaauuuuuucguauguuugaguguuuaugcaaacaaagaugcugaauuguaaacaccagcaaucugaguaccuucuuuugauuucucucuccauauuguuuagucccuuuuucuuuguuuguuuuaugaaauugcauagauguuuugguugagaguagauuguuuuuacuuuucagggacaggcaacaauuucaugauauaacuucuaaaaauauuuuaaacaaguaugaaaauaguuuuuucuuccaaaaaaccauuucuucauuuggcacauacacaaacaaaugagcagaauuuagaguaauuuagagacagaauuuagauaauuuggguggguuuuuuuuuggacagucuugcccuguuguccaggcuggagugcagugaugugaucucggcgcaccacagccuccuccucccaggcucaagcgauucuugugccuuagccucucaagcuacaggcacacaccaccacguccagcuaauuuuuguauuuuuauuagagacgaguuuuugccauguugcccaggcuggucuugaacuccuggccuuaagugauccuccugccucggccuccuuaagggcugggauuacaggcaugagccaccacagccggccuagugugaaagcaguuuuuaaggacaguugaacaggaaagcuccuggauuccugcacauagaucuugugccccuccaaagugccguaaguaccgauuucugcugucuugauuuaacucagugucuggagcuuacgauccuuccucucuguuuccuucaguggcguagcuugggggugucaauuaaagaguuauugcaagaucucagccucugaaaguuuagcuuauucaucagcaaaacuuuaagcaagucucaccucuucuaaauuagaauuguaaccuugacuuuagucucagaguuaacauugugcagaaaaagaaaacacugcgcaguguugaagcaguuugcaaacugaaaugauacaaaugaaaaaugcuaugauguuucucaguagucucuguauuugcaaaugagucaguuaggauuaguuuuacccacaaauaacaacaacaguaaaaaaaaaaaaaaaagaaagaaagaaagaaagugacccagcacuauaauacaaguuuauuucucucucacaucaaggaaguucaggguagccagucugggcugguuuagcaacuccuugaucaucauggguucugugcuaccugguaguccaggaugguugcacaagcuccagccauugcaucuguaucccaaucagcaagaaaaaggaagaaaggcauacccccuuuucaggaggcuuccuggaaaucacauacaacauaccugguuacaucucaucagugaccuuagucacacagccauacuuagcugcaagacaagcgaagacauucagauucuaccucuucuucuugaaauagaaaggugaguugccaauccacugucagcgugacgacaguucaagagguuuuccuagacacagaguugaguuaaucccgucaucugugucaucgucucuauuuugacagcaucugucagguggucaaccagaguuuaggcaagaagaccuaugacuucucuacacagacaugauuaggauuaucuucuaaaucaaccaaacugaccagcccacccuuucauucuucugugcaucacagaucauuuuugaaaaagaguuuaggacacauccaauaguaagaguguaguuuuauaaaucaggacucagucuuacaguggaagauuauaugguaguuagugucauggagaaaagcuucauauuagauuaguugaaucgauugggauacagaaccgucuuuagagcauggcaucguuacauugcagauaaagcauguagguagagaaugauaucuuuguuggggagagccccaaacugcucuucaggaaccuuucuccgagauuugcaagccaauuaggcauaaugaaaccuuguuuuuaaugcauaucuuuugccaguauaauaaacauaauaauuaaauguuuauauaucuuucguauuuuccuguauaauacaacuaaucauauuuuugucaggcugaggacaucucaagaggagggaaagguggcaaauugagggucuguucuucuuuuauaccagauggcaauuauaacaaauuacuucuggacuuagggaugggggagggguggggagaugggaacaugagaauuauuccugauuuuuguuacuuuuuguccuguaaaauaugcuuaccaggccgggcacgguggcucacgccuguaucccagcacuuugggaggccgaggcaggcagaucgccugaggucgggaguucgagaccagccugaccaacauggagaaacacugucucuacuaaaaauacaaaauuagccaggcgugguggcacaugccuguaaucccagcuacuaggaagggugaggcaggagaaucacuugaaccugggaggcggagguggcggugagcugagaucacgccauugcauuccagccugggcaacaagagcgaaacuccgucucaaaaaaaaaaaaaaaaaugcuuaccgggacaucucaaggacaucauuccuuugucaacgguacaaagauaaccugagacauaaagugaaaaugauuuaugguuuuuuguuuucuuccuuacauuaaauuuuccaauaacauaucgcuaauaacauauuucuuuuguuuugagacggaguuuugcucuuguugcccaggcuggagugcaguggugcaaucucgacucaccgcaaccuccgccucccagguucaagugauuucuccugccucagccucccaaguagcugggauuaccugccaccacaucaggcuaauuuuuuguauuuuuaguagagacgggguuucaccauguuggccaggcugguuuugaacuccugacuuugugauccaccugccuuggccucccaaagugcugggauuacaggcgugagccacggugccuggccaacauauuucuaauaauauauuaauuugauaaacagaaguuauuuuggaaauaagccaaaacaacaaaaaaugcucaucccugcuuuucaaggcuauuaucuguaguuugagguuuuaucaaauguagauaugaacugcgggccucuucaggauguccucauugcuucuguuaaugcuuuuaccauccaguaccacugaacaggcagcagggugccuucuugggcacaccggaaggacccaggaaaaggaagauaguguggccuguucuugucuccaugccccaaaauggaccacuacaccagugggguaggaaauagcagguguguuauggguugaguuuggagaccuugacuugaucaaccaucugcucacccaggucaucuuuccuuuuuuugcagaggugaggucucacuaucuugcccaggcuggucuccugggcucaagugaucuuaccgccuuuaccucccaaagugcugguauuacaggugugagccaccaugccugguucuugucaccauucuuaacaucagcagcagcagaaaaacccccuguuuagccuucaauguuaauuuccuccuugaucuauguguucuacacaaaccacucccuuguugucccccauauauuacauuuguggacucuucucaaacucugcagcucagcccugguuccugcugagccuacagccccaggccugagcagccggcugggccaaguuacccucagucucaagaugacuuccucacaaggcaaaacauuucuccagcuggguuggagaccuaagcuggggaacugggcucucacauuccaagauagagguuugccuauggaccccugaaaguaggcguguagaagcagguuccucugauggcagaggcccucuguuuaucucugaaagauccugaaugcuaugcuucuuucauccccucugccuugaauucgccugcuuucuaggugcgguggagaaagcugggaaaagagccaccucugcucccaggggccacugagaggguagaacacugaccgaaucccagacucacuaccucaggggcugagauggguccaaaggggcccuuaaccucucacuugaucaccugacucuuaccgcugucauugaucugacauguucuccugggcgcugucccagcucugucccagcuucucagcacuguguccuggucagcccugagggcucauuuccuuuauccauacugaggaccaagaccugucuuuccuguagggcagugagggccacgggcuagugccugagccgaugagugcacugcugguacugugcugagcccuggacaaggguguagguugcucuaaaaaacaacuucccaauauucuacaaaauaacguucaaacugaacagagcuugacugaagauucuucuuacuucauuuguuuucaugcuacauuuuugcuguccggcuccaagucugugacaaugggucacgggaucagugcgaguaacagugaagauguuuuucuucaucuuugggcuaugauugugcuuugugauccuaaguauaaauacauugaggcugggcacggugucucacaccuguaaucccagcacuuugggaggccaaggcagguggaugccucgagcccaggaguucgagaccagccugggcaacaugucaaaaccccaucucuacaaaaaaaauacaaaaauuagccaggugugguggugugcaccuguggucccagcugcucaggaggcugaggugggaggaucaccugagcccuggagaucaaggcugaagugaguuaugaucguaccacugcacuccagccugucucaaaaaacaaaacaaaaaaaauacauacacugacuaauaacaccagcaauauuguuucaugggagcugccucugcuguuuguaccaaaacugagcagauucuuuaggccaggcccgaguaaucauuaaaucgaucugcuugugagaaaccgguaggucuaggcaugagcacaaaguggcagguccgucucuucccuucuuaaauaaggaaucaccagagguagacucugugccugugacucuugaauguuuaacugaaauccagagcagcaauugcauuuuauaugacaccaugugugugcaaaaacugaaucaaaaucuugugaaacagugcuacuuucacuuacuauauaugauguagucuaauaauuuucuauccuauuuuauuuccuuuuuuuaaaugcugguugaaauucuguaaauuuauauaaugacaaacuacugggacucuaucuugguucaaaaguccaugaucagccugcuuguauugaguuacuacauuguacgaucuuauaauuguaaaguuuaagauauuuuccuucugucugucuuaauuuauucuguaaucuaaguuguccugccaggaaugcuggcauauuuacuuuguuuuugaauucaauaaucauaguuucucuugcuaaguuacauuaaugguaccaaaaaaaaguuacugcaugguuuuugaaacuguucuuuccuaggaaguuuuaaaguaaaauguuuuuaccuuuuauuguuuacacagguuaagcaucccuaauucaaaaauccaaaauccaaagaagugcucaaaaauccaaaguuuuuugagugacaacaugaugccaccaguggaaaauuccacaccugaucucguguggcggguugcagucagcaugcaguuaaaucuuucauauaugcacaaaauuauuaaaacuauuguccagggccaggcacaguggcucacaccuguaaucccagcauuuugggaggccagggcaggcagaucacuugagcucaggaguucgagaccagccuaggcaaggugaugaaacccugucuccucuaaaaauacaaaaaaaaaaaaaaaacauuagcugggcacgguggcacacaccuguagucccagcuauuugggaggcugaggugggagaaucacuugaacuggguggcagagguugcagugagccaagaucaugucacugcacuccagccugggcaaacagagggagacccugucuuaaaaaaauauauauacauauauauauauaguuuaggcuaugucuauaaggaguauaugaaauauaaaugaauuucauguuuagacaggggucccaaccccaagauaucucguuauguauaugcaaauauuacaaaaucugaaaaaauuuaaaagccaaaaaucacuucagucuggugccaaccauuuuugcauaauugcauuuuccauguugcauuuugcaaccauuuugcauaauucuguacuucuuucccuuuuggguuuguuuucauaacugcucaguaaaaaguguucugugucaucuuuccauuauuuugggcuaaaucauguuaauggccaagccugucagaauucauuuguuuugaguuaacuuccugguguccaguucucaggaguugcaagaauagagcucuucccucaugcaaucauccaaaaucccaggccucuaaccaggauuggggaacaccacuguuggccaagagcagaaggcuuaaagcucuggucauagucauggcacuguacaaacuguucuuguucccuacaagaacaugggaacuauuuggauaauggauuuaugaauuuaauucugauggauuuuuauaaaggagcuaaaaauaagccuauauaauuuauuacauguauaaucauauaauuuuaaauguguauaauuuauaauauucaucgaaacauuucuuuuuggaaauuaaauuucacuuuggucaaaaucaucuuacaaaacaagaugacucaugaugguucuaaauaauguaaaccggugucuguaacuaauuaaugcucuggaggaaggaaauucugaguucugacacaaaagcacgucuaagugguauugguauuuucaaagcuuuuacuacaaccaaaaauauguucacguguaccugucuccucuuuacacugcuuacuuucucuaucgcuuuucccaaauacguccccaguaacuuccucauguucugugcaccaccuccaaucuuccccuaauguguaugaacuuggucaucaccaaagagguggaaaggaagaagggcaugugcuaauauuaauauugagguuugggcugggugugguggcucaugccuguaaucccagaauuuugggaagccgaggcagguggaucacgaggucaagacauugagaccauccuggccacauggugaaaccccgucucuacuaaaaauacaaaaauuagcugagugugauggugcacaacuguagucccagcuacucgggaggcugaggcaggagaauugcuugaaccagggagguggagguugcagugagccgagaucgugccacugcacuccagccuggcaacagggagagacucugucucaaaaaaaaaaaaaaaaagaaaaaaauugagguuugugccaguuucuuuuuccuuuaggucuccugauaugugucuaguuaguucuauauacuuccuggaaauucgacuccaagauauuuaauaaaacuaaacaggguuauauguugaauagacaaauccuaaagagcagaaaggauuuagugguuagugaaauuucauugacuuaagaugaguuggauccucaaaauuaauauauucuaaacaaaguucuauuuuuaagcugcaguaauaaugccgaauuucucuuauaguuaauugaaugauuuauccugguguugucuccugguagucacugaaaaagucauuacaauccucacuuucuccccuuuaauucaaguucagaauucauguguugcugugacuuuuuuugaguuuaucugcagacagcugccauugaauaaacauguuuauauagggcagaaaaaggcagccugaagauucuacuuucuauuucuuuuagcacuguuuggcaguuaacaccaacagcgcuucagaaugagguacuguccagcauacaccuugcuuguuccucuacaaagcuucuauuuuuguuuuugauuuguugugaggaagcaaaguguagccuuuacuugaaugaaagcuacaguuuuauuuuucuuucuuauuuacaagaaauucuuuugaugauuaaguuagccagauacgccccgugcgcucauauuucuuaaccuauuuugagcugagcuaguugcaaggacuaguucuucugugaaaccucuggcaguccauaaauucaaguucguguccagacguaauggugaacucaauauguuguauauuugauauauguuuguugcacacauggagagaaaaguugcuaccauugugaaguagccaugaaauccgacaguucuaauuucuuuaucuucugaguacccauggaauaaaggaccucuuagugccauagcaaggcagaaguuuaauuugcaauucugguggcaacauccagguauuucaaguagaaauuaagaaaacuuuacggaaaaacuaucucagcacuucaguuuaacuauuuuucaaaguccaaggaggguuuuccccaguguaaaagcagaaaugagaauuucagaucuaaagcgguucuugccuuuucuuuucccuccaugcacaugugcugacaacagaaaguaaaauuugaaaagaaaacccaggcuagagcauuggggucacucauuucccauccagcgaagggagagcuggugccuggcugggggagguuaggaaggcaagucuugggaucugaucacucggcugggaguggguaaaauaccuggaccucaggaggccggauugcagcgccaguguucucuaccuguguggccuguuccugccugggguuggguaccaaguccagguggaaguggucccuggagcauccucucucugaaguguuucuuugucaaacagaauacucccugcugcugccccagaacucaucacuguugacacauggaccaagaacuagcagaggaggugauuuauaaucucuaaaugaauugcucuaaaagagacaacaagcacucugacuuaaguaaaggaagggaggguggguggaaaggaaggaggaucauaaagaacauucuagauugcauacuuugguaaucacagcagggccuuauugcaguuagaacaaaagccuggacacacuuaccucucaguucaggaaaauaauuuagagcuacuuguuaaaugcuggaguauuauugaaguaccaaguguuaagauuuucacugaaagcaaaacugaccaagcagcucagcuagggaaaugcuaugugaucaguugauuguuugaugaggaguauggagcagggacuuuggcagagguugcuagcagacaggccuugguuuuaguccaagcucuaucgcuuaauagcugugugaccuuggggaaaauuauaaaauuuuccaguccuuaguaucauaaacuguaaauggaggagaaagaugccucacagauguugaaggugaagugagacaggacaccuaguacauugccuggcuacauagaaaauguuucacaaauguuaacuugaggcccucuccccaugccucggucucuuagaaugguuuuuccccaucgugugcacauugagcgguaaggcggacagcugccgccgcccaugcugccccauguugagagcauuucuguugaccuucccuucuucccugugaagcugguucagcagucaccucaucacuguuuuucuucuccagagagugcuggguuguagcgaccauacuguugacgcaacacaucccaaccacgcuggacggaauuuuuacugcgauaauucauauuccaggaucuuacagugcacaggguuacaacgauuagcauaaugaucuugcacaaucuuucugccuagcauguagugcauucguaauauucucagaggaggcgucuagaaagcgccaggcuccuuccuccugcgugagccacugcaagcugucggcgccucagugcuauggagaccuuggguggauuauuccuuguuggcggggggagggucccagcuguccugugcauuauaggauauuuagcagcauccuugcuagaugccauuuacaacaaucaaaaaugucuccaggcauugcuaaguguccagguggggagcggaauaggcagaaccgccuccagucgagaagggcugaacuguacuuaggauuugugauucugcagaaauggguucugugaaugcacuaaagcaugagaacauccaaaaaucaguguggcacagaacugaauucaaauuuaccuggauccagguaaauaagcacaauuuugaaaguaccaaacagaauucaagaaaaacaacaacaacaacaaaaaacacauuaaaaacagaaaaguuggccgggcgccguggcucacgccuguaaucccaacacuuugggaggccgaggugggcggaucaccugaggucagaaguucgagaccagcccgaccaacauggugaaacccugacucuacaaaaaauacaaaaauuagccgagcgugguggugggugccuguagucccaccuacucgggaggcugaggcaggagaaucgcucgaaccuggagggcggagguugcaguaagccgagaucgcaccauugcauuccagccugggcaaaaagagugaaacuccauauccaaaaaaaaaggggggaaaggucagaaagacguucuuuuucacuaggugaugaauuaaucuuucccaucuuugucauguuaaaaaugugccuguggcuguuucuccacuaaaugaagacacuggcacacagaugauuguguguaaacacuaggcaagacacuaggcacaaucguagggguucaguaauuauugaaugagaagaaagaaagguuguucuugaauucugugaugugaguguuuaaugauguuuuugaggagaaugccauauguagcagacagaacccugggcugggcaucagagggaccgggggcaccacacugggcuuugugucauuaucuccagaaaguaacuggccuggugcacaggagaaaguuagaguacauuguccauacaguucccacauagcuguaggguuuuaugaacccauauuuuaaagggccuucuaaugaagugaggauguuaaugcuuuuuuuuaaaaaaaaaaaaaaaaaaagagagagagagauuggugauuacuuuaaaaucugaguccuggccaggacucacgccuguaaucccagcacuuugggaggcugagacgggcagaucauuugaggucaggaguucgagaccagccuggccaacauggugaaauccugucucuacuaaauacaaaaaucacgcuccuguaaucccaguuacuugggaggcugaggcagaagaaucacuugaacgugggaggcggagguugcagugagccaagaucacaccacugcacuccagccugggcaacagaaugagacuccaucucaaaacaaacaaaaaaauccaaguccuaauuaucgcugcagcuuucuuuaaugugugcaguaagguggggacauacagaauaacuuaagauguagaaaucgucucucccucccugaagaauaucauggauacuacauuugccugccaggaauguuguguuguucugguguucucguuucugccguuaucauuguuucugcuuaauuuuuacaacacaacucuggccgcacccguggaugaucauggaaaggcagcugccuggcuuuccagaauuguuuugacucuccaucugaacccagagcucuguuuccuguacagguugcuagcaguauuuacccaaauugucccuucccaacucagacccacugacccuuccuuucucagcugauuacggguuuaaguuugaaucaaaccaugcuauagaaucacuaucuagcagcuucugugcuugcacaauaagaguauuagucagcguuuccuguuuucauucauauuguaaguugaauagcuguaacaaaagggaaagagauugccaagacaaauaauucuuauggcuugugcaaacaauuuauuacaagccuuauuaaauaugcagcuuucagaagucuacgugauaugccuuucagcaaagcuaaauccuacuauguggacuugcuucaugacuuaagaacaagucuauauugaauuuaacauuaaauaauuauuuggccuguaucucuuuuaagcuuuguuaagaacugcaaauaugauaagggaauaaauugcucauuucaagucacuaagaaaaccuaaccuauagguuauauauguuggcaguucccaagaaguaccuaggaaauggaaccuuccuauaagagugguuuguccccuucucacgagaugggucuucauaucaaggcccccuaaggcacagauacacagcacuccacaguguccaaguucguaguaauugguggcaccuuauuaaaguaguuuuuacuuucauaauuacugauuacacaucagcauaccuuuuccauguucuguuuccuuggcagccugauauuugaauacaaacgacauaaaagugauuacaugcagcauuucaggacaguuuucaaacugagagaauuuggcacuuucuuuuauuuucuucccauucuucgucuauuuccuuugcauuuggaagccaaacuccucgaaccuuuacuucugcauguuguuuucguccccuagcuagaguucucuuuauuacuacuuuuuuguuuccaauuggucucuuuuuaaaaauaaaacauggugaaaccccaucaauacaaaaauuagccgggcaugauggcgggugccugugaucccagcuacucgggagacugaggugggagaaucaauugaacccaggagacggagguugcagugagcugugaucgugccauugcacuccagccugggcgacaagagugaaacuccguuucaaaaauaaaugaauaaguaaauuaaaauaugaaauuaagcuuagcuagccuguguagauguuuuagauggucauaucuuuaucggauaugacauuuaugccuuucaguaaaaccauuguaguauuguaagaaaaaaagggaaguaugauagggaggacuaagaacauauuuguacuucuauguaaugcuauuuuaugugucuauuuccauugaaguguggccuugacaucacuggcucccaagucccauccuguuuuuucauugaccugcuugugccagguacugcguuaggaaguggagcuaccagaugaauaaggcguggucccgcccuccaugugggagacggcacgucaguguacuuaggaugcugcauguggugacagaugagggcccugcaagggagcacaccacagggccgggagggugggaugggcgggaggaguagccaacuuugcccgaaagcaucaggacaagcuuccaggaaauggcacauccaagcugagucuuggacagcggguuaaagaggcagagaggggagagaggaauguuccacaugggaaaagaggucuggaggugacaacaaguaacauagaguaugugggcugugccggaagcuugauauuacagaggcacgaagucugaggcagggagugugaaggaagaugaagguaggggaaggaaguuuacacaaggguggccuugacuuuuauauuaaggcacuuuagggaagcaggaaccacugaagacaggagaacauggugacuacacgggcgcauugaaggggggaggagcuagguuuuugaagggaauuugagcuugcaauuuuucaagggcauucaaugguuauaaaugaaacuuuucauuaauauauuuguguccaaguguuuuuagaugugcuuuucugcuacucucuuuuuauuugguuuggagauagauggugacuuuccuucagugccuucuaugugucuugacauguuaaugucucaaacacaugguccguaucaucauggagcuugcaaucuaacaggguaguuuaacacauaaauaugcauccaguuggaaagaacuuagagaucacuugaucagcccccguuauguaaaauguaugcaacaaucuaccuccaacuauagggcgacauuaaacaguuuuucaaaauaccauggcauugaaaaaaaugcguaacauuuggguuacuucagucccacuccccgguacuaaucaggccagugaaccagucuugcuggugaaauaaugacuucuccagucaugauggaugauuucccuucaucaugaccauuucuucccuggcucugccuuuaccuaugaaucucuucuuuccucccucuccuuccuccucuuggucucugccugccauacccaacuccacauuucucugcuuggaaaaauccuacuugauucucagagccugacuccaucacccccucucuccaacccucccaggcaaacuccgucccucccagugugccgcccuccagcucucucuaguugaauagcagauguucucucucccacuucccugcagggcuucaggguagugacccuaagagugagcuucuaccagugagaaaaacgccuggauggagcaggaauucccacaaaugcuuaggaauucaauaugauuuuuagcaagugggagaauuauccuuuugguuacaaagaugugaacuauuuuugugaguucucaguaugcaccaagaaaaaccccagugacucaguaauguaccugugccgucucacuuaacccuuccaacaaggaacuugccaaggugcacagcugggagggauccggggucccguccgugugcuaaccugcaggacagcgccgcauaauccaguacuggggccuuauuguccagccuuccaccuccaggagcccacucagugaugacuuuugacaaaagucacccggauuaucccucuuuugggguccaugaugccaccaacggcuaaaguuaacaaaugcauuaccaggagguaccacugagguaaggauuguuacuguaagugauuuucucugauuuugaccacuacaaguaaaaucacaagauuugucccaaauacuauauaaagaggaaugucuuuuauuucucgaaauuguucugccacuuuguuuguucaaauaacacauaauaaaggauaaauggcuuguagcuauauuuauccaaauugaacauuuuugauguaauuuuuuuaauuugucaaaagcauaucaauggucauaaaaauuuuuuauguccucuggcccuauuaccuuacccuugggaauuuauuccaagaacguaauuugaaagagauuaaagcacauaggcacaaauauuuucagugcaguauuguuuauauuggaaacaacccaaauguucaguaacagggggaacaauuuuguaaaucuugcuacagcaacuuaacaaaauuauaagcugccacuuauaauuguaaauuuugaaaguuuguagcacagcaaggaaacugaucauguuaaauguuucugauaucuuaguuaauuuuucucccgccaguuccgaucgguguccuggucauaccgucagcauauaaguauguauuucauaaacauuuacuuuguauuaacucaguaguauucccuuccuagagugguuugcuucccagauuguaauggacaaucaucucaccuggggaucuuguaacaaugugauucugauucuguaaacuuuguggggagcccaagauuccacaugucuuagaggcucucagauacugcugaugcuguugaucacgaaucacgcauugagcagcaagguccuagagcucuuuguguaugaagaagauacuacugacccagugccucgcuaucuugaaaggcagcugugaccuuucuagcaacugaggggguggggacuagaaacgaguguuuucugguguuucucuaauaaagcugcugucuuguauccagauugaccaucaguauccuuaugcccuucaacuaacuugaaauuugucaguuaacagaaauuacuggguggcacuaaaauaaauuauucuuaauauaaaggguaagaaagggucgggugugguggcucaugccuguaaucccagcacuuugggaggccaaggugggcagaucaccugagaucaggacuuugagaccagccuggccaacauggcaaaaacccgucucuacuaacaauaaaaaaaaaaaauuagccggguguggugguggguuccuguaaucccagcuacuugggaagcugaggcaggagaaucgcuugaacccgggaggcggagguugcagugagcugagauugugccauugcacuccagccugggggacaagagcgaaacuccaucucaaaaaaaaaaaaaaaaaaaagaguaagaaaggaucuuccauuguaaucauacuaucauugccuuuugaaacaauuuggaaccugauuacaaaguugaaaauccccaucuguaugaagaaaagcuucacuggcuggucaccuuggcucaacgccuguaaucccagcacuuugugaggcugaggcggguggaucacaaggucaggaguuugagaccagucuggccaacauggugaaaccccaucucuacuaaaaauacaaaaauaaaaaauuagccaggugugguggcaaacaccuguagcuacucaggaggcugagucaggagaaucgcuugugcccgggaggcagagguugcagugagccgagaucaugccgcuguacuccagccugugcgacagggcaagacaccaucuccaaaaaaaaaagcuucacugugaguuaugauaugggaagaaaagucuuggccuggccaccacaaggaaucccucaggccuggcggugggaagcagaggagggcgcagucucuuuagggcagaaagugaagaacauuucuaugacaauggggaaaucaguucaccuuuguguugguaaacaaaaggaauguaagcuguccuuugagcucgaaucauaguggugauugccaaaaccuaccuuuguuuuuagaagauaauagcacauauuccacuugcuuccccacagugaccgaagcuggcuuuggugcugacaucggaauggagaaauucuucaacaucaagugccgagcuuccggcuuggugcccaacgugguuguguuaguggcaacggugcgagcucugaagaugcauggaggcgggccaaguguaagugcccacaccgccuuccuaauaccaaagaaauuucauuauguuaaaacagaauugagcauuugaaaaauuccugcccauuuaaugacuauaguuuucuagaguauuuuucuuaaaacuuuuuuuuuccuguagaccucccucguggacaucuaaaacguuuuuuguuuuguguuguuuuuuguuuuuucccaacaccaccauagggcacuuugaguuuaguaaguucgaguaaacaguaacacccacaguucuuucuaaacaauauuuuggaaaggagcauaaugcaaccacuuuuuagucucaagcuucacaucugauacucaggccaagauuguauaaccauaugguaaugggagguuagaggcucuugucccugaacgaagaacaagaggauuagagugaguucuuugaugacagagauuuuucauuguuuguacagauaguuuuucgguucacugaugcugcaacucaucagauuucaucuaaaacuauuuuccuucucuuucuguuuauuaugauuucuccucacaacucuguuauaauacuggauuguuucuaagagcuuugcuuggaaaacacaaauucgauuuuaacuucuuuaaagacuuuuuauauuuaccuauccuaauauauauagaaauuacagacauuauaaaggaaauauauuccuuuccacagaaaaccugugcauagauuuuuggggguuuuuuuguuguuguuugcuuguuuguuguuuuuuuguuucauuuuuaggaauuuccaaguggagaauaagacauuuuauacugauuaaucauuuugaaauaaaauaaaauuucucuaucauaauauucacauaugagacgaacugccaaaucugauuucuuaauugguauacuguacuguguaugugacaaaagucauauauucaaugauuauugcauagucaaaacaaguagcagguuugccaucaugaaacgcuguaaagcaauucuuucuccugggagagguggacaugauuuuuauaccauuuuacagauaaggaagcugaguuuugauaggcuuagggaauauggacaaugucagcaggccagcagagagccgagaacuucagaucuaaaucuccuacuauguccaccaugcagagcuggauguuaaugaagggcagaaguuuucuaaauccaaauccacuccuaauacccgacacuuaagcacuucauuuuugccuaaagcuucaucaucauuucaaaugcaagaaugauauaauacagauuaaaaguaguaaaucauaaagaauucugacuucacucaaaacaccccuuguugcuacaguccuuccuggauuuuagacauugaaucuguauaacaacuucuauuuuuaaaaacuacuuccgcccauguaggaugcauuuggaauucucccucccugcccugccacccugaaaauuauagaaagggcuuagagauugucugaucucauucagucuuuauaaagagaaaaucucugaggcacagggagacgcagugacuugaguggugucacacaucuauuucagggacugaucagaucuacaguccuggucucuugacaucagucccauaguuuuccagacucuggucucuguccuguaaaaauucucuacaugguuuacaauccuauuucauucaucuuaacauaugugcucuguuauucagugguugcacuuucgugccacauuaauccuuugugucucuuccacugcugcuuaaugucaugguucucagccagugaucaugguaacauggaacaggguuaguaggcacagauauggguggaggauaagaaaagguggggaccagccaggcgugguggcucaugccuguaaucccagcacuuuggaggcugaggcagguggaucaccugaggaguucaagaccagugguggcgggcgccuguaauucccacuacucaggaggcugaggcaagagaaucgcuugaacuugggaggcagagguugcagugaucugagauugcaccauugcacuccagccugggugacaagaacaaaaguccaucucaacaacaacaacaacaacaaaaaaaaaaaaaaaaaaaaaaaaaaaaaaaaccagcagggaccaggaagcccugugaagcuaggcaucccucuccugggcuccaguaguaccuucugccucacauuguuucaugaaugccuuguucugugucucccuauguaauucucaauuccuugaguuuagggacugugucuuauuaauugguaugguccaagugucuggcauggucuauaugcagggaguguuuucaauaauggcaagauaaaugaacuuucauccucuuaauccucuauuccauagugcucaucucgguguccuuccuucauauugaauagcucuguauuuuugaaccaugauuauucauuucuacuucuguuuucuuuuuucuuuuuugcuacaaauacugcgcugggaucgacuuccuuuugaucauuacacaaauaaccauggcugccucuuauguuuauucagcuuguuuuuuuuccauaauuuguacaguggaaaaucuuguggcccuugaauuugcccauuuuaaauuugcccucagucauuuuaaacucacauccugucccccagagugcucggccauucccagugcaauccaauaacuaauauugugcuaugcuuugggauccacagauucuuucacaauuagaucuuuaaacuaaccauuguaugaaucagcauucuucacacauagaaccaauaaggauguguguauauauagagaaagauauuuauuguaaggaauugggucacaugauuacagaagcuggcaaguccaaaaucugcacugugggcuggcaagcugaagacccaggagaggcaguggugcuaaugcagucugaaggcagcagucugcuggagaauucuccugcucucaggggaggccagucuuuuuguuguacucaaaaaggccuuugacuggucaguugagacccacccacauuauguaggacaacuugccuacucagaggcugcugauuuccauaucaauuucaucauagacacccucacagaaacacgcaaaauaauguuugaacaaauacuggacacccuauggccccagcaaaguugacacauaagauuaaccacaaggccaggcacaguguuucacccuguaaugccagcacuuugagaggccgaggugggaggacugcuugagcccaagaguucgagaccagccuggggaagauagcaagaccucgucucuacaaaauaauaaaaaauuaucuggguguggugguacacaccuguauuccuagcuacuggggaggcugaggcaggaggaucacuugagcccaggaguuugagaccgcagugagcugugauugugccacugcccuccagccuggacaacagaacuuuauggcaauuaccguaaaaugauuucgaauggugauguacucuguauaaaucaaguauuaaacauauuauuaguuuuauguucuaauuugaaccaauguuugagaaguuucauacuguuccauuggcucaaauuagaaucauccagggagauuuuaaacauuacugaucccagguuccccucccagaacuucugcuuucauuggucuggguggagcccagggaucaguguuuucuaaaagcuucccgcaggaguuuagguuuagccagugcugccagcuacuguuuuaaaagcacaaaacauagagguacauuucuaaaaauugaaugugauuauguuguucuuucuuucagaucgguuguguaagcauuuuuauaggauuauucuucauguuuucucuccuuauuucagguaacggcugguguuccucuuaagaaagaauauacagaggagguaagaggagcuguuuagaugcuuaugugaagaaucucuuaaauccagugacucguuggcuuucagugaaugagcccuccuucaguggccucuuagaaaagugcuguucuguccgggcgcagugacucacaccuguaauuucagcacuuugggaggccaaggcgaccggaucacaugaggccaggaguucaagaccagccaggcaaaacccauggccaacauggcaaaaccucaucucuacuaaaaauacaaaaauuagcugggcaugguggcucacgccuguagucccagcaugagaaucgcuugaaccugggaggcagagguugcagugagcugcgaucgcaccacuguacuccagccuggacgacagagugagacucugucucaaaaaaaagaaaagaaaagugccguucuaagaauccgagaggaaauggaugggaugaaaggauaaaauucauucaguuaacucuuaaauaucaagaaaagauggauauaggcuuugucuacuauuguguacucccaggguagccaucagagcaggaacucaaggucuccaggucagaaacaaauaugaagcuuacacuucuguauucuuuugucauggaaggucuauauacaguuggcuuuaugauuuacaggaguggcuuacucuuuucuguaaauagacuuugauuugcuggcagcaguaccucuuagcuccuacagguggcgccagggaucugagccaggaauaccuggucagagcuccucacccaccuggggccuugugccugucaggccucaaccugcagagcaugggcgcauugcauagacccugcagccuguccucagcagggugagcugccaggcuucagacccacccauaugccauuggauccagaaucauuuuagaaauuauuuugaagacgaaccucuuuauucuugcagccaucuuucuuggaggaaaaagugaaaaaagauguagcaaauccugccagagaggugcuggcaguuuagcuuggcagguuuggugggagacaauacacaggggucuggguuuugcuuuuuucuuuuuuacagaacauccagcugguggcagacggcugcuguaaccuccagaagcaaauucagaucacucagcucuuugggguucccguugugguggcucugaaugucuucaaguaaguccagccuccuccuuuaaaugugggcauuaucacuaggccacccugugaacgauauuugugucuugggguauuuggucuuucugugcuucaucuaaaaguauacagaaauacccaguucuuucuguuuguuuauuugguuugguuucauuuuagcaaauguguucucacaauguuauuaaggaagugaaauuuauauauagugaguuacuaucuccuuggcuuuuuuuuuuuuuuuuuuuuuuaauucuacccagcauuuuugucugaaacaaacugugaaugaucaaagggauauguuauggaauuuucuugauaacacccuuaacgacuugaaauauuugagucacuuuagagaggacuuuuuuuuuccaugcuuuaagucugauuuauuuaaacacgaugugaccacuuuugauguuuaaaauguauucaguguuagggagcgaaguucuguauaaauggugagucuuucuuugaaaacauagcuaaauggauacagaugcaaaaccacaaacauuuucuucacuaggaccgacacccgcgcugagauugacuuggugugugagcuugcaaagcgggcuggugccuuugaugcaguccccugcuaucacugguccguugguggaaaaggaucgguggacuuggcucgggcugugagagaggcugcgaguaaaagaagccgauuccaguuccuguaugauguucagguaagaucuaguaaaaacaauggcucacauuucuuacaccuuagcauggguugucccauucuguugucaccacaacccuacagauaagaaaacuaaagauagaagaguuuaggcccggugcaguggcucacgccuguaaucccaacacuuugggaggcuagggcgggcagaucacuugaggucaggaguucgagaccagccuggccaacauagagaaaccccaucucuacuaaaaauacaaaaauuaggugggcaugguggcgugcaccuauagucccagcuacucgggaggcugaggugggagaauugcuugaacccaggagguggaggcugcagugagccaagaucgagaucacaccacugcacuccagccugggcgacagagugagacccugucucaaacaaacaaacaaaaagguagaagaguuuaagccauaugacaaagucacauuuccaaguacagacccuagcuccuugucccaaagccugugcuuuugaagacucccaaaucgcaguccuaagugaggagguacuuuagcgaacaggauuugacagcugacgcuuucaggaguugcacaggaacaagagcaauuucgugaggauugggaaaccaugggagguauuuuccuuguucauuucucuuuuuuuuuuuugagacagucucuguugcucaggcuggaguacaguggugcaaucucggcuuacugcaaccucugccucccagguucaagcacuucucugccucagccuccugacuagcugggauuacaggcaccugccaacacgucuggcuaaguuuuuguauuuuuaguagagacgggguuucaccaucuugggcaggcuggucucaaacuccugaucucaugguucacccaccucggccucccaaagugcugggauuauaggcaugagccaccacaccuggccucugcuuguucauuucuguuaugguucuuuucucuugugguuuuauugaacuaugucuaguguauguguguguauauauacauacauaauauauuuauuuauuuucauugugguaaauauauauauaacaaaauuuacuaucuuagccuuuuuuuuuuuuuuuuuuuuuugagacagagccuugcucuguugcccaggcuggagugcaauggcgugaucucggcucacugcaaccuccaccucccggguucaagcaauucuucugccucagccucccaaguagcugggacuacaggcgcaagcaagcgugccuggcuaauuucuuuuuuauuuuaguagagucgggguuucaccguguugcccgggcuggucucgaacuccugagcuccggcaguccacccgccucggccucccagagugcuaggguugcaggcgugagccaccacaccuggcccaucuuaaccauuuuuaagugcacgucaguaguguuaaguacauucacauugucaugcagccaaucuccagaacgcuuuucaucuugcaaaacugaaacuguacccacugaacaacuccccaugccccucccuacagucccugccagcuaccauucuccuucauuuccaugaauguaacaacuccagggaccucauguaaguagcaucauacuguggcuggcuuauuucacuuagcauaaugugcgugcauguuguagagugucagaauuucccuucuuuuuuuuuuuugagauggaguuucgcuuuuguugcccgggcuggagugcagaggcaccaucucagcucaccgcaaccuucugcucucggguucaagcaauucuccugccucaggcucccgaguagcugggauuacaggcgugcaccaccacgcccagcuaauuuuuguauuuuuagcagagacaggguuucaccauguucgucaggcuggucucaaacuccugaccuugugauccacccaccucggcuucccaaagugcugggauuacaggugugagccaccgcgcccggccagaauuuccuuuauuuuucgggcugaauacgcucccauucuuuggauaucccacauuuuguuucuuuguccaucuguggauggacacuugagcucccccucacagcuauuguaaguaaugcuguaugagcaugcguguuuauggcauauggcauauguacaaguaucccuucaagaccguguuuucuuuuuuuuuuuuuuuuuuuuuugagacggagucuugcucugucgcccaggcuggagugcaguggcgcaaucucggcucacugcaagcuccgccucccggguucaugccauguuuucaauucuuuuggaaauguauucccagaagugggauugcuggguccucuaggauauuuuuaagcacaugucgaugguucagucagaagaccugagcuucccagggcucacucuccuccucagaucgucugucuuugcacccgucugacaucuccauucugaauuuugugguuccgauucuggcugauggauuugucuucagggguagugcaugauuguggagugcccaggcuucaagcugauugcugcuucuccuguuccuucaucccucacauauucuauuguugagucacucagaugucacagacacucuucuuuccuguucaguggcauaaaucaauagcauaagugaagaagaaauccgugaagcaagagcuuagcagcguuguugauaagccuggagucacaguggugagagaacggggcugauguauuaauauuuaauauuaccacagcucucgcuuuuaaggaguuguuugugagcuggguauaugggcgcuuugcacauguucaccucuuugguccuaacaucccucuuagguggaaacuggugauaucuucccauuuuacagacaagaaaacuaaagcacgaagagacuaagucaacugcucagugucccauagcuaggaagaggcagagcugggagaaagaauauccagaugguugaggucaucacccugcucuguucuucagagcuaaguacugugcucaaaaguguguguguauuggaggucuggggggagacauaguuaaaggggacagugacugagugaccccccugaagagaaagggugacagugaugggcauaggcacagauuccaugccacacaggggacaucaucgcuggcacgcagucaguguuuacggaaggaaggacacagggaauuaauuggaggcuagcucauaaaagguuuuucauuuuuaugaggccauuuugugaaugaggaacuagaauauucuggacuacagaggcgguagagaucaauugagggagaagauuuuggaugagugaaaagaaaaauguuccaguuggaagcuuugaguucucagaccuagagguguucagcgcaaaauagauguagcccugcugugggcaagucagaggcauugaagccaacucagauggcagguggccaaggagacccuggguuccuguucuuugguccuggguaaggcuugccaggguaccuacaacccuuggcacaugccagagccuuucuacauaaaccacuguagggagagucacccccagauccugcugugagugugccucugaucaugccaucugaucaugccaucuugccgucugaucaugaaccaccccacucugcauagcaaaggcaguuauuuucaugaaugauuucacaaagugcggcucuuuucaaggaaaacaucccaggugaaaaagaggucaguaaucagaagaaaugcuucugaguuaugcugucucagacaugcacuaacccuaacaugaacccuuuuccuuuccacugauauuucaauuuuuuuuucugaauucccauucuucaugcagauaaugcugcuaaaaugucagcucucuucugaaaggaggaaaauguuuaauaauaauguggucuaaaguccucuauugauaggcgaccucaaggccaggaucccugccuccuuugccaacacacuucucgcuuuucuuguaacagaaauucgauuugagcugcauaauuguuuguuagauaaucagccucccagccuacugcagcaugacaguucaugaaaagagcugcugcugcugcuggcucucuuuguacugucugccuguuagcuguguuccucacaccagcaagauuuagaucaucuaagaccauuuacagucuugucuugucaccauguaaaaaucugaauucauuggugcagucaguaauagagcucaagccuucuuugccccggauuucuugcauugauuggugcugguaaaacuuuaguaacuuaaguaaugguuuucuggaagcccuuuuuaccuccccuacaaccccacacccucacaaccaacccuugggugcugggcagugagaaagauauggcauugcucuauaggagaaagaaguuauaaaugcuuugcauaugacacucucccaccuuugcuucucaaagcaaacuggguuucugugugccccuuggugucuccccagacuuuauauccccaagaauguauucaguacaagacuaauggcaucuugugugcuauucuuucuccaccccagucuuguggaaggaaaacaccggagaugauuuaggguaaugggaaauagugcuagagcccagggcaugacugcauuugaaugugaaguagaaauugucucggaaccccacuggagagugauucagcuggagagaguggggcaccuggcucucagaggcacugugcggccagacagcagugugcuggacuuccuaauggcgagcucacagguuaagugagaaacaggcugcacuucugacuugggagucucugcugaacuuuauagaaaacugacuucagcagcaacugcugucuagagaacaauuuggcaucucuuuuugccagaguaacuucuaacucaagaguaggcaacuuuuaauuaugguaccggauggaggcagcaaugaauaauuuagaauaaagauugaaaaauauggaauaagguguaguagacuaauugcucagaagaaguuuuauugugugaaaaugaauguguuuaaacuugaaauacagaggaucauuuccucucuacccuugagggugauugcagucccuuuuaagaagcuguuaaaagucccccucaagaucaucuucucuuugaauuuuccuuucuaaugugacuuuugacaauuauaucuuuaucguucacuaagagaauaucuccaugucugcagggaugcagggaaauaugauggcugaaagaaacgcuaaucuacaugcgcacuuuauuagcuaagaaaucccuccuccauacguucuuccaggcaugccuccgcacaucccaucugcuaugugggcucaacucugcauuauagaugggaaggugauggacuuguccauaagaaauggacgcuugauaggagaaggaacauauuacauagagcuaacaggcuaaagcuuugggaucaugcaaauuaaguuuaaaccuugaguaggccuccuacuguggacacaauuuggggaagcugacuaaucucucgagccucagcauccucauuuguacaauggugucugacagugacaccaacuucaccaaguugcugugagacccaaaugaaaugccccagaguaaaaugcuggaacauagaaagcaggcaaugaaggccaggagugguggcucucgccuguaaucccagcaccuugggaggcugaggcagguggaucaccugaggccaggaguucgagaccagccugggaaacauggugaaaccccaucucuacuaaaaauacaaaaacuagacagguguggugucacgcaccuguagucccagcuacucgggaggcugaggcaggagaaucgcuugaaccugggagguagagguugcagugagcugagaucacaccacugcacuccagccugggcaacagaguuagacucugucucaaaaagaaaaaaauggaggaaaguagucaaucaaugcugguucuuccuccugucauguucacuuggaaagagagugggccuccugaauucaccuucaagaauucuccuguaacucaagguaacuuugucaaacuccaagauugguuuauuuugcucuggguuaaaaccaggaauuagaagucaagucuccuaaagcacuacugaacuaaaccaagacacugacguuuuuccuucuccgugagaauugggagcccuuagugauaucauaaaacaucagucauuuuugcaaagaaggagguaugacccggagaagucagcuugacauucagucggaauauuguuuguuaaaugaggaguuaagguugaaaaucaucucuguauccuuccucuagccuugcaaacauuuuaagguguagccuugacagcaagacaggauaguguuuguuuuuauuaaaaggucuuuccuguuccuugcgugaagccauucucuugaucccagugggggcuggaugaaggaagagcaaaacaaaccacgaagacagccuggagccgcagccagcucugcugacuucugaacuucacgcucucacugcccagauggccagggguguuuccuccucugcuggucuuuuuuaaggcaggauguuuguuguuauuguuguuguuuuucugguugguucuuaagaaauuauuuucuacaucuugaaaaugccagcuggaaccuacaccaguuguugguggggugugagaacuauccuuuacauggacuuggagcauuugcaacuagagccuccacauugaaauaaacauuuaaaaaugcauaucuauggauauacagugggggaucuuccauugugguaaaaauauguauaacauacaauuuccccuuuaaucgcuuuuacauguauagucuguggcauuaaguacauucacauuguacauacaggguuuaauuaauaggaucuuaaaacuuaaaaggguauugaugcacaucucuguugccuuuuacauuucacaguaauuagaagggaaaaaacacacucuagguugaaaggcuguccuuucuuuugguuguccuugucccuggaaaagcugucuucccccucagggccuuugaccucccccggcucucccucccaucuucagacacgcccagggccagccugagucaguagcccuuucuucagcgcucccucuucuccuguugugcauuagaauguuuggaguguucuguggaaagcugguccuuacauuuuccagucaguuaugcaucucacucauaaaccuguuucuucccccaugcucuuuaauauucugcuuucuuaauuaugguugagcugccuuuaaacagucuuagauuguucaaugugaguggcuucaacaagccucccauaagccucuuauccccuggcccccuuuccaugauccaaccccaaaucuccagauacccccugcuuuuuuuauguuuuuuuguuuguugguugguugguugguuuuuggguuuuuuuuuuuuuuuugaggcagagucucgcucugucacccaggcuggagugcauuggcacgaucucggcucacugcaaccuccaccucccgguuucaagcaauucuucugccucagccuccugaguagcugggauuacaggugugggccacuaugcccagcaaauuuuuguauuuuuaguaaaggcagaguuucaccauguuggcugggcuggucucgaacuccugaccucaagugaucuguccuccucagccucccaaagugccgggauuacaggcaugagccacugcaccaagccccggauaccuccugcuugaccagaccuucugcaaacacaccuuagaucccucucaaaucuagaugcuucuccaacacuggcuucuagguucuuuaugaaaccucugcuggccggcaguauauaacccaccacccagccugccaggcacgucauucagcuguguuagacaguuucgagggaucugcaccugucaugagcacuggcccaaccuucucaaagcaucccacucaucccugugauucuggcaaagcuugccccagcuuucuuuccucgaugguugaaauagcacccaaugagaaaaaaacaguggccuguauuuauuauacuuacacaugucacaagaaucccuguagugucauugaaagcuuucuucuagcaugcaaaaugauugucacuaugauguaaguuucuagaaaugccuuauuucaucuaaaauuaugagagaagguaaaaugaugaacuaucaaagucacacuacauguuggccggcugccuucuaccacucacuccaucccuccccaggcuuucugacuuaaauuuagaucacaugagaccauugcaguggagagaguguccacuuucucaaucuaaaagcaagcucgugaagaccauuaaauaugaucacaggaacaaacauuaaagguaccacacguaauggaccacuuaagacagaaaacuacgaucuuaggguuuaggggaaaaaaacacucaaacagcacaggcuuccagucuccccagucucugagagguugggauuuuuuuuuuuaauaaaguacaagggcuccuugaacaugaacacggaacgagcguugcaccuguauucauucauuucgcucuuguaacacauugauguuccuaagucagauuuguagaagaggaacgagcagaugcaucaugagaacacugugcuuggccaggcgcggcggcucaugccuguaauccuagcacuuagggaggccaagguaggaggaucgcuagaaucgaggaguucaagacuaaccugggugacauggcagauccugucucuacuaaaaauauuuuaaaaauuagccaggcauaguggcacaugcacuguagucucagcuacucaggaggcugaggugggaggauugcuugagcuugggaggcagagguugcagugagccaagaucaccccacugcauuccagccuaagcaacagagccaagcucaaaaaaaaaaggccaggcacgauggcucccuccuauaaucucaacccuuugggagacugaggcgggcagaucacuugaagucaggaguuggagaccagccuggccaacauggcaaaaccccaucuguacuaaaaauacaaaaaugagccgggcaucguggugcgugccuguaauuccagcuacucuggaggcuaaggcccaagaaucacuugaaccugggaaguggagguugcggugagccaagaacaugccacuacacaccaucaugcccggccuguuuuuuuuguguguguuuguuuuggguuuuuuuugagccugggcaacagaacaagacucugucucaaagaaaacaaaacagaacacuguacaugaguguuccugggcccagcagagugcucgaaccagucagcacuuugcccucuuuugggugagaugagaucuuuaaaaucacuuauucccauauauuccguuuuuuggcauugcuacacuauucuauuugagaguaauaaaagauuacccauguggauuucuuacuauuucauguggagaaaugcagcuuuucuagcggcgagccuuucuuccauuucccagaguccgguuacccucaccgcaccccagguuugccguagaaggaugagauucccuacauguaggcgucuucagagugaaccuguugcucagggcccgcgagcccacagggcuccaugcccacugagcaggcucguggacgucggcacguagcucagaugugcugauuuccagccaaggacaugcuuugugucaacgauacaggggccuguuguucucaguaacaagggcagagccgcucccgggacuccaguugguauugguaaugcaagcccuugcaccuagugugguguggucaguauaaauuaauaucgacagcuucauguuguacuuuaauuugaaguacaggaaaggcugcuugccaaacuguauuuguagaucauuuaaaauuuaugcuucauuuaaaaugcaaaauacgaauggaaauaauuacuguguauccggaaaugucuauucaacuuacaaguuuauuaauugauccuucucuuuacauguuuuacgggacuuggaauacacuuugcuaauaucacagcauaggaagauuuaacccauaugaauucaacucuguagccuuggugaaagaaaagaaccauguauuugucauucacuguggcccccgauguaugccaacgacuucauuuggugcagggcugaagaaauggcaguguguuccaauacuucacaacaguggggccucauuaagagaugcuaggguauugagaguggaguguuacauaguguuuuucauaggucuucuaaaagauuuuucagaguugcugacuuaagaauuuggccucugaguaagaugagacgccccuacuacguuauaaagccuucauggaucuuuauuucuaacaguucauuuuuaaacuuuuguuccauuucauuuuauuuuguccauuuuuugucaucaaaaaauuauuuuaaaauguaacagcucuucuagaauguacagaucaauuuuauuccacuaaaaaacaggacuucaauaauuuaauugaagaauucuagugagcauuuccagagccuuuccaagaaagcuauacuguuuaacuuugagugacucagcuucuaggacccugguccaccacaccuacaaaaugaauuuaauaaagcaugaaggucaccaaauccucuacuauuucuucguggagucauucagcuaguguuuauguugugccugcucugugcgagagacugugccaccaauauaaccacuggucacaguuauuuucuagagccauacugccugauaucccauguggcuaagauugacaguucaguuucuggauuguuccagucccauuuccagugcuuuuaauagccacaugaggccagugaacacacgauacaucuuccauugugauagaaaguggcaguggacagcuuuguucuagaguauuuccguuucugaaauacauguuuaagaaguuuggaaaggaauuaguguagaguaugagaaggguuacauuuuuggugaauaugaagauuuaacauaauguuaguucaaaaaugaccaaagacacaaguguagacaccaggcuuuugaaguagcuaauauguuaagcagcugugcauuauauagacagaauauucacuaugucccacucagcccuguguuugacaccauuucaccuuggcuucugccuuucuuucccuucuuugccuauugagauuuuuccuguccuuucuauccuuuuuuuuuuuuuuuuuuuuuuuuuuugaggcagagucuugcugugucaccaggcuggaguccaguggcacgaucucagcucacugcagucuccaccucccggguucaagugauucuccugccucacccucccaaguagcuuugacuacaggaaugcgccaccacucccagcuaauuuuuguauuauuuaaauagagaugggguuucaccauguuggccaggauggucucgaucucuuaaccucaugauccgcccaccuuggccucccaaagugcugggauuacaggugugagccaccgcaccaggccuccuguccuuucuuuaaugcacuauuccagcuuuuuuuuuaauaucuugccagcuuuugcugauuuucaugccucccucugcaaccugugaucucuugacuuuaauaguaauguuuauacagagucuugacugcacacucucuucugucaucguuguuuguugugucucauuguccccaauccaucagaaguucuugguacacaaagucccugaagcuguaugaacaaugcccugacgucuugaaaggacuugccauaggugguuauuugaucacuuagcagaugccuuugggauccuacuuugugcaggccacucuccaaggcacaauguggcaaguaaauauauuagucaauauuuacagaaccaagagaaagccagcaaugauuaaugcauaaacagucauaaauuggccauuuuauuuguuuauaaaagcuaucauuuacuacagagaaguacaagugaauaucaagcucagaucaagaccuuuggacugagcuuggcuuuuuuuuuuuuuuucuuuaaagauuacacuucucccccaaaucaagcagauuaaccauaggaaguuccuugccugcuaacagaauauaaauagauugcaugcaaggggaaggaccuuaucagggcagauuuuaguauuuacacuaaacccaaaagauuauuuccuuaauuguacuugugagugaaaaacaaaaauuguagcaggagucccaagagcacucuggccaugggcuuuugagcugugaguugaagcacuuuauucagcauguggcugcaggguuguagcucagguuguagacagugcauucucuucaggucccaggaaacagugucauaccuguggaagccaccagaaugcaccuucaucuucuccagugguggcgagguugaggccaagcaucagaagugcugagugcugggaaacuguggggcuggauagauggcagugccugcugggaagcacacagcccuggguugaggcagggaagcagggccgcccaguugggauucauucguacuacuggccccucacaguaccgucauguguggguggucgcgcuuguccuacaggaaguaaaccacaacuacucaucucacacagucagcccggcaccuccuuggaauucccaaaacacuuuccaauaaacauuggaaaggaagaaaguuuaguugguaacaaaaaaauguauguugccuuacgcccaaaagcauugaaagcagggacucaagcagguacucaugcagcccuguugauagcagcauuguucccaguagcugaaaggugggaacccccuugucugucagcggggaucagcuaaauauggcacacacauacuauggaacauuauucagccuugggaaggacaccuccuaucacacggaugaaccuugagaacauuaugcuaaaugaaauacaccagacacggaaggacagauacugcuugauuccacuuguaggggccuguagagccgucacauucauagacaggaaguagaauggugguugucaggggccaaggggaggggcauggaaaguugcugcuuaauggguacaguuucaguuuugcuaaauacagagaguucuggagguugguugcccgacaccauaaauggacuuaacgcuacugaacuguacacuuagaaaugguuaaaaugguaaauuaggccaggcaugguagcuugcggcuguaaucccagcacuuuggaagucugaggcaggcagaucacuugagcccaggaguucaagaccagccuggacaacauagcaagacccccaucucuacaacaauuuuagaaauuagcugguggcuuacaccuguagucauagcuacacaguaugcugagguaagaggaucacuugagcccaggaaguugaggcugcagugagccgugaucacaucaccgaacuccagaaugagacccugggucacaaaaaaagaaaagaagaugguaaauuauauguuauguguacguuaccaaaauuaaaguucuuaaaaauauauauuuuaggccagacacaguggcucacaccugaaaucccagcacuuugggaggccgaggcaggcagaucaccugaggucaggaguucaagaccagccuggccaacauagugaaaccccaucucuacuaaaaauacaaaaauuagccaggcgugguggcgggagccuguaaucccagcuguucgggaggcugaggcagaaagaauugcuugacccagaaggcagagguuaccgugagccaagaucgcgccacuacacuaccagccuggguaacagagugagacucugucucaaauaaauaaauaaauaauauauauauacauauuauauagauagauagauagauuucuuacaaaacauuuucguguuuaaaaauaacaaaucaggccaggcacaguggcucacgccuguaaucccagcacuuugggaggccgaggcaagcggaucaccugaggucaggaguuugagaccagccugaccaacauggugaaacccugucucuacuaaaaauacaaaauuagccgggcgugguggcacaugccuguaaucccagcuacuugggaggcugaggcaggagaaucacuugaacccaggaggcagagguugcagucagccaagaucucgccauuccacuccacccugggugacagagugagucucuguauaaaaaaaauuuuuuuaaauaacaacucagccauccacucgcaucaauuuauucacuagucauucgauugcuauuacuuugcucccaugugaguuuuuuaaauuauuaacagaaaaaucacacucuuuauuuuugaauuaugaucuugaguucaguaaagaaugcauucuguugauuaaauguguuaugaguaacaguaucuuguuuugcuguacuuccaagcaaaauguaauucuuucaguccucccuaccguucucacuccauaauaauaugacuuaagguuuguauagcaugacguuuacaacgugcuugcguuuuacacugacucaacgugugcaguacagugauguauagugaaguauucacauccucaucuuagaaaugaggaaauaaauucagggagguuacaugauuuaaccacacauaaggaggggcugcauucucucugagcccuucuaccucacacagccaccaagcuccuuugugcagagcccauggaggguuggaguggccacacugggguaggugcaggccagagacuggaugcaacaggaacauugccugcuucccaaaaccacuguucuacugcccggagaacacacccuucugggagcugacuucuaacaaagcaagguccuuggacuugcccugcggcuucuuuccugcaagaaguaucuuccagcauccuaccaacuuuuauuucuuaaaaaagguuguuccuugccaggcauugguugaucagcagaggagcucgcauuaguuucagugcaguguugggagcaagcacuugagugcccagcaacauaggcugcucaugaucuaagauucauggaaaaagucuucugcgcuguugccugcagcacaucaacaccugaauuuucuuaucaucuuguguggcuauugaaccacagggaacccaagcuuagucaauaggaaauauagaaauauucauugguucaacuguauagggagggccuuguauauauuccaggggcuguauccuaucuugccucuagguaaauaagagauggucccgaggcucaaagaguuuaucaaccauucuuuauucuucagcuaauaugaacauugaaucuuuuacauuagaaguugcccaugcagggcacgccuguaaucccagcaaccugggaggccaaugcaggaaaaucacuugaggccgggaguuugagaccagccugggcaacauggugagaccucaucucuaccaaaaauaaauuuuaaaaaaaguuacccuuaaauuucuuucucuaacccagccucaacuuuguacucaggcaguaacucuuuguacaacauuccuggcaccauauucagcuuauacagaacccuccaggcaaggacaggucacugcuaagugagagagcucugguuauuauaguucuuccuuaaacacugcacucaaaacgacuuccuucuaacguuugucccuugguucacauucugcccuccuuucgauuuuuuguauggcauggcccuccaagagauuucagugucaguguggugcugccaagucugugugacuguucacacacucgggcuccauucacacaccccaagauugcaugagcuuuugcugcagccacucacagucaggccccagugaaucccuguccucugaagcugcagguaggagcgccccaagggcaucuagaugucaaagaagaggaugcucacaugugccuaagguucauccaugaaggcuucguggaggagguggcuuuugggauagaucuuagaaagcucagagaguuuuaacaaagauugguccuugaagauuacuaaucuuuugacuuuauaaauacuugcauauaucuucuuccagucugucucuuauuuuuugaccuuauuuauaaugucuucuuaaaacaaguuuuaaauuuugcuguagugaaaucuauauaucauuuccuuuauggguuauucuauuguuaccucauuuaagaaauccuucucuacuucagaauaauagaguucccacuguuuucuuccaauauguagaguuauaauuuucaaguuuaugccuuuguuccauauuggguuuauuuggaggccugguaugugguaggaauauaauuuuauuucucuccagccaaaagucagaugguagucagccuuucucuguugauuugugucaccucuguuauauacuauccugcacaugcugagugucuuuguggguucuuucuucuuuuccguugauuaauuugucuauacuugugccaguacccauggaauuuauuagcauaguuuugugguaugauugauagcuaguagaaaaguccucuuucuuuguucuuuugguuuuguuuuauuuuuaaaguuaucugacuauuuaugccauuacccuguguuaguucacucucgaguugcuauaaaggcaucccugagacugguuaauggauaaagaaaaguaguuuauuuuggcucaugguucugaaggcugugcaagcauggcaccaacaucugcugggcuucuggugagggccucaggaagcuuccacucagggcagaaggugaaggcggggggagccagugcaucacauggcaagagcgggagcaagagauggggugggaggugccaacaagcagaccuccugagaacucagagugagaacucacucauuaucgugaggacaguaccaagccauucaugagggauccgcccccgugauccaaacaccucccaccuggccccaccuccaacauugaggauuacauuucaccaugagauuuggaggggaccaccauccaaaccacaucaacccuuuauuguaaguuucagaacuaauuggccaaguaaccaaaaaugagcuugggauuuuuauuggacuugcauugaacugaguaaguuucagagaagugacgucuguacaguguuaagucuccucauccaugagcaaacuauuuuccuccauugacucagacucuuuuuaugucccucagugaaagguuauaaggcuugcaccuucauuucuuuuuauuuguuagaauauucaauauuuauguuccagaccacagaacaccucuacaguaauaaaaacuguaguaaugaaaaacacguuuuaaagcaguuuuggguucuaucaggguugggaggggaagagugcuagcuuuuauuuauuuucucuuggguaacucuuguaucaauaguauuucauacaaaugugacacuagcuguugccaagcaaaguccuugaggcacaucacgggagacuugugccccuugguugacaucuguuccaucagcauuugguucagcaguuguucaccaaacaguaaauccacuaauugcaucaugcauaugcuuucuuuuuuuuuuuuuuugagacagagucuugcucugucacccaggcuugaagugcaguggcgcgaucuuggcucacugcaaccucugccucccagggucaagcgauucuccugccucagccuccugaguagcugggauuacagaagugcgcugccacacccagcugauuuuuguacuuuuagcagagacgggguuucaccauguuggccacgcugaucuugaacaccugaccucaagugauccacccaccucagccucccaaagugcugggauuacaggugugagccacugcaccuggccacauaugcaucuuuacccacaggaggauuguagauaauuuugccaaauguguuucuuaaauuuagaauuacuuuaucuguggaauauuauuuuccuaaugaaucauucuuguuucugaagaucccuugccguaugcuaucaauagucuguguccugguuuucaaucuaacauuauggaaaucuucuccuccaacacacuuauuugccuguaucuagucuucucacauuucuuccaugccacaugacuucucauaauuugcuuaagugacaguagguucaaccucugauuuuccaauauaguguuugaucacaucagcauuuauguuaaaaucucaauccauuacugcucaugaaaaaauacuuguuuuuaauacuaugaacccguauucagacccacuuaaaaaccagcacucacaauuucguugggagacuccuguccugacauauaugauuauuugaaaauuauaguaaacaggccaggcgugauggcucaugccuguaaucccaguacuuugggaggccgagguggacaguuugcuugagcccaggaguucaagaccaaccugggcaacguggugaaacccagucucuacaaaaaaugcagaaaaaaaauuagcuuggagucauggugcaccccuguagucgcagcuacucaggaggcugagaugggaggaucacuugagccugggagguugaggcugcagugggcugagauugugccacugcacgacagagugauacugucuuaaaaaaaaaaaagaaauuauaguaaacuauauuuuuuuaaugcuacaauggauaaaaaugguuacaacuagauaagaagccucuaaauugccugaacaccuaagacuuauuugcuaguugacaucugaucuauuucugacacugaaaauuucagugcuuuagggugcuaaaaggaaaaaagaggguuugcuaggaauccugcaguugcugaggggguacucugauaagggaauuuuaagcaauuacagaacaucucacuaaaguuuuuaaaaaaucuuuaaccagauuaaacuuauacaauuuuguuauaauuuguguuucuccagguuccaauuguggacaagauaaggaccauugcucaggcugucuauggagccaaagauauugaacucucuccugaggcacaagccaaaauagaucguuacacucaacagguaaaaguucuacuuuuaggggaaaagaaaaaauucaccuuaggcucucagaauacucagcuugacuugaggauuuguacauaucgcaccagcuaaccuuugcuuaaucuauuguaugguuaacaaagaugaagguaauauccucggguagaguguagacuauauuuagaacuuuauggugaggcauauauccucugauccaugcaucauuuacuucugugacuauaaaugugucugauaugggugguaucccuguuuuuaggugaugugugaucuuucaucccucccacucagcccugaauguugaagcuauccuuuggaguagagcugcggagucagauuuagaugaauugcaaugcuuccucuuccuuacaggccucuuacuuacuaccuuaaaaaugcuagcguggugccaggguaggcagauaggagugcagccuauaaagaugggaauguuugcuguucuucuuaugcaagcgguucacuggcuuuuuacugagcuuguccgcugagauugaaggcuccaucaucuucuaccucuagccacugacaaaggcaaguaggcaaacagcugggaagguggcugugaucugacagcaugcaucaccaucuaguccagugacagucaugaucaaucaacuccacuacaggaggcucagccaccuucaccaaaaggaccguaugccucgagugucccuccuacuuugguguagucggauagauagcagucagaacacuuuaagagccugcuggcuaaagaacuucaugauggguagcguugaccuuuucuuuaaaaaaaaucuccaacuccuuauucuuuuuuguaaacccauuugaaauuuuguuaaaugcugccguugccagccaggguauuuguucuccuagguuugguaaaauagucagcaacucaggaaguucuaaauucuuagaauuuucccuguauguucuuggcuuauccuuuacaaaaaggauucccaagcacugcucugugcacaggcauuguggugaaauuuucauucaugugcaaugaaccaaguaaaauaaggucauucucauaagguugguuuguuuuuuuuuccgugaguuuuuaauaaugauauuuaagacuaucauuuauucuaauauuaagucuuuucuccuuucaguguuaaaaugguauuucuuuuaugaaguaaucuggugagaguauauggcauauugguugguuuuuuucuuuuuaauaugccuacugacaaaauuuuuacauuagcaaaccuguauuaguucauagaaauuacuucaauauuuaaccaugucugaaauuuaaaauucuggcaccauuucugaaagacaguugugauugucacucagcaaaauucuuaucgguauagaagaguggagauuucaaaaagaaaauggccccaaguccaaguccucccugaguugauaagacucuaagaucuuccaaauaguuuuaggcuaagucuuaugaaaauuuaacuaaagauuucauucccuuuaucucuaucaaggaaauauuccuuaaaagugaugucaaccgggcacggugcucacaccuguaaucccagcacuuuguggggucaaggcagaggaucaguugaagccaggaguuugagaccacucugggcaacauagcaaaaccuccaucucuauuuuuauuuuuuuuuuaaaguuagugucaaguaugugguugcaaugaauuagcaaagccucuaaaggaacacugugugccauuuaaucagaaccaggcuuugaggacacugugcuuuuugugagacaccacaugugacuuccugcucuuucaccuuuggaacucugggucagacauagacuuugguccuuaaaaacaagaagcuuaaauagugaccucaucuuaguucuuauaauguaauugcagaucaaauagccaugauucauaaaccaacacaaaggaacccuuugcuuccugacugacuccagaaugagugaacaacaugaguaagagccucgucgcagagccuuucuccagacuaccuugcugggucccggauauuaauagucuuggaaagugguuucuacagcugcugcuuugccugaaaauagccaugcuuuccccaaacaugcacauaacacugccuucucuuaaagagagccuccaaaauaaacaauagucacccuugaccugcuaaacagucaucacauggagaugaguuuuuauccucaccuucuugcuucuucagugaacaaguaguaacaagcagcuccugcgugugccucgaucugagccggcauaccauugcugccgagacuguauaaagugcaaauugaaaagcacaggagacuaacaucuguaucagugaacacauuuucuuuccuuucucacaggguuuuggaaauuugcccaucugcauggcaaagacccaccuuucucuaucucaccaaccugacaaaaaaggugugccaagggacuucaucuuaccuaucagugacguccgggccagcauaggcgcuggguucauuuacccuuuggucggaacggugagugagucacauuuuccaaaaacccuccccauucugcauugcuguggugccucaaaucguuaugcuccgcccgcucuuuaaaaaucauggauuagggaaaauugggaguaauuaauaguacaguauucgcuauuuuucuaaacacugugucucaccuacuuuugccauugugguuuggauuuuucuuuuuuuagaucauguguucaggguccuuagagucauaauacuaauuuccuuccuaaggugaguaagaacauaacuugggagaauucagucuguuauuuaaaugguagaauggcuuaagacagugguugucaaccuuuaucacacauagcacccaaaaugaugucaucacggugggguugacugcucacaccagacaggaucugcccagucaccccaagggcuggggaaagcaguccucacccucucucacuuccccagcacgucaggugggaagcucuggcuuaggaaauuacugaaucauaggaguucucauuuuugauguuguugugaugggaucauguugcuauuggaugauuauucuguuauuuuguguuaucuauggggguaaaggagaugggcagauaaauaaaagcuuaucaaagugcuuaaaauccaugaagaugggcuucauuugguacagcuacacagugauagccuuccguugguaccgucaguggccuaaauuugacuucuugucuuugggagugcuccuaaauuugguuuagaacaaaaaagaauucuuacaaccuagcagaucccauggcaagcaaagaaaaaaauauucuaacccaucauuaucgucaucauuagugcaaagugaucugagcuuaaacagcauacauuaucauaauuuuuuauaauaaaccauguugcuuuauugugcaaacaagcaauagauagauaaaaagugcagauucuugccuugauauuuacauacuucaucuaauauuggacacaauguuuuuucaaucagcauuuuuugaauucuuccugcaugugaggcacagagauuuuaggaugagcaggugugagacgcauggguuugaauagcacagagguaucuggagagcacuguguugguauucugaaugcccucagagcccagggggauaacagcucauuaugccugggguagaacuuacccaggauguggaagaagaggggauucuucaaaaagagcucagccucugaacuggcaaaacagugaguuuugacucaaaggcaccaaaguacuaauacaugacauccucuccuggggugauccgauguggcuggaguuggaugaggggggguggcuggggaugggaaugggaaugggauugggauagcaggacagggucacauggccaaggaucuugaagaccaucucauggaacuugaaucugaucucuacacacuggggagccacgguaggguggguuuuuuguuuguuuguuucuugguuuuuuguuuuuuugguuuuaaauaaggaggagaagaauguggucugauguguauuuuagaaaaauagcucuggcagcaauauggagaauguuuagugaaaagagaaccaggcccagagagguggguuaauucagcucgggccagaggcaaucaagguccgcacuuuggccacagaaguagauacagagagugggggugaauugcagacauacucuaaaaguauccuccuaccgugggggccgggggaagggaccguucuagcuuggugacucuggcuagugaugccaucggucauggaaaggacacgggagaaggcagauuggcagagccagaaaugagccuggcuugaacagagagagcucagaggguuaauaggaucuaaggaauagucugugucuccacuggaaauacagacacagugcuucaaagaaagaggcaggaaggucacccugguggguuuaaggauaugggugaaggcagucguuaaacaagagacacagggauagcuggaaaucagugagaagacagugaaggaagacaccccugaaacacccacguuaaugcagccgacuccuagcaggggugccuuccaggaggcgggaaggaaggagcagcggcauggcagagaacguccagaaaaaucccacagacaccgcucguagcaguguuggcacagggagaagggccuggaugaaauggguucugaaugacauuuucaggucuacaguucagaucagugguugccaggaguugggggaggggaagcguuugacugcagaggggcaggagggaacuuuuugggauaaugcaaauacccuauguuuugacgugguagugauuccauggcuauauacauucuuccagacucauagaccuauucacguguguugcccaggcuggacucaaacuccugggcucaagcaauccucccaccucagcuucccaaguagcugugacuacaggcucaugccacugugccaggccuguguauaauuuaauuauaccucaguuaacaaaaaugggugcugaagagcuugcuuuauauucguuagaauggccucagucagccgggugcgguggcucacgccuguaaucccagcacuuugggaggccgaggcgggcggaucacaaggucaggaguucgagaccugccuggccaaaauggugaaaccccaucacuacuaaaaauacaaaaauuugccgggcgggguggugggcaccuauaaucccagcugcucaggaggcugaggcaggagaaucgcuugaacccgggaggcagaaguugcaguaagccaagauugcgccauugcacuucagccugggugacagagcaagacuucaucucuaaauacauacauacauacauacauacauacaugcauacaugcauacaugcauacauagaauggccucagugauggccacuuuacuccugagcuuuagcuggugaaagccuuggcuuagggauaagagggcggcuggacagugcaggcccagagagacuggaccaucaggggaggugaggggugacggaggugcccaaacagagcaugaaaugguagaguagcugagaagguuagccucagucacgaucuguccuguccuacccucugaggacucuaaaccccgcaguaguucacccaacaaauucauucacucggccaaugcugcauaaggcacucagcucggggcuacagggagccccaacuuuaagaagcuuucucugcuucagguaguuuacaggugguagacgcagauagaagugaauuaguaaagagaauaguuugguguaaaaauugugcauuuaacugaaaccuuaauucacuacugagcauuuaauagccauuaaauaaaaaccagggcccgcacaguggcucacacuuacaauccgagcacuuuuggaagccaagguagaaggauugcuucaggccaggaguuugagacgccugggcaacauagccagacuuugucucuacuuaaacaaaaauuagccaggagucauggcacgcaccuggagucccagcuacucaggaggcugaaaugggaggauuacuugagcccaggaguuugaggcuacagugagcuaugaucauaucauugcacuccagccugggagauagagugagaucucugucucuaaaaaaaugaaauaaaauaauaaaaaacacaauauaauuuaaaaucuuuggagucacuaaacaaauauacaaugugaaucuccucucacuccagcuaacgccaccauauccaacacuagguaaagaccaaagccguucuggaaaaucagaaucuguugccauggcucaugccuggacaccaggcuguccgcuccugacgucacucuuucacuuacgacuuguuagaaaaugaauguguggaauggcccuggauagcugcugcagcucccugguuuccugaagugagcccucugugucauuaucuggucuucucagcccucagccgaguuccuccuguggccacacacggggucgcagugagcgucagugcacagugaugaaaucuccuggaacagucggguguggggcaugaggaagggaguggugccugacuacagaaguuccuggaggucaggaaacucucacuggaggcgguggcccuagagggcugcuuucuaugacagagcaggaagcugcauguguagugggacacacgcaccagaggggccaggaucuccuaauaaggacugguauuuauuuuuacuugaccccauucugggccuugccacagucugcugaaaugccuugaacauucaucacccgugugggagacaggauaguaauuuccugcugagaugacugaggggacggggaauggggacaccagggggacuggcuccugcaggugggaaaauucuagcaaaaugaaucacucuucugcuuagucacccaaugugcacuuauuagggugcugcugaaauacauauucaucuauccacuccagaaagauaguccaaacugagaccucaggaucagaaagccucccauucuccugcaggguucauucauuuacucagugaauuauuaaaugccuacagcacgcagggccaucagccccacagcuaugagaaagauucaguccuucccucacaggccuuaugauagacuccaguaaauaaaaccauacaggcacagaaugcggcgggcuuuauaacaaaggcagaaagccccucuuguuguguccucaagggaggcagagaagcuccccucuggcucuaguuggagaaucccaacccaagcaaguccauccuuaaacaauaaacaucuccagcauugcuggcuuuggaagaccccauggugagaugcuggagcuuuuuuccgcuccagauuucgcuucuaaauauuuacuuuuacuuuccauguucacuuauaggccaggguuuuuuuuuccuaccauugaauuauuucgucauguucuauuuaauuauugcuuuaauuggcauuggugaccacaaauaauaauaaauacuauuaacugguguaacagcuucacuagucuauuucacugccccaugcuguuguaacugaagcccccagcacaagcauucccagcucguggucaucuaagaccuuugaggucauucuuacaugcauugcuaguguuuuccauauuccuugaugguagccaauuuuuccuucuuaaaauaacuuucuucauuccuaguaagcuucauauguauuuuauguauucuucccucuuuuuuaugacaugauacauauuauugaaagcuaggaaauaaugcaagauucuugaacgacauaauaccacuuaguacaucuuuuuguaagagauaguuuuucuaauacaaaucuuugauaugggaagaaacaagcaaguuguuuuuuaagguuuuccaacccuauauucuacuacaaauuacccuguuaugguaugcuuccaaaauucuuucaaggauuaugguuuauagaguucaauaaaccuaauaguuuauaaaacuucucaaaaaauaaucucaugccaaaaauaauuuaguaguagguggucuuugucuuguggucacaugguuuugauauugucuuuaaguuucuauaauuuacaagggcuguuuaaucaguuggcauaaauuucaugacaaaaauacuaauauguaagcaaaguauaugaaacaauauuauugagaaguaaauuacauuccauguagaaaaagacuagaaagacaacaccaaaaccuuaaauuagacaguguuauuaugaguagcuuuuuuucuucucuuuuuccauauagaucaaauuacuacauugggcguauaucacuuuuauaacaugaaaauacaguaaauagggcgaugauaaacugcaagugcuuggggagaaugcuuaacucaggccaguugcaagagagugagaacacacacgcagccugugggagcgggcuccaugccaucaccuggccgguccuggcuguguugcuguguuuucgcaccucaaaaguugggacagcaaagaaaggccauaagagcuagaacguuuccauaagaaguguauucaguaugauuugucuagcucugacuaaugugugcaaaccccacauuccacuaagcaaaugcaagauuguuuuucccuguucauuuguuccugggcccuucuugcuuacuguguugggaguuggagaggggauaauugacuucuuucuucucacaguguuuucucuuuuuuuuuuuuuuuuuuuuuuuugagacagaguauugcucugucgcccaggcuggagugcaguagcaugaucucggcucacugcaaccuccgccuuccagguucaagugauacuccugccucagccucccaaguagcugggacuacagguauaugccaccacaucuggcucauuuuuuguauuuuucaaagagacuggggucucaccauguuggccaggcuggucucaaacuccugaccucaaguaagccacugcgcccggccaucucucacaguguuuuuuaaaacaacaaugcauuuucauaacaguuggccuggagagguguccgaccaaguuggaauucauaguagaauccauuggaaguuaauuuuugauguauuugacuguuuuccauugacuucgcauugaggcagugagagagacuugaagaacuuagaauacgcacccuuuugucacuggcaaacaugggacauagaggcgugucuugacagcaauuuguggcaacacucugggcuggaaucuagggguuagacagccuggccgguuuuguaaauuagauagccaggccacccucagagucaguuugaggguugagugggaagccugaauaaaaagagaaguuaaacuuuuaagaaaagggucaagcuuuaaaacuggaauuggguuuucaaauuuaaugaggaaaaagaaaccccaaaacuggaauuguaauuguggagaaauacaacugauaauauuuggaauaucaucuacaaggaaugaaacuauccagaagcauuuagaugguagucagugccauguagggcaccucugggggcaggguggcuccuggcacuguggagaaagacgacuggugcuuccuucucccaaucggaggaaagggauacacuguggaggucccagcagcuuagggccugccccccaugugguuaucucugugccguuuccuucccucugucuuccuguaacuccuucacuuuggccccucugcccuuucugggcagagggugacaggaggcaccgcauggguacauucuuuuuuuuuuuuuuucuuuuuuuugagacagagucucacucugucaccugggcuggagugcaguggcgcaaucucgacucacugcaaccuccaucuccggguuucaagcgauucuccugccucagccucccgaguagcugggauuacagguggccgccacuacgccccgcuaguuuuuuguauuuuuaauagagauggcauuucacuauguuguucaggcuggucucaaacuccugaccucgugauucaccugccucagccucccaaagugcugggauuacaggagugagccacugcgcccggccaacuacaugcuuuuuuccuccugucgggauuggccugggcuguaccuaucucaugguggaaaccugcccagggaccaggcccuagaagaccagcaguuuauuuaacuggguuggccuuuguccccacucccugugacccggcccugccacaucuuuacccaggugcaccacugacaucaucgcuuggcuggacucuggaaagcaggaaacugcuggagcguguuuggggcaucagugaugucacccgcuacaaaugcugggugggguuacuggacugagggccaugaaaaaagaaagcugcggccccggcccguggacucacugccauucugcucuuucucacguuucaguucagcucgguuuguuuuccgucccccucccucuacuguaaaaguauguacucaguguuucguuuccugcuggaucugauucaggucagugaugaaguuauuugugaacucaguggggagguguuuccuccccuuuguaccggcccuacuuagggaugcacgguugguuauacgcuugcuucacucgguuaggcauggaggagaauucauucagcccucauagguuuaaaucaaaugcaugacccuucacauuuuccagagauuuacggccaguuacaaugagacaauuaaacauucacccccccgccaagcugcacuuggagauguguaagcaguaauguagucaugcgcuccccaugaugugagagcgugcagaacgccacuccccccagcagguccgccaggaccuccgcagggagcaucuugccugcaaaaucacacaucccuuuuucccccucucuccacuuucccuacuacuuuuccacucccacacccacaaauaaacaaagaaaccuugagcuuauuuuacaaaagucuuugaaauggcccucgucucuccaaugcuccuggguccugguuuggccccaucugugcaaucucucugaugagugugaaauaagccagguuuggcucaugcucugccggugagcuugcccuccccaugagccuguccucuccaucuggccucacuuuguuugugucccuguguccuuugucucccauccugggauccuggugguuuccuccuccccucccagcaugaguccuuuuccccaggguucuucccuaucucuacaucagaauuuccugcuuucucccaaauaugcauuucccuggcccaggcauccacugcuuccucucaucgugaggucccugccgcaggcugcugaugguauuguggccgugccuuccuccacaacccagggaaagcuacgugugugucugucccauagggaaggagucaucccugucuccucagugugguguguucaggaggaaggaaaguaaccagcgucguucucaauuuccagaaacuguuuaucauauugacaagaagaagaaagcuuugugacucaugagaaugauguuuuccucucugguacauaagguuaucuagguccaauccauuuguguagaggaucuucucuccccuagugugauaugcacuuauuuuuagcacaaguauaaaacuacuuuaaaugaaaucagccucagccagggaaauaugcugaguaauaauguugccagguacuauaccacugaguugaguuuguaauucacugcuauuaaucccuguguauuaguucugauuuuuuacucuuugcauacauagaaaaaugguguuucucuucagagucaaggagggaaaaaaagaaaagauaaaagaugcuuauaacacuuuuguguccaccccuaaaaucagcauauugaucuauuauuuuuucuagguauugaugagauguugacucauauacuuucauacaacugguaauauauauauauauauaauauguguguguguauauauauauauauauauauauauauauauauauauauauauagacucauuuuucuuccacuuucaucuacagccuacuuguuuucuuccccccauuuuucguauggauucauagcauaaauugacaacaaagauacaucucaauuuagagcuuccaaaaggcacccauaaaaguaucuggugcucauggaauugcucuuucuucuaugucucuuaguuacacuuuucucuuauuacacuuuucuaucccagccauggcuaagaggcguauaaucagaagcagcuaagcaauauaugcaagggaaauaaaaugaaugcaaaccaagauaccgguuuuguaaauuagauagccaggccacccucagagucaguuugaggguauagugggaagccugaauaaaaagagaaguuaaacuuuuaagaaaagggucaagcuuuaaaacuggaauuggguuuucaaaucuaaugaguaaaaagaaaccccaaaacuggaauuguaauuguggagaaauauaacggauaauaucuggaacucgcggcaguuuacaggcuuaacuauguauguguuccuuaaauuauccacccgcagauaucagauuacaauaaguccucacuuaaugucauugauagguucuuggaaacuaccacuuuaagcaaaaagacaugaugcauaugaaaccaguuuucccauagucuaauugauaggaaaaagaguuaaguuaugcagccacacaguaccucguuuggcuuaaagucacuguuuccaagaaccuauccacaauguuaaguaaggacuuaccguauaugaaaauauuugcaguaaauugcuuuugagagaauugguuaucacacucuucucuggguaucauugaaaauucagaauguuuaauuacaucaggcuauacucacugguauaaaaucagggagcaaguauaaaguagguguagggaaauaauuuauguuggauuaaaugauccaaugaagggauuuuauuaagccccuagaagucccagaaugaaaauguauaacugcaugacuaaccccuaagaauuugcugggguuucugcauuaaguacgcuucccaggccauuuguaaugaagguaccgugaucuguuaaggaagagaccuacagcugggaacaaaaagagccaauuccauccuagacaucagucuccuguuugacucauuccaaccccaagaauauguuguagaguguaggacccaugaaaguuacuuacugugcuucccuguaccuuccgucauccaguucccagacauaucuguguuucuucucugaaugccuaguuacuugggaucccaugcuguauuggucuguucucacacugcuguaaagaacuaccugagacuggauaguuuauaaagaaaagagguuuaauugacucaguuuuacaggcuauacgggaagcauggcuggggaggccucaggaaacuuacaaucaugguggaaggcaaaggggaagcaagcacaucuucacauggcggcaggaaagagagagagugaaggggcagugccacacacuuuuaaacaaccagaucucaugagaacucacuaucacgagaacaacaagggggaaauucacccccaugauccagucaccucccaccaggccccuccuccaacacugaagaucauaauucaucaugagauuuggcuggggauacagcgccaaaccauagcacaugccuuucccaggacuggugauggaggaacggugcccuugucacaccuaccagaauauacucacccaccuccagacacuccauuucucuuucaagcacaccucuucacuugugccgccagcuaagguuuacugcaguuacuuccuuuguguguccucuuaccuuaccaagucgccucacccaccaucuacuguuaauuaaauuaccaccucccccacuucccaccuccagaguagagacugugucuucaguucucuuggccuucccacaaugggaaguccaguguagaacauacccuaggagccaacuaaaugugcuaguggccugccaacccugcagagggcuagggaaucuucaaggagucugcugccagugaaacucaccaguacuagaaucccaggcuccaaagaagucuagaaaaguacaucuuuuaaggagguaauaagaggcucaagugcccacaaauccuaucugcucuuggccuaguucuuuugggaucaaugugcuagucucucuugucgaaccaguuacugaccagcaagacuaaaaaaccaggcccaaacacauucuauucaugugcuuagauauggaccuacggaucaaauaucccacuguaaagcaaaacagcaaacuguuuuucccuuguacuuucacacucaacaauagcacgcuucuguggcuggcugugugggggcuuuuccuuacacaccaaauauuucucacaaacaccaaccagguguccucuuauucaauucaauccugacacugucuaccuggagauggugucggaucccacagauugacggcucagucccaugagaccagccccacuucaggcacuaauugcaaauccaggccaugcauacuucucugacugccuggcuaaaaaccgcauucacagccgggcacgguggcucaugccuguaaugccaacacuuugggagaccaagguagguggaucacuugaggucggagguucgagaccagccuggccaacauggugaaaccccaucucuauuaaaaauacaaagauuaggccgggcacaguggcugacgccaguaaucccggcacuuugggaggccgaggcaggcagaucacgaggucaggagauugagaccauccuggcuaacacagugaaacccugucucuacuaaaaauacaaaaaaauuagccaggugugguggcagacgccuguagucccagcuacucaggaggcugaggcaggagaauggcgugaacccgggaggcggagcuugcagugagcggagaucgcgccacugcacuccagccugggcaagacagcgagacuccgucucaaaaaaaaaaaaaaaaaaaaauuagcugggugugguggcgggcuccuguaagccaagcuacuagggaggcugaggcaggagaaucgcuugaacccaggaggcggaaguugcagugaguugagauccugccacugcacuccagccugggagacagagugagacuccaucucaaaaaaaaaaaaaaaaaauggguucgcaugagcccccuccuuggguucaauuaaguuccuaggauggcucacagaacugagagaaacacuuauuuacagagguguuaugauauauauugauuuucguccaugguuccugguuccugaaucccauaaaccuucuuacagccuuuuguuauaauguugggggugucacgccucaggggcaggccucugaccuucccugcccuccuugcacuguaauguuucccccauuucugauugugagucuuaagacccucccaugagagggucccacccuacaccuugugggaaggaauguggaugucaugaaguguccauaaaaacccaagaggacaggguucaaggggauuccagauagccagacauguggagcuuccuggaaggcagggcacccaggucgggcauggaaguucugcaccucuucccccauaccucgcccuacacaccucuucauauguguccuuugcaauaucuuuuuguuguuguuguuuguuugagacagagucucgcucugcugcccaggcuggaauacaauggcaugaucuuggcucccugcuaccuccgccuccuggguucaagcgacucucccaccucagccuccugaguagcugggauuacaggcauccaccaucaugccuggcuaguuuuuguauuuuuguagagacgggguuucaccauguuggccaggcuggucuugaacuccugaccuuaggugacccgcccgccuuggccucccaaagugcugggauuacaggcgugagccaccgugccuggccuguaguauccuuuauaauaaacuggaaauguuaagcauguguuuccuuuaguucuguuagcugcuccagcaaauuaaucaaacccaaagaggggaguccuaggaacuccaauuugaaaccaguuggucagaaguuccagaggcccagacuugcgacugguaugguggggggcacucggcccugugggaucugacacuaucucuggguagacagggucggaacugaacuggaagccaccccaccuggugucugcugcuugguguauggggaaaccccauacacauuuggucacagaagucuucuauguugaugacuguuguggugcgacagcagaggaaaacacgguuugaggagagcuuuucccaacacgcuuaugugugccaguuuauuauagaagacacagaugaacaccagaugaagagaugcauagggcauggucuguggaguugggguucaccucccuccuggcacaaggaugccuucaccaacccagaaacucaucaagucuuguucaaggauuuuuguagagcuuaaucuccacuccccgcccuccacccuuccuggagguugauggguggggcugaaaguuccagcccuccaaucuucuacuuacuuggucuuuccauccugaggcuagcuggaggcccaccccgucacuccauuaccuuaagcucagguguuauugaaggagcuccuuaugaauagagcaaaaucaccccuaucagaaauuucaagaguuuuaggaaaccugugacuggaaccaaggacaaagaugaaauauauuuuguaugauagcacacccaccagauuggaucguggggccauauggccuuuaguguggaagcugcuugaccacauuuuccgcccaugcacugccauucucauuucaggcugcgucaucaucaucaucaccaucaccuguucuuagcaaaggucgcacaccuuccaaaugcuuuguauagauuagcucaucacuccccauacucacccugggagcauagucagggauaagagguagaguucuagcgcucuguggcuacuaugguuuaugggaucuuugcgcaggaauaacuggacuuuaaacaucuuggcuuuucuuuucaguaggucagucggcauguacucacagggccgugcaugcugagcauugagacacaucacaagggagugaaaaccugcugccauacccccccagaggcagcaggauguuuggauaaauaaggcauaaacaccuggagaauuaaagcaaguacaauuagugcagccuuugccaagagaaagguguaagugcuaaaugcaguagauguucaaauacggcagagaccacagugggcaggguaggccaagaaugcugccuaaggaguggggcuuggggugaaacuggggcauuugagacacugcaggcccaucacccuggcugcgcccuccugagggaggcagggacugaggcgggaggccuggagaggucugugcgugagccugggggcucauugauaaggagcuuccagugggggcaauaacauuggaaguggagaggauggcaugugugccgggagacgcaguggaguggaagucgccggaacugacaagggaugggaugugagcaaggaguccaggugaguccuggggaccugaaaggauggacccagagagauaaacgacuucaaaccggcacggcagugaagugacugacccgcgagugcccugcaccgaggcugacauuugacuuccugccaaguuggccaucagacaguuagaaaucaauuuuggaguucaggagagaggccagagcugaaaauuggggaguuguuuacauugggagugauauacagucucuacauuuccauccaguucaaaacauucuugcgugucugcuaugcacugugcacugagguuaccaagacuggaaagacccaaucccuguccuggaagcuuaguguuggcaggaggcagacaagcugauacaugcaaacaaagggcucacaggugccaggaugccaagggauacagaagaaggaugguugcuucucuacccaggagugcccugaggugucuuaaaaagaggagcauuuaugacucaggcaggguggcacauuccagacggcagugggcaggagccugacuccagagcgccuuagaggcugccgcugggaguugagcuggacccugaaggcaguaggguaagccauaaauuaggguuaaggaaccaagggaauaaggggaucagaccauugcauagcuccagcagcaccauuacuagcagccugugugaaugaugguccccucuuacaugcccaccaugcaagggcucuaggccauucuucacucuuuaaugcagaaaagcaaaacuuccagcuguuuuccccuacccaaaaugugugagccugagcccagccccaggauggaucuuguccuagguaaccaagaaggccuuaagugucagaagagguagcuccaggcugaauaaagggacaaaugaagcauuacugcacugagaucgcccgucguggggugggucuauacccaucuagucauuaagccucaauaauuugguuucuaaauggacuauuauuugcuacagaucaaaaguuguuggaaacuauauuacacagauaaauagaauuguccugcaaauaaaggaaguaaucucuucucuguuugagauaccaugcaguauuuguccaacuuguacaaauaguucugauccaugagaauccuccacuuucaacuuacuugcugcuauaucccaacuauuauaaggccauggagaccaguagccugguuuccauuaucuuugcucuguuuuuuuuuauggcaugguugacacuaccuccaguagcaaagaguuaacuugucaucagagcuauaaaaucacaaugauaagugaaaaguucucuuuuguacuuuagcauccaagagaaguguaauucccaacuacaaugcucaaaauaauagagaguuuuuacuuugggccugaaaauacuuauaggucaggucuccuaguuggguccaugcuguuguugguguucccucccaaguaaauacauacugaauuuagcaaauuauucauuugugauccucugugccaucuaaaaauauauauaguuuaaaacgcuggccaggcgcaguggcucaugccuauaaucucagcacuuugggaggcugaggcagguggaucaccugaggucgggaauugaagaccaaacuggccaacauggugaaacccccucucuacuaaaaauacaaaaauuagcugggcaugguguuggacuccuauaaucccagcuacuagggaggcugaggcaggagaaucucuugaacccgggagguggagguugcagugagccgagauuguggcacuguacuccagccugggugacagagugagacuccaucucaaaaaaaaaaaaaaaaaugcuuaucauugcacagauagcuguacaguuuuuuauuauuuaugauaacgguaacugacuuuuuguuaaagcugguuuggaaucuggagguuauuuuaauuuugauaacuuuaugauuuuaacuuuuaauuuuaacuuuaugauguuugucauaaaagaguggaaugugcuccuauuuugagauggaaacauuucggcagggagagagaagagagacaccaaaccaccuaacagccagguuccaaggggagauucauucagcgucuuugaagcauuguuaguuuucauuugaggcauaaauuggaaacuuauaucuuucuuuggaguaggaaguauuucagacagaaaaaaaaugauugcuacaacaacaucacgaaaaagaacagaagguuucaugaagaguaauaaaguuaaguuuaugaauuagagcuucagaugggaaaucuuauuuggacaguaaaugguuaaugguacagggacaccaugaugggggaucuuugcagcauugaaaaaacacgcguccauaaauccuucucuagcacuucuuugugaucacagagucaagcugaggacaaugauggagugcuccaguucauccgaagugcacgaguccccuuugcagcagacucugacauucccggccccucuccggaguguuaucaacaugcagucagugcucucuacgucauuacuuuaaaaacaaaaacucggccagcagcaguucaguacaucuucaaagaucuugacuuguaauuuuuuccccugcaucuucucuauugagcacaugaacugacaucuuucuacccccaaauaaucaguucuuucccccuaaauaaaauggguaauccaaaaaagacccaucaaaaggaagcuaaagauaguaaugccuagguaguuucgggaccagaaugauugucucuaaauauguacauguacagugauuacguguuuaaaauguuuaaugacuuggagaaauaguguguugaguggagaaaaaugagauuuaguagagcauaacgucaacaguguaaaaauacauagaaaagcaagcaggaauaaaggaauguuuaaauaaauuacaaagauaaaaauuaaaaccguaauucagccgagccuggugggucaugccuguaaucccagcacuuugagaggcugaggcaggcagaucacuugaggucaggauuuugagaccagccuggccaacguggugaaaccucauuucuacuaaaaauacaaaaauuagccgggcaugguguugggugccuguaaucccagcuacucagaaggcugaggcagaagaaucgcuuaaacccaggagauggaguuugcagugagccuaguucgcgccacuggacuagacuaggugacagagggagacuccgucucaaggaaaaaaaaaaaacuuaacuagaacauuuauugagcacuuacuaggugccagcuagugcucugagugcuuuguguguauuaacucauuaaugcccccagcaccucuugagguagauuaaaaucuccaucucgguuuuacaugcaaggaaaccagagcaggaagagcuucaggaacuugcccuccuaguaaagauagaaaguagcaaacccaggauucaaccccagaaauauuauauacuauguuugugcugaaucuuuuuuuuuuuuuuuuguuuuuggagauggaguuuugcucuuguugcccaggcuggagugcaguggcgcgaucucggcucaccgcaaccuccgccucccagguucaagugauucuccugccucagccucccaaguagcugggauugcaggugcucacuaccacgccggcuaauuuuguauuuuuaguagagacagaguuucuccauguuggucaggcuguucucaagcucccgaccucgggugaucugccugccucggccucccaaaguguugggauuacaggcgagagccaccgcaccuggccuuugugcugauucuauagucuuauuuucacauccuaucaguuacuguaaguaacucuugauuccaagaacuguauaauaggaaaggguagcuuccaauuaucuacucuugcuugauaaugcauuaauuccacauagccuuuaaaaguuuaguaaauuuuaggauaaauuuucgaacuguuauuuccuauuggcuguuagaaaauuguguugcucaaaggggaacaugucuauugugccuuguggagauuuuccuacagcuuuucuggcugacccgucacuugcacucuggaacucuccuaaaccagauacggcccaccacguggcaugguguggauccuggacuuucugucauccguuagguucauauucuugaagcaagucuagaacuauuuucugagagauucccuggcuguuguucuguguuuggguggguuagucaccuuuuuaggugagagacuugauuuggguacacaguuucacaaaaguauugucaacccugcuggccaagugacugacgugcugggcaugggagcacacuccaucggcauggcagaguggauucacuccaugccauugccagagaauaggacuuugaaccacagccacccggcuuuuucugaaaggccugcuugggcaaugaugccuggagaauuaucugaagaaugcagucuguccauuccucuggagauggucuaguuuuuauccccagaccaagcugaaccucuuagagcugugcauuuauauuguguggaauugccuucagcgacguguucuauaacgucguguucuugucaccuuuugagggacacuggugcuguggggaagauccucaccaauacgcaacagcagggcccuguucucucaccugccauccccucuggaaagcucacagagaggguuuccuggguugcuccuuuuccaagcaggacuucuacuguagacuuacagcuccaguuacaagccugugugcuugucuguuuccccacaagguguucugaccugggagggaagggacggaauccuauucaucucugaauccuaaaugccaggccuagcacuuggcacacaguggguuccaguuguggaaugaauuuuuuucaguccugacaauaaauguugggguucuuuaguuuguuuguuguuauugucuguuuuauuuguauuuugggguuuuuugcuuuuucccccagggaaugaaaaugccuucuccauaugaaccagacauauccuggggcuggggcugaguguccuuuguuguuugcucuaauuauaacuaaugaacaguucagcucugguaauuguaggcuugcuggacccagugccugccuucuaacugaaucuugacucugcuccauuauguauuuuccaugauccugauuucugucaaucuaauuuuuaaauuucauucuaaggcaaaccugcucauguucuucgcugaaaucaaccuccccuuucuggaauggacauauggaaaauuggaggcaaaauauaauaaugguggugacucagacugcuuuaaggccugagagaccggccagguacuguggcucacgucuguaaucccaacauuuugggaggcugagguggguggauugcuugagcccaggaguuugagaccagccugggcaacauaaugaaaacucaucucuacaaaaaguuacugggcucaguggugugcaccuguagucccagcuacucaggaggcuggggugggaccaucgcuugggcccaggagguaaaggcugaagugagcugugauugcgccacugcacuccagccugggcaacagagugagacccugucuuaaaaaaacaaaaagacccaugagaccuagacucccccugucaaaaauacucacacacacacauauacgauaagauaguauuucuaccuuuucuuucucaaaacauuccacagaacagucuuaccuucgaggagagccguaugcaugaccuuuuguuuguuuguuugagacggagucuggcucuguggcccaggcuggagugcaguggugccaucucggcucacugcaaccuccgccucccaggcucaagugauuuuccugccucagccucccaaguagcugggauuacaggcgcgugccaccaugcccagcuaauuuuuguauuuuuagaagagacaguuucaccauauuggccagacuggucucaaacuccugaccgcacauuaucugccugccaccaccucccaaagugcuaggauuucaggcauaagccaccaugcccagcuggaggccuuauuuuuacugcuauucagagaaccuguggcuuauccauggagggcuuaagcuuugccuuuucucuugcucauuuccauaccuagcaagagcuuaagcugguuuauugcacugacauucuaaugaaauauaaauagcuucucaacagagagauaagaaagaggaguaucuaguacagcaagacccucugggugggucagggccagcuggggccgugccggggcucugaguggaggagguggcgugggagcacugaugcucgggcucugucacauccguuuuuggcauuuguccuggcaaaggcugcauuucugaucuuucagaaagcuguggguacacuguacagaaauguguuuugcuugcuuugaaggaugaccuacuggcugacagccagccagaauuaauuccauauacauuugcagauuuucaguaugagagacggcaauuagccuacagaaacccauuuaacccccgagguggagcuguauggugaagacuguuauuuaugggagucuguguaauuugccucugugacaagggacagccauggcucaggagggcccacgccacccuccuuuucaaggacuccugccccugccugaguggcuuggccuggccuggccaugugagucuuguggacacgugcacaucagucagggaccccugugguauggaccaaaggguuguuuuuuacuguuuuaacuuauuuaauagcaucucaucaguauuacaggcaugugccgccacgccaggcuaauuuuuuuuguauuuuuaauagagacgggguuucaccauauuggccaggcuggucuugaacuccugaccucaggugaucaccccgugucagcuuccaaagugcugggaguacaggcgugagccaccgcaccuggcccacagagcuucuaaaggaaauguguugguuuuuuaaucaaaguugaggcagugccucagugaggggcaggcuggagcagugguaagcgcgcugaaggagucgggcucucugggcccaaaguccugcccuggccacagaguggcucccuucccccugaggugggaugauguucuccagggccuuuuagcuccaggcugcuacaguucuaaacugguggugguggugguggugguggugguuguggugguuguuuuagaugcagucucacucuuuuccccaggcugggaugcaguggcaugaucucggcucacugcaaccuucgccuccuggguucaagcgauuuuccugccugcgccaccacgcacagcuaauuuuuguauuaguagaguugggguuuugccauguuggccaggcugcucucgaacuccugaccucaggugauccgcucaccucagccucccaaagugcugggauuacagauacgagccaccgcaccuggccaugauuguuguuuuuauaaaaucagaauauaaaauuugaaaauguucuuuuuuggugagaaaugagaacuaccaaaggaguaaaaugcucuaaaagccaucagguccuucccacaguauugaggcucugcucuuaccauuuuguuaaauaaguuuuguuccuaacacucuuugugauaugaaguauucuugcuaaucaagcugcccggagacuggcguuucccagagcaguuucgaaaguggaaaugaugcugcauuuccuacccacagucuggaggguggcugugcucucugcacggugggucugugcugcucaguuacgggaugguaagggaaggcucuaacucggugucuuacaccaugcacuagggagucgcccgcuuuauuuacgagcgaguugaugcuuucaguggguuuuggcuuugccugguuccagacucaagcccuuccucuaauguagggcggguacaagagagacuugagcaaggauauugggauuuaagggaagggcagugcaggccaaggucagcaagaggacaucucuaagaugaacagcacugcauuugugggaagcaacccugccauaaacaacucaguuaacguuuacauaguaaauaauugcauugccuugggcuggaauagggacgccagaagguauaggaccauguggaauucagaaaagggagcccugaagaaugagauuuuauuguucuuaccaggagaguccaggugcuagaguucucuccuuguaagugacuaaccuucucccuuuugguacacaauccucagaugaacggagaugauucauuaggccauucuagcuuaauggaugcaucacugugcaaccacgcaaaugccucauuucugauucacucauuuaauauuuauugaggagugcuggguacuaggccauuagaagaacaaacaacaacaacauaggccuggaccuugcacuugcagaguucacaggcuagagaggcacacaaguuaaauauagagacagcugaaagagcugacgucugggacagagggagcccccugcuccaggagccagggagcagaugccauggggggcuggcagggauagggaagucaggccaggaaugggguuaccuaagccggaucaugaaggacgagaacagacucaccaggggucgagggacaaggaggcagcaaguccgcagcaugaaggcaggagagaacauugcuguaagccuuuaccauggccacugcauggggaggaaacaggagauuuggaaugagcugugacacugggcaggaaagcaagacccaggucuugugaggccuugagcgucaagcuuaggagucaggaccuggggauuuuaaguacagcaauaucauaauuacauucauguuucagagagaucacucaggcagcagucuggaagguggaguggaaaacggagaaauuagucaugaagaccuauuuagaaaguaguaggcaagaaauacccagggccuaaccugagguguaggcaggggaugggaaugagagcaauuaccgaacuagaaugaacuaaacucaaugaacaggagcggggaagagggaaugcagaaauggcucucagauuucugacuuguucgcuuaaugacugggguugucauuuguuuagauaagcaauaaagaaccuagaaacaauuuuaggcggaagauaguuguguugggagccccuaagaccaugauuuauuacagcacaaggauacaaagcaaaauuagcaaaaggaaacagcacguggggucaaguccaggggagcucaggcgcaagcuuccagaguacucuccccauagagucacacaagauacacuuaguuccuccagcauugaacuaugacgacaccugaaauauugucugcagaagaggcucauuagagacucaguccccaagguuuuuauuggguaauggucacguaccaaauuucagucucucagaacaaaagcaaauguucagcauagaccauuuuguuugugaaauuuaggcacagugagccccucuugucaguuagaggauaguugaaacccucccacaauccaaguucucagacucaggccugcuacauuauuucuuuccuacacaguaguggauuugguuacuaacauguuggaucugaagcauuuguuguaauuuacagugaagauguccacugcacaguuccguauugagucugagguucacuggagacaucugugcuaucaaugaaaguuucuggagucauuagccccucaaagggucauuaaaaccaggucuucuagagagaaagucuaacccuguauuccuuuaaaccaccauagagaccaucuaguucuucacauuauaaaaaugagaaaacugaguccccagcgauguggcuugguugcacauuuuucuauuucaagucuguuacuccuuccaucauaccagacugccucacaaaaugacaaagucaggcauuguucauaaaagaacaaaauggcauuuagguuauaaaucaggcccuuguaaguuugguuaauacaacuuauuucccaaagauccugguccucagacccucaaaaggagagcugaucacaucaaggccucuaccuggaaggaauuucuaagcagccucuaagucaacuguucauguucaguccaccuugauuuacaaagaacagugaaucauuaagaccuuucucuccaaggccgggugcgguggcucacgccuguaaucccagcacuuuggaaggccgaggcgagcggaucacgaggucaggagaucgagaccauucuagcuaauacgaugaaaccccgucucuacuaaaaauacaaaaaaaauuagccaggcuugguggcgugcaccuguagucccagcuacucgggaggcugagguaggagaauggcgugaauccggggggcagagcuugcagugagccaagaucgcgccacugcacuccagccuggagaacagagacuccaucucaaaaaaaaagaccuuuugcuccucuuugcucuugugucuguuuaacagauuuuuauguuaacaggcacucuguuugccacuaggaauaaaaagauaaaugggacaaagucuuugcccucaaguuacuuauauucuagagccaagaaagagauagaugaagaacacaucuuauauauuaggacuguguugggggcaggaguaggcagaguaacccuuuggauaugggaaaugaaaauaaaucaaacucaaaacaaguuuauuauuugcuugaagcucugguaaaagauaaagugaaaccugcaaacuguaaaaugaaguugcugcuacacauuucuccaguuuuggauuucauucuuggauggccuuuaacuuggauagaaggauacaagacagccauauauauauauauauacagcuguugcucuuuaagauauccacuucacccuguuguggggugggaggaggggggagggauagcauuaggagauauaccuaauguaaaugucgaguuaaugggugcagcacaccaacauggcacauguauacauauguaacaaaccugcaccuugugcgcauguacccuagaacuuaaaguacaauaaaaaaaaaaauuaaagaaaagagauccacuucgcucagcacaugugauuuggcuuuggucuuugguguuaauuuggaugccuaaagaacugacuuuccuugaugcucacuccagccuuuuuaggacuagauuggauacauuuacauguuugcuggcuguuuuuucuacagucacacauccuacccauaauaauauugcaauauucuaaguugucuuggaggauaucaucaaguaggugucaaguaaaacuuaaugguagacuguaaauuuuaaaacaaguuacaggucauuuguguagucucucucucuauauauauuaaaagaaacaaaacuuuucccucuugaaucuuuauuccuaucucagcuucauuuauugccucguuugucaucuaaauggucuuuguucuuucagcuuucaaacaugauuaauugacauugugcagcauagcacagggaaaaggcugaauauuuuguaugaugaguaaucuaguuaaacgcccaucuuucuuuucaacuuuaccaacaaaugugucuuaugcagauguaagggcgguuugcuuauuucccuguucaaaauuuuaugcuauuagccuagcauagcauguuucuuuuccauugagcuagccaaaaauaauauugacaaauucaugaagccuuccaucugauacuguugcaaacuuaugcaaauguauuuuagacuguuaagggaauguaagaauuaaauaauuaaacauccaaaugucaagaaugggauaggaagaaguaacuggccucauguuggaaguuaaugaaauauuugaaaauauaccuuuaaaaucaaagacaugaauuuguguuuuggguuuuuuuuuuucagauuugaauaaagcagaguauaauauuauaguugcugcaggaaguuaugagcauuucuggaagugcuuauuuucagcacaugcuacuuagaauuuuaaaggacauucaguguaucuuugucaugaaucuuucuacugggaccaggccacuccuggaugaacucacagauugagagcuucucaaaauguaaaaucaaauugucuuuuaaaauaugcuauuuuaaaguucuggagaaucaaugaacuuuaaaugaaaaucggccaauacuuggcaaaaagucaauuugaagaguugucucuuuauaaucucugauuucacuuauagagcuugcuuccaaaaaaaguacuacguaugucauaaaucugaaauguuuugcuuuuaugccauuuuuaaguccugauaaauauucuugaaguguuaaauuauuauuauuauuauuauuugagauggagucacucugucgcccaggcuggaguacaguggugugaucuuggcucauugcaaccuccgcccccccggauucgagugauucuccugccucagccucccgaguaucugggauuacaggugccugccacugcauccggcuaauguuuuguauuuuuaguagagacaggguuuuaccaucuuggccaggcuguucuugaacuccugaccuugugauccgccugccucggccucccaaagugcuggaauuauaggcaugagccgccgugcccagccaguguuaaauuauuuuuaacuuguuagaaauaauugucccacaacuuacugaagguugguuuaauauucacuauuguucccaaaaaacucuuaaaauauuaaaccaacucauagcucauaacuuuucaagguagcaaguguuugcuaaucuuaaaauguguuacuauucuuuuuuuguuuuuuuuuuguuuuuuuguuuuuuuguuuugagauggagucucccucugucacccaggcuggagugcaguggugugaucuuggaucacugcaaccuccaccuccuggguucaagugauucuccugccucagccuccccaaguagcugggauuacaggcgugccacuacgcccagcuaauuugcuuguauuuuuaguagagaugagguuucaccauguuggccagacuggucucgaacccuugaccucaggugauccacccgccuuggacucccaaagugcugggauuacaggugugagccaccaugcccggccacuauucuuaagugaccuucugcacaucucuguaguuuuaugccuggugauggcguuuaauuuaggaguaucuggcaugccacuccagucugacagcuaggggcauguuagcaaagggggcauuuuucaggugagugggugagcauagccgugcugaccaucuuuccuauccagagggaaggccuagcagggacucacgccaucuugacuugccugccccaggcucccucucacugcuccccuggccucuuccucuucuccagacaauggggccuuaugcucgcuguguuugucagaacucucuugugguuguggcugcaaguaagagaaacucaacucgagcuuauucagaaagaggggauggauugacccagauaacagaaaagugcuaggcuagaucuggccuuagccacagcuggauccagccuucuggcauuugugcuccguuccucagcccugccccacugggagugaugccuucuguucacagugugaucugcuucauacucaaaacucccuauccagaggaagaggaaucuuuucucucccaccaucugcacagcaguauucaggaauccccugccaggcucuguuggccucaugugcccuguccuaauccaccacugugcccagccaggguguggccauacaugcccauccugugcauagggcaggagcagacccaccugcaccacaugcgguggccgccaugaccacaagaccaggauaggagugcugaucaggccagaccccaagggcuguugcucagaccauaccuggccuguagaguagaagaacuaaaugucucacacaggcaaagacuacucuucaauuccuuuaauugcagguguauguuggaguccaugaaauacaaaguuauugagaagcauaacuaaauuuauaguagcuccucauuauauauuuucauguugauaggauucugcccccaugggaauuaauuuucuucaucaaaagugaucuccauacucacaaacacugaauagcuuugggcuuuuaaaaacaauguuuuggcuuuaaaagaaccacaggaggcugggcgcgguggcuuacgccuguaaucccagcacuuugggaggccgaggcgggcggaucaugaggucagaagauugagaccauccuagcuaacauggugaaacccugucucuacuaaaaauacaaaaaaaucagccuggcgugguggcaggcaccuguagucccagcuauucaggaggcugaggcaggggaauggugugaacccaggaggcagagcuugcaagugagcugagaucaugccacugcacuccagccugggcgacagagcaagacuccaucucaaaaaaaaaaaaaaaaaaaaaaagaaccauggcaaaaguguccuuuagccgggugcgguggcucacaccuguaaucccagcacuuugggaggccgaggcggguggaucacgaggucaggagauugagaccauccuggcugauacagugaaaccccgucucuacuaaacauacaaaaaauuagccaggcgugguggcaggcgccuguugucccagcuacucaggaggcugaggcaggagaauggcgugaacccgggaggcggagcuugcagugagccaagauugcgccauugcauuccagccugggcaauagagcaaaacuccgucucaaaaaaaaaaaaaaaaguguccuuuagucuacuguugguucuuccaaagagccauccuuucgcugaugcuuuaggaacucccaaccuggguccugucaaggauaagcucucaucuuauucccacaaaauuccuagaguuacucaucauuuuccuuucauauucagcucauuaaagcaguuuguaggucucuguaguccauauuaguaaguguuaaaaauguaucaauuugauuuuuuuuuuuuuuuugagacagagucuugcucuguagcccaggcuggagugcaguguugcaaucauggcucacugcaaccucugccuccuggguuuaagggauucuccugccucagccuccugaguagcugggauuauaggcgugcaccaccacgccuggcuaauuuuugcauuuuuaguagaaacgggguuucaccacguuggucaggcuggucuugaacuccugaccucaugagccaccgcucccggccaucgauuugauuauuauaaaaucagguuauauugguuugaccaguuaaaaacaucacagguuauuuaaucuuuuuauuuauuuauuuauuuauugagacagagucuggcucugucacccaggcugguguacaguggugcaaucucagcucacugcagcuucgaccuccuacguccaagcaauuaucgugccucagccuccuguguagcugggauuccaggugugcgccaccacacccagcuaauuuuuguauuuuuaguagagaccaggcuucaccacguuggccaggcuggucucgaacuccuggccucaagugauccacccgccuuggccucccaaagugcugggauuacaggugugagccacuguggccagcuaaucacuuuuuuaaaucacaauuuguguuacguucaugaguaaugggugccagaaauaauguuguguguuaaacauaaauguagauggguaaccauguauacaaaugcauaucuccucaacccagagagugaaauuuccccaccccagugacccugccucgcuguaugguucauucuucuccaggaauugaaacaugguggcagccugccagcuuggcguuaccauuaauucuuauucucuuccccugccgaugucauggggacaccagccaaaugaacucugaugugucucacguaaugcauguggacuucuggugcauguaaacagagggugguuauucuugauugcacauuugugauuuuuagugaggcucuaagggagaagcaagaggacuugaauaacagauuuauucucgggcacugguacaugaaagagaugaguaaugccaaacaaauaacacaauucugauucacgccauugguaauggaggagacuucuggguaaacaaaccaaaguaacagcuagaaugcagaucugaucacagcaguguguuuugauucagucuaaagaugacaaagaaaaguuucugcugguccuaucuguagcaacaagggccugcccgccugaccacacugcaguggaacagccacauugugauuuugcgggccugaagccuuucgucuggugacccuuuaagaggaacuugagccaagaucuuaucagugauggagauggagacaccucaggauuuuccaguaucguuuuucacuuuuuguucuuggacauaguuaauaacgcugccaggucuuucaaaugcugaggcauuuccucauagcuccaaguagcugcugcgggucagauucugcuugaaccgaggguucaauuacaacauccguaugcuuuccagcccacucucugaccuuuguucuuuuuuucaguacuuuuucaggcucuuaauguuuccauccacuaaucucaggagacucuguaaauauucugaguauacauagcccaauuacuuuugaaaagcuaauuuaauagaaacuucuugauaugaauugaauaaauuuuuuaacuuaaaaaucauuuacuuacaacuuaagacaguuaaacuugagaguauuugaaagcuaguaaacuucagagcuuucuucaguaggcacgaacuuuaccauuuuucugacacucagcacggucagcaaugacacauucauuggaggacucaucaauaucccuaaaaauaguagcaguacucgugcacagccugauuucuuuugaacuuggcucaauuucuuggaagcauugaucaugggaucccgcuuugauuccuuuucuguagacuagugccaguuugcccaguuucauuacauuuuuggaaagagcuaaaacuaugguaucguuuuauugcaguccucacaucaaucauaauuuggagcagucuuggugaaagaugaggaauucagacugggauccugggcaaggcagguccagggggcaagagggauggaaugcagugaguacuuauuuuauaucauaaguacagccaccucagccucaugacuuuuuagccacggcuucauuccaaagugaccacagucauaaggcccaaaacuaucuucucucucuuucucucucucucucucucucucucucucucccucccucucucugucauagggaccucccuaauccuccagguuguacagccaggaaggguaagguauugucaaaaacaagugagguacccccuugauagcucagugggccagagggccucuggaugcuggcugaucauggcaaaaacuaaauacagaauccauacaguggauucucugugcuuuuucucuucaccccuccuuacccuugaccaaauuucugacuguguuauuuucuuauugcaguccucccugcuagauauacaacuuugacuuucaucagaagaaagugcucccauugcauuauuagcuaaaccauguugcaguggcaacgcuccuucuuccagcuugccucgguguuucuguaguuagcaucagguguccuugguucuguuuaccagccuguccagggaucacuucccuggugggaucucucuggugacccucaucucagagcucagcggugccuuuggggcuacuugccagacaacuccaugugacagagggccagguccaagugcucgaucaccccagccaccauuucagaguucucggauuauagaucccucaacgagucccagugagacaccgaacaugccauagaagcuauguuuuucuauuucagcacacaguaaaacacuaccucuuagaugucgaugaguacaugcugcuuuuauguugacgcagaggaccuguguugacucuucaucggcaaggugucuuuuuuuuaaguuucaauugacacauaccaccucuggcccaaguggaccacacaguuaugcaugcccuuuggugcaagauacaucacgucuccaagaacucggguguuuuucugaucauggagaauuagauuccacauauagcuuguauuuaggaucugcagauuagguuuuauaaauuauguuuggcaaaugauaauccacaaaguagauucuaaguuaaaauacuauaaaguacuauaauuuauguuuaaaugucuuucaaccugagaguuacucucccuuagaaguccccaaaaaugcugaaaccacaccagguugauaucugaccuuucacuuuuggaaaauguguauauuguugaaccucuaaucuagauucggacaccaucaccaaccagcuucucucuuucaguugccaucugcacuuuacuguuuaguuuuuguugucuuuagggaaaguuguaaaauacccacauucuucucaaguucuucaagucuuuugguuuuuaguaaacccuuuugugacauugucuuugagaacagaggucaacaaacauuuccuuaauggacuagauaguagauauaucaggacuugcagaccacauggucucuguccuaacuacucaacucugccguuauagcacaaaaccagccguacucaauauauaaaugaaugacccuguggcuguguuccacuaaaacuucauaaaaauaagcagcuggccagauuugcugugugggucuuaguuugccaaccccugaucuagaagaaaagaguuuuguguaauguuuggguaauaaaauaaacauaccaaaccaucucaggaaucccuaaccuuuuccucauugggaacuauuuucccaguauccccaaguacuggugggaaugagauaaaaagggccaggcaugccauucccuaaagcagauagccaacccucuuucuuucccuguggaaauccccucugccuacagggaggagaagcaacugguuuggaagcugccagccaguccguuuauuuagaaaauucuaagcccaguuccagaucacuuugcgucaacucuaaaauacagccacaaaugaaauaaauguuguuuauaauccuaccaagucuaguagguguguaugugcuugagguuaaacuuuuguguaagcuccagacuuacuuuagguuuauagaaaauuacaucgcaauugauacaaugguuguguugggugauggagauagaaagagggagaagaagugaaagugaaauuuuggucaaaauuggauaccacccuaauaagccgggagauaaggggugcugcagaacuguuuucugugauacagugcaucuacauugauaauuuguguuuuauguacuuuuaaaaugaggcuuuauuggcuugauuucugugagaaaaaucacuaaugggcugaucguacugcucuacuucaacaugcaagagaauugcucagacgcuugucagaugccugaaccacauacuuauuugagaaugugccaucauaggaagcuuucauucaccaaggucaccgagagggcagcccagggaagcacguugaacuucgcaugguucuggccacucgugucaguagcaaagcaaggaaauaaggagcugacuugcccaaaaauuacaaguucagagaaaacggacuuguuuuguuuggaaaaggcagauaacggagcaguaacuaaagaauccucuuuuuuuauuauuauuguuguugcucaauuuauaaaccuaaacagaaaauguguguugccuuauuuccucuucuuuucuacagauaacuuucuuuuaaaacauucuaaauauuaagcaacauuguaaguacagauuuuuuuuuuuuuuuuuuuuuugaguuggagucucacuccgaucauccagacuggagugcaauggcgcgaucuuggcucacugcaaccucugccuccuggguucaagcaguucuccugccucggccuccugaguagcugggauuccaggcacccaccaccacauuugguuaauuuuuguauuuuuaguagagaugggguuuccccauguuggccaggcuagucucgaacuccugacucaccucagccucccaaagugcugagaguacaggcgugagccaccacgcccggcuaguacagaauuuuuuauggccccuuuuaaagacugcaaaccuuuuuauaccaaaaaaaaauuauuuuuccuguauuuauuuuacacauuaguaaaugaaugaaauuuuggcucuagguuuagaaagcaauuucauuuuaagcucauuuuacugugucauuggacuuuuuauuaauuuuauucuugaacuacuuagcugaaaaucgaauucugucauuauauguaaucauauaaugcuucucauaauguuacacuuuaauuagaugcaguugaauaauaaccuaaaaaaucuucauagucuauaaaauucacacuuauauuuauaagacaauauuaucucacccauugauacauaauguuauguuaaaaguacacaauauggccaggugugguggcucacaccuggaaucccaguacuuugggaggcugaggcggcagaucacuugagcccaggaguucgacaucagcaugagcaacauguugaaaccccgucucuaccaaaaauacaaaaauuagccaggcaugguggcgcacaucuguaaucccagcaacuugggaggcugaggcaggaggaucacuugaacccaggggacagagguugcagugaacagagguugcagugagcggagauugugccuccucugcacuccagccuggaugacagagugauacucugucucaaaaaauaaaaagaguacacaauauuaucucacccauugauacauaauguuauguuaaaagcacacugcauucuagagaagguagaguaacagggucuuacuuuacccucccacuugaaacaaguaaaaaacuggacaaaguauaugaaaaauacaucacucagggcauuggacaccaggcagcaaaaaacaguggccccugagaaauuggaaacaaagugaguccuauaauuguccuuaucuagaaaaaguuuccuggcuacuguguagagagaaggaacccaggagaaagagcucaacugucucccugaguugaagacagagcuggggauacaucaagggaaaccaaggcagcuaguuugcagagguggaggaccggagaggagagaacugcauagagagagcuuugcggauguacagaguccuccuugagcaugcaagugcguacugaucaaagugugguugugagaaaacuacccaucaccagagaaaggaucacccgaaagaaugagggaacagugccugccucccacacaguagccaagaagaggugccuguugccaacagcuagagugaaaaccucugaaugcaggggcacugguuagaauacuaagaagggucuugccagacauccaauccaaaauuagcaggcaugcaaagaucuaggaaaauaccaccuaaaaugagaaaagucaaucaaaacuaacccauuauacagaugauagaauucauagacacggacauuaaaguaguuguugugacuguaguuugcauguuuaagaaacuagaagaaggauuuaacauguuaaauagagacaaagaagauauaacaaagauauaaaucaaacugaagagaugaaaacugcagugccugaaaugauaaaaaaaaaaaacucuuaauuaauagcagauuagacauugcaaaagaaaagccuaguuaacuuaaagacaugcaguagaaacuaucugaaaugaaacagaaaaaggcugaaaagaagcaagagagcaacauugagcuuugggaucauuuuaaguagccaaaaauauguaaaacuagagucccacaggaguggaaaaaaggaacugaaaaauauuugaagaaauaaugggcaaaacguuuucaaauuugauagaaacuauaaacucauacauucaaaaaaaugagaacauuuuaaaaagagaggauaaaugacacauuauguagagaggaacaaagauaaauuggcugaugauuucuuguuggaaacaacacaaacuagaaggugguaggucaauauuuuuaaagcagugaaagaaaauucacagccuagaguuuuuuaccugguuaaaauaucuuuccaaaacaaagcugaaauaaagacuauuuuagacacguaaaagcugaaaaaauucaucacuagcuaaccugaaguacaaaaaguguuacagaaauuccugcuggcagaaagaaaaugauaccaguuggaaaccugaaucuacccaaaggaaugaagaacaccaaaaauaguaaccgcauggauagaaagacuuguucuuacuguuuaucuuaaaagcuauuacuguauacaguaauuacugcauaaagcaaaaauaauaaaaauguaguauagcguuaaaaacauuuagaagcuaaauauauggcaacaauaacacaaagucuaagaggagagaaauagaagcaugcuuuuguaaaauucuuaggcuauaugugaaguaguauaacuauauguggugugguaguauaauuauaugugaagguagacugugcaaagugaaauguguauguagucaugugcuguauaauaacguuuuggucaaaaacaaaccguguauacaacagcaguuccaucagauuauaauacuguauuuuuuacuguacccuuucuauuguauguuugcauguauaaauacuuaccauucuguuacagccaccuacuguauucagaacaauaacaugcuaugcaggcuuguagcccuggugcaguaggcuguaccauacagccaagguguguaggaggcuauaccaucuagguuugcaaguacacuguaugauguucacacagugacaaaaucacccagugauguguuucucagaauguacccgucuuuaagcaacacaggacugugcuguaaaugcaagguaaccauuucaguaauucaacaacguuauaguuaaagaguuguaaccuuguuauaguuaacaaaguuaauauauaguuaucuacaaaguagauaaaaugaaaucauuaaaaauaauccagaggaagcagaaaagggaaaaaggaacaaagaacagauaggacaauaagaaaaagaauagcaaaauaguagauuuaaacucaacuauaucgauaaucacacuagauauaaauguccuaaauacacuaauuaaaaugcaaagaaugucagauuggcuaaaaaugcaagagccgacuauuacugucaacaagaaacccuuuuuaaaucuaaagacauaaguagguuaaagguaaaaggauggaaaagcgcuaauacuaaucaaaagaaaauugaauugguauaucaauaucaaaguagaacuagagcaaagaguaguaccaaggauauaaaagaggcuuguuucauuaugacaaaggggccguuucacgaacaggacauagcaguucuaaguguuuaagcauauaauaacagagcaucaacauaaaugaagaaaaaaaaagauaaaauuauagggaaaaauagaaaauccacaaauauagucagaauuuuuuaaaccccucucagaacaaguagaguaaaaaucaauaaggauuuagaagacuuaaacaaugcuacaauucagcuugacuccacccaacaacagcagauuacgcauucuuuucaaacguacacagaacauuugccaaaauagaccauauucugagucacaaaaugucuuaauaaauuuguaagggcucaaaucauacaaaauauguucucuaaccacagugggauuaaauuagaaaucaacacugaaagacaucuggaaacacuccaaauauuuggaaauaagcuacagagugggagaaaauauuugcaaguuaucuauuugauauaaggauuuguauauggaauacuaaaacucaaaacucaaugagaaaauaacgcuuuuaaaagaugacugaaagauuugaacacauauuucacccaagaaaauacaugaaaauaugcuuaccaucacaggcauuagggaaauggaaauuuaaaccacagugaauaccgcugcauagcuauuagaaugucuacaauuaaaaagauugaccagcuaagcacaguagcucaugccuguaaucccaacacuuugacaggcagaggcaggaggauggcuugagcccagccuggacaacauagggaggagacucugugucuacaauaaaagaaaaagaaaauuagccaguugugguggccuagcugcucacuugggaggaugaggugggaggauugcuugagcccagguugaggcuguaguaagcugugauugcaccacugcacuccagccugcaagacagagcaagacccugucccaaagaaaaaaaagauugggcugggcacgguggcucacagcuguaauugcaucacuuugggaggcugaggcagguggaucacuugaggucaggaguucaagaccagccugggcaacauggggaaaccccaacucuacuaaaaauacaaaaaauuaauugggcaugguggcacacgccuguaaucccagcuacucgggaggcugaggcccgagaauugcuugaacccaggaaacagagguugcagugagccaagauuguaccacugcacuccagccugggugacagagugauacucugucuaaaaaaaaaaaaaaaaaagacugaccauaccaaauguuggcaaggauguggaacaacuggaacccucauacacugcugguaggaauauauaacaguaccacccccuuggaaaucaauuuggggucguuucuuaaaaaguuaaagugcaccugccauauagucaagacauucucuuucuaaauauuuacccaagagaaaugcaguauauguccauguaaagauccgugcaugaauguucguagcagcuuuuuuguaauaauauacaguaagcuuuacacuuugacaugugcaguuuauuguauguaauuugccucaauaaaaguuuuaaauaauacaauuuuauccaaaauaaaguugugaaaaguagaaaaaugaggaaaaaguuucaaagguuagaggggucaguccaggagaccuaacaucuaacuaaugggaauuccaauaagacagaagaaaccagaagggaagaaauuaucagagaaauaauccucagccuuccacccaaaauuuucucuccuagaacugaaggacucccaaaucaaaagggucagcaaaauaaauguauagacucacaccaacacacuucaucauaauaguaaaaagaacaguagagucaaaaagaggauacuaaaagcuuucagagggggaaaaaacaaaacaugcaaauaaucuggaacccgaauggcaucagacuuuucaacgguaauacugggcugggugcaguggcucacgccuguaaucccagcacuuugggaggccaaggcaggugaaucaccugaggucaggaauucaagaccagccuggucaaccugaugaaaccccaucucuauuaauaguacaaaaauuagcuuauuucuuaaaagccagcaagggggaugguuuuuuccuugggcugguggcacgcaucuguaauccuagcuacucgggaagcugaggcaugagaauugcuugaacuugggagguagagguugcagugagccaagaucgugccacuauacucuagccugggcggcagagugaaacugugucuuaaaagaaaaaaauaaauaaaaguuaucaaaaaacaaaaacaaaaccauaauacuggaggcuagauuacaauagagcaauaucuucaaaauucaaggaaaauggccaggcgcgguggcucacgcuuguaaucccagcacuuuggaaggccgaggcgggcggagcacgaggucaggagauccagaccacggugaaacccugucucuacuaaaaauacaaaaaauuagccgggcgugguggcaggcgccuguagccccagcuacuccggagaggcugaggcaggagaauggcaugaacccaggagguggagcuugcagugagccaagaucgcgccacugcacuccagccugggcgacagagcaagacucugucucaaaaaaaaaaaaaaaaaaaaaaucaaggaaaauaauauacccagcuaaaccaucaugaagugugauaagaauaaugacgaagccagacauuuuagaaaaaucuaccccuagcgcccuuuuucucaagaagccacuagaggaguauuucacucaaaugagcaagcagaggaaggaggauugcuugagcccagccugggcaauguacagagaccccaugucuacaaagaaauaaaagaagaaaauuagccaggugugguggccuguaguccuagcuacucacucaggaggaugagguaggagaauugcaaguaaaugagcaaguaaaccacagaagaauauuaauuuucucuuuuuucugcugcauaacaaaugagcacacauuuaguggcuuaaaacagcucacauguauuaucuuccauuucucugggucagcuuagcuggguucucugcuucagacugcgaaaauugucucaucugaggccuggguuccucaucaaagcucauuuggcagaauuccauuccuugaaguugugggacugagggcccagcuuuuugcuggcugucagcuggaggccacacccaggucccagaggccauguggguuuuugccaugagaccuucuccuucguccauucacagcauggcagcuuauuucuugaaagccagcaggggggauggguuuucucuggaaucuguuagaugaagugaccucccuucacugucacucgugccauauucugcuggugagaagcaagucacaggccucaccugcacucagggagggacucacugggagucgccgccacaguguggcuccaggaauggaaacuaccacacugcagaggugcagggaauccccaggauuauggucaagaaagagcccacuaaguguuuuguucaguaggccugcaggaugaagggugccaggaggauggcuccaugaaagacugagccuauacgugaacguacugaaagcugacuuacaguucagccaguguggugguaugugauugacagcgcccuagcaagaugagcaacaaagauacaagacuccagcagaaacaagcugcagaagaacaggaguguaaucaauaaaucagauggccuugcugugaacgguuacauagcucugauaaauccugaucuaaccaaaagucaugacagcucgauauuugggagcuggaggggguggggaguagggguaguaggauaugaaggagcuaaguccccauuguugauauuagaaauccaguggguaacaucugaacggcaagaccaggacagcagcgaaaggcaaaaagacaccacugaguguugacaguggcugccuuucaggagugggaaugccacugggggcagggcaguggggggcagggaacagguuuuucuguuuguuuuuuguuuguuuguuuguuuuguuuugagauggaguuucacucuuguugcccaggcuggagugcgauggcaugaucucggcucacagcuggagugcgauggcgugaucucggcucaccgcaaccuccgccccccggauucaagcaauucuccugcuucagccucucaaguagcuaggauuacaggcaugcaccaccacgcccagcuaauuuuguauuuuuaguagagacggaguuucaccauguuggucacgcuggucucaaacucccgaccucaugugaucugcccaccucggccucccaaagugcugggauuacaggugugagccacuucgccuggccaugggaacagucauguugcauaguaagcccuaaagagcagugugaucucuuaagccagcacgugauuuacuuugguaaaaauuaaauuaaaaaaaaagaaauuaggccaggcgugguggcucacaccuguaaucccaggacuuuggagagccgagguaggcgguucaccuaaggucaggaguucaagaccagccuggccaacguggugaaaccccgucucuacuuaaaauacaaaaaaaauagcugggcgugguagugcacauccauaaaucccagccacucgggaggcugaggcaggagaauugcuugaaccugggagguggagauuucagugagccgagauugcgccauugcacuccagccuggaugacggagugagacucuggcccaaaaaagaaaaaaauaauccuauuggucucauaguguuucucuguauuuuuaauauacuguguaugugcuuaugagaaaccgaaagagaagugauuugugaacgauuugaggacuuuugguccacguuuuuuucucccacuuauacuuguggcauaauccagaggaagaagggcagcugcggagucccagcaguguugcggguaucagggcagccagugagaggauggaggagaaacccaggagagggcagaggaggagggacagcugugcccaccugguccuuucauuguugucugccucugcccuugcaguuagaaaaagaguguucuguguauagaagccuuugcaaguagcauaguuaggagucuuucgguccaggaauugaaggugcuaaagcaggaggaaaacauacauagaagaaaggaaauguccacauaaguaaguguauuagucugcuagggcugccguaacaaaagaccauagacuggguggcuucaacaacagaaguuuauuuuauuuucucacaguucuggaggcgggaaguccaagaucagggugcuggcagggcugguuucugcugaggccucucuucuuggcuugcagacagcugucuucccuguaugucgucuucucuguacacaaacaucccugugaccucuuccucuucuuuuaaggacacucaguccuauuggauuagggccccaugcuuaugaccuuuuuggguuguuuuuuguguuuguuuugagauggggucuugcucugucacccaggauggagugcaguggcacgaucauggcucccuacagccucgacuuccugucuccaaauguagucguauugggggauuaggaugucaauauagggguuuugaggggaugcaguucaguccauuauauacaguaagccacuucuagacccagucugaaguccugagcauucagcugguaucuggaguggaucaccuaagaaacauuacagaacaauauaggccucugguauuuaaaauaguuuaauuacgucacaggguaguccugaauucuuuccuacuucagccagucuuggccagccgaguuucaggguagugaugagcacugaugaggugacucccccuucuccaaacucuuccuuugccacugucccaagaaaaccauaaaggggaaguuuaaaugauggauguaauuuuccugacuugggcugggcgcaguggcucacaccuguaauuccagcacuuugggaggcugcggugcgcagaucaccugaggucaggaguuccagaccaggcuggccaacauggugaaacgcugccucuacuaaaaaugcaaaaaaaaaaaaaaaaaaaaaaaaauagccaggcaugguggcacacgccaguaaucccagcuacuugggaggcugaggcaggagaauuacuugaaccugggaggcagagguugcagugagcugagaucuugccacugcaccccagccugggugacagagacugucucaaaaauaauaaugauuucccugucuuauguuuuucuacuacacagcuuauuaucucugggcaggagcuuucccagggucggaggggcaagggucuaguugugagggagagaggugaaagcaaaagggaaaugcuaaaugacauggcacagcaagcaaggucuaggcagcugcgccuuugauaacaagcugcuugaagagaaagaccagaucggcugagugaaagcacuguccauccuccccaccccuuccuuccugcuuccuccucuucccaucuccuccagcuucuccuuaaagggacuaccgaaugaugauuuccuugccaguaggaccuugacauaaaacccagcccacaacaucacaguugauuuucaagggaugagcuucucagaaaccagaauuuaauuacuuaauuuugaguuuccaaacaauaaaauauauuauuaaauugauuuguuuuccacacguaguggagauuuucauggugugcuaccugucggucaaacggcugaugaaugaguaugucgcaaaaacucuaggugggaauaugacacaugaggaauggaauuugugcuucagcucuucccagcaucuucuugggcugcacaagaguugguagucuuucaucuccuaaggacugaagggccauuuagaaucacaccuguuuugaguuuauagucacgcuucugaaacuuucucucuuacagccuuaucugaccucaaucaagcuaccccuguucauuuaaauacuuuaggucuuggcuauugguuuagcuuaacauuugauugccauaaauaagaacuacagaaagcgugacuuguaaaauuguagacccagaaaaauuagggaacaaucucauaauacuaaugaaaccuuuuuucccauaaaauaaauacauaauuagauauagaagauuuuuuuuuugguuuaagcuaucuuuuccuauuucuaucuuaaauaauuuacaacucuccuuuaauccaggcaauuaucaauucuauaauaaaauaacaacaauggguacuguguauuaaacucuaaacuaggguccuucaucucauuugaauuuugaaaugacuccauaauauauuguuauacucaugcuguaguuauagauaaagaacgagggcugaccuuugacaaucacaaucaaaaaaaacaaaacaaaagaagugaaggcugagcgaaguaacucacccagcaagaugcaauucguauaggguagaguccccugucucccgauaaugcuuugccccacaccugaaagucuugaucugguucccauuaccccucagacuuuggguccccaguagaaccuuugcacuugcaguucuccuuccuaaugggcucagggaaacucacaugacugccuggaggcuguuucugcaccuguagaugggaaugggcaagucucucccgacucacuugucucauaguguuguugaaaggcucaggugugaucauuacagugaaauaaggaaaggcagggaagaaucuccaucguucuccaaauacgaagaaugaaaugcaauuuuuuuuuuuuucuuuuugagacgaagucucacucuugucacccaggcuggagugcaguggugccaucucggcucacugcaaccucugccucccagguucaagcgauucuccugccucaaccucccgaguagcugagauuacaggcaccugccaccaugcccagcuaauuuguguauuuuuaguagagauggaguuucaccauguuggccaggauggucucgauuucuugaccucgugaucugcccaccucggccucucaaagugcugggauuacaggcgugagccacagcgcccggccacaaauaaguuuauacccuuguagucauggccuuucuuuuaucuuucugguaaugaauaaaaaugaagcauauaagugacagagaaaccagcuacuugaucaauaguggcauuguuucacaauugucuguauuggauuuugccaacccacuagagaguuaccaaagcacauuucugacauaacuaugauugauuuuuuuuuaauuuuugacuaaauauguuacuuugacuaaauugguuacuucauugcauaauggugaccauuuacacuuuucagauagguacaaaaaaucuguguauucuagcuggccaugaaagaguagcaagccuguuauuuuuaagaaaaaagcucgaguaguuacuguauuuguaucauuuuggaaaucucucauuuuucuaaucagcaaaauggggauaauguaaauaacaauaacccugaccucacaggguucuugggauuaaaugagauauggugcauacaacgugcuuagcauggcgccuggaguauggucagaacuuaacaaacacaaguuauaaaugaggucccgaaauacaagaaauucacuuccucagaaaccuuccuugagccuggcuacaucuauagcuacauuuucuacauguuaaaugccucccucagaagugucacuguuggaguugccagggcaccaauuuauuacuuugaaaauagauaaauaaaagaaucaagacaaaagaaaaaggugcuaccaaagaagacauucugucuuacacuggaucacacgagauguggauauuuggcccggaacugcucacaugggucagcaagccugagaaugaccguggagagaaauggcuggggcugcaggacucagccaagccuggcacgcgugucuuccgggcaccggagcaggacguugucugaaaacaugaagaaugaaauggaaguaauguaauaccuggggucggggcugggggaagcuuucuaaguacaggcagggucuuucuauguugcccaggguggucuugaacuccuggccccaagcgauccucccaccucggcuucccaaaguguggggauugcgagugugggccacugugccuggccuaauuacugauuuuaaauauuaaucuuucuaaaagucaaacuccagaacugugcauguagaacuauucaauuucuguauauaacuauagaaauauauauuagacgggccgggcgugguggcucaugccuguaaucccagcacuuugggaggccgaggcgggcagaucacgaggucaggagaucgagaccauccuggcuaacacacggugaaaccccgucucuacuaaaaauacaaaaaauuagccaggcgugguggcgggugccuguagucccagcuacucgggaggcugaggcaggagaaucgcuugaacccgggagguggagcuugcagugagccgagaucgcgccacugcacuccagccugggugacagagugagacuccaucucaaagaaaaaaaaaaaaaaauauauauauauauauauauguauauauuuauauauguauauacacacacacacacauuagauaagcacauuguuuauauaggaaucaaaaauuaccugugaguaauuuuuauuuauguaauuuaauaauuacauaaaaauuauuugcagagguuaccucuggaagcaguauuagaaguggaggacuuuuuucuucuauguugaaaauauuuuaaguaaauuuuuaaaaacgaauagaaauuuaaucaggaacaggcuuucuaccauuaaaaaacuuuauagucuucuuuacaaaagaagagaaauaauuguacuuguucagucauucaaggccacugaaauaauuggcauagcuugagcucuguaguacugucacaauaugcaaacacagugugguaauuuuuauaguaauugaacaugacuuacgucuuagaaagucauaaguuaggaauuuauucuguucguucuuuugaagugaaaaguaaagaaagcaaaacauuuuuuggccgggcgcguugucucacgccuguaaucccagcacuuugggaagccgaggcggguggaucaccugaggucaggaguuugagaccagccuggccaacauggcaaaaccccaucucuacuaaaaauucaaaaauuaccuggccaugguggugggugccuguaaucccagcuacucgggaggcugaagcaggagaaucacuugaggccaggaggcagagguugcagugagcagagauugugcuacuacacuucagccugggcgacagagcgagacucugucucaaaaaaaaaaacaaugacuuugaccugaaugucccaagggucugcuuuguguagucugccccucuacaagcagggaccaggucuuggucaccugguguccuuguaguaagcucuuagcagggacuggguccuggucaccuggguguccugguaguaagcucuuagcagggacuggguccuggucaccuggguguccuuguaguaagcucuuagcaaagguugcugagucgaaugaacuucaccguuucgguccuuugguacaguaacaggcacucaagagaguccacgcuguaggguugaucagccaccaugagagagaaguauacucuaagagcacacaccaucaaccccagagcaucccugccgaccaggaauguaguuacagcggugcagguucccagcuaccccaaagaaaucccaggagaguccaucucuacuaagucaagcaaauagaaauugcaacuguagcagcacaaucuauuuucauuauauagugugugucucucucuccccucaucucucucucucucuccuuuccccucggucacuugacauugauacugggccauuuauccucgugcaucaucuuagaguuacauuuguauaauuaucaacauggccauuugauauaaacaauuccgucccucacauccaaagaaaagggaagagacagaaagaaaaggccuaauuucugagcaauuuuuguuguuuguuucccauuuuguaauuguccuccaucuuuacucaucuguuuuuuuaaauauuaauuauuuuuuugagacagggucuggcucuguugcucaggcuggaguacaguggugcacauggcuuacuguagccucgaccuccugggcucaagagauccucccaccucagcccccuaaguaacugggaccacaauugugcaccaccacaccuggcuaauuuuuguuuguuuuuuguagagauggggcuuugccauauugcccaggcuggucuugaacuccugggcucaauccauccuccuaccugagccucucaaagugucaggauuacaggcgugaaccaccaugccugaccaaaaauacuuucugagggucuaauauugccaggcaccguguuaacaauucagaaaauacuccugcuuaauaaauaaagacuugaauuuuuuuaguuacuucauugaaaagaaaaucuuuuuauuuaaauuguaucgucagccaggcgcaauugcucaccccuauaaucccagcacuuugggaggccgaggcagacgaaucauuugagucaggaguucaagacuagucuggccaccguggugaaaccuugucucuaccaaaaauacaaaaauuagccaggcauggcggcgggcaccuguaaucccagcuauuugggaggcugagacaggagaauugcuugaacccacgaggcggaggcugcagugagcugagaucacgcugcugcaguccagccugggcgacagagccagaggccaucucaaaaauaaauaaauaaauaaauaaauaaauaaauaaauaaauaaauaauaaaauugugauguaguuaacugguauaaucuuuucaguuauuuuuaaauuuuugaaacaacacgcuguauaucagccauccaucagagaaggaaagaaauauguagaaggacugucuucugcuucagaucaugaacuguaggaacaaaauagauauguguaaaaaugcugcuccuuuucugaaccaaaauaaaauuagauuuuuguuguugugguuguuguuggaaaagguaguagauuucaggcaaaaucagaaaauaaauuauuucagaaacacaacaaaacuaaguacaacgauauuuugguuaagaaaauuaugguuagaaauuaugauucuaucacuuuaugaaacagaaucuuuaauaauuuuucagcuuauaccaaggauauucuuuuauuucuuaaugacuaguuuuaaauauaugacuauucucucuguacagauuuuuaauuaaugcucauaaaggcuauugauagaacucauucuuucuccaaaauggaguuaacccgaaauggguagagauucagaagcuucauuguaguuaaaauuagggucaugaagggcaaaagcccagguauuucagccuuuguagaagaauccauuaaugcagcauuacaaguaaguguaauuuaguggcuccuuaguuauuuuaagcaagaggccuccuuaaagggcacacagauaaagucaacauagaucuccacugaccccaggcgugcggccagaggucaacucccaacggcugucugggcuccuuuuucccugcagugcuguaugucugggggggugacaauccuuugauaacaguuuuuuuuauugggagaaaauuugugggaaugcauaaggucuugcuaacauaauuccacauuaugcuugcucaacaggagaaguuuuaguuuaaauguagacuuauuggagauggcuguauaucugcaggucagggagucucgcgucugcagauucuuugugguuucucgucugucgucgcuuaucccaaauaaguagcugcacuucuuggaagagaugauugcgucacuugaaggggucaugggagucuacugauugaacucauuuuucucccaucugaaagaaagaaaaguugaaacaagaggaaagacauuucacacuuucuggcauuuaauauuucggcuaguuuuuguuuguuuguuucuuuuuugagacagauucucucucuguugcccaggcuggagugcauuggugcacucucggcucacugcaaccucugccucccgaguucaaacgauucuccuuccucggccucccaaguagcuaaaacgacgggugcucauuaccacacccagcuaauuuuuuuuuuuuuuuuuuuguauuuguagaagagacagaguuucgccauguuggccaggcugacuucaagugauccgcccgccucggccucccaaaaugcugggauuacaggcaugagccacugcgcccggccuggccagguuuagauccugguuuugugaaagaaucagaaugacuagaagauucauguuccgauccacugcagcuaacaaauacagcuccaggaaccgcacaaauccugcaucgccuuucaucagcagauaguuaaaggcggagaauuggguuuucuuguuuguaaagauagugcguguaaacaagcaugcaguaaauuauguuaucugcaguagagucuuccauugguagcuuuggucagacgagcugaaauacacugccuucaggguucuucuugguuugucaccgugaguagagauuugaauuuacacugccucaucuguacugaauucugcccuugcugugaaucaugucacagucucagaagcagcagcagccauagaguccagugacauccuuaccaguaagauaccuuugaccuagagaguucauuucagggguggggcagcaucaguguggcuaaaugugaauauucauuucuuuuucuuaaacuauaaaaugcuuguucuuuuccaaauccauagcuaggcacagauuauagaggcaucuuaaaaagccuucuauagcugggugcaguggcucacgccuguaaucccagcacuuugggaggcugaggcggguggaucacuugaggucaggaguuugagaccagccuagccaacauggucaaacccugucucuaccaaaaauacaaaaaauuagccgggcaugguggcaggugccuauaaucccagcuacucgggaggccgaagcaggagaaucgcuugaacccgggagguggagauugcagugagccgagaucgugccacugcacuccagccugggugagagugagacucugucucaaaaacaaaaaccuccuauaaaugccauaagaugccggcaaaugccaucucaaaaugcaguuaggcaggaaaauuaccugguaugaguuguaaccuaggcaacuggaaaaaaauauguguccaccaguuacccuuguguuugauguuucaaguaguagaacaguauaagugugguuuucuuucuggggucucccccauuguaugcacucacuguaguaaccagaggaaaauguuaccuuccugcugggaaccuuaacuuccgaggcugugauacccaucuucauaccuaaaguuuuaacauauagcaaguccccaccuacaagcaggucuuaugucaaaaguguaguugcaguuuauugccuggaacccggaauggauuuucccauaggcguguuaugaacggcagcuguauuccaggcagcuguggaagccuuuuuagcccauuuauauaccugaagugcagucaugugcaauuagcaagacaagaaccagccaucauccaucacaauguuuuauguguucccccagccuccccacucccacucucaguuggcccagcuaggcagggaaggggguguuaaugaggccugcaggugcacagauuuacuccccaccugcugcaucugcagggguuaaaccggcuuuucccuccccuucgcucucaccauuccuucucucccucuccccacccccagucucccuuucccugugcugaaggggcugggcagugaagugaggaaggguggcuggagcuguugggggcugaggccacauugugcaguucacaucagaacccccuggggacuugcuccaguugcagauucaaaugcagcaggucuggggugggcucugaaauuccgaauaucuaacaggcucccagguaaugcccaugcacaggcccacaggccccauuugaguaacaggagucucuaaacaccaugcagggaggagaggcuggugaagagggaaaccucgagucacgacugaaaggcaguggagggugagagcugaguucuauucucuaggccuuagggaggucccuuuuacacugagaacuuuuugccacaugggaagaagcaggcaaacccuggaugccaucaggugcuggcacaucgcagccucaucucaugcaagguguucuuggccagggccuguggagguucuacaugauauggcauuaacccucgggagagcaggcacaguagaaccugaaugucuccuccaagcgacugggugcagcaucgcuccaugugacugggugcagcaucgccccaugcgacugggugcagcauugccccaugcgacugggugcagcaucguuccaugcgacugggugcagcaucguuccaugcgacugggugcagcaucgccccaugcgacugggugcagcaucguuccaugcgacugggugcagcaucguuccaugcgacugggugcagcaucgccccaugcgacugggugcagcaucguuccaugcgacugggugcagcaucguuccaugcgacuggguacagcaucguucuaugugacugggugcagcaucgccccaugugacugggugcagcaucguuccaugcgacugggugcagcaucguuccaugcgacugggugcagcauugccccaugugacugggugcagcaucguuccaugcgacugggugcagcauugcuccaugugacugggugcauauugcuccaugggcaugguuuguaugaaacacucacuauuaaagcacaguaggaaaugcugaaauggaaaaggaaugggucauccgggagccccaggaucuagacccuggagcaguguuucagggccugaggauccgucaagggggccagcaucagaagccccagcacacagggggcuucugaugcaggaggagagugugcgguuugaagaucuuucaucccaacacagcaaggcggugaagaaccaguuuucauccugucuccaccacuaacuagccauguguccuugagcucauacccucaugccuaaguguccucuguccucauccguaaaguaaggcuaaaaugaguaccuaccucauuagggugcugggaagcucaaugagauuauuucuguaaaacccuuagacuguccauuaagugucacaaaagcagucguagggguggcuguggcgguaugguaguggugaaaugaguaauuugagauuauaggccuaaagucaaauuucugguuuugcaacuuuuuacuagugugaccugggcaagugacuuagccucuccaaaccucaguuucuucccuuguaaaauggaaauaauaaaaguuccuaccugcuauauuauugagaggauaaaaugaggaaagcacguagcacagugcccaucacaaagcaagcucucaguagauaucaguuacuguuauugagggagaccggggugacgacuggcaucugaacaggaguuuuccagcugugcuccaggagcuauagguuuuacaaaaaugugucuugggggugagaaggaggccauuauucacccugcccacaccugcugcccccuucaaccugaugggcuugucuuuguuggcguucagcaugaagauuuuauugagaagaaaagguuuggaguuuggaagaucacuguuuuguaguucggguguguuauggggccacagggaagguaaauggucucaauuuucaggaaguugacauuugccuuuucuacuucauuuccuuaaacaaaaauugaaauaucagaugacaaauuuaaagagauauaucccauauaaaaccuaaaguucuaugaggcuguauugaacgauagaguuaauuugcaucaucagauguuguggccgcuuuguagcauuugcuaaucuguaacgcuugguuuucucccccagaugagcaccaugccaggacugcccacccggcccugcuuuuaugacauagaucuugauaccgaaacagaacaaguuaaaggcuuguucuaaguggacaaggcucucacaggacccgaugcagguaggcugaugugcuucaacuuuuucucucuuuguuuuuuuccaguucauauccuuuuuuugucauuuuuuuuuucugauaccacagaagugaucugauaaauccuuuccuuccuuuguuacucaaauuccuaccaaaugauuuuccgugacuggaguucacuccuggguguggcugugaguuacaugcucagaugcucaguacacaacccuuaguguccugcgcucgaguccagugaaagccaaguuaugucaucccugaauauagauguguuuagagcaucucugaccauaacagaacucuguaaacucauuguucuuuuccaggauuaaaaccagcgucuguuauaauuuuaaaagaguaacuuccuaccuuccugccacguaucucuugguacagagcuagaaucaugugaaagaggaaucuugguguauccguuuccuggggcugccaugacaaaguaucgcaaacuggguggcuuaaaacaguggaaaguuugaaacaguucuggaggcuagaaguccaaagucaaggugucagccaggccauacgccaccucgagacucuggguggaauccuugcuggccucuuccuagcauccagugguggcugucacucccuggcguucccaccuugcagcugcgucacucccgucucagccucuguggucccaccacguucucccugugucugugucuucacaugauguucaccucuuauaaggaccccaguccuauuggauuagggcccacccuaagaaccuccuuuuaacuugauuacucugcaaagacccuccuuccaaauaagaucacucucagccaagcacuuugggaggccgagguggguggaucacgaagucaggaguucaagaccagccuggccaagauggugaaaccccgucucuacuaaaaauacgaaaauuagcugggcguguuggugggcaccuguaaucccagcuacucgggaggcugaggcagagaauugcuugaacccgggaggcggagguugcagugagcugagauugcgccacugcacuccagccugggcgacagagcaagacucuccuucuaaaaaaaaaaaaaucacucucacaggugcucaggguuaggacuuaagcauaucuuuuaggggacacaguucaacccagaacacucaacuguguggcacaacagguguguucggcucucuugucccuggacagacacauagccaugggacagaccauuuaacuagagggccccauggguuccaggaagggcagggcagcagaaaguaggccacuugaugacuucggguuugcacagucucagguugggcuuugacucugagcugucuuaggcagcccagaccuggggacucucggucuuauucauguccacgccacagcacugcagccauaccugcuggcuucuauccugacuccccaucgugaagaaaaaugaccacauuccuaaaccucuucccugggagacaacuccuaaucagaagcuugaaaggcucagggcugcuucuccuaccccagggaucaaacauguccucaccauauucuaaagacacauucuuuccccgcaagcaccccgccuccuucuccccacugacuccuguuccugagcccagaaccucucccucuugccagcauauucucggccuuugcagaugagcuuuuguggccuaaagaccuucuucuucaaccaucucugaguuacggcuccaagccaggcacccaggauucucauuucauuuguuucacuaccaggaguccacuugaggacuuguuguuguuguuguuguuugagacagagucucgcgcuaucaccuaggcuggaguucaguggcgugaucucugcucacugcaaccuccgccucccggguucaagcaauucucuugccucacccucccaaguagcugggauuacaggugugugccaccacgccccgcugauuuuuguauuuuauuuauguauuuauuuauuugcgacagagucuuacucuguugccaaggcuggagugcagcggcacugugugggcucacuacaaccucugucuccuggguucaagcaauucuccugccucagccucccaagcaguugggauuacaggcguccaccaccaugcccagcuaguuuuuuuauuuuuaguagagacaggguuucaccauguuggccaggcuggucucgaacuccugaccucaggugauccacccgccucagccucccaaagugcugagauuacaggcgggagccaccacgcccagccuaauuuuuguauuuuaauagagaugggguuuuaccguguuggccaggcuggucucaaacuccugaccucaagugagccaccucgucuggccaaguuuuuuuguugaggcuuuguugcuaaaacacuaaagaccuaggcuauggugagaaagauaagggaaccauaaaugaaauuacauuaaaacaaagugugaaauuguuuguuuugaguuguggauguuguuuggggguguuuguauguguuuuuugcugaggagcgggagcuguguuaaguuugagccauaacugcaucuuugaucuuuguuauuucagaaaaaauaaaacucuagaaaaugaaguaagggagacuaguuuaacaaagaaacccauaaacucaaguguugauaaaauguuguuucaucuuuuggugugagcuuguguguugccaaugucuuccauuccccaguaaggcuguggggaaauaauugcuauuuccccaauugcuaguuggccuagcaauucucuuuuuaugucaggaacccauuauguuacauuucugccauuugucauuuuucuccagaauaaguguguuugauucucccaucucucuuggacaguauuuuuccagcuuuuggugaguuuucacaugcucuccaaguaggucauauaaguccaauuauaccuuaaucacuguaguuaggacucagguccuacucagggauacauccuuagcauuauuaaugcauacccuuaaauccuuuauuaccuacucccuaacaagaauuccuccagaucuuauauacggggccugcagggcaggacacaggccuaugguaauuacuuccaauguaucgggcauugugcuaagcacuuugcauggguggucacagcaccucuggagccaaguguugucccauaagggccacaaggcuucaagaggacggagccuaccccuuggucacugagggguggcccuggucugcaaggcuacagaacugccuugccacccuguggcacugccucucauuucauagcuggcacaugucauuuugccacccccaucacaugucaugcuggcaucaacccagggagguggguaguauuuuuguugaagagcugcaagaacucugcccagagaagucgacaaccugcucaaguugugcagcuaauaacuacaaaagccaagacucaacucagaucuguugacucucaguauuaccccaaccuuuaugccccaaaccaaaggaugcccuuuucauuucagucacggguaaaaugaacuuuggcccauuccgaaagaugauaccagcuauuugaacagacagguacuugaggauaaugagguaauuuuuucuaauaaguaaagauaauuguuuggguauuaaaagcuaugauuuugucauaauucuuuuuaguccaaguauaauagagccagcucuuuccuaauucucuaauggaauggcauuucuaccccuuacccaccccccaauccaaggccucuuucuucuuugugaauugcuaaauacaguucugggcuagugggcagugguucaaaacccaucguuugacccugcuugaacaaucaaaaacagauccaguguccuaagauaaaaccacuauacaaagcaaacauucccucucaguggcuccucgguaaugacccagcaaguauugucuguuucccgugccucucacuauagccaucagggaccacuucuacuaauaaucagaggucugcggcuauucaaaaugcauaaaauaaaaauguuaaagcuuaggugacagcuuggacaaacgugggcaucugaaaggaaaugucuggcuugcugacguugcuccuucagggaucacaccguagauggugugcauacccaggugcggagcagcacacucauuauucccccaggaaaguguugaaggcgcguuccacucaggaagaagauugugcuugguugaugacaacuuucuguccuucccuuccucaccuuucuagccugucucaccuccuaggaaaccgugugaaaccaaaggugaacauuauaugccaaaaaacaucagaauuggagcucuccuugcucccucuucccaagacuucucuguagugccuucacugugguuagaauaagggcaugacucauucuuuuggaugucacuaaauagaacuaauuaaaauagauuuuuugucccagugaaauugauccggcuguugagucuuuuguuuaaagauuauuggaaugaaggauuugauacuuuuccccccauucuuuuuucucacuuggaaacuuuaucauauuucugagcuuuggcaagauucauucaaaugaacacacaauaaagucuggcaaauuuccugaagaauucaaggacucccuuacuucuuuauuguacugugcaaaguuacguugaguacggaaucagauucacuccaguccugcuacaaauguuuguuauuuacaaaagaauugcuuuuucuugaauuacauacacagaaauaaguucaggaaagaaauuaguuucuuuccuaaacuggcuuuagggcaucuacagacaaaugguuaaagaaaaugugguauguauagagaguggaauacuacuuagccauuaaaaaagaaugaaauaaugucauuuacagcagcauggauggaaguggaaguuauuaugugaaauaagcugggcacggaaagacuaaugcugcauguucucacucucauguggaagcuaaaaagcuuacccucauagacagaauaaaugguagauaccagaggcugggaaggauggguggcugggaggagguuaugaagaaagguugguuauggguacaaacauacaguuagacgaagaaauaagcucuaauguuugauagcaaacuaggaugacuauacucagcaacaauauuuuguauacuucaaaguaacaggaagagagugggguguacuugaaaugauaccaacauacaguaguaaugauaaauacucaagauaauggacaccccagguacccugacuugaucacuacacauuccaggcacauaauaaacacucauauauaccccauaagaauauaaaauauuaggccaggugugguggcucaugcuucuaaucucagcaguuugggaguccgaguggguggaucacuugagcccaggaauucgagaccagccugggaaacauggcaaaacccugucccuacuaaaaauagaaaaauuagccaggcgucauggcacgcaccuguaaucucagcuacucaggaggcugaggcaggcaaaucucuugaacccaggagguggaggcugcagugagcugagaucaugccacugcacucuagccugggugacagagcaagacucggucucaaaaauauauauaauguaucaauacaagggaaaaaugggcagaaauuuucaaugauauuuaauaaccauaaauuaaucuugaguuggguugcugccugccagcccuucugugaacaugauuuguucagucccaagucacaaaccacaggguuacaaaguacccugggagggugccugagcucugugguuuuagucuugaaacuuuaucuuuucacaaagcaauucaaaaauugcucaucaccauuguguuccgagaaaaggggcgccaaggcaucacccugagccauccgaggagugcugugugccuucuuccuuucugcuuccaaguaggauggaagcuccagcuuuauacuuaaauaauccucaucaacaucuaaaagauagugauaauuaaaucucuccuaucuaacuaaaauggaauguuuuaaagcuuagguaacaauucugaaauucuuaauuccccccaaaacaaacuuuuucugagcacauuuugauuucuuauucccaugccagaauagacuguuuuguauaugguaucuuccaagauauuuucccacugaguuaacuucugaaauugcuucuuccaacgcauaagcaauaaacaacagauucguuuuuacauucucaccuuagcuauugcaucucugauuguuuucaucuauaaugagacuuucuauacuuuggccaguccuucuguuuuucuuaaaaugugggaccacaggccaggcacgguagcucgcaucuguaaucccagcaauuugggaggccgaggcaggcggaucaccugaggucaggaguucaagaccagccuggccaacauggugaaaccccaucucuacuaaaaauacaaaaauuagucgggcaugguggcggguaccuguaaucccagcuacuugggaagcugaacccugagaauugcuuggacccaggaggcgaagguugcagugagcugauaucgcaucgcugcacuccagugugggcaacagagcaagacuccaucucaaaaaaaaaaaaaaaaagugggaccacauacucuaagcaccuuuagacaaaaccacaggauacaaauguaauguggcuaaucagcuggucuuccaccacccaccucuggagcauggaaggccuuguccagccuugccuugccaagccaagggucaucucuaguccacugagcccacccucuacccuagcaccccuccugucccaagagucauugacccucaggucaagggauaccagagccacuacagugaggcuggccgugucucugaaauauuuucuuuuuuuuuuuuugcccuucucucuuccucggcgcugccuauggagguggcagccaucuccuccucggcaucuuggccgcccucagaccccuugugaagcccaagaucgucaaaaagagaaccaagaaguucauccggcaccagucagaccauuaugucaaaauuaagcguaacugguggaaacccagaggcauugacaacaggguucguagaagauucaggguccagaucuugaugcccaacacugguuaugggagcaacaaaaaaacaaagcacaugcugcccaguggcuuccggaaguuccugguccacaacgucaaggagcuggaagugcugcugaugugcaacaaucguacuugugccgagaucgcucacaauguuuccuccaagaaccgcaaagccaucguggaaagagcugcccaacuggccaucacagucaccaaccccagugccaggcugugcagcgaagaaaaugaguagacagcucgugugcacauuuucuguuuaaauaaauguaaaaacagccaucuggcaucuuccuuuaaaaaaaaagaaaagaaagaaauauuuucuuucuuuucuuuuuuuuuuuuuuuuugagacgcagucucgcucugucacccaggcugaagugcaguggcacgaucucggcucacugcaagcuccgccucccggguucacgccauucuccugccucaaccuccagaguagcugggacuacaggcaccugccaccacgcccagcuaauuuuuuuguauuuuuuuaauagacacgggguuucaccguguuagacaggauggucuugaucuccugaccucgugauccacccgugagccaccgcgccuggccugaaauauuuuauuuuuguucaucuuuguugugcuuauaauacuccuguuuucuguuuauuccccugacuugaaccagauguuaggggaguauuugaagcuccucguucccucucuucaucaauaucuucugucuagaaacuaaccaagcaccuuaucuggcuccagaccucucagugaucugugggaggccaacucgcaggauuucagcagaguuugcacuuucuaggccuaaaagauaaguccuuccauguguaaguucagauuaaaggcaacauauugcauuuacauuuuagagaggugaacacauuauuuucugggacuuaaguguuguuuuguuucuuuuuuuuuuuuuuaauguaguuuauuucucuuucuaagagauuacaggauucaagaauggcaaugaaucuuaauagccuuugggagaaagcagcaaagcuuuaauacuaaguuccaggaccaugaacuuccauguuguccuaaaugcauuuuucaaacauugcuuucugugccuacucuauaaaaccuaaaaauccaaggugacaguauuccuuaucuaaaauccuaaacaaggcugggcguggugguucauaccuguaaucccagcacuuugggaggacaaggcaggcggaucacuugagcccaggaguucaagaccagccuggccaacguggugaaaccucgucuuuacuaaaaauacaaaaauuagccgggcaugguggugcacacuuguaaucccagcuacuccggaggcuguggcgggaggauugcuugaacccgggagacggagguugcagugagccgagaucucgccacuacacuccagccugggcgacaaagugagacucugucucaaaaaauuaaaaaaaaauuuuuuuaaauccuaaauauucucauuccacaggauccugcaaacuguagaucccaaacuuggaaguucugggaauucugccaguauccccaaguaaaucucuugggaaguuuagaaugcugcauggcguagcugugccugcucuuauagaguggugcagacucugcuucuccacgucugcuaaguaaaauauuccaaacacagaucagccuuaucuagcgaaccaucacucugcucuugaauuuucuuuuggccucaaacucuagagcuauaacauguuaacgguuuaacaccagaggagaaagcuauucuuaaacuacucaaacaugguuuuuuuuucuauuuuucagacuccugaaacagacuacucuuugccuuuuugcugcaguuggagaagaaacugaauuugaaaaaugucuguuaugcaaugcuggagacauggugaaauaggccaaagauuucuucuucguucaagaugaauucuguucacaguggaguaugguguucggcaaaaggaccuccaccaagacugaaagaaacuaauuuauuucuguuucuguggaguuuccauuauuucuacugcuuacacuuuagaauguuuauuuuauggggacuaagggauuaggagugugaacuaaaagguaacauuuuccacucucaaguuuucuacuuugucuuugaacugaaaauaaacauggaucuagaaaaccaa

SEQ ID NO: 192116 - RNA, 45587 nt, Homo sapiens
aauagcaacuuaugauuauauuaaaaggaaaaaaaggcuuaauaauaaaauacaauuuauuaaaggaaucauguuuacauagauacagaacaucuuggauauuucaacaccauagcaacacaaaauuaauuucuucauguauaaaagaugugcugaaagcugcaugccucaucaguuuuuauuuuauugguuauggcuauaguugacaucuuuccauauaaaaacaaacugcacagcaucacauauagaguacagacaucuuaaguucauucacaaaguuaauuuuucuaaacugcccuucaaaaauuuacaucuuugcucaauucuaaacauucaacaaaauuagcuucccaagaaacaaaaaugauacccaauuucuuugcuuuucuagaaguaacuuuccauuuguucauguauuuugauauguuauauuccccacccgaauuaaacccuuuguuaaaagaacaaccuacuuuagguucagucuaaaaauaaagcguacuagauucuggaguguuuuucaaauauuuuaaaauauuugccacuuaugguuaaaaaaaacgugaauaagaauaucaugugaguguagauaggcaccauacuauacacuccucucagaaucauuucuagaauguguauaaucccggcguuaagugauggugggaaugauuugccuuuaaaagccuacaaauuaaaaggggaaagaugcuaagcuagaugcugguuuucuguaaagaugaauuugugaaaaacugcuuuauggucuagaaauacguaagccuggcauuagcugauggcacauucuaacauuuuauagcauuaaaaaacaucgacucauuccauuggaugaaagccauggugacauuuuuacaaaagcuguacccaggaauccacucaacguccucucuucaauugucguuuuucaucaacaaagccuauauauauauauauaaaugaguugcugugcucucaccauggagcaguguugauuugauguaaugaaguauuaaacguucuccuugcucucuuugccuucaacuaaguuucuguuaguuuuuggcaugccagauucucugcuuccaucuugauuuccuaucucacugcaugaccaucuuagagcuguuacuaauucaaagucugggguuuuuuucucccaaaggucagucuaaggaggcagccaccuauaugacaugacgucagagggauuaggaaggacccacacucaccuucccuaaggcuuacugacuuguacauaagguuuauaauuuagguauacccacccuaaguaacaucugauugaaggcaugaacuugcuugagauccacucucagaaacagguuuagaggggaaaagaaaaagaauacugggagcuucaaggaggaagaaaagggccacagaacaaggggaagcugggccuauagcaguccagcaugguaaggggccaacaguuggcuucuaaaagguaauggguuaacacagucauccuaauaccaccuccugagaugcugaauuuucucucagcuaaguacacauuucuauuuucagggacagcuuacauaaaucagaauuauauuuuuaggaaucuuuaaucaugaauuccucucuaaauuucaaaauauuuuaugacuucuaaggaaacuuuuuuuacaauaaauaauaaagaaagauuugggauuugcagaaucuucuggcccaauuaaaaacaaaagaagcuguaaauauccagaacuuaauagauguauaaauuauaaacaaaacaugucccugccccaagguauugaaauuacauuacuauagauacaucccauuuaugagguaguccgauuccucagauguaaugggacgagcuuuuuucaguuucuguuucaccagucguagucggcaugcaaccaugagaagcagcagagcagugauagccaaacccagcgccagggguagcacugcaccuuugagaagguuagacaugaagagggcaagccagugauuagucacagugacagcuacuggucacuauaugauacgcgcuuugcaugcacuauuuuauuuaauccaaacaaauuguuauuaguauuaucacuauuuugcagauuaacuaagguguaccaagguuaaguaauuugcuuauuugccuaggaggcuguaaguuguagguucaggucccaaaccuagacuuuuuuuuuuuuuuuuuuuugagauggagucuugcucuguugcccaggcuggaguguaauggcucaaucucggcucacugcaaccucuaccuccuggguucaagcgauuccccugccucagccucccgaguagcugggauuacaggugccugccacugugcccagcuaaauuuuguauuuuuaguagagaugggguuucaacaucuuggccaggcuggucucaaacuucugaccucgugauccaccugccucggccucccaaagugcugggauuacaggcgugagccaccgugcccggccaacacagaccucuuuaaaaccaaauucucuaccagcuuccuacaaaauuuguauggcaucaauggguacacauacuaccaucugaucacucauauccaacugaaauaggcauucugaucacgaaauuuuuuuguuguagucauugacuauauuuaugaauucauacaugaucauucuucaacuaaguaugaacuaacuccugauuucuuguucuaguuagggcuuaagaaauuuauuuccuucuaaauccagggaacugacucagucaguagaaccuuuguugaaaacuaacuuccaaauaugcuggugugauuuuggacauuaaaggaaaacauuucuuuaguuuuuccugugagguggauucuagacaccagaguagaaguagcgaggcuugcaggagucuggaaggacagggugugccaauaucagucuuuuuuaucaagcuuagcaggcucuauuuuuagucugaucuacucuguggccaggccaggucuggagauuauaugguggaacuguuuuuagcuguagggaucuugccaacugguagaacuagaggagaaacaucuccuuuguguaggcucauucuauaccauuugcucucauuuauucauucauucugcauucauuaaaagccuucuuccaugugccagacacugagcuaagugcugauaauccuuuuauuuguaaauaaauaccaccccccucaagauaagcuaaggccaagaauaccagcuuuauagcuuaaaucacugaauucucacaaccaccacauaaguuggugcuauuauuauccccauuuuacaaaugagggagcuaaggcaucaacaaugaagugagggccaggcacgguggcucaggccugugauaccagcacuuuggaaggcagaggugggcaaauugcuugaucccaggaguucgagaccagccugggcaacauggcgagaccuugucucuacaaaaaauuauuagccaguuguggcaugcaccugcagucccagcuacucgggaggcugaaguaggagaaucaccugagcccagaaaguugaggcuguuaugagccaugaucaggcuacugcacuccagccugggugacaguguaagggccuaucucaaaaaaaaaaaagagaagugaggcugggcacaguggcucaugccuauaaucccaauacuuagggaggcuaaagcagaaggaucacuugagucugggagguagaggcuucagugagcucuuaaacuguacuccagcuuggguggcaaaguaagauccugucuuaaaaaaaaaaaaaaaaaagacugaagugacuugucuaagauuguuaagugguagagcuagcaaauaaccccagacaggacagccccagagccugugguucuauccacuaugguacucuacuucuacaaaauguaaaugagacaguuuuugaacgaguaagucuggguagacagacauuuaaaugggaaaaaaugcaacaaaguguuauacuuacuaugauagaauuauagaugaagcauaguuguauuaauaaaauaggugguccaucuaccuggucuguaggauuuuugccugagugauuuugauguaugauagagacuguuggguggcugaaggagguaaguuuauuuuuugacauuuucagauugagaugccuaucagcgaucagguggaauuuucucuuaggcuuuuggauuagcugggccuaaauaugugggagccuuuagcauaaaggugguagcugcagucacaauagggguuaggacagccagagagaaaggaagaagaaaggugagccaggaacgagguccugggaaacaccagcauuuagagggcagacaaaagcagaggaccaaaaaaaaacagaagaagaccagucagagaaauaggaggacaaccgcuauaguagggagugggcuuuuggaagcugaggaaagagacguccaagaagaaaguccucagcugaaucaaaugcuaaggaaaugucaagugaggugaagccuggagagcccccuggauuuagcaauugguaauucauuuaugggaguacagaagauggaggaugcuacuuuguuucuuuacacauuaagaaaucugaacaugaucacagucaggagaaugagccaguaaagaaacagagaugaaaaacacgggagagcuaggagaugaugagaaaugaaccugaggaaaucaggggcuuuagccagaucagggagagaccuuggaaagaggcgacaccucuuccuuuaguacuggaggggaggaagaggggugaaugcaaccagaugaguuuuuacauuuggggggcagguagcugaggaaguucacuccagacagucuugauuuacugggcuuaaaacuggucccagguauagcuggccgccucuugaagacaagaggaccuggagcugaugacacacucacggcacuugaacucugguguauuuuuagaaucccagguaaaacuccugaacaagauucucaagaacaguuugaaagugucugguugccggaggaggggaugggaaagcugcuuuagagacuguuagguaucaaacaaaguucuggaagaggccagcauuccuccagagaauugugaaagauacaaaucggugauaacccuauggacuggaauuggauucuacggcugucucauuccauacacagcaguucuggaggugucaagauggcugccuggucucuccaugccagcaguuuggggcuucaguagcuacuacugccuccuagucuccaccugaugaaagaaguucugacaaggcuaaguggccccaaggugucauucucccuccaccuuccuauaaguugcauauguuacaaaggaacaggacaaaaaaagagacuuuggucaauacccacagaaaaccccaggaaccccaaaucauuucucaugaauuggaccgcaacacccagccccaguccgggggacuugcuuaaagaugagcaucagcauuuaggcuaaaggguuaugaagcugugguugaagaugccaaucccaaugccggggcucagguuuagcuaugguaacaauaaaacagacgagaucugggaaaauguucuauuugcuaagucagauaugaggcugcugaacugucugaucugauuccuguuuaaugcuuuuaugacaaggaaaaugaaaucucccaaaaguacuugccagaauauugaaaauuauucuugacuuuuaauauuuaguuggcuuaguuuggauaauuugagauuuacaacuuucuagcuccuucuaaaacacaccaugaugcuauucucaguaaccagcuagggugaugaauuauguauucuguucauaugaaugggggugacauuuaaaauauguaacaggcugggcacagugguucacaccuguaaucccagcauggugggaggcugaggcaggaggaucacuugaggucagaaguuuugagaccagccuggccaacauggcaaaaccccaucucugcuaaaaauacaaaaauuagccaggugugguggcaugcaccuguaaucccagcuacuagggaggcugaggcaggggaaucguuugaacccgggaagcagaggcugcagugagcugagaucgcgccgcuguacuccaaccuggacaacagagugagacucgaugucucaaaaacaaaacaaaacaaaaauauguaacaaccagaauaggcaacagccaacuagagcugagacucucuggauacauauguguggggaggcaagaggcaggcugguuucccucuucccuugauaggggacagggccccuuuuauucaaauaucuugggacaggcuaaguccaggaggccagcagaccaagggggucacccagguacuugacaucuggaguauucuuagcuaucuauuguuuaaacauuauauuuuaauauuguccugauauuauaaauaggguaaaaagaaaguuuucucaauguuuauaacuuaagcuuauauuuuguucuucuaaagcuucuuuuacuaguuugugggauuuaagacuaaagccugccuuucuaaaggaugguuuccaaagucuuuucuuccuaguuaaaaucaaccaaaauuaaagaaauuauuguauucuucuuccacuuaguaaauauucuacuuccuacacccuucccucauuucuguuguuuucugucuuugucacuagggcacuuggaaagagaacuagguauucuaagaccuuuacucuucuuucaucguaaauaacugaguaauaacugccaucguuucuauauuuggcucaucauaugagccacacagugcauucaaugcuugagauuaauuaucccauauauucuucucagcaacccuaugaggcagguauuguuacuauccucaucuuacgaaugaggaaacugagauccagagagauaagauagccugcucaaggucauacaguuuaguggguaagugagaauuuuuuuuuuuuuuuuuugagacggucucacucugucacccaggcuggagugcaguggcacaaucuuaucucacugcagccucgaccucccaggcucaagugauccucccaccucagccucccugggacuacaggcgaaugucaccacacuuggcuaauuuuuguauuuuuuguagagacaggauuuugccauauugcccaggccggucuugaacuccugagcucaagcgauccuccugccuuggccucccaaagugcugggauuacaggcgugagccacugugcccagcuuugagcaaggauuugaauuguggcaucugacucuaaagcuuguguucucccaccaugccacaaguaugacauuuuccacaggugucacaccuggaaggguguauagaaaaggcagcugagguccaaagauggaagguuacuaucaggagccccaagacgcagugcaauacaagcaacgaggagacaguucuuucgguccacugacggacuccuccuguccugagcucucauggccucagggaauauccucagccagagggcaugcaguucugagaagacuacagucugcaaaggguuuccaagguggacauuuaccuguuucuggggcuggguguuccccuccuccuccaucacccuuugacucaaauauauaacuuuccucuuuucuguucuucccugaggaacuacuaucugcagaaaagaaagagaacauauauugaagguguaugcaucagaaacuucaggaaacaaaugugaaaauacagccuuauuuuuuuuuaagauggacuuagagaagaacuguuuauuucucuacuaaacaaaggccuauguuugauaguuaagcaguaaauaacuaaggugacccacugaauaaagcaaaguacgcagcuaauacgaaaccaccgacagagagagcggaagacacacccugcaccgaacuaccaccacgccucuuggagaagggagaucucaggcuagaagagucacagggagucuccggauaucacgccaugaaaagcagaaaccagaaagguuuuucuuugaagaauaaacaaugggcauauauaaggcauuuagacaugcucuuucucuuucucacaacucuggauggcagguauaaauagcucaauuuucuuucugguuaggcucagggucagguucguaccuagguucacacaaguaagugggucacagggcugggaugcaaacugguuucuugguagagaccaguacuucuaauuuaaugauauauuacuuaacuauuaaguuauaauacugagggggaaauuauuauuauuuauuuacuuuuuuuuuuuuuugagacagagucucuguugcccagauuggagugcaguggcacgaucuuggcucacugcaacguccaccuccuggguucaagcaauucuccugccucagccucccgaguagcugggauuacaggugcgugccaccaugccucgcuaauuuuuguauuuuuaguagagacgggguuuugccauguuccccagaugggcucaagugauccgcucaccucagccucccaaagugcugggaugacaggcgugagccaccaugcccagccuuaagugggauuuuugaguauuacaaugcuuaauggcaaugaauuagaaauaaucuacugacaaauuuuauugagaaaauuuuuaaagcuucuuuacucauauggcaucaacauaaauguuccuaauuccugcaaaugaaauaagacuauuuaaagguaguauauaaaauucuuugguaacuugcauuuugcaaauuuacuaagucacaaaguuggccaggugcacuggcucaugccuauaauccuggcacuuuggggacagucuacugugucuuguuacucuagaaaguuccauguauguugguccuacauacagccaauaauuugggcuuucuccauaaacucugagcucagacagaaggagagagaugaggaaagcacagccauugcucauaggcugcaggaucagauuucccugcaaaaagaguucuguuacuguccaacucacugcaguagccacgacaguggucaccaaggaccucuccagcuaccuggauucucuuauaugauaccugaucccaggccagguaguucuauaagauuguauuacauaagggccgcacgcaguggcucaugccuggccaacauggcaaaacccugucucuacuuaaaauacaaaaaaaauuagccaggcauggugggcgccuguagucccagcugcuggggaggcugaggcaggagaauggcgugaacccuggaggcggagcuugcagugagccgagaucgcgccacugcacuccagccugggcgacugagcaagacuccgucucaaaaaaaaaaaaaaaaaaaauuagccaggcaugguggugggcgccuguaaucccagcuacuugggaaacugaggcaggagaaucacuugaacuugggaggcggagggugcagugagccaagaucaugccaccgcacuccaaccugggcaacagagacuccuuuucaaaagaaaaaaaaaaaagauuuuauuauauaugauucuggccuaggaagcuauacuagaaguacuguaaacaucugcugacauaggaaagcacuauuuaauacagaaaaauaagaccaugcagcuuuuuuauuuuauuauauuuuuacugcuaguagacagaccagagugcaauuuuuguggcaaguaauuuuuacacuuuuucucaggggugagguaguuaauagguacauauuuaaccacugcuuuuauggugcaaaucucaugguguugauauccauauugaaaauaugaguauguuuuauuuucuuuuuuuuuuuugagacagggucucccuuuguugcccaggcuagagugcaguggugcaaucucagcucacugcagccucgacuucccaggcucaagugauccucccaccucagccucccaacuaacugggacuacagguaagcaucaccacaccugacuaauuuuucuauuuuuuuguagagaugggguuuugccauguuucccaggcuggucuugaacuccugagcucaagcaagccucccgccuugaccucccaaagugcuggaauugcaggugugagccacagcaccugaccuaaaaauaugaauauuuucaauagcauuuugaagguucaauguaagccuuguuuagauuacuacagagacuccagugaauguuccugagcuuuugcuugguagagauauagaaaacauuacuguguuuuaaagucaauaaugccugauuuuuucaaaugccaguugcucguggaucuccaaaagaaacacaagauuuguucuguagagauauaaaucagugauaugcaaaacaguccauccagcagccgcacacacaaaacuagcagcccugaaacagcuuggaaaucaaacugcuaaguuaccuaaaaaccacuuguggcacuucucccuucaucccuuuccuccucccccaugccguacugccagguuagcuugcaaaggaacuucuaugcauucugcuuuaucucucucuccaauaauaaauuuggaagugggaagaucacauggugggaaacucaaguccuacuuuuuaaaaauaauaagccagggccugggcaugguggcucacgccuguaaucccagcacuuuaggaggccaaggcagguggaucacuugaggucaggaguucgagaccagccuagccaacauggugaaaccccaucucuacuaaaaauacaaaaauuagcugggaaugacggcacacgcuugugaucucagcuacuugggaggcugaggcaggugaaucgcuugaauuugggagguggagguugcagugaccccagacagcgccacugcauuccagccuggguaagagaacgagacuccaucuaaaaaaauaaauaaaauaaaauaaaauaaaaauaaaaauaaaauuaaaaaugagccaggaauaaaaacaaagugccaaaauucaccaacucccgauuuuuuucagaggacuaacugguuugucuuucacccaauaaaaaaaauaagauaacugcauuuacaguguucaccucacuguuucuucccaaugaagaugagagcuugcucaucuuaauucuuaaaggaacucaguacuggaaacacuacugcacuauuucuauuuuuuauuugaauuaacugccuuauacacuuggcgcucucuuacccugguuuccuagcgaauaccacuggacuugaauguucuagcaaaaauucaaacagcacuaacauuuacugagagacaucaauuauauuuacauauaauaucuccugcaaucuuuguagccauauuaugagagauuauuauccucuuuuuuuuuuuuuuuuuuuugagacagaauuucacucuuguugcccaggcuggagugcacuggcgcaaucucggcucacugcaaccuccaccuccuggguucaagcgauucuccugccucagccucccgagaagcugggauuguaggcaugcaccaccacgccuggcuaauuuuuguauuauuaguagagaugggguuucuccguguuggccaggcuggucucgaacucccuaccucaggugauccacccgccguggccucccaaagugcuggaauuacaggcaugagccaccgugcccagcugagauuauuauccucuuacagguaaggaaaugaaguuuagagaaguugauuacuuaguagcuaguaauugguggugcuggaauuagaacccaggacugauccaaagcaguuuuccauugaaccauacugcucucaaggucacaacuagcaaauacgaguuuuuuacuccaagaaccaagucaauacuauauuuauuuacucauacccaggcaaaaucacacacuuuuaaaugauuuuuaggaagguucuggacaaagcuuuauuaaggaugcaguagagaaauuggcuaacuguacuugcaaaagggaccuaaccucacagguggguucauguaaaaaacuaugcaaauucuuucugaaucuucaguugucaaaauuaaagagcacuuucuuucuuuaagaaaaauuuuuuuaaacagcauuuucuuaaaugcccuuauucccuggggagaggaagauggugauguagggagggaucagguaucaggcagcgggcagugugcaugggagacuucagaaggcgcaguugccccagacucuaggauuacccaggaaccuggcccugccuucuggguaacugaaaugugaauuucugcuguuuacauuccaugaaggaauucccuaugauuucccagucugccugauucauuuuuccuagauuucagcauaaggaacgccauagagaaaugcuucacuuucacacauccaaucacaggcucuagccaguguggcgaaucgaaacaaaacaaaacaaugacaucacuugcuucuggaaauaguuacuuuugguaaugauccuucuggaagaguuacaugucuuaggagaccauuuuuccuuucuucugaauguauuauguuuacuaugcauggcgacacauucacagagggaauuggcagcuggauggaagcuguuuucauuucauuuccagcugccauagagcaugcaggcaugauccggaagaaauacuuuaacaugcccaggaauucucaaguuucaaaaagcagauuccacgugaauguggauguagcaccacuuuucuagcccuuuguagggcuggaaaccagauuucuuuccucgggguagcuuggauacaagaggguggaauuguuaaugaaugacauggaccacacagagaacaggcccuacggcuaugaccauggucaacaauccagccauugugccuuuacaugcugagcaaacacaggccacacuggagcucugugcuccuccugcccgguggcucagaguguacugagcaugcauucgcugguguaacugaaugucugcacauaccuucauuuuauccucaguaaccuguguggaauaaauccccaaaagugggacaauugggucaaagcacacauaguuuuguuuuagagaugaggucuuacucugucacccaggcuggaguacaguggugggauuacagcucacugcagccucgaccucccaagcucaagcaauucucccaccucagccuuucaaguagcugggauuacaggugaauaccacaagcugauuucuguaguuuuuguagagaugggguuuugccauguugcuagggcuggucuagaacuccuggccuuaagcaauccaccugccuuggccuuccaaagugcugggauuacaggugugagcugcugcacccgaucauauacauaguuuuaagccuucagaaacuggccucuggaaggacguacuaauugcauugcuaccagcagagugugagacuuguuucucucuacucuuagaaacauuaauuauuauaauucuucaucauugucaaugugauaggugaaaaacuacaucucacuacuuugcaugcuacacuguuaguauuaaucuuaguaucuuguuaacaagucuuccaugagcuaagucuuuuuuuuuuuuuuuuuugagacugagucucacucugucaccugggcuggagugcaguggcgcaaucuuggcucacugcaaccuccgccuccuggguucaagugauucuccugccucagccuccugaguagcugggauuacaggugccugacacuacgcccagcuaauuuuuuguauuuuuaguagagaugggguuucaccauguuggccaggcuggucuugaacugaccucgugauuugccugccucggccucccaaagugcugggauuacaagcaugagccaccgcgcccagccgagcuaagucuuauuuguccucaccacaugucugugcaggaaggaggcagcagugaauuuaacucauucauauuuauuguacuagcugauggucuucuuaaaacccaggcaugugucaugaacaacaauguacuuuuuuuuuuuuuuuuuugagauggagucucgcucuguugcucaggcuggagugcaguggcgcaaucucagcucacugaaagcucugccuccuggguucacaccauucuccugccucagccuccuaaguagcugggacuacaggugcccgccaccaugcccggcuaauuuuuuguauuuuuauuuuuauuuuuuuauuuuauuuuugagacggagucuugcucugucgcccaggcuggagugcaguggugcgaucuuggcucacugcaagcuccaccucccggguucacgccauucuccugccucagccucccgaguagcugggaccacaggugcccgccaccacguccagcuaauuuuuuguaguuuuaguagagacagcguuucaccauguuagccaggauggucucgaucuccugaccuugugauccgccugccucggccucccaaagugcugggauuacaagcguaagccaccguuccuggccuuuguauuuuuaguagagaugggguuucaccguguuagccaggaugaucucgaucuccugaccucaugauccgcccaccucggccucccaaagugcugagauuacaggcgugagccaccgugcccggccaauaaugcacuuuuaaaucuacuuaugggucuuuaacuuacaugaaaucagaggcugaggacucuacucugguggucuuagggacagcagagggggagggcagggacagcuacugucugaacagaaacuacaggaugugagggcucuuucuaacauuuucaguuuuguuuuuuucuucccacuuucuucaccccaggacuuucaaaaaguguguuuuugaugaauaguuaauaauacaugaaaaugcucaugaguaagaaaaaaguuuuauaaaagcauuauccugcuuuuguuaaaaaugaauaaauauguauauguguaugaauagaaguaaccagaagaaaaugcgacaaaauuuuaauggugaguuuugcuagaugcuuuuaacuuucuuuguauuuuucuauauuuucuacaguaaauccauauuauuuuaauaauuagaaaaagcccuaauauaauaacuguacaucuaaucucucugcaucugugaaagaccacucuuuacaucuucauaaccaaauccaaaggcugauuaucaaaaagcaaaaggagagaucauaaauagauuggaaauugggugcugacucccaucagccgcagguggcagccuggagcauuauuuucuuuuuuuucccuccaacuucuaaguuccgggguacauguguaggaugugcagguuugucacacagguaaacgugucauggugguuugcugcacagaucaucccaucccuagguauuaagcccagcauccauuagcuguucugccugaugcucccccucccccuaccucccacccucugacaggccccaguguguguuguuucccuccauauguucauguguucucaucauucggcuuccauuucuaacgugaggacaugcaguauuugguuuucuguuccugcguuaguuugcugagaauaauggcuucuagccuggagcacuauuuucaaaaggauucugagcuaaguccacauuccccaugggacagugcugggaccaaugagugacaccuagcauggguaagggcugaugggguaaaguaugaaugucagccuauuuaucauuccucagugcuggacagcaccuuggaggacaucugguugaagucccuuauuaacagaugaggcaacugagguccagagauaugaagugacuuauucaagguucuaaagguagagccaagaccugggcuuuggucucgacucuacuuucagcuaauuuguucaugcucacgugguucucuccaccacaguaaugugguaggaauucauccauccuggccucugauaacacagaucucuccauaaacucuucaccccuucggcaguccugccaaagaugccuggucugcccaacucuguuucuuagauugugaugcucuucuccauacaaacuaucuuaagcagagaaaacccacuaaaaccacauccaaaggcuugcauguagugaccgauuuuaccaguagguggcaguaccaaccaggaauggaccaaaaaagcagacacuuggcagcauucuuaaccaaaacucagaaagaaaagccccugauagaaugcaauguuuugcagacauauuuuuauggaggcacuuaaaaucuacaaggcacauaaacaagaguggaaggaaauauaacaaauauuaaaagcaguuuucaaaagaggugguauuuuaaauucacuuuccuucuuaaauuauuuugcaucuuccguaucuuguacaaugaacaaaaauuuuucuuaauaaacuuacuaaaaucaugucagguuauuucaauacaacuuaugcagagucugaaaagacauuagaaaagcuuuuggaaaugugauaaucucuauuucugucucaugucacauaaucaugcaaauaauaaguguguaaaaaaugauggaauccuguaauacuuauugauugacugauugagacaaggucucacuauguugcccaggcuggucucaaacucuuggccucaagcaauucuucugccucagccuccagaguagcugggauuauaggugagucacugcaucuggcuaaauucuguaaugcuuuagucauguuaauguauuuuaggccaggugcagugacucacaccuauaauccuagcacuuugggaggccagccgaggugggcagauugcuugagcccaagaguucaagaccagccugggcaacauggcaaaaccuugucucuauaaaaaauacaaaaauuagucaggcaugguggucccagcuacuacgccuauagucccagcuacucaggaggcugagaugggaggaucaugugaguuugggaggcugaggcugcagugagcugugaucgcgucacuguacuccagccugggaaacagagugagacccugucucaaaaaaaauaaaaauaaaucucauuagccuuacuuuuuuuagugauagauuuaguuaaauuggaggcauaacguugaauuacuagcacaugcaucucuuucaagacaacuuguuuaaauguucacuugcuugggugaagaggauuuacacaaauacauaaugguuaugcuguuucaucucaaaacaaccuaaaauuuaacacuuuggguauugguuuacguaagcuaaguguuaauguauuuacaaauaaauguauuagugucucuggaguagguacaugaguguauuuaguaagugucccuuacuacaaauuagugcaaaugucaagauuuccccccgccuuucuggccaaauucuuaauuuuaacucuuauuucaagauacuuccuuaacacucuucaaacauaaacuuaauugugagccaaguuuggcuacagaaaacaagguucuucauugagaacccaccgugaauccuuaccuggcaucacaggaaugauuugacucucugguccccaaaaggcggaaugauuccucuucucuguguuugauaaugcagguggcuuguuuggggcaguggcuuucugagacuuuuccaccaaggagucacccccugcaucuucacucggcccugugguucuuggcagggcaggacuagcugccguguggguuaccaucuugcgguccaggcccacugaaguguggaagagcuacuguuaguugcuggauuucuuuucugagcuuuaauacuaaaaacacuacaucugcagcugauuuaaaaucacggauauuuggauguaacagcccacucaucuaagacaugucagaggaccauaaaaaucuauucucacguuuucaaauggguaaucuguucuuucuucuuccaauagucagcuuuccaaauguuacacauaaagaaauggacggggcccagcacgguggcucaugccuguaauccuagcaccuugggaggcagaaguaggcaaucacuugagcccacgaguucgugaccagccugggcaacaaggcaaaaccccaucucuacaaaaaauuaacaaaaauuagcugggcauggugguacaugccugcagucccagcuacuggggaggcugaggugggagaaacaccuaaggcuggggaagucgaggcugcagugagccaugauuaugccacugcacuccagccugggugacagagugagaacuggucucauaaaaaaaagaaagaaaagaaaaaagaaauggacaaagacuaaacguaaacuuaagguuuugagacucuucguccuuccucaaauccauacuucauuacauuuucuucaguuuuucuucuuucuuacaggguguuucuauguguaugauauuauaagacugauuuacagcucugacuuagccacacccugguguaucgcaaauuuucuuuaaaaaauuaucaaaacaaagcaucaaaucacugcaguuuuuaagaaagcacaugacaugcagcauuuuuaggauagaaagaaccuggaaaauugaaaaaaauuaaaaacauaagcaauacuaaaaauuugacauuugagacuuagacuagagacauauugaauucucauuuaaggcauagcuuuuacauguaaaguuauaacuaaaaucaagcaggggaaggacacuguguuugcauuucauucucagaacacagaccucccaacuccaucccuuccagccacugccuagcaaugugacauagccaacucacgauucuggcagaagucuucaucagacccaucaggacacugcugcacuccaucgcaggcgagcgugaugucaaugcagcagccaucgucacagaagaagugguagcgugagcaagugugcaaacauccuauuuguaaacaaaucucaagucacacgagugcagaaguucagacucucaagauggggaugacaaaggggaguccguggggaugauaaaaugcacuucggggaagagaugcaaauaaugaggcaaaccuaacaauuccagcaacagguucuggagagguuggagggcucuuuuugagccucccgacuuaauucuucagacuccucaggggcucuuggucugagggcuguucuccaugcuugccuugccaggagguggcacacagaagcaacagcccaggucucucuccacccuugauuccccgccucagcugucucccucuucauucauucauucauagaaaccauuguuggaaccucuucuucuggcugucgauugcucugcaggagggcaccuaauaccaucccauccccuggauggcaguuggcuauguuuuaacagagauaccauuuauuuauuuauuuacuuacuuaagacaaggucucacucugucgcccaggcugaagugcaguggcacaaucuuggcucacugcaaccuccgccucccggguucaagagauucucuugccucagccucuggaguagcugggacuacagacaugcaccaccacacccgguuaauuuuuguguuuuuugguagagaugggauuucaccuuguuggccaggcuggucucgaacuccugaccucaacugauccaccugccucggccucccaaagugcugggauuacagguguuagccaccgugccuggcccagagguacuauuuuacauaugcuaugucuuacauucuugucuccuaaguaauacuuuucacugagauuaaguuuuuacuauugaauccuauuuguugauuaucauaacgucccugguacuguagagaauaaacaaaauuuaguuaugggcuggcaugaauuuaguuucaugaaauaaugacauuggccaggcgugguggcucacaccuguaaucccagcacuuugggaagcuaaggcggguggaucacaaggucaggagaucgagaccauccuggcuaacacggugaaaccccgucucuacuaaaaauacaaaaaauuagccgggcuugguggcaugcaccuguagucccagguacucgggaggcugagacaggagaaucacuugagucugggaggcagagguugcagugagccaagauugugacacugcacuccagccugggcgacagagggagacucugucucaaaaaaaaaaaaaaagaaagaaauaacgacauuucucccuucuggaguucuuaggagcuuuuaauuugcagugcaauucauaggagcuacaaauauuuuccugaaaugcauuuucccucucccuugauuaagccaacuuuauuagacuuagcuagaggagaaccgggugacuaucugguacuggcaacauggacuaaggcacaaggcuagaagcaggucacaggagcuccacgguuuuacagggacagaguggacuagacaauucucucaggaacauggggaaguggcagauuauaugauauuccuucaaaaccaaauggcugagcacaguucacaaacccaagugaaaucuuggacauacacuugguuuuuuuuuguuuuuuuuuuuuuuguagauacagggugucacuauguugcccaggcuggucuugaacuacuggacucaagcaauccuccugccucagccucccaaagugcugagauuacagguguaagccacugcgcccggccuuggacacaucuuuuauugaaacgugguuaaaucaagagguuggaaaaggagucuaucuuggugugaggcaauuugaagauauauugauccaggaggaagagaaguuaaagaaaauaaauggugauagaagcuccugcggaagaagaggaagcaaagagccugcaguuaugacugagaacaugggccugaaggagagucagcuccggccacugggaagaagcagggagcggaggugggggacacgcuggauaucaagcaggauacaguuccucgucagguuucuuaaauucauggcaugaaaaucccagauaucucaagguuuuauuuauucuuuggugauuuuggagauggauccauauuuguaaauuuucuaucuauuuuuggauuagcagccuccaaacuuuuuugaucaugcauccugaucaauaauauauuguugaacaggcaucuccaguuuauuuauuuaucuauuuauuugagacggagucucgcugugucgcccaggcuggagugcgguggcacaaucucagcucacugcagccuccagcucccaggcucaacugacucucaugucucagccuccugaguagcugggauuacaggcgugucccaccacauccggcuaguccgguuuauuuauaaauaauacgugcauacuacuguacuaacaugggguguaucuuauaaaauauacucaaauuuuaaggaaaaaaauuaaaaaucagcaaaaauauaaacucugcugucuucuuucucacccuaaaaaugucuugaacaacucaggggcauccuguuuggagacugcugaguuagaucauguuggaagagcuugcuggcuugcuguuugaucauuuuucuaagcaugaaaaauguucaaaaugucaacuuauuaaaaauugaaccaaguuaugaucauauaagcaggguaccugcucaucugucuaccucagcuagugucacccuugguuaccauaacaucugggucauucauugcaagaccaauacauacaaugcaggggagggaaacacuugucucuucuaccucuauuuuccaaugucucucugugguguuuuauuaacuuuaauucauagcauguuauuccaauauaaccacuaagugauucuagacagcaguuaguacuucaccaauuccuuuuuauuuuccauauaaaguuacccacacaagaccuauacucaagcggccacugaguaaucaaaaaugauucacacaccacucucugcuacuucaaauacaguuuauuaucaucuuggagaagggccagaaauuuacagcuggcaauuuaccucuggagcccggaaagcugccugaggaaauaaaccaggacaaacaaguggccggugaggugcuggccaucugcucauaucagugcaggcccuuccucccucccaggcacuucagcuguacaagagcaauccuuuucugauuucuguggggaugacaggguaucugugucuuuuucccaagagucccuuccucccagagucagcacuugacucagacccuguccaggugagucccgguacccagggggaaagcccucuagagggcgcccagaucuacagaagugagccaucccugcuggagacaaugucaugucuccacugguccugguggccaagggaccaaugauguuuugaguagcugcccagcaaagggacucaacaauguuuugaguagcuggcuggcucuccuguccagcugcaaugaauuagcagggcugauggaauccgggcugagcuggacagacuguuuacucgcuaucacuggugaccucacagugcuggcacgggcuggaguuuggugccuguccugucugugaaugguuacccugcuuccuuacaguaagcuuaaccccuggcuggacagguugucaucagccaaacaaauuuuuaaugccgccuaugaaaauuaucaaaguugacaaguccuuaggauccuaaaaucucuaacuccuuagaaaauuucauuuccaguaugcauacuaaccucaguuuuugauagaaggcuagauccaauauaguacaaguaaaucacaguccuguuccaacucuuuuauccucauucugcacucugcuggcuuaauuaccaucuggauccugaguauugaauacugagaauucaaaaaugucacagacuuacugcaaguuuaccagagucagggaccaccagugcaccacucuauccccagugccuggcaaggacccugcacacugcauacacuaagaaaauacacgaugaccgaguaacaggauauuuaaauguacaagaccuuagcaccucuccagaagugaauuguguguguggugagggguucccucuacaauacuacaauaucuuuagugucgcuaaguuccaugcaauggauauuuuaaaaaauuugaugaccuaaucuuucuuagacauguagacguugggcugggcgcggugguucacgccuguagucuaagugcuucgggaggcugaggcggguggaucaccugaggucaggaauucgagaccagguuggccaacauggugaaacccugucucuacuaaaaauacaaaauuagcagggcgugguggugcacaccuguagucccagcuacuugggaggcugaggcaggagaaucacuugaacccaggaggcagaggcugcagugagccgagacugcaccacugcacucccacuccagccuaggcaacaagagcaaaacucccucucaaaaaaaaaauguagauguuuagaaaaguaagaaacauagaugaaugaaauaaguuuuacauuguuacauuguacaacagaaugugagaaccaucauauguauuuaaaguuauauuauuaauauaacugcaucugcguaaagugucuaugaaaauguguagguagcacuuucaaauugauggguccuuugcguauuucaauuaauuuuaaccguacuccuuagcugcacucuuuuucucuuucuaaaauuuuugaagugacuuauuauaucagcaauugauuacacccaagagccaagucuuucuucaauccugugguaugccuuuuccuuguuuuuuuaauauguauuuuuaauugacaaaagaggagaguauauauuuaugaggcacaaugugauguuuugauauauguuugcauuguggaaugauuacaucaagcuaacugacauaucuaucaucuccccuacuuguaaucuuuuugugaugacaacauuuaaaaccuacuguuuuagcaauuuugaaacagacaauacauuaucauuaacuauagucaccaugcugugcaacagaucaccagaaccuguuccuccggucucagugacacuuuguacccuuugaccagcgucucuccuuucccaguccgucccccgcacagccuccaguaaccgccauuccacucucugcuuccacgaguucaacugguuucacuaaacuccuuagcuucccucuuggaacagaugcagcaaauggaccauccaucuguaaacaaaguccucucccagaauagccaagcaauugucuuugaugaagucgagucaagagaagcgggagcaucucuucucauccccuggagugcuuccuccaccccaacccaguagcaucggcuaagcccaaaacagaagagagccugcuuuuguuauuguguuuuuagcaaagacucucucauucagcaauaaccaaaaauaaaauggaagagcccauggagcgcagagccagaggacaaagcgccaacccgacauugccuuccacaagcagugggaagcgagggaaggacuuucuucucaccuccuguggaguaggcugcgcgaagcacugucacugacacguugucagagcuucucugcccggcaguguccgucacggucagcuggaagguguagguucccuccuguaggugggacagcuucaggguuccugauugaggcaccugccacacagaugggacacaucacgucgagcagcagacuugagcuccgagcccaacaccauccucaaccgaaaguccauguccucagagcagccccaggaccugccucugcacuccggcccgaggcugcugaacuacaucacacacuguuggcagcuggcccaccuugaacucauaaguucuaguuuauuuagguggccaaggccuugacugacaaucccuucacuugucugcagcaguugcugcuccaaaccugcaccucauccccagccucacgcucaggauccaggcccugccgucucagcagggggacucaucagcuucagggagaaaaucaggaccaugacuagggcuccaccacccaccuccuccugguacccuaccuguacccacugucacuuccuucugacagccagcagggagaagcugucccuccuguguuccaggccaaccccuccuucuaguccuugcccccuuucuuucuaggaccuuuagaacacugacacaucgacucauuucucuuucaaauggcucugcuauuacuaugcucaaguuucucucauccuaagaaacaaacaaaacaacaaauaaaaaaaauucccugagcucuaagggcucaccagccacagccccgcuuccuucccaucuccacuuggcucccugaaaggccuggcugugccgugcuugcuguuucuguuugcucacuucccauuuagucuucgcccacccaauguagcugcuuuccccaccaucccccugaaacagugcuggcaaaacucacuaacugaccuagcaaaagucuccuaggugucaagaccaacaauacuauuuuuaaaaaauccaugcuugguugggcacgguggcucaugccuguaaucccagcacuuugggaggccaaggcgggcggaugaugaggucaggagauggagaccaucuuggccaacauggugagaccccaucucuacuaaaaauacaaaaaucagcugggcaugguggcgugcgccuguagucccagguacucgggaggcugaggcaggagaaucgcuuaaaacugggagacagagguuguagugugccaagaucacccacugcauuccaaucugcugacagagcaagacuccaucucaaaaaaaaaaaaaaaaauccauguuuaacuggcccucuuacuguaucuggccaugcuggccacuuuggcuguuugaaaaccccugcuuccuuggccuccuuuucuauccaaguucccccagucauucauugcagaagcccuccugggcuucaguucugaucacucccuaacccagggcuccaugcuugcccucugcucucccaacauucacaggcagcuugcugagcaugcuggaacaacagcuucugaagcucagcucugugguaggauuuugggagucacugcuggacagucagccugaagacuguuuuuccagcucuccuaaugauucuauuaccuauuuaauauucuauuuaaaaaaauuccuuucugcuuaaaugaacuagucuggauauuguccucugcagaaugcugaccauuugacauucuauuacauugaugcguuaauaauggacuuuggaaauuacagaggaugggauuguacuauuauaagaaccaucugcuuguuuuuaauuaggaaauccuagaauuuggacugacuuaggcuuagaggauuugucaacauuacauauacacacccauaggaugcuuuacaaucauuuagauauaaugagauuaccgugguugucauauguuaugccacuuuagcuaagguauggauuuccaggucccagccucagagagucagagucaguggguuggucaggagagcaggacccaggauucuacacuuaccaagcccacccaggugacccaugaucacacugaaagaaacacuggugcgugguuaagagcacagaacccgguguccaauagacauggguuugaaugccagcccuaccccguaccagcuggcugaugauguacaagucacuuaacgucuccaaaccucauuguuuucauuuguaaaauggaaguaauaauagcaccuaccugaugaggaucaaauaagguaacucauguaaaagagcugggccuggcccauaguaagcgcuuaaauauauccaccaucuccacugguugauucuuaucucuaacugaacauuacacaaugacucuuuacagacaaagaaacgaauccccgugaagugauuuucauucacugcgacagugacagaauugagaccucgaguuguaaaacagucuacacuggccuacaagcuguccaccacuuucccugcaaaagccuuacuuuggagggcuggcaaugacggccaccugccuuuuguuguuuauuucaaagagauguuaagcagugcucacugccacgcuguuacauuaccuucaggcccaacuacacugacagaaugccaaacgggucauuuacgugagugcuaaaauacuaagggcagcagagagagcucuaaugacaauaagagaacuuccaaagagccuggagugggcugcugaugcuaggaaucagaacccacugaaauaaaaguggaagucagucugagacaggacaagaccagauaaugucuuaaucugaucagauaagacuuggggcucaggucuuaucugucggauaagaccaggucuuaucuggucagauaagaucagagaaucagauaaauaagagugaaaacaagacuagaacucugguuugagaccucaagauugcauuuaaugauccuucuaucucaccuccaauccaucaggaauuuccauggggucugccuuaaaaacacauccagaauuugaccauguaucacccuguccgcggguaccaccuugcucugaccccagccugucucuugccugggucacugcaguggccaggaggccugagcucugggaagaccagggucugcugucuccuuuuuucuggaaacuuuuccucccaccuucauccgcagugagaggaaggucaguuauggccucuucccaugggcaccaggcugaaccaaggcaagacaaagacagggcaaggugcagguggugaagcucagagcugcauaaguggagaggugggcgggugugucacaggcucuggcucucuuuaauccuagcucggaaccaggcuggugggcagcagugcaauagcuuaugcccucauuuacugucucuugggacuuaggaacacaagggagcauggcugcaaaugacaggcaugcuggaguaugucuaggugagacccugcagccuucagucaaguaaggugacacaagaaagcugcucugucccagcugcuccgccugaaagcagacaagaagcccugagacugccagggagcagcaggugcuggcccccugccaugguaugugaguggaggcgugggcugcaggauugauucggagcagagauuuagaagguuggugugacggggaugcugagucaugaccagauucugagaguggccaucggaguggagacaaaguuaacagagauuuuaaaaaacaccaaggggccgggcacaguggcucacgccuguaaucucaccacuuugggaggcugagguggguggaucaguugaggccaggaguuugagaccagccuggccaacaauggugaaaccccaucuuuacuaaaaauacaaaaauuagccagguggugcaugccuguagucccagcuacuugggaggcugaggcaugagaaacucuugaacccaggaggcagagguugcagugagccaagauugcaccacugcacucuagccugggugacagagcgagauccuaucucaauauaaaauaaaauaaaauaauagaauagaauagaauagaauagaauagaauagaauagaauagaauagaauagaauagaauaaaccaaggaagcacugaggccagggagcuggguguaccauccaugaggcugcuggcgucacccugugccagagcucccugcaaaagucagugagucacugagcuucugggugucaaagcucagagugccaaugucagacuaaacucugcaggccugcgguucacuagcaagccucuugucaacacuggggcugaaaggacagagcaucccugggucaggggccauccucacaccuggccuuggcaugcuuccccccugccugcccaggcacugccucucugauacaggcaacacuggguccagaugcagaugaugauaucaccucagccuccugagcacacuccaguuuagaucuauccagauugaaugucccuucccuagcucuuuuagcuaacgagagcugucucuccugcauucagauauuuagaagauguagaacugucacacggaugcuuucccuuuaagggcccaggugacccuucuauacauuuucucccauuaggaugacacuggagagaggguuuacaguguuucacagacauguuccaaguaucaggauaaaaaacuaucuauauauguacacacaacauauccaauuuguaacuuggaaaaagacaugaucauaaaccaggagcucccaaucucugcucaagaucccuguucagcaguaacagccuuuggugguuggcuucuggccaaaucaaugaaugacucagccuguugucugacucaaccccaucuuccuagcuaggaauucaguggcuagcaauacacguuugggcuucucauauaugucuaaacuaaauuacacacacacacacacacacacacacacacacacacacacacacacacacacacauuguauauacuugguuacaaagacuuaguaauaccugucuauuuaaaaaaauuauguacagcagguaggccaggaugcaguuaguuuuaauuuaauaaugaaguuguugguuuaaauaaugcccauccuuuagcaagcuuccuuacgugugguuuucugaagucacugcuguagacugaauggcugagugcccucccaaggucacauguucaaaccuaacgcccagugugauggcguuuggagauacgugcucaugaaugagguuagugcccuuauaaaagaggucccauguuauuaaaaaguaaaaaacaaaacaaaacaaaaaaaaccccaccagaugcuggugagguuguggagcaaagggaacacuuacacacugcuggugggagugcaaauuaguucacccauugugaaaagugguguacuguggaaaguggugugacaauuccucaaauaacuaaaaacagaacuaucauuugacccagcaaucccauuacuagguauauacccaaagaauacaaacuguucuacuauaaagacacaugcaugcauacguucacugcagcgcuauucacaauagcaaagauauggaaucaaccuaaaugcccaucaacgguagacuggaugaagaauaugugguacauauacaccauggaauacuaugcagccauacaaaacaacaagaucauguccuuuguaggaacauggaugcagcuggagguccuuauucucagcaaacuaaugcaagaacagaaaaccaaauaccacauguucucacuuauaagugggagcuaaaugagaacacauggacagagaaaggggaacagcacaacgcugggaccuacuugaggguggaggauggaaggagggagagguuuagaaaaaaaacaaaacugcuggguaauaugcuuaauacccaggugaggauauaaucuguacaccaagccccuaagucauaaguuuaucuauauaacaaaccugcacauguaccccuuaaccuaaaaguuaaaauauguuuaaauauaaaauaaaagaggccccagagggcugccuugccucuguugccauaugaggacacagugagaagauggcugguuauaaaauaagaaauggguccucacuagacgccaaagcugauuguaccuugauuuuggacuucccagcauccagaacugaaagaaauucauuucugcucuuuagaagccacccagucaugguguuuuauuauagcagaccaaauggacuaagauaaucauuuagaaaauuuuaagcaacugacgaauguaaaucaauauacugauuuaugaauuccaaaucuccugaauguccuacuuuguaucauguuccuaaaugucauauuuuacauucugacuucagauuuaaauguauuauguuuaauaaccaugaaagucagcaucauuuaauggguugccugaaaaauaugugucaucuugcauuuugauguauuauaaauauucaguuaaguggauguaaaauauccuguucaagggcauaaaauauauaacuuuaaauccaguggauagccucuugguucugaccaaucauccauucugucuucacaaaugaaaaagacagaucaggugcuguggcucaugccuguaauuucaacacuuugggaggccaaggagggaggauugcuugagcccaggaguuugagaucagccugggcagcauagugagaccucaucucuacaaaaaguuaaaaaaaaaauuagccaugacuauagucccagcuacucaguaggcugaggugggaggacugcuugaggcugcagugagcuaugauugugccacucacugcacuccagccugggcaacagagacccugucaaugaaugaaugaaugaauaaacgaaugaaugagacaagucaggaacaugagcuuuccuguaugcuuagugccuaguacaguacuggacacauaccagaugcuuaaaaauuaacuauuaauuguuucauaacuaaucugacagcauaauuccuugcagguugaauaccugucugggucacuuggacaugaaaagaugggcccuagaagcugaucuuaaaguaucacgaggcaaagggagagaucacuacucugccugagaacagacagcaagggugaggagcccgugcagaugguggagagcaggggagaugagaggagggaugaauggcucaagaagaggaggagaugggcgcucaggggaaagcccaaucaauggacacucuugggugcuagggacagucaagggacuuaggaacaagggcauccaauaacagguuuuaacuuaacuauuuugcugugugacugcccucccucuauucucaacaaccuucaaacuuagccccauuuugcagcuugagggcggagugcaucaguguuccagucagcaggaagccauucucagagaaaaaggaauuugauuugagaggcccaauucuccuggcagaaauguuggggugugaaauaaggcugcucaaguuaaagggaucagaggcauagcuccugaggguuaauuacuguuaaaggaaaauucucaaaauaguaaagcuaugacugucacacaaauauaauaugaauauuuuucaaagacauuaguuaaagagggaaccaauaagguguucaacugauuuaaagaaucugaagacuacacauauacaggcaaucaugaaugccaaaaagaaguugcuaggagaugcaaaacugaaauggguuugcuaaucaguacugaaaugaaucuacuaauagaucgguuaguaucuacauguacuaaaaugucauguuugaaaucuuauuuucucuagggugaaagucaauuaccccuauauaccuaauuuucuuuugcauuucuauggacaagaaucauuugguuacuaucaguuuucugcaacuuauagauguuaacccugaaggauccacuaaccaacccagcauuccauugaaagguacuuaguaaucuuuugcccaccucaaagucuuccacaauguuuccugacagucuucauccaccaaauggggaugugccuacaagugaggguguccaguggauuacagaucucucuaagcugccuggcacucagugggugcucaauccgugggggcuuugauuaugaugaagucucagcaggaugaguguuaacuuugggugacauucaugaauguauaucauucuaagacagucacaaauugguaacagauguuuccccuaguacaggcccugucauuuagaugauggcuucauaacuugaggucuaccugccgucacuguuauacacgauugggaacugguucagaguuuccucuugaaggcaagaaaaaugcagcacgaacccacugugugaugcagcuacugacacaguucauguaacgaagcucauuaauagaaggagaggcaauaucuggaucacaguagguaaugaaugagucagaaaaccaaagcuuaaauaugggguucaauuagggguauuagauguuaagaaggguauggauuaauaugagaaaauccagacaaggcaggauaguggcgggccugaaaaaucaauucauaugaggaacaucugacaaacuguggggugcugaguucugagaacagcauaccaauuggugauguucuuucuuucuuucuuucuuuuuuucaaagacuuccaaagcuuuuacacaggauaaaaagaugaguucaguguuuuuccaaagggaagacccaacaccaaugcacagaaguaaggggaggcguagccugcuugcccaacacagugaugaguaaugucauggacaugaugugaaguagugagcuucugcccuuggaaaagucagacagauggcagaugagccuuggaagggguguuguggaaggcacucuuguuuggaggagaggcugggaaggaugcuggguguauuaguccauucucacacugcuacaaagaacugcccgaaacuggguaauuuacaaaggaaagagguuuaauugacucauaguuccacauggcuggggaggccucaggaaacuuacuaguauaaucaccgcagaaggcaaaggggaagcaaggcaccuucuucacaagguggcaggagaaacaaccaaauacuuauaaaaccagcagaucuugcgagaacucacucacuaucaugagaauagcaugggggugacugccuccauaauucaguaaccuccaccuggucucucccuugacacguggagauuauggggauuacaauucaagaugagauuuuuggguggggacaaaggcaaaccauacuggacgagggugaguccaauucuaaugcaauauaaucagggaguaaaaucacucuuacuuaaaccagugaugagggacuuccagauuuguuuuuguuuugguuccaguagaguacaaaucagugccuccuuaccucacccucuuucuccacuuccucuaacugaagugguuuggaugcaguuuaucugccuaagccaggaagugcuuauuugccuaagccaggaauccacccugagagggugaauaaaaagccacuugucucaccacccaagacuuccugagcauaggcagccaccagccacauggcugauuuccaucggcggcuaucccaggagccccgggcaggagccccgggcaggagcaccgcaugcuggccucccucccucacaggcucggugugccccagcagaccuagcugccagguaagcugucuacuuuccggcucaugugaaggauaaguucauccuauuguuauuguccucuuuagacuccuuuguaguuucaaauuuucuaccuggaucuugagcucagaaaaagaaauagaacuuuaaaaaaguaaucugagucauuaaaacaaagcaugagccuucuuccuugaagugucuuuguccucuagacaagucacaaacagcagcuagaaggaggguaggcuccaagacaaaugaucgagauugcugcucacucucagcagaaaagcacauugagauaauaaaccauuuuggcauaaucaguuuuauacagucuccauuuuaugccuucugcuagcguacagacauuuagggagcaugaaguggcaggacauuacaaaagaccacuucacugaaauacucguuuuuguuagcagugacaacaugcguuaccuucauguccacugacgggucccccugcagcagugcccacucauacuggacgauggcguggucaucugugcucucgcggccgucuagaaccaccccgucugugggcagaugcagaaccacauccugcccagccuugcuaaguggaggcgcauccuuuucugagaaagaaaauaaauaauucauaaaagaugauuucuuauuuuuucuaauuuauggagagguaucuuguuugcugaauagauaugauucggcaaauaacugcuaagagaauccauauuaaauggaaauuauuuuucuauuuauuuuaugaucguggaauuuagcuauaauaugcgcagaagaggcuguguggaguguuggcugguagcgauuuuggguacaaggcagcauacgaggucccaccaauguguaaauauggagaagcaguuuuauuuucuagaguggauuuuucacuuaauuuuaaaaucacuuaaguucaaaauacuguuaaauaaauuuauuuuaaaagauuauuauuauuuugagauggaguuuugcucuugucacccaggcuggagugcaauggugcagccucggcucacugcagccucucccucccggguucaagcgguucuucugccucaaccgcccgaguagcugggauuacaugugugugccaccacauccugcuaauuguuuuuuguauuuuuaguagacacaggguuuugccauguuggccaggcuggucucgaacuccuggccucaggugauccaucugccucggccucucaaagugcugggauuagcagcgugagccacugcgccuggccuugaaaagauuauuaaaacaaaccugaaaaacaccaaauucaccucuaauauggauuuucuuuuuuucuuauccucaaguuuuaaaaauaggagugauauaaaguauucaaugaaugggaaauauauuaaguuugaaaaguuaaggcaaauuuuuagagccauacaaaauaaagccugcauguaaauucucuggaauccaauuuuucaucuaggaaaauugaagacguucaccguuucuaauaacuaauuuuuauaauagaagccagcaggcucagaugacuacaacagcaaaauaaaucuguauuuaccuuuguuuuuguuuuguuuugcuuuugagacagggucucuaucacccaggcuggugcacgaucauagcucacucacuguagccuccaacuccugggcucaagugauccuccugccuuagccucccgaguaguuaggacugcaggugugugcuaaccuucccaccuauuuucacucuuuuguagugagaguugcccaggcuggucuugaacuccugaccucaagugauccucccaccucagccucccaaagugcuggaauuacaagugugagccacugcacccagccuauauuuaccuuuaaccuagaaugguacuaaauaauauaagguuaauuauguuuauuucaauauuaauacuuuacugacagcugcuacagggaugaccgaaaggauaagcuguacaaagaaaacauuucuaagagcauaguuaccaaaauuuuaauugauguaagcuucuuaguaaauucacccaaaugcacacauauuuuaaagaaacagcaacagaacuggaaaaacucuacagguuuguguaccacgcccucuuuggcauccacuuccccauuccuucagugccaaagcucugguucgagugcuggcugggcuugccccucuuuggcucacccugcacagugcugcaaggcaccgccucuccuccugcuuucgagcccaucacuuuccuccacaggggccaauguugcuaccuacacaaacuucuaaagggccaagccacacaucccagugcuugaguuucggggcuuacugcaaucccaccucagugucucauuacggaacaaaaggugaccacucuugauacauugcagcugaaaugacucuucuggaaagcuaaucugacggggucauucugcgaguaggaaaaacccuucagcaaguuaccauugccuuucagauguuuaggaccuaacccuccaggauucucuucucuucuagugguucccucaaugcccagcaccaggguguggcaacagguugucaucagcaaccagagcagccaguuuccacuaacccuuuccuguaauucugaugaaugcauaaguuaaacauucaagcuggagaaacuggugccugaguacaaggccuggaaugugaaaacaaauacauuaagaccucgccuggacuuucucagacccuaacaucugaucgaaggcauucuuacacauauaccuuguaucaaggccacuuaagauuaaagaaaauuuuccaaggcucuagagacuuuccagaccccagacccuaaagauuagacugaaugaaacacuccugcuuguaggugcacacucucacacaggcauagagguugaauugaauguaaauaaacacugaagaaaaacuuguaacuuugaguuggucuggugagucacucccaccaucuuccugucaccaguugcagaaauaaacucccuucuuucccagucugucugcaucucauuggaaagcgagaaaaagcagccggaccuugaucauccaggaacaaggggauuuaugugaggggucuggggcucuuagagaugcggcuuuucugaaugagaaugcugcugccagccacaaagggaagaugccuuuuuuuuuuuuuuuaaaaaaaaaacacauuaugaggaauuaagcacaauugcuuuuuacaugcuauugcuaacuauggagaagacgugucccauuuuuccagucacuuaagagugaggacuaguaacugugauuuaaauaagccaaguaaacaauccccugccuaggaagaaacuuguucuucugccuuuuuccaccucugaacaaacacggagugucugaugucuuuaugcugcuucugccagguaaggagagauaggacacuugcauuauuuugauaguccuuucauaguguugaccuuuucuuugguucugaaagguucauuguuuccacacaaugguuuaugacuuuauaauucuggaaagcaucuuauaacucagcaguuauacauuacagcuagcagcuauuuaaacuuuguuaaaaauacauuuuuaaguagacaaaugaaaauaugucuaugugauauaaacaguaauggacacauaauuuuuuaaaaacucucaaagauuuaagauggaagaaucagauaagcgcugaaauauuccacacauuauacaauuaauuaauccuaccucuccuggaagaaaaagaucauuuuagucacuuacuuuuauuuaggugagcuuuaagaugaauuauaagcuuagugaaaucauccuaucuucuaaacugaucacugaugugucugaaauaacacagauaauguuuccuuuucaguucaaguccaggccauuuccauuguaaaauguauuuuaaaauaacccagagcuuaucuacccagaaacaguccuuaaaauaaacaaauaacaacacgaagaggaagggagugugccauuuuaaaaugugugacuugcuaaugaagaacaaaauauauguaauuuugaauuuuugucaaaaaaauguaauaaacccauguuaaguacuagggaaacacugguuucuuuugaaaacuaaacacacuuaguaagaccuacagaggugaaauaagacuccugccgauugagaaugagcaaaucaagguggcauuuuauucagagaaguguaauauaauaucaaccagccucauucacaacacgcuacugugcacagagccuccaugacaaggaagacauucugugcugugugggaacgaaugguauagcucaggcagagcaacuggaaagaacccugaagucaggguacggaagcggggcgagacuaggggaagaggcucagauacaugcggucaaaauccaucauggauuuccaacugcaacacuucggaaaaaaaauuauccgcaaccccaauaugauuauugugauuuuugguauguacugauccaguccuucucccuauggugcugcugauaauaauuauaauaguugccauuuacugagggauuuugaagcugacuuugcaaaaauuauagcugagaaaauuauaacagugaaauagaucugaccugacuccauguggcuucuaaucuccaagcuguccuuguccauuccugggcauaggccgaacuaauuuugggaggaacuugguuuacagucugacuuugaaacagacgcggccggguguggugauucaugcuuguaaucccagcacuuugggaggcugaggugggcagacugcuugagcccaggaguuccagaccagccuggaacuggugaaaccccaucucuacuaaaaauacagaaaguagccugauguguggcacaugccuauagucccaguuacuuggggggcugaggaauucaaagcuacggugagccaagacugugccacuucacuccugccugcauaacaaagugagucccugugucaaaaaaaaaaaaaaaaguaaaaagaaacaaagaugguaacagcccuuuccccaaauaagccccuuucuugccugaggacuggacugccuuugcaaaacuaacaaauaagccacaagauuagaaauuauggcuuaggcaucacuauuauaaaaccuaaguucagugcuugagauauuuuauagacccuguccucgaugguuggcagcaccccguuggcaguaccuagguugauaaacuggcucaucuggucuuguguuuuauccgcacaaccaguuccuugugaauuaaacucuuucucuauugcaauuccccugucuugauaaaucagcucuguguaggcagugggcaaggagaacccauugggcgguuacaauuuccuuguaccagguaccaggccaggugaaguuauagaaagaacuuaacuuucacaacgaaucucugagguagguauuaucaucugcauaauacugaugcagaaacuaggcucagagggcuaaguuacaucacacaggcgauaaauuugucagaucagauacuucuuuuuaauuauuuuuuuauuauuauacuuaaaaguucuaagguacaugugcacaacgugcagguuuguuacauagguauacaugugccauguugguuugcugcccccuucaacucgucauuuacauuagguauuuguccuaaugcuaucccuucccuugacccccaccccgacaggcccuggugugugauguucuccuccguguccguguguucucauuguucaacucccacuuaugagugagaauaugcgguguuugguuuucuguccuugugauaguuugcugagaaugguuuccagcuucacccaugucccugcaaaggacaugaacucauccuuuuuuuauggcugcacaguaguccauggaguauaugugccacauuuucuuaauccagucuauuauuaauggacaucuggguugguuccaagucuuugcuauugugaauagugccacaauaaacauacaugugcaugugucuuuauaguagcaugauuuauaauccuuugaauauauacccaggaaugcagcccaguuauuucuaacucaaagguucuauccuuccacuauacuucgagacaacccuagguguauuccaguuacaauaaauauaauuuuacauccugaauuuaauccaucaacuuauugguauauuccuguuauugauauuucuucauauaucuuagcacugcccaugugauaaccuaagcuucacaauugccacuugaguuuccuaaucuguacuacuggacauuuacuuuguuacuuuuucaccauuauaaauaaugccauaauaaacauguuuugcucauacguucucuucagcauagaugauuuuccuaaaaaauauuccagaaguaugaauauuuuaaugguuucugccacauauuuuccaauuacuuuccaagagggaaguaccaauuuacaccaucagugagcuagaaguguauauaaaguuucccauaugcaugucaauaugaguaaaacacuuuuuugcucauauguucucuucagcaugguuccuuuuccuaaaaaauauuccagaaguaugaaaugaauauuuuaauggucucugccacauauuucccaacugguuuccaagagggaaguagcaauuuacaccaucggugagcacagaaguguauaugaagucucccauaugcaugccaauaugaguaaaccuauuuuuaccaaguuaauaaaugaaaauuggccuuauuuacauuucuuugauucuaaggucgaacauuuuuccauguuuauccaccauaccuccucuucugggaagugucugcucauguccuuugcccauuuauuuuuauuuuucuugcugacucauauauauauauauauauauuuuuuuuuuuuuuuuuuugaccgagucuugcucugucgcccaggcuggaguccaguguugcaaucucagcuuacuguaaccuccgacuccaggguuuaagcuauucucaugucucagccuccccaguagcuaggacuacaggcgugugucaacaaaccaggcuaauuuuucuauuuuuaguacagauggaguuucaccauguuugucaggcugguuucuaacuccuggccuccagcaauccaccugcguuggccucccaaagcgcugggauuacaggugugagccacugugccuggcccauaaacucuacgaauaaauaaugucacauuuuucccagacucuuguuugcaauuccuuuuguuucuugauaugaaguuuuuuauaaaugugcauauaaucuauccccuuucuuugugaccucuuuaauugauuugaaaccugucuuccuuccagauauggaaguuuacuuccuuuaaguuuuuuuauguauggaguaaucuauggcuuaauuuaaaaaaaauuuaauucuuuaauccaucuggaauuuguguauggucagaguuguaggucuaaauguacuuucccugacacugccaaccaguuaucuuacuauuauuuauuaaauauaauuguuuauaacacaaaagggagaagauaagaaugugagaaaguaaggcccuuggagagggagaguggucaagcaucugcagagggauuaaccuugaaugggaaggucaacucuuuuguuugcacuuggcggagacagggaaaggcuggggguggcagcaggugggucugcagagaggagagcagaccucugccuaauagcuuugauuuucccugacacacaaggcaaggggcccacuucccaaauucuuccccgagauacuggacuucaggcugaauauccagcaaaaaccacauaaagguuaucguccuugaguccuuggagguuauauucccugcucuucuggaauccuagcagcucuagcuucuaccucuccucccucccucccucccuccugcuguucuucacuuuuuaucaugacauccagucccccaacccucuagucaugggcaugacccaaccagguuccuagaacaguaucauguacaugcgugccaccuuccuaacucacaaagcauguccccccuugaaccucacgacagccugggauggaggacaagcagacaccaaguccugggggcaugagcagggacuuguuuguggagacgccaggccccagaacuucaagcacccuccucuguucuacagauucuagcaggcaggcucagucacuacaagacaccucucuccagcaucucucacucauuccugcauccucccgccuucccuaccucuacccucgcagucccagccuagugaucccuuucucagcuucugcuggugcugcuggagaaagcauaggaguucaggcuccacaaccccaugcugugugacccuugggcagguuacuuucgcuugccaagccuuguauacacuagggauuauaacagaaccuaggccuuuguguuguugugaggacagagugaguucaugcgugcaaagggcugaggacagcaccuaacaccaaagucaacaaaugugggcaugaaaacagggcugguguguccugcuguaaguucgugcuaucccaucaccauuucuucauggugcuuucauccaccucagauggauccagucacagcuccucuccaagggcucuucuaaaccauuuucacaugcucacaacccaaaaacgaacaauucaagaaggaaaaacuuagucucugaagcauaaacaacuucaaccugucaagcaucugagcaggggacacacaggacacuggggaacaauuuuugaccuccacgcagagagaacaaaugagccucuacaggaaccugagccgcaccuuccgcguuuccauguugcugggaccucaggaagucugagcacagcaguguucucccagaaaugaggaccagcaccgcgcucgccuauuuucaucccaaacaucuacaaaacaauuccuagacaaacuccccuggggaaaggaagggcaacgaagcaagcaagaggaaaaacaacccagaaacuucucauaguaaccugaaguuuuuguuucuguuucugaggcagugucucccucuguugcccaggcuggagugcaguggcgcaaucuguacucacugcgaccuccaccaccacaguucaagcgauucuccugccucagccgcccgaggagcugggaucauagacaggcgccaccaugccaggauaauuuuuguguuuauuucuuuuuagcaaagacggguuuugucauguuggccaggcuggucucuaacucuuggccucaagugauucacccgccuuggccucccaaaguccugggguuaguuaugagccaccgugccuggcgucuccaaguaaucuaaacuuuaaaauuuuuguucuauggcauauucuuuccuuguuuauuuuccuuuucaaagguuuccucuggguuuauaggaaagcucacuuuggcaaugucaguuucuuccagguaaguagugagaacacagagaaaagacuuuguuucuuugcugcugggauauuuuggucuguguuugggcagagaggaugugugugcaacagccguggugggccucagagaugcugaugggggguccaagugaaagugcugccugccuccacuucagaaggaaagcuauggaguccuucccaguguuugccucaaggccaagcagucgcagggugacccuuugauaucugcuccccugacaaggauucugagccucaucuaagguagagguggggagggaggcaggaugugauggacacagauuuccagacucuuucaauggauccacagguuuuggagaauccacacuuccaaaggggcugagcuccgcccccaucuugcugauaucauucgugcuauuauaaaucaaacagcaacagggcaugauuaaacacacggagccugaccacacgugggcacaaucaaggucucuuauucccuccgugacauucauguccaaccacuaccauuuuugugccuccuguauguguccugauucucucauucagagcaucuacaaaaagucaaaccgucgaaucagcaucauuuuuaguccuuaagaaacacgcuuuaaaguuuccuauuuucuuuuccuuuuuuuuuuuuuuuuuuuaagauggaguuucgcucuuguugcccaggcuggagugcaauggcgcgaucucggcucacugcaaccuccgccuccuagguucaagcgauucuccugccucagccucccgaauagcugggauuacaggcgcaugccaccagcucuggcuaauuuuuguauuuuuaguagagaugggguuucaucacauuggucaggcaggucucaaacuccugaccucaggugauccgcccuccucggccucccaaagugcugggauuacaggcauaagccaccacgcccggccuuaaaguuucuuauuuucaacgaaaaucaaguccccucuuuucacuuuuuauaaaagggaccagaaguuuuccucccauuuuuguaugaugaaagccaccgcaggcaaagucaggagagccacgucaagaaaaaggaguggguguuacgagaagcccggcaucuaauuagauuuugcucuugcaauuacuuaacacaaaccaugccuuauacaacccaugagacuaaaacaaacuuuuuucucucagcauuucuccccuuuuaagucauauuuccacgaauccucucagaucagccuuucucuucaagccuagaaaaauuccaguagcacgucaccgcgcccgcccgcccgcuucugccaaacuacugggcuuccucuucccuaagacagagaaacccaugccagaaacucuucugggugcccgcggcuaaaauaacuuggcacgaguguguuucgcuuccaacuuggcgagggcgcugcgggucucgagcgcucuggccaaggccggccccucagucgcgcgcuuacccugccggggcgaggcgcgcgcgguggccagggcggcgccguccggcgcgcggcugaggcuguagcugcuguagccgcugugcagcgcgaacuugcagacguugcggccgcgcgccgugcaguugaagagguagcagccgagcacggcugccgggggcgcggggcgccggggcagcuccaccacggccacggagcagcgcggcucggagcagcaggccgccacgcauugccgccagccccgcacggccgccggcgcccgcaggaagcuggcacccgccgccagggaguccuuggugcggaugauggcgucaggcauugcgcuguagccgccgcugcccgggcccgggcaguccuccugggggccgccgcccgcgcgcagcuccagcuccagcuccuccugaggccgcuccugcugcaguugccggcggaacuccuccagcagcugcuccacgcccgacagcugcgcgugcaguucggacagcggcgccgcgggcggcaaggccgcacggccgcuuggcagccacaggcagagcaguagcagcccgcgcagcgccccgugacgcggcgguagccggcgcugcgagcccgcgcucuccugggcgacggaggccauggcgacgagagccaagggcagcgagccgaggcggggcugagcgcgggaggaaggcggggacgcgggcgagcgcgggcccugggccccuccugcgcggccgcggcuggcucuaggccccggccucacagcgcggcgcccccgaacccggcugcucccccgaggucgcgggcgccggcgggaaccgcaguagcgggagacauagccggcccagccgggcaccgcuccuugcccucgccggagacugcccagcgcccugcgccucuccgccccggccugcggcgcgcuggguggcgacgagucggccucggcguugaucagcaccag

SEQ ID NO: 192117 - RNA, 45587 nt, Homo sapiens
cuggugcugaucaacgccgaggccgacucgucgccacccagcgcgccgcaggccggggcggagaggcgcagggcgcugggcagucuccggcgagggcaaggagcggugcccggcugggccggcuaugucucccgcuacugcgguucccgccggcgcccgcgaccucgggggagcagccggguucgggggcgccgcgcugugaggccggggccuagagccagccgcggccgcgcaggaggggcccagggcccgcgcucgcccgcguccccgccuuccucccgcgcucagccccgccucggcucgcugcccuuggcucucgucgccauggccuccgucgcccaggagagcgcgggcucgcagcgccggcuaccgccgcgucacggggcgcugcgcgggcugcuacugcucugccuguggcugccaagcggccgugcggccuugccgcccgcggcgccgcuguccgaacugcacgcgcagcugucgggcguggagcagcugcuggaggaguuccgccggcaacugcagcaggagcggccucaggaggagcuggagcuggagcugcgcgcgggcggcggcccccaggaggacugcccgggcccgggcagcggcggcuacagcgcaaugccugacgccaucauccgcaccaaggacucccuggcggcgggugccagcuuccugcgggcgccggcggccgugcggggcuggcggcaaugcguggcggccugcugcuccgagccgcgcugcuccguggccgugguggagcugccccggcgccccgcgcccccggcagccgugcucggcugcuaccucuucaacugcacggcgcgcggccgcaacgucugcaaguucgcgcugcacagcggcuacagcagcuacagccucagccgcgcgccggacggcgccgcccuggccaccgcgcgcgccucgccccggcaggguaagcgcgcgacugaggggccggccuuggccagagcgcucgagacccgcagcgcccucgccaaguuggaagcgaaacacacucgugccaaguuauuuuagccgcgggcacccagaagaguuucuggcauggguuucucugucuuagggaagaggaagcccaguaguuuggcagaagcgggcgggcgggcgcggugacgugcuacuggaauuuuucuaggcuugaagagaaaggcugaucugagaggauucguggaaauaugacuuaaaaggggagaaaugcugagagaaaaaaguuuguuuuagucucauggguuguauaaggcaugguuuguguuaaguaauugcaagagcaaaaucuaauuagaugccgggcuucucguaacacccacuccuuuuucuugacguggcucuccugacuuugccugcgguggcuuucaucauacaaaaaugggaggaaaacuucuggucccuuuuauaaaaagugaaaagaggggacuugauuuucguugaaaauaagaaacuuuaaggccgggcgugguggcuuaugccuguaaucccagcacuuugggaggccgaggagggcggaucaccugaggucaggaguuugagaccugccugaccaaugugaugaaaccccaucucuacuaaaaauacaaaaauuagccagagcugguggcaugcgccuguaaucccagcuauucgggaggcugaggcaggagaaucgcuugaaccuaggaggcggagguugcagugagccgagaucgcgccauugcacuccagccugggcaacaagagcgaaacuccaucuuaaaaaaaaaaaaaaaaaaaggaaaagaaaauaggaaacuuuaaagcguguuucuuaaggacuaaaaaugaugcugauucgacgguuugacuuuuuguagaugcucugaaugagagaaucaggacacauacaggaggcacaaaaaugguagugguuggacaugaaugucacggagggaauaagagaccuugauugugcccacguguggucaggcuccguguguuuaaucaugcccuguugcuguuugauuuauaauagcacgaaugauaucagcaagaugggggcggagcucagccccuuuggaaguguggauucuccaaaaccuguggauccauugaaagagucuggaaaucuguguccaucacauccugccucccuccccaccucuaccuuagaugaggcucagaauccuugucaggggagcagauaucaaagggucacccugcgacugcuuggccuugaggcaaacacugggaaggacuccauagcuuuccuucugaaguggaggcaggcagcacuuucacuuggaccccccaucagcaucucugaggcccaccacggcuguugcacacacauccucucugcccaaacacagaccaaaauaucccagcagcaaagaaacaaagucuuuucucuguguucucacuacuuaccuggaagaaacugacauugccaaagugagcuuuccuauaaacccagaggaaaccuuugaaaaggaaaauaaacaaggaaagaauaugccauagaacaaaaauuuuaaaguuuagauuacuuggagacgccaggcacgguggcucauaacuaaccccaggacuuugggaggccaaggcgggugaaucacuugaggccaagaguuagagaccagccuggccaacaugacaaaacccgucuuugcuaaaaagaaauaaacacaaaaauuauccuggcaugguggcgccugucuaugaucccagcuccucgggcggcugaggcaggagaaucgcuugaacuguggugguggaggucgcagugaguacagauugcgccacugcacuccagccugggcaacagagggagacacugccucagaaacagaaacaaaaacuucagguuacuaugagaaguuucuggguuguuuuuccucuugcuugcuucguugcccuuccuuuccccaggggaguuugucuaggaauuguuuuguagauguuugggaugaaaauaggcgagcgcggugcugguccucauuucugggagaacacugcugugcucagacuuccugaggucccagcaacauggaaacgcggaaggugcggcucagguuccuguagaggcucauuuguucucucugcguggaggucaaaaauuguuccccaguguccuguguguccccugcucagaugcuugacagguugaaguuguuuaugcuucagagacuaaguuuuuccuucuugaauuguucguuuuuggguugugagcaugugaaaaugguuuagaagagcccuuggagaggagcugugacuggauccaucugagguggaugaaagcaccaugaagaaauggugaugggauagcacgaacuuacagcaggacacaccagcccuguuuucaugcccacauuuguugacuuugguguuaggugcuguccucagcccuuugcacgcaugaacucacucuguccucacaacaacacaaaggccuagguucuguuauaaucccuaguguauacaaggcuuggcaagcgaaaguaaccugcccaagggucacacagcaugggguuguggagccugaacuccuaugcuuucuccagcagcaccagcagaagcugagaaagggaucacuaggcugggacugcgaggguagagguagggaaggcgggaggaugcaggaaugagugagagaugcuggagagaggugucuuguagugacugagccugccugcuagaaucuguagaacagaggagggugcuugaaguucuggggccuggcgucuccacaaacaagucccugcucaugcccccaggacuuggugucugcuuguccuccaucccaggcugucgugagguucaaggggggacaugcuuugugaguuaggaagguggcacgcauguacaugauacuguucuaggaaccugguugggucaugcccaugacuagaggguugggggacuggaugucaugauaaaaagugaagaacagcaggagggagggagggagggaggagagguagaagcuagagcugcuaggauuccagaagagcagggaauauaaccuccaaggacucaaggacgauaaccuuuaugugguuuuugcuggauauucagccugaaguccaguaucucggggaagaauuugggaagugggccccuugccuugugugucagggaaaaucaaagcuauuaggcagaggucugcucuccucucugcagacccaccugcugccacccccagccuuucccugucuccgccaagugcaaacaaaagaguugaccuucccauucaagguuaaucccucugcagaugcuugaccacucucccucuccaagggccuuacuuucucacauucuuaucuucucccuuuuguguuauaaacaauuauauuuaauaaauaauaguaagauaacugguuggcagugucagggaaaguacauuuagaccuacaacucugaccauacacaaauuccagauggauuaaagaauuaaauuuuuuuuaaauuaagccauagauuacuccauacauaaaaaaacuuaaaggaaguaaacuuccauaucuggaaggaagacagguuucaaaucaauuaaagaggucacaaagaaaggggauagauuauaugcacauuuauaaaaaacuucauaucaagaaacaaaaggaauugcaaacaagagucugggaaaaaugugacauuauuuauucguagaguuuaugggccaggcacaguggcucacaccuguaaucccagcgcuuugggaggccaacgcagguggauugcuggaggccaggaguuagaaaccagccugacaaacauggugaaacuccaucuguacuaaaaauagaaaaauuagccugguuuguugacacacgccuguaguccuagcuacuggggaggcugagacaugagaauagcuuaaacccuggagucggagguuacaguaagcugagauugcaacacuggacuccagccugggcgacagagcaagacucggucaaaaaaaaaaaaaaaaaaauauauauauauauauauaugagucagcaagaaaaauaaaaauaaaugggcaaaggacaugagcagacacuucccagaagaggagguaugguggauaaacauggaaaaauguucgaccuuagaaucaaagaaauguaaauaaggccaauuuucauuuauuaacuugguaaaaauagguuuacucauauuggcaugcauaugggagacuucauauacacuucugugcucaccgaugguguaaauugcuacuucccucuuggaaaccaguugggaaauauguggcagagaccauuaaaauauucauuucauacuucuggaauauuuuuuaggaaaaggaaccaugcugaagagaacauaugagcaaaaaaguguuuuacucauauugacaugcauaugggaaacuuuauauacacuucuagcucacugaugguguaaauugguacuucccucuuggaaaguaauuggaaaauauguggcagaaaccauuaaaauauucauacuucuggaauauuuuuuaggaaaaucaucuaugcugaagagaacguaugagcaaaacauguuuauuauggcauuauuuauaauggugaaaaaguaacaaaguaaauguccaguaguacagauuaggaaacucaaguggcaauugugaagcuuagguuaucacaugggcagugcuaagauauaugaagaaauaucaauaacaggaauauaccaauaaguugauggauuaaauucaggauguaaaauuauauuuauuguaacuggaauacaccuaggguugucucgaaguauaguggaaggauagaaccuuugaguuagaaauaacugggcugcauuccuggguauauauucaaaggauuauaaaucaugcuacuauaaagacacaugcacauguauguuuauuguggcacuauucacaauagcaaagacuuggaaccaacccagauguccauuaauaauagacuggauuaagaaaauguggcacauauacuccauggacuacugugcagccauaaaaaaaggaugaguucauguccuuugcagggacaugggugaagcuggaaaccauucucagcaaacuaucacaaggacagaaaaccaaacaccgcauauucucacucauaagugggaguugaacaaugagaacacacggacacggaggagaacaucacacaccagggccugucggggugggggucaagggaagggauagcauuaggacaaauaccuaauguaaaugacgaguugaagggggcagcaaaccaacauggcacauguauaccuauguaacaaaccugcacguugugcacauguaccuuagaacuuuuaaguauaauaauaaaaaaauaauuaaaaagaaguaucugaucugacaaauuuaucgccugugugauguaacuuagcccucugagccuaguuucugcaucaguauuaugcagaugauaauaccuaccucagagauucguugugaaaguuaaguucuuucuauaacuucaccuggccugguaccugguacaaggaaauuguaaccgcccaauggguucuccuugcccacugccuacacagagcugauuuaucaagacaggggaauugcaauagagaaagaguuuaauucacaaggaacugguugugcggauaaaacacaagaccagaugagccaguuuaucaaccuagguacugccaacggggugcugccaaccaucgaggacagggucuauaaaauaucucaagcacugaacuuagguuuuauaauagugaugccuaagccauaauuucuaaucuuguggcuuauuuguuaguuuugcaaaggcaguccaguccucaggcaagaaaggggcuuauuuggggaaagggcuguuaccaucuuuguuucuuuuuacuuuuuuuuuuuuuuuugacacagggacucacuuuguuaugcaggcaggagugaaguggcacagucuuggcucaccguagcuuugaauuccucagccccccaaguaacugggacuauaggcaugugccacacaucaggcuacuuucuguauuuuuaguagagaugggguuucaccaguuccaggcuggucuggaacuccugggcucaagcagucugcccaccucagccucccaaagugcugggauuacaagcaugaaucaccacacccggccgcgucuguuucaaagucagacuguaaaccaaguuccucccaaaauuaguucggccuaugcccaggaauggacaaggacagcuuggagauuagaagccacauggagucaggucagaucuauuucacuguuauaauuuucucagcuauaauuuuugcaaagucagcuucaaaaucccucaguaaauggcaacuauuauaauuauuaucagcagcaccauagggagaaggacuggaucaguacauaccaaaaaucacaauaaucauauugggguugcggauaauuuuuuuuccgaaguguugcaguuggaaauccaugauggauuuugaccgcauguaucugagccucuuccccuagucucgccccgcuuccguacccugacuucaggguucuuuccaguugcucugccugagcuauaccauucguucccacacagcacagaaugucuuccuugucauggaggcucugugcacaguagcguguugugaaugaggcugguugauauuauauuacacuucucugaauaaaaugccaccuugauuugcucauucucaaucggcaggagucuuauuucaccucuguaggucuuacuaaguguguuuaguuuucaaaagaaaccaguguuucccuaguacuuaacauggguuuauuacauuuuuuugacaaaaauucaaaauuacauauauuuuguucuucauuagcaagucacacauuuuaaaauggcacacucccuuccucuucguguuguuauuuguuuauuuuaaggacuguuucuggguagauaagcucuggguuauuuuaaaauacauuuuacaauggaaauggccuggacuugaacugaaaaggaaacauuaucuguguuauuucagacacaucagugaucaguuuagaagauaggaugauuucacuaagcuuauaauucaucuuaaagcucaccuaaauaaaaguaagugacuaaaaugaucuuuuucuuccaggagagguaggauuaauuaauuguauaauguguggaauauuucagcgcuuaucugauucuuccaucuuaaaucuuugagaguuuuuaaaaaauuauguguccauuacuguuuauaucacauagacauauuuucauuugucuacuuaaaaauguauuuuuaacaaaguuuaaauagcugcuagcuguaauguauaacugcugaguuauaagaugcuuuccagaauuauaaagucauaaaccauuguguggaaacaaugaaccuuucagaaccaaagaaaaggucaacacuaugaaaggacuaucaaaauaaugcaaguguccuaucucuccuuaccuggcagaagcagcauaaagacaucagacacuccguguuuguucagagguggaaaaaggcagaagaacaaguuucuuccuaggcaggggauuguuuacuuggcuuauuuaaaucacaguuacuaguccucacucuuaagugacuggaaaaaugggacacgucuucuccauaguuagcaauagcauguaaaaagcaauugugcuuaauuccucauaauguguuuuuuuuuuaaaaaaaaaaaaaaaggcaucuucccuuuguggcuggcagcagcauucucauucagaaaagccgcaucucuaagagccccagaccccucacauaaauccccuuguuccuggaugaucaagguccggcugcuuuuucucgcuuuccaaugagaugcagacagacugggaaagaagggaguuuauuucugcaacuggugacaggaagauggugggagugacucaccagaccaacucaaaguuacaaguuuuucuucaguguuuauuuacauucaauucaaccucuaugccugugugagagugugcaccuacaagcaggaguguuucauucagucuaaucuuuagggucuggggucuggaaagucucuagagccuuggaaaauuuucuuuaaucuuaaguggccuugauacaagguauauguguaagaaugccuucgaucagauguuagggucugagaaaguccaggcgaggucuuaauguauuuguuuucacauuccaggccuuguacucaggcaccaguuucuccagcuugaauguuuaacuuaugcauucaucagaauuacaggaaaggguuaguggaaacuggcugcucugguugcugaugacaaccuguugccacacccuggugcugggcauugagggaaccacuagaagagaagagaauccuggaggguuagguccuaaacaucugaaaggcaaugguaacuugcugaaggguuuuuccuacucgcagaaugaccccgucagauuagcuuuccagaagagucauuucagcugcaauguaucaagaguggucaccuuuuguuccguaaugagacacugaggugggauugcaguaagccccgaaacucaagcacugggauguguggcuuggcccuuuagaaguuuguguagguagcaacauuggccccuguggaggaaagugaugggcucgaaagcaggaggagaggcggugccuugcagcacugugcagggugagccaaagaggggcaagcccagccagcacucgaaccagagcuuuggcacugaaggaauggggaaguggaugccaaagagggcgugguacacaaaccuguagaguuuuuccaguucuguugcuguuucuuuaaaauaugugugcauuugggugaauuuacuaagaagcuuacaucaauuaaaauuuugguaacuaugcucuuagaaauguuuucuuuguacagcuuauccuuucggucaucccuguagcagcugucaguaaaguauuaauauugaaauaaacauaauuaaccuuauauuauuuaguaccauucuagguuaaagguaaauauaggcugggugcaguggcucacacuuguaauuccagcacuuugggaggcugaggugggaggaucacuugaggucaggaguucaagaccagccugggcaacucucacuacaaaagagugaaaauaggugggaagguuagcacacaccugcaguccuaacuacucgggaggcuaaggcaggaggaucacuugagcccaggaguuggaggcuacagugagugagcuaugaucgugcaccagccugggugauagagacccugucucaaaagcaaaacaaaacaaaaacaaagguaaauacagauuuauuuugcuguuguagucaucugagccugcuggcuucuauuauaaaaauuaguuauuagaaacggugaacgucuucaauuuuccuagaugaaaaauuggauuccagagaauuuacaugcaggcuuuauuuuguauggcucuaaaaauuugccuuaacuuuucaaacuuaauauauuucccauucauugaauacuuuauaucacuccuauuuuuaaaacuugaggauaagaaaaaaagaaaauccauauuagaggugaauuugguguuuuucagguuuguuuuaauaaucuuuucaaggccaggcgcaguggcucacgcugcuaaucccagcacuuugagaggccgaggcagauggaucaccugaggccaggaguucgagaccagccuggccaacauggcaaaacccugugucuacuaaaaauacaaaaaacaauuagcaggaugugguggcacacacauguaaucccagcuacucgggcgguugaggcagaagaaccgcuugaacccgggagggagaggcugcagugagccgaggcugcaccauugcacuccagccugggugacaagagcaaaacuccaucucaaaauaauaauaaucuuuuaaaauaaauuuauuuaacaguauuuugaacuuaagugauuuuaaaauuaagugaaaaauccacucuagaaaauaaaacugcuucuccauauuuacacauuggugggaccucguaugcugccuuguacccaaaaucgcuaccagccaacacuccacacagccucuucugcgcauauuauagcuaaauuccacgaucauaaaauaaauagaaaaauaauuuccauuuaauauggauucucuuagcaguuauuugccgaaucauaucuauucagcaaacaagauaccucuccauaaauuagaaaaaauaagaaaucaucuuuuaugaauuauuuauuuucuuucucagaaaaggaugcgccuccacuuagcaaggcugggcaggaugugguucugcaucugcccacagacggggugguucuagacggccgcgagagcacagaugaccacgccaucguccaguaugagugggcacugcugcagggggacccgucaguggacaugaagguaacgcauguugucacugcuaacaaaaacgaguauuucagugaaguggucuuuuguaauguccugccacuucaugcucccuaaaugucuguacgcuagcagaaggcauaaaauggagacuguauaaaacugauuaugccaaaaugguuuauuaucucaaugugcuuuucugcugagagugagcagcaaucucgaucauuugucuuggagccuacccuccuucuagcugcuguuugugacuugucuagaggacaaagacacuucaaggaagaaggcucaugcuuuguuuuaaugacucagauuacuuuuuuaaaguucuauuucuuuuucugagcucaagauccagguagaaaauuugaaacuacaaaggagucuaaagaggacaauaacaauaggaugaacuuauccuucacaugagccggaaaguagacagcuuaccuggcagcuaggucugcuggggcacaccgagccugugagggagggaggccagcaugcggugcuccugcccggggcuccugcccggggcuccugggauagccgccgauggaaaucagccauguggcugguggcugccuaugcucaggaagucuuggguggugagacaaguggcuuuuuauucacccucucaggguggauuccuggcuuaggcaaauaagcacuuccuggcuuaggcagauaaacugcauccaaaccacuucaguuagaggaaguggagaaagagggugagguaaggaggcacugauuuguacucuacuggaaccaaaacaaaaacaaaucuggaagucccucaucacugguuuaaguaagagugauuuuacucccugauuauauugcauuagaauuggacucacccucguccaguaugguuugccuuuguccccacccaaaaaucucaucuugaauuguaauccccauaaucuccacgugucaagggagagaccagguggagguuacugaauuauggaggcagucacccccaugcuauucucaugauagugagugaguucucgcaagaucugcugguuuuauaaguauuugguuguuucuccugccaccuugugaagaaggugccuugcuuccccuuugccuucugcggugauuauacuaguaaguuuccugaggccuccccagccauguggaacuaugagucaauuaaaccucuuuccuuuguaaauuacccaguuucgggcaguucuuuguagcagugugagaauggacuaauacacccagcauccuucccagccucuccuccaaacaagagugccuuccacaacaccccuuccaaggcucaucugccaucugucugacuuuuccaagggcagaagcucacuacuucacaucauguccaugacauuacucaucacuguguugggcaagcaggcuacgccuccccuuacuucugugcauugguguugggucuucccuuuggaaaaacacugaacucaucuuuuuauccuguguaaaagcuuuggaagucuuugaaaaaaagaaagaaagaaagaaagaacaucaccaauugguaugcuguucucagaacucagcaccccacaguuugucagauguuccucauaugaauugauuuuucaggcccgccacuauccugccuugucuggauuuucucauauuaauccauacccuucuuaacaucuaauaccccuaauugaaccccauauuuaagcuuugguuuucugacucauucauuaccuacugugauccagauauugccucuccuucuauuaaugagcuucguuacaugaacugugucaguagcugcaucacacaguggguucgugcugcauuuuucuugccuucaagaggaaacucugaaccaguucccaaucguguauaacagugacggcagguagaccucaaguuaugaagccaucaucuaaaugacagggccuguacuaggggaaacaucuguuaccaauuugugacugucuuagaaugauauacauucaugaaugucacccaaaguuaacacucauccugcugagacuucaucauaaucaaagcccccacggauugagcacccacugagugccaggcagcuuagagagaucuguaauccacuggacacccucacuuguaggcacauccccauuugguggaugaagacugucaggaaacauuguggaagacuuugaggugggcaaaagauuacuaaguaccuuucaauggaaugcuggguugguuaguggauccuucaggguuaacaucuauaaguugcagaaaacugauaguaaccaaaugauucuuguccauagaaaugcaaaagaaaauuagguauauagggguaauugacuuucacccuagagaaaauaagauuucaaacaugacauuuuaguacauguagauacuaaccgaucuauuaguagauucauuucaguacugauuagcaaacccauuucaguuuugcaucuccuagcaacuucuuuuuggcauucaugauugccuguauauguguagucuucagauucuuuaaaucaguugaacaccuuauugguucccucuuuaacuaaugucuuugaaaaauauucauauuauauuugugugacagucauagcuuuacuauuuugagaauuuuccuuuaacaguaauuaacccucaggagcuaugccucugaucccuuuaacuugagcagccuuauuucacaccccaacauuucugccaggagaauugggccucucaaaucaaauuccuuuuucucugagaauggcuuccugcugacuggaacacugaugcacuccgcccucaagcugcaaaauggggcuaaguuugaagguuguugagaauagagggagggcagucacacagcaaaauaguuaaguuaaaaccuguuauuggaugcccuuguuccuaagucccuugacugucccuagcacccaagaguguccauugauugggcuuuccccugagcgcccaucuccuccucuucuugagccauucaucccuccucucaucuccccugcucuccaccaucugcacgggcuccucacccuugcugucuguucucaggcagaguagugaucucucccuuugccucgugauacuuuaagaucagcuucuagggcccaucuuuucauguccaagugacccagacagguauucaaccugcaaggaauuaugcugucagauuaguuaugaaacaauuaauaguuaauuuuuaagcaucugguauguguccaguacuguacuaggcacuaagcauacaggaaagcucauguuccugacuugucucauucauucguuuauucauucauucauucauugacagggucucuguugcccaggcuggagugcagugaguggcacaaucauagcucacugcagccucaagcaguccucccaccucagccuacugaguagcugggacuauagucauggcuaauuuuuuuuuuaacuuuuuguagagaugaggucucacuaugcugcccaggcugaucucaaacuccugggcucaagcaauccucccuccuuggccucccaaaguguugaaauuacaggcaugagccacagcaccugaucugucuuuuucauuugugaagacagaauggaugauuggucagaaccaagaggcuauccacuggauuuaaaguuauauauuuuaugcccuugaacaggauauuuuacauccacuuaacugaauauuuauaauacaucaaaaugcaagaugacacauauuuuucaggcaacccauuaaaugaugcugacuuucaugguuauuaaacauaauacauuuaaaucugaagucagaauguaaaauaugacauuuaggaacaugauacaaaguaggacauucaggagauuuggaauucauaaaucaguauauugauuuacauucgucaguugcuuaaaauuuucuaaaugauuaucuuaguccauuuggucugcuauaauaaaacaccaugacuggguggcuucuaaagagcagaaaugaauuucuuucaguucuggaugcugggaaguccaaaaucaagguacaaucagcuuuggcgucuagugaggacccauuucuuauuuuauaaccagccaucuucucacuguguccucauauggcaacagaggcaaggcagcccucuggggccucuuuuauuuuauauuuaaacauauuuuaacuuuuagguuaagggguacaugugcagguuuguuauauagauaaacuuaugacuuaggggcuugguguacagauuauauccucaccuggguauuaagcauauuacccagcaguuuuguuuuuuuucuaaaccucucccuccuuccauccuccacccucaaguaggucccagcguugugcuguuccccuuucucuguccauguguucucauuuagcucccacuuauaagugagaacaugugguauuugguuuucuguucuugcauuaguuugcugagaauaaggaccuccagcugcauccauguuccuacaaaggacaugaucuuguuguuuuguauggcugcauaguauuccaugguguauauguaccacauauucuucauccagucuaccguugaugggcauuuagguugauuccauaucuuugcuauugugaauagcgcugcagugaacguaugcaugcaugugucuuuauaguagaacaguuuguauucuuuggguauauaccuaguaaugggauugcugggucaaaugauaguucuguuuuuaguuauuugaggaauugucacaccacuuuccacaguacaccacuuuucacaaugggugaacuaauuugcacucccaccagcaguguguaaguguucccuuugcuccacaaccucaccagcaucuggugggguuuuuuuuguuuuguuuuguuuuuuacuuuuuaauaacaugggaccucuuuuauaagggcacuaaccucauucaugagcacguaucuccaaacgccaucacacugggcguuagguuugaacaugugaccuugggagggcacucagccauucagucuacagcagugacuucagaaaaccacacguaaggaagcuugcuaaaggaugggcauuauuuaaaccaacaacuucauuauuaaauuaaaacuaacugcauccuggccuaccugcuguacauaauuuuuuuaaauagacagguauuacuaagucuuuguaaccaaguauauacaauguguguguguguguguguguguguguguguguguguguguguguguguguguguaauuuaguuuagacauauaugagaagcccaaacguguauugcuagccacugaauuccuagcuaggaagaugggguugagucagacaacaggcugagucauucauugauuuggccagaagccaaccaccaaaggcuguuacugcugaacagggaucuugagcagagauugggagcuccugguuuaugaucaugucuuuuuccaaguuacaaauuggauauguuguguguacauauauagauaguuuuuuauccugauacuuggaacaugucugugaaacacuguaaacccucucuccagugucauccuaaugggagaaaauguauagaagggucaccugggcccuuaaagggaaagcauccgugugacaguucuacaucuucuaaauaucugaaugcaggagagacagcucucguuagcuaaaagagcuagggaagggacauucaaucuggauagaucuaaacuggagugugcucaggaggcugaggugauaucaucaucugcaucuggacccaguguugccuguaucagagaggcagugccugggcaggcaggggggaagcaugccaaggccaggugugaggauggccccugacccagggaugcucuguccuuucagccccaguguugacaagaggcuugcuagugaaccgcaggccugcagaguuuagucugacauuggcacucugagcuuugacacccagaagcucagugacucacugacuuuugcagggagcucuggcacagggugacgccagcagccucauggaugguacacccagcucccuggccucagugcuuccuugguuuauucuauucuauucuauucuauucuauucuauucuauucuauucuauucuauucuauucuauuauuuuauuuuauuuuauauugagauaggaucucgcucugucacccaggcuagagugcaguggugcaaucuuggcucacugcaaccucugccuccuggguucaagaguuucucaugccucagccucccaaguagcugggacuacaggcaugcaccaccuggcuaauuuuuguauuuuuaguaaagaugggguuucaccauuguuggccaggcuggucucaaacuccuggccucaacugauccacccaccucagccucccaaaguggugagauuacaggcgugagccacugugcccggccccuugguguuuuuuaaaaucucuguuaacuuugucuccacuccgauggccacucucagaaucuggucaugacucagcauccccgucacaccaaccuucuaaaucucugcuccgaaucaauccugcagcccacgccuccacucacauaccauggcagggggccagcaccugcugcucccuggcagucucagggcuucuugucugcuuucaggcggagcagcugggacagagcagcuuucuugugucaccuuacuugacugaaggcugcagggucucaccuagacauacuccagcaugccugucauuugcagccaugcucccuuguguuccuaagucccaagagacaguaaaugagggcauaagcuauugcacugcugcccaccagccugguuccgagcuaggauuaaagagagccagagccugugacacacccgcccaccucuccacuuaugcagcucugagcuucaccaccugcaccuugcccugucuuugucuugccuugguucagccuggugcccaugggaagaggccauaacugaccuuccucucacugcggaugaaggugggaggaaaaguuuccagaaaaaaggagacagcagacccuggucuucccagagcucaggccuccuggccacugcagugacccaggcaagagacaggcuggggucagagcaaggugguacccgcggacagggugauacauggucaaauucuggauguguuuuuaaggcagaccccauggaaauuccugauggauuggaggugagauagaaggaucauuaaaugcaaucuugaggucucaaaccagaguucuagucuuguuuucacucuuauuuaucugauucucugaucuuaucugaccagauaagaccuggucuuauccgacagauaagaccugagccccaagucuuaucugaucagauuaagacauuaucuggucuuguccugucucagacugacuuccacuuuuauuucaguggguucugauuccuagcaucagcagcccacuccaggcucuuuggaaguucucuuauugucauuagagcucucucugcugcccuuaguauuuuagcacucacguaaaugacccguuuggcauucugucaguguaguugggccugaagguaauguaacagcguggcagugagcacugcuuaacaucucuuugaaauaaacaacaaaaggcagguggccgucauugccagcccuccaaaguaaggcuuuugcagggaaagugguggacagcuuguaggccaguguagacuguuuuacaacucgaggucucaauucugucacugucgcagugaaugaaaaucacuucacggggauucguuucuuugucuguaaagagucauuguguaauguucaguuagagauaagaaucaaccaguggagaugguggauauauuuaagcgcuuacuaugggccaggcccagcucuuuuacaugaguuaccuuauuugauccucaucagguaggugcuauuauuacuuccauuuuacaaaugaaaacaaugagguuuggagacguuaagugacuuguacaucaucagccagcugguacgggguagggcuggcauucaaacccaugucuauuggacaccggguucugugcucuuaaccacgcaccaguguuucuuucagugugaucaugggucaccugggugggcuugguaaguguagaauccuggguccugcucuccugaccaacccacugacucugacucucugaggcugggaccuggaaauccauaccuuagcuaaaguggcauaacauaugacaaccacgguaaucucauuauaucuaaaugauuguaaagcauccuauggguguguauauguaauguugacaaauccucuaagccuaagucaguccaaauucuaggauuuccuaauuaaaaacaagcagaugguucuuauaauaguacaaucccauccucuguaauuuccaaaguccauuauuaacgcaucaauguaauagaaugucaaauggucagcauucugcagaggacaauauccagacuaguucauuuaagcagaaaggaauuuuuuuaaauagaauauuaaauagguaauagaaucauuaggagagcuggaaaaacagucuucaggcugacuguccagcagugacucccaaaauccuaccacagagcugagcuucagaagcuguuguuccagcaugcucagcaagcugccugugaauguugggagagcagagggcaagcauggagcccuggguuagggagugaucagaacugaagcccaggagggcuucugcaaugaaugacugggggaacuuggauagaaaaggaggccaaggaagcagggguuuucaaacagccaaaguggccagcauggccagauacaguaagagggccaguuaaacauggauuuuuuuuuuuuuuuuugagauggagucuugcucugucagcagauuggaaugcagugggugaucuuggcacacuacaaccucugucucccaguuuuaagcgauucuccugccucagccucccgaguaccugggacuacaggcgcacgccaccaugcccagcugauuuuuguauuuuuaguagagauggggucucaccauguuggccaagauggucuccaucuccugaccucaucauccgcccgccuuggccucccaaagugcugggauuacaggcaugagccaccgugcccaaccaagcauggauuuuuuaaaaauaguauuguuggucuugacaccuaggagacuuuugcuaggucaguuagugaguuuugccagcacuguuucagggggaugguggggaaagcagcuacauugggugggcgaagacuaaaugggaagugagcaaacagaaacagcaagcacggcacagccaggccuuucagggagccaaguggagaugggaaggaagcggggcuguggcuggugagcccuuagagcucagggaauuuuuuuuauuuguuguuuuguuuguuucuuaggaugagagaaacuugagcauaguaauagcagagccauuugaaagagaaaugagucgaugugucaguguucuaaagguccuagaaagaaagggggcaaggacuagaaggagggguuggccuggaacacaggagggacagcuucucccugcuggcugucagaaggaagugacaguggguacagguaggguaccaggaggaggugggugguggagcccuagucaugguccugauuuucucccugaagcugaugagucccccugcugagacggcagggccuggauccugagcgugaggcuggggaugaggugcagguuuggagcagcaacugcugcagacaagugaagggauugucagucaaggccuuggccaccuaaauaaacuagaacuuaugaguucaaggugggccagcugccaacagugugugauguaguucagcagccucgggccggagugcagaggcagguccuggggcugcucugaggacauggacuuucgguugaggaugguguugggcucggagcucaagucugcugcucgacgugaugugucccaucuguguggcaggugccucaaucaggaacccugaagcugucccaccuacaggagggaaccuacaccuuccagcugaccgugacggacacugccgggcagagaagcucugacaacgugucagugacagugcuucgcgcagccuacuccacaggaggugagaagaaaguccuucccucgcuucccacugcuuguggaaggcaaugucggguuggcgcuuuguccucuggcucugcgcuccaugggcucuuccauuuuauuuuugguuauugcugaaugagagagucuuugcuaaaaacacaauaacaaaagcaggcucucuucuguuuugggcuuagccgaugcuacuggguugggguggaggaagcacuccaggggaugagaagagaugcucccgcuucucuugacucgacuucaucaaagacaauugcuuggcuauucugggagaggacuuuguuuacagauggaugguccauuugcugcaucuguuccaagagggaagcuaaggaguuuagugaaaccaguugaacucguggaagcagagaguggaauggcgguuacuggaggcugugcgggggacggacugggaaaggagagacgcuggucaaaggguacaaagugucacugagaccggaggaacagguucuggugaucuguugcacagcauggugacuauaguuaaugauaauguauugucuguuucaaaauugcuaaaacaguagguuuuaaauguugucaucacaaaaagauuacaaguaggggagaugauagauaugucaguuagcuugauguaaucauuccacaaugcaaacauauaucaaaacaucacauugugccucauaaauauauacucuccucuuuugucaauuaaaaauacauauuaaaaaaacaaggaaaaggcauaccacaggauugaagaaagacuuggcucuuggguguaaucaauugcugauauaauaagucacuucaaaaauuuuagaaagagaaaaagagugcagcuaaggaguacgguuaaaauuaauugaaauacgcaaaggacccaucaauuugaaagugcuaccuacacauuuucauagacacuuuacgcagaugcaguuauauuaauaauauaacuuuaaauacauaugaugguucucacauucuguuguacaauguaacaauguaaaacuuauuucauucaucuauguuucuuacuuuucuaaacaucuacauuuuuuuuuugagagggaguuuugcucuuguugccuaggcuggagugggagugcaguggugcagucucggcucacugcagccucugccuccuggguucaagugauucuccugccucagccucccaaguagcugggacuacaggugugcaccaccacgcccugcuaauuuuguauuuuuaguagagacaggguuucaccauguuggccaaccuggucucgaauuccugaccucaggugauccacccgccucagccucccgaagcacuuagacuacaggcgugaaccaccgcgcccagcccaacgucuacaugucuaagaaagauuaggucaucaaauuuuuuaaaauauccauugcauggaacuuagcgacacuaaagauauuguaguauuguagagggaaccccucaccacacacacaauucacuucuggagaggugcuaaggucuuguacauuuaaauauccuguuacucggucaucguguauuuucuuaguguaugcagugugcaggguccuugccaggcacuggggauagaguggugcacugguggucccugacucugguaaacuugcaguaagucugugacauuuuugaauucucaguauucaauacucaggauccagaugguaauuaagccagcagagugcagaaugaggauaaaagaguuggaacaggacugugauuuacuuguacuauauuggaucuagccuucuaucaaaaacugagguuaguaugcauacuggaaaugaaauuuucuaaggaguuagagauuuuaggauccuaaggacuugucaacuuugauaauuuucauaggcggcauuaaaaauuuguuuggcugaugacaaccuguccagccagggguuaagcuuacuguaaggaagcaggguaaccauucacagacaggacaggcaccaaacuccagcccgugccagcacugugaggucaccagugauagcgaguaaacagucuguccagcucagcccggauuccaucagcccugcuaauucauugcagcuggacaggagagccagccagcuacucaaaacauuguugagucccuuugcugggcagcuacucaaaacaucauuggucccuuggccaccaggaccaguggagacaugacauugucuccagcagggauggcucacuucuguagaucugggcgcccucuagagggcuuucccccuggguaccgggacucaccuggacagggucugagucaagugcugacucugggaggaagggacucuugggaaaaagacacagauacccugucauccccacagaaaucagaaaaggauugcucuuguacagcugaagugccugggagggaggaagggccugcacugauaugagcagauggccagcaccucaccggccacuuguuuguccugguuuauuuccucaggcagcuuuccgggcuccagagguaaauugccagcuguaaauuucuggcccuucuccaagaugauaauaaacuguauuugaaguagcagagaguggugugugaaucauuuuugauuacucaguggccgcuugaguauaggucuuguguggguaacuuuauauggaaaauaaaaaggaauuggugaaguacuaacugcugucuagaaucacuuagugguuauauuggaauaacaugcuaugaauuaaaguuaauaaaacaccacagagagacauuggaaaauagagguagaagagacaaguguuucccuccccugcauuguauguauuggucuugcaaugaaugacccagauguuaugguaaccaagggugacacuagcugagguagacagaugagcagguacccugcuuauaugaucauaacuugguucaauuuuuaauaaguugacauuuugaacauuuuucaugcuuagaaaaaugaucaaacagcaagccagcaagcucuuccaacaugaucuaacucagcagucuccaaacaggaugccccugaguuguucaagacauuuuuagggugagaaagaagacagcagaguuuauauuuuugcugauuuuuaauuuuuuuccuuaaaauuugaguauauuuuauaagauacaccccauguuaguacaguaguaugcacguauuauuuauaaauaaaccggacuagccggauguggugggacacgccuguaaucccagcuacucaggaggcugagacaugagagucaguugagccugggagcuggaggcugcagugagcugagauugugccaccgcacuccagccugggcgacacagcgagacuccgucucaaauaaauagauaaauaaauaaacuggagaugccuguucaacaauauauuauugaucaggaugcaugaucaaaaaaguuuggaggcugcuaauccaaaaauagauagaaaauuuacaaauauggauccaucuccaaaaucaccaaagaauaaauaaaaccuugagauaucugggauuuucaugccaugaauuuaagaaaccugacgaggaacuguauccugcuugauauccagcgugucccccaccuccgcucccugcuucuucccaguggccggagcugacucuccuucaggcccauguucucagucauaacugcaggcucuuugcuuccucuucuuccgcaggagcuucuaucaccauuuauuuucuuuaacuucucuuccuccuggaucaauauaucuucaaauugccucacaccaagauagacuccuuuuccaaccucuugauuuaaccacguuucaauaaaagauguguccaaggccgggcgcaguggcuuacaccuguaaucucagcacuuugggaggcugaggcaggaggauugcuugaguccaguaguucaagaccagccugggcaacauagugacacccuguaucuacaaaaaaaaaaaaaacaaaaaaaaaccaaguguauguccaagauuucacuuggguuugugaacugugcucagccauuugguuuugaaggaauaucauauaaucugccacuuccccauguuccugagagaauugucuaguccacucugucccuguaaaaccguggagcuccugugaccugcuucuagccuugugccuuaguccauguugccaguaccagauagucacccgguucuccucuagcuaagucuaauaaaguuggcuuaaucaagggagagggaaaaugcauuucaggaaaauauuuguagcuccuaugaauugcacugcaaauuaaaagcuccuaagaacuccagaagggagaaaugucguuauuucuuucuuuuuuuuuuuuuuugagacagagucucccucugucgcccaggcuggagugcagugucacaaucuuggcucacugcaaccucugccucccagacucaagugauucuccugucucagccucccgaguaccugggacuacaggugcaugccaccaagcccggcuaauuuuuuguauuuuuaguagagacgggguuucaccguguuagccaggauggucucgaucuccugaccuugugauccacccgccuuagcuucccaaagugcugggauuacaggugugagccaccacgccuggccaaugucauuauuucaugaaacuaaauucaugccagcccauaacuaaauuuuguuuauucucuacaguaccagggacguuaugauaaucaacaaauaggauucaauaguaaaaacuuaaucucagugaaaaguauuacuuaggagacaagaauguaagacauagcauauguaaaauaguaccucugggccaggcacgguggcuaacaccuguaaucccagcacuuugggaggccgaggcagguggaucaguugaggucaggaguucgagaccagccuggccaacaaggugaaaucccaucucuaccaaaaaacacaaaaauuaaccgggugugguggugcaugucuguagucccagcuacuccagaggcugaggcaagagaaucucuugaacccgggaggcggagguugcagugagccaagauugugccacugcacuucagccugggcgacagagugagaccuugucuuaaguaaguaaauaaauaaauaaaugguaucucuguuaaaacauagccaacugccauccaggggaugggaugguauuaggugcccuccugcagagcaaucgacagccagaagaagagguuccaacaaugguuucuaugaaugaaugaaugaagagggagacagcugaggcggggaaucaaggguggagagagaccugggcuguugcuucugugugccaccuccuggcaaggcaagcauggagaacagcccucagaccaagagccccugaggagucugaagaauuaagucgggaggcucaaaaagagcccuccaaccucuccagaaccuguugcuggaauuguuagguuugccucauuauuugcaucucuuccccgaagugcauuuuaucauccccacggacuccccuuugucauccccaucuugagagucugaacuucugcacucgugugacuugagauuuguuuacaaauaggauguuugcacacuugcucacgcuaccacuucuucugugacgauggcugcugcauugacaucacgcucgccugcgauggagugcagcaguguccugaugggucugaugaagacuucugccagaaucgugaguuggcuaugucacauugcuaggcaguggcuggaagggauggaguugggaggucuguguucugagaaugaaaugcaaacacaguguccuuccccugcuugauuuuaguuauaacuuuacauguaaaagcuaugccuuaaaugagaauucaauaugucucuagucuaagucucaaaugucaaauuuuuaguauugcuuauguuuuuaauuuuuuucaauuuuccagguucuuucuauccuaaaaaugcugcaugucaugugcuuucuuaaaaacugcagugauuugaugcuuuguuuugauaauuuuuuaaagaaaauuugcgauacaccaggguguggcuaagucagagcuguaaaucagucuuauaauaucauacacauagaaacacccuguaagaaagaagaaaaacugaagaaaauguaaugaaguauggauuugaggaaggacgaagagucucaaaaccuuaaguuuacguuuagucuuuguccauuucuuuuuucuuuucuuucuuuuuuuuaugagaccaguucucacucugucacccaggcuggagugcaguggcauaaucauggcucacugcagccucgacuuccccagccuuagguguuucucccaccucagccuccccaguagcugggacugcaggcauguaccaccaugcccagcuaauuuuuguuaauuuuuuguagagaugggguuuugccuuguugcccaggcuggucacgaacucgugggcucaagugauugccuacuucugccucccaaggugcuaggauuacaggcaugagccaccgugcugggccccguccauuucuuuauguguaacauuuggaaagcugacuauuggaagaagaaagaacagauuacccauuugaaaacgugagaauagauuuuuaugguccucugacaugucuuagaugagugggcuguuacauccaaauauccgugauuuuaaaucagcugcagauguaguguuuuuaguauuaaagcucagaaaagaaauccagcaacuaacaguagcucuuccacacuucagugggccuggaccgcaagaugguaacccacacggcagcuaguccugcccugccaagaaccacagggccgagugaagaugcagggggugacuccuugguggaaaagucucagaaagccacugccccaaacaagccaccugcauuaucaaacacagagaagaggaaucauuccgccuuuuggggaccagagagucaaaucauuccugugaugccagguaaggauucacgguggguucucaaugaagaaccuuguuuucuguagccaaacuuggcucacaauuaaguuuauguuugaagaguguuaaggaaguaucuugaaauaagaguuaaaauuaagaauuuggccagaaaggcggggggaaaucuugacauuugcacuaauuuguaguaagggacacuuacuaaauacacucauguaccuacuccagagacacuaauacauuuauuuguaaauacauuaacacuuagcuuacguaaaccaauacccaaaguguuaaauuuuagguuguuuugagaugaaacagcauaaccauuauguauuuguguaaauccucuucacccaagcaagugaacauuuaaacaaguugucuugaaagagaugcaugugcuaguaauucaacguuaugccuccaauuuaacuaaaucuaucacuaaaaaaaguaaggcuaaugagauuuauuuuuauuuuuuuugagacagggucucacucuguuucccaggcuggaguacagugacgcgaucacagcucacugcagccucagccucccaaacucacaugauccucccaucucagccuccugaguagcugggacuauaggcguaguagcugggaccaccaugccugacuaauuuuuguauuuuuuauagagacaagguuuugccauguugcccaggcuggucuugaacucuugggcucaagcaaucugcccaccucggcuggccucccaaagugcuaggauuauaggugugagucacugcaccuggccuaaaauacauuaacaugacuaaagcauuacagaauuuagccagaugcagugacucaccuauaaucccagcuacucuggaggcugaggcagaagaauugcuugaggccaagaguuugagaccagccugggcaacauagugagaccuugucucaaucagucaaucaauaaguauuacaggauuccaucauuuuuuacacacuuauuauuugcaugauuaugugacaugagacagaaauagagauuaucacauuuccaaaagcuuuucuaaugucuuuucagacucugcauaaguuguauugaaauaaccugacaugauuuuaguaaguuuauuaagaaaaauuuuuguucauuguacaagauacggaagaugcaaaauaauuuaagaaggaaagugaauuuaaaauaccaccucuuuugaaaacugcuuuuaauauuuguuauauuuccuuccacucuuguuuaugugccuuguagauuuuaagugccuccauaaaaauaugucugcaaaacauugcauucuaucaggggcuuuucuuucugaguuuugguuaagaaugcugccaagugucugcuuuuuugguccauuccugguugguacugccaccuacugguaaaaucggucacuacaugcaagccuuuggaugugguuuuaguggguuuucucugcuuaagauaguuuguauggagaagagcaucacaaucuaagaaacagaguugggcagaccaggcaucuuuggcaggacugccgaaggggugaagaguuuauggagagaucuguguuaucagaggccaggauggaugaauuccuaccacauuacugugguggagagaaccacgugagcaugaacaaauuagcugaaaguagagucgagaccaaagcccaggucuuggcucuaccuuuagaaccuugaauaagucacuucauaucucuggaccucaguugccucaucuguuaauaagggacuucaaccagauguccuccaaggugcuguccagcacugaggaaugauaaauaggcugacauucauacuuuaccccaucagcccuuacccaugcuaggugucacucauuggucccagcacugucccauggggaauguggacuuagcucagaauccuuuugaaaauagugcuccaggcuagaagccauuauucucagcaaacuaacgcaggaacagaaaaccaaauacugcauguccucacguuagaaauggaagccgaaugaugagaacacaugaacauauggagggaaacaacacacacuggggccugucagagggugggagguagggggagggggagcaucaggcagaacagcuaauggaugcugggcuuaauaccuagggaugggaugaucugugcagcaaaccaccaugacacguuuaccugugugacaaaccugcacauccuacacauguaccccggaacuuagaaguuggagggaaaaaaaagaaaauaaugcuccaggcugccaccugcggcugaugggagucagcacccaauuuccaaucuauuuaugaucucuccuuuugcuuuuugauaaucagccuuuggauuugguuaugaagauguaaagaguggucuuucacagaugcagagagauuagauguacaguuauuauauuagggcuuuuucuaauuauuaaaauaauauggauuuacuguagaaaauauagaaaaauacaaagaaaguuaaaagcaucuagcaaaacucaccauuaaaauuuugucgcauuuucuucugguuacuucuauucauacacauauacauauuuauucauuuuuaacaaaagcaggauaaugcuuuuauaaaacuuuuuucuuacucaugagcauuuucauguauuauuaacuauucaucaaaaacacacuuuuugaaaguccuggggugaagaaagugggaagaaaaaaacaaaacugaaaauguuagaaagagcccucacauccuguaguuucuguucagacaguagcugucccugcccucccccucugcugucccuaagaccaccagaguagaguccucagccucugauuucauguaaguuaaagacccauaaguagauuuaaaagugcauuauuggccgggcacgguggcucacgccuguaaucucagcacuuugggaggccgaggugggcggaucaugaggucaggagaucgagaucauccuggcuaacacggugaaaccccaucucuacuaaaaauacaaaggccaggaacgguggcuuacgcuuguaaucccagcacuuugggaggccgaggcaggcggaucacaaggucaggagaucgagaccauccuggcuaacauggugaaacgcugucucuacuaaaacuacaaaaaauuagcuggacgugguggcgggcaccuguggucccagcuacucgggaggcugaggcaggagaauggcgugaacccgggagguggagcuugcagugagccaagaucgcaccacugcacuccagccugggcgacagagcaagacuccgucucaaaaauaaaauaaaaaaauaaaaauaaaaauacaaaaaauuagccgggcaugguggcgggcaccuguagucccagcuacuuaggaggcugaggcaggagaauggugugaacccaggaggcagagcuuucagugagcugagauugcgccacugcacuccagccugagcaacagagcgagacuccaucucaaaaaaaaaaaaaaaaaaguacauuguuguucaugacacaugccuggguuuuaagaagaccaucagcuaguacaauaaauaugaaugaguuaaauucacugcugccuccuuccugcacagacauguggugaggacaaauaagacuuagcucggcugggcgcgguggcucaugcuuguaaucccagcacuuugggaggccgaggcaggcaaaucacgaggucaguucaagaccagccuggccaacauggugaaaccccaucucuacuaaaaauacaaaaaauuagcugggcguagugucaggcaccuguaaucccagcuacucaggaggcugaggcaggagaaucacuugaacccaggaggcggagguugcagugagccaagauugcgccacugcacuccagcccaggugacagagugagacucagucucaaaaaaaaaaaaaaaaaagacuuagcucauggaagacuuguuaacaagauacuaagauuaauacuaacaguguagcaugcaaaguagugagauguaguuuuucaccuaucacauugacaaugaugaagaauuauaauaauuaauguuucuaagaguagagagaaacaagucucacacucugcugguagcaaugcaauuaguacguccuuccagaggccaguuucugaaggcuuaaaacuauguauaugaucgggugcagcagcucacaccuguaaucccagcacuuuggaaggccaaggcagguggauugcuuaaggccaggaguucuagaccagcccuagcaacauggcaaaaccccaucucuacaaaaacuacagaaaucagcuugugguauucaccuguaaucccagcuacuugaaaggcugaggugggagaauugcuugagcuugggaggucgaggcugcagugagcuguaaucccaccacuguacuccagccugggugacagaguaagaccucaucucuaaaacaaaacuaugugugcuuugacccaauugucccacuuuuggggauuuauuccacacagguuacugaggauaaaaugaagguaugugcagacauucaguuacaccagcgaaugcaugcucaguacacucugagccaccgggcaggaggagcacagagcuccaguguggccuguguuugcucagcauguaaaggcacaauggcuggauuguugaccauggucauagccguagggccuguucucugugugguccaugucauucauuaacaauuccacccucuuguauccaagcuaccccgaggaaagaaaucugguuuccagcccuacaaagggcuagaaaaguggugcuacauccacauucacguggaaucugcuuuuugaaacuugagaauuccugggcauguuaaaguauuucuuccggaucaugccugcaugcucuauggcagcuggaaaugaaaugaaaacagcuuccauccagcugccaauucccucugugaaugugucgccaugcauaguaaacauaauacauucagaagaaaggaaaaauggucuccuaagacauguaacucuuccagaaggaucauuaccaaaaguaacuauuuccagaagcaagugaugucauuguuuuguuuuguuucgauucgccacacuggcuagagccugugauuggaugugugaaagugaagcauuucucuauggcguuccuuaugcugaaaucuaggaaaaaugaaucaggcagacugggaaaucauagggaauuccuucauggaauguaaacagcagaaauucacauuucaguuacccagaaggcagggccagguuccuggguaauccuagagucuggggcaacugcgccuucugaagucucccaugcacacugcccgcugccugauaccugaucccucccuacaucaccaucuuccucuccccagggaauaagggcauuuaagaaaaugcuguuuaaaaaaauuuuucuuaaagaaagaaagugcucuuuaauuuugacaacugaagauucagaaagaauuugcauaguuuuuuacaugaacccaccugugagguuaggucccuuuugcaaguacaguuagccaauuucucuacugcauccuuaauaaagcuuuguccagaaccuuccuaaaaaucauuuaaaagugugugauuuugccuggguaugaguaaauaaauauaguauugacuugguucuuggaguaaaaaacucguauuugcuaguugugaccuugagagcaguaugguucaauggaaaacugcuuuggaucaguccuggguucuaauuccagcaccaccaauuacuagcuacuaaguaaucaacuucucuaaacuucauuuccuuaccuguaagaggauaauaaucucagcugggcacgguggcucaugccuguaauuccagcacuuugggaggccacggcggguggaucaccugagguagggaguucgagaccagccuggccaacacggagaaaccccaucucuacuaauaauacaaaaauuagccaggcgugguggugcaugccuacaaucccagcuucucgggaggcugaggcaggagaaucgcuugaacccaggagguggagguugcagugagccgagauugcgccagugcacuccagccugggcaacaagagugaaauucugucucaaaaaaaaaaaaaaaaaaaagaggauaauaaucucucauaauauggcuacaaagauugcaggagauauuauauguaaauauaauugaugucucucaguaaauguuagugcuguuugaauuuuugcuagaacauucaaguccagugguauucgcuaggaaaccaggguaagagagcgccaaguguauaaggcaguuaauucaaauaaaaaauagaaauagugcaguaguguuuccaguacugaguuccuuuaagaauuaagaugagcaagcucucaucuucauugggaagaaacagugaggugaacacuguaaaugcaguuaucuuauuuuuuuuauugggugaaagacaaaccaguuaguccucugaaaaaaaucgggaguuggugaauuuuggcacuuuguuuuuauuccuggcucauuuuuaauuuuauuuuuauuuuuauuuuauuuuauuuuauuuauuuuuuuagauggagucucguucucuuacccaggcuggaaugcaguggcgcugucuggggucacugcaaccuccaccucccaaauucaagcgauucaccugccucagccucccaaguagcugagaucacaagcgugugccgucauucccagcuaauuuuuguauuuuuaguagagaugggguuucaccauguuggcuaggcuggucucgaacuccugaccucaagugauccaccugccuuggccuccuaaagugcugggauuacaggcgugagccaccaugcccaggcccuggcuuauuauuuuuaaaaaguaggacuugaguuucccaccaugugaucuucccacuuccaaauuuauuauuggagagagagauaaagcagaaugcauagaaguuccuuugcaagcuaaccuggcaguacggcaugggggaggaggaaagggaugaagggagaagugccacaagugguuuuuagguaacuuagcaguuugauuuccaagcuguuucagggcugcuaguuuugugugugcggcugcuggauggacuguuuugcauaucacugauuuauaucucuacagaacaaaucuuguguuucuuuuggagauccacgagcaacuggcauuugaaaaaaucaggcauuauugacuuuaaaacacaguaauguuuucuauaucucuaccaagcaaaagcucaggaacauucacuggagucucuguaguaaucuaaacaaggcuuacauugaaccuucaaaaugcuauugaaaauauucauauuuuuaggucaggugcuguggcucacaccugcaauuccagcacuuugggaggucaaggcgggaggcuugcuugagcucaggaguucaagaccagccugggaaacauggcaaaaccccaucucuacaaaaaaauagaaaaauuagucagguguggugaugcuuaccuguagucccaguuaguugggaggcugaggugggaggaucacuugagccugggaagucgaggcugcagugagcugagauugcaccacugcacucuagccugggcaacaaagggagacccugucucaaaaaaaaaaaagaaaauaaaacauacucauauuuucaauauggauaucaacaccaugagauuugcaccauaaaagcagugguuaaauauguaccuauuaacuaccucaccccugagaaaaaguguaaaaauuacuugccacaaaaauugcacucuggucugucuacuagcaguaaaaauauaauaaaauaaaaaagcugcauggucuuauuuuucuguauuaaauagugcuuuccuaugucagcagauguuuacaguacuucuaguauagcuuccuaggccagaaucauauauaauaaaaucuuuuuuuuuuuucuuuugaaaaggagucucuguugcccagguuggagugcgguggcaugaucuuggcucacugcacccuccgccucccaaguucaagugauucuccugccucaguuucccaaguagcugggauuacaggcgcccaccaccaugccuggcuaauuuuuuuuuuuuuuuuuuuugagacggagucuugcucagucgcccaggcuggagugcaguggcgcgaucucggcucacugcaagcuccgccuccaggguucacgccauucuccugccucagccuccccagcagcugggacuacaggcgcccaccaugccuggcuaauuuuuuuuguauuuuaaguagagacaggguuuugccauguuggccaggcaugagccacugcgugcggcccuuauguaauacaaucuuauagaacuaccuggccugggaucagguaucauauaagagaauccagguagcuggagagguccuuggugaccacugucguggcuacugcagugaguuggacaguaacagaacucuuuuugcagggaaaucugauccugcagccuaugagcaauggcugugcuuuccucaucucucuccuucugucugagcucagaguuuauggagaaagcccaaauuauuggcuguauguaggaccaacauacauggaacuuucuagaguaacaagacacaguagacuguccccaaagugccaggauuauaggcaugagccagugcaccuggccaacuuugugacuuaguaaauuugcaaaaugcaaguuaccaaagaauuuuauauacuaccuuuaaauagucuuauuucauuugcaggaauuaggaacauuuauguugaugccauaugaguaaagaagcuuuaaaaauuuucucaauaaaauuugucaguagauuauuucuaauucauugccauuaagcauuguaauacucaaaaaucccacuuaaggcugggcaugguggcucacgccugucaucccagcacuuugggaggcugaggugagcggaucacuugagcccaucuggggaacauggcaaaaccccgucucuacuaaaaauacaaaaauuagcgaggcaugguggcacgcaccuguaaucccagcuacucgggaggcugaggcaggagaauugcuugaacccaggagguggacguugcagugagccaagaucgugccacugcacuccaaucugggcaacagagacucugucucaaaaaaaaaaaaaaguaaauaaauaauaauaauuucccccucaguauuauaacuuaauaguuaaguaauauaucauuaaauuagaaguacuggucucuaccaagaaaccaguuugcaucccagcccugugacccacuuacuugugugaaccuagguacgaaccugacccugagccuaaccagaaagaaaauugagcuauuuauaccugccauccagaguugugagaaagagaaagagcaugucuaaaugccuuauauaugcccauuguuuauucuucaaagaaaaaccuuucugguuucugcuuuucauggcgugauauccggagacucccugugacucuucuagccugagaucucccuucuccaagaggcguggugguaguucggugcagggugugucuuccgcucucucugucggugguuucguauuagcugcguacuuugcuuuauucagugggucaccuuaguuauuuacugcuuaacuaucaaacauaggccuuuguuuaguagagaaauaaacaguucuucucuaaguccaucuuaaaaaaaaauaaggcuguauuuucacauuuguuuccugaaguuucugaugcauacaccuucaauauauguucucuuucuuuucugcagauaguaguuccucagggaagaacagaaaagaggaaaguuauauauuugagucaaagggugauggaggaggaggggaacacccagccccagaaacagguaaauguccaccuuggaaacccuuugcagacuguagucuucucagaacugcaugcccucuggcugaggauauucccugaggccaugagagcucaggacaggaggaguccgucaguggaccgaaagaacugucuccucguugcuuguauugcacugcgucuuggggcuccugauaguaaccuuccaucuuuggaccucagcugccuuuucuauacacccuuccaggugugacaccuguggaaaaugucauacuuguggcauggugggagaacacaagcuuuagagucagaugccacaauucaaauccuugcucaaagcugggcacaguggcucacgccuguaaucccagcacuuugggaggccaaggcaggaggaucgcuugagcucaggaguucaagaccggccugggcaauauggcaaaauccugucucuacaaaaaauacaaaaauuagccaaguguggugacauucgccuguagucccagggaggcugaggugggaggaucacuugagccugggaggucgaggcugcagugagauaagauugugccacugcacuccagccugggugacagagugagaccgucucaaaaaaaaaaaaaaaaaauucucacuuacccacuaaacuguaugaccuugagcaggcuaucuuaucucucuggaucucaguuuccucauucguaagaugaggauaguaacaauaccugccucauaggguugcugagaagaauauaugggauaauuaaucucaagcauugaaugcacuguguggcucauaugaugagccaaauauagaaacgauggcaguuauuacucaguuauuuacgaugaaagaagaguaaaggucuuagaauaccuaguucucuuuccaagugcccuagugacaaagacagaaaacaacagaaaugagggaaggguguaggaaguagaauauuuacuaaguggaagaagaauacaauaauuucuuuaauuuugguugauuuuaacuaggaagaaaagacuuuggaaaccauccuuuagaaaggcaggcuuuagucuuaaaucccacaaacuaguaaaagaagcuuuagaagaacaaaauauaagcuuaaguuauaaacauugagaaaacuuucuuuuuacccuauuuauaauaucaggacaauauuaaaauauaauguuuaaacaauagauagcuaagaauacuccagaugucaaguaccugggugacccccuuggucugcuggccuccuggacuuagccugucccaagauauuugaauaaaaggggcccuguccccuaucaagggaagagggaaaccagccugccucuugccuccccacacauauguauccagagagucucagcucuaguuggcuguugccuauucugguuguuacauauuuuuguuuuguuuuguuuuugagacaucgagucucacucuguuguccagguuggaguacagcggcgcgaucucagcucacugcagccucugcuucccggguucaaacgauuccccugccucagccucccuaguagcugggauuacaggugcaugccaccacaccuggcuaauuuuuguauuuuuagcagagaugggguuuugccauguuggccaggcuggucucaaaacuucugaccucaagugauccuccugccucagccucccaccaugcugggauuacaggugugaaccacugugcccagccuguuacauauuuuaaaugucacccccauucauaugaacagaauacauaauucaucacccuagcugguuacugagaauagcaucaugguguguuuuagaaggagcuagaaaguuguaaaucucaaauuauccaaacuaagccaacuaaauauuaaaagucaagaauaauuuucaauauucuggcaaguacuuuugggagauuucauuuuccuugucauaaaagcauuaaacaggaaucagaucagacaguucagcagccucauaucugacuuagcaaauagaacauuuucccagaucucgucuguuuuauuguuaccauagcuaaaccugagccccggcauugggauuggcaucuucaaccacagcuucauaacccuuuagccuaaaugcugaugcucaucuuuaagcaagucccccggacuggggcuggguguugcgguccaauucaugagaaaugauuugggguuccugggguuuucuguggguauugaccaaagucucuuuuuuuguccuguuccuuuguaacauaugcaacuuauaggaagguggagggagaaugacaccuuggggccacuuagccuugucagaacuucuuucaucagguggagacuaggaggcaguaguagcuacugaagccccaaacugcuggcauggagagaccaggcagccaucuugacaccuccagaacugcuguguauggaaugagacagccguagaauccaauuccaguccauaggguuaucaccgauuuguaucuuucacaauucucuggaggaaugcuggccucuuccagaacuuuguuugauaccuaacagucucuaaagcagcuuucccauccccuccuccggcaaccagacacuuucaaacuguucuugagaaucuuguucaggaguuuuaccugggauucuaaaaauacaccagaguucaagugccgugagugugucaucagcuccagguccucuugucuucaagaggcggccagcuauaccugggaccaguuuuaagcccaguaaaucaagacugucuggagugaacuuccucagcuaccugccccccaaauguaaaaacucaucugguugcauucaccccucuuccuccccuccaguacuaaaggaagaggugucgccucuuuccaaggucucucccugaucuggcuaaagccccugauuuccucagguucauuucucaucaucuccuagcucucccguguuuuucaucucuguuucuuuacuggcucauucuccugacugugaucauguucagauuucuuaauguguaaagaaacaaaguagcauccuccaucuucuguacucccauaaaugaauuaccaauugcuaaauccagggggcucuccaggcuucaccucacuugacauuuccuuagcauuugauucagcugaggacuuucuucuuggacgucucuuuccucagcuuccaaaagcccacucccuacuauagcgguuguccuccuauuucucugacuggucuucuucuguuuuuuuuugguccucugcuuuugucugcccucuaaaugcugguguuucccaggaccucguuccuggcucaccuuucuucuuccuuucucucuggcuguccuaaccccuauugugacugcagcuaccaccuuuaugcuaaaggcucccacauauuuaggcccagcuaauccaaaagccuaagagaaaauuccaccugaucgcugauaggcaucucaaucugaaaaugucaaaaaauaaacuuaccuccuucagccacccaacagucucuaucauacaucaaaaucacucaggcaaaaauccuacagaccagguagauggaccaccuauuuuauuaauacaacuaugcuucaucuauaauucuaucauaguaaguauaacacuuuguugcauuuuuucccauuuaaaugucugucuacccagacuuacucguucaaaaacugucucauuuacauuuuguagaaguagaguaccauaguggauagaaccacaggcucuggggcuguccugucugggguuauuugcuagcucuaccacuuaacaaucuuagacaagucacuucagucuuuuuuuuuuuuuuuuuuaagacaggaucuuacuuugccacccaagcuggaguacaguuuaagagcucacugaagccucuaccucccagacucaagugauccuucugcuuuagccucccuaaguauugggauuauaggcaugagccacugugcccagccucacuucucuuuuuuuuuuuugagauaggcccuuacacugucacccaggcuggagugcaguagccugaucauggcucauaacagccucaacuuucugggcucaggugauucuccuacuucagccucccgaguagcugggacugcaggugcaugccacaacuggcuaauaauuuuuuguagagacaaggucucgccauguugcccaggcuggucucgaacuccugggaucaagcaauuugcccaccucugccuuccaaagugcugguaucacaggccugagccaccgugccuggcccucacuucauuguugaugccuuagcucccucauuuguaaaauggggauaauaauagcaccaacuuauguggugguugugagaauucagugauuuaagcuauaaagcugguauucuuggccuuagcuuaucuugaggggggugguauuuauuuacaaauaaaaggauuaucagcacuuagcucagugucuggcacauggaagaaggcuuuuaaugaaugcagaaugaaugaauaaaugagagcaaaugguauagaaugagccuacacaaaggagauguuucuccucuaguucuaccaguuggcaagaucccuacagcuaaaaacaguuccaccauauaaucuccagaccuggccuggccacagaguagaucagacuaaaaauagagccugcuaagcuugauaaaaaagacugauauuggcacacccuguccuuccagacuccugcaagccucgcuacuucuacucuggugucuagaauccaccucacaggaaaaacuaaagaaauguuuuccuuuaauguccaaaaucacaccagcauauuuggaaguuaguuuucaacaaagguucuacugacugagucaguucccuggauuuagaaggaaauaaauuucuuaagcccuaacuagaacaagaaaucaggaguuaguucauacuuaguugaagaaugaucauguaugaauucauaaauauagucaaugacuacaacaaaaaaauuucgugaucagaaugccuauuucaguuggauaugagugaucagaugguaguauguguacccauugaugccauacaaauuuuguaggaagcugguagagaauuugguuuuaaagaggucuguguuggccgggcacgguggcucacgccuguaaucccagcacuuugggaggccgaggcagguggaucacgaggucagaaguuugagaccagccuggccaagauguugaaaccccaucucuacuaaaaauacaaaauuuagcugggcacaguggcaggcaccuguaaucccagcuacucgggaggcugaggcaggggaaucgcuugaacccaggagguagagguugcagugagccgagauugagccauuacacuccagccugggcaacagagcaagacuccaucucaaaaaaaaaaaaaaaaaaaagucuagguuugggaccugaaccuacaacuuacagccuccuaggcaaauaagcaaauuacuuaaccuugguacaccuuaguuaaucugcaaaauagugauaauacuaauaacaauuuguuuggauuaaauaaaauagugcaugcaaagcgcguaucauauagugaccaguagcugucacugugacuaaucacuggcuugcccucuucaugucuaaccuucucaaaggugcagugcuaccccuggcgcuggguuuggcuaucacugcucugcugcuucucaugguugcaugccgacuacgacuggugaaacagaaacugaaaaaagcucgucccauuacaucugaggaaucggacuaccucauaaaugggauguaucuauaguaauguaauuucaauaccuuggggcagggacauguuuuguuuauaauuuauacaucuauuaaguucuggauauuuacagcuucuuuuguuuuuaauugggccagaagauucugcaaaucccaaaucuuucuuuauuauuuauuguaaaaaaaguuuccuuagaagucauaaaauauuuugaaauuuagagaggaauucaugauuaaagauuccuaaaaauauaauucugauuuauguaagcugucccugaaaauagaaauguguacuuagcugagagaaaauucagcaucucaggaggugguauuaggaugacuguguuaacccauuaccuuuuagaagccaacuguuggccccuuaccaugcuggacugcuauaggcccagcuuccccuuguucuguggcccuuuucuuccuccuugaagcucccaguauucuuuuucuuuuccccucuaaaccuguuucugagaguggaucucaagcaaguucaugccuucaaucagauguuacuuaggguggguauaccuaaauuauaaaccuuauguacaagucaguaagccuuagggaaggugaguguggguccuuccuaaucccucugacgucaugucauauagguggcugccuccuuagacugaccuuugggagaaaaaaaccccagacuuugaauuaguaacagcucuaagauggucaugcagugagauaggaaaucaagauggaagcagagaaucuggcaugccaaaaacuaacagaaacuuaguugaaggcaaagagagcaaggagaacguuuaauacuucauuacaucaaaucaacacugcuccauggugagagcacagcaacucauuuauauauauauauauaggcuuuguugaugaaaaacgacaauugaagagaggacguugaguggauuccuggguacagcuuuuguaaaaaugucaccauggcuuucauccaauggaaugagucgauguuuuuuaaugcuauaaaauguuagaaugugccaucagcuaaugccaggcuuacguauuucuagaccauaaagcaguuuuucacaaauucaucuuuacagaaaaccagcaucuagcuuagcaucuuuccccuuuuaauuuguaggcuuuuaaaggcaaaucauucccaccaucacuuaacgccgggauuauacacauucuagaaaugauucugagaggaguguauaguauggugccuaucuacacucacaugauauucuuauucacguuuuuuuuaaccauaaguggcaaauauuuuaaaauauuugaaaaacacuccagaaucuaguacgcuuuauuuuuagacugaaccuaaaguagguuguucuuuuaacaaaggguuuaauucggguggggaauauaacauaucaaaauacaugaacaaauggaaaguuacuucuagaaaagcaaagaaauuggguaucauuuuuguuucuugggaagcuaauuuuguugaauguuuagaauugagcaaagauguaaauuuuugaagggcaguuuagaaaaauuaacuuugugaaugaacuuaagaugucuguacucuauaugugaugcugugcaguuuguuuuuauauggaaagaugucaacuauagccauaaccaauaaaauaaaaacugaugaggcaugcagcuuucagcacaucuuuuauacaugaagaaauuaauuuuguguugcuaugguguugaaauauccaagauguucuguaucuauguaaacaugauuccuuuaauaaauuguauuuuauuauuaagccuuuuuuuccuuuuaauauaaucauaaguugcuauu

SEQ ID NO: 192118 - RNA, 22232 nt, Homo sapiens
gcugagaggcgcguacugugcuugcuuuuugcaguaccugcugcggccgcuuucggcauggaggaaauuuaugcgaaguuugugucccagaaaaucagcaaaacccgcuggcgaccgcugccuccgggaaguuuacagaccgcggagacguucgcuacaggaucuugggacaaugagguaucgccgcugauagggacgagccccuaccuccucccucucuccgguugagcugaccccuggccuuccgcgcgccaacucccaccuucugguucuucucgcacuuuuaggucccccggaccccugucucaggcgcgguugcuccguagcucagagccggugauggcaugccugagccucguaucucguuguguuuuaaacucaccauaccauuugagauguuuuggagcaacauuuccggacgggagcacaacuuuuauuuuccgagaguugacguuuaugucaucucaagacaaaacuuucuguuuuacaggaaaauuauauuucacuguggucuauuggagauuuuggaaacuuggacucugauggaggguuugaaggagaccaucaguuauugugugauaucagacaccauggugauguaauggauuuacagguaaaucuguguagcauccaaaagcuaacuuugaaaguccugaguaauacauuuaaacaagcagagcaucauaaaaguugucuggugucaccccucguuuacagaaaacugagugcucuguaaguuaugauuugcccaacaucauuuagccauuuaguggcagaaaaaggacugggaaaggggauguagauuuaaucauacuuuuuuauuaauugacugucgacuaugugcuaaauaccguuuggggagcuuuacaaaaauuaauuauuguugcaugccagugaaucaaguaucguuacuuuguuuuacuaaugagaaaauugagacuaauauaucuugagcauguacuaugugacagauacugugcagggggauaacaucauuuuguuuuuugaauucucauaacaacucccuaaguagagauuagugcucccguuuuaaagauuuaccacgauuuagugaacuuaacuuggccaaagucucaaaaccaguaaugagugguggggaugaaauugaguuuucuuuuuuuuuuuuuuuuccaagauggagucucgcucugucacccaggcuggaguacaguggcaugaucugagcucacuacaaccuccgcuucccggguucaagcgauucuccugccucagccucccggguagcugggacuacaggcgcaggccaccauacccggcuaauuuuuuguauuuuuaauagagacgggguuucaccauauuagccacgauggucucuauuuccugaccuggugauuugccugccucggccucccaaagugcugggauuacaggagugagccauggcgcccggccgaaauuaaguuuucaaauccugguguggagagccccugcauuuuccauagaaagcuaccuagcccuggugcgcgcuuguaaucccagcuacucuggagucugaggcaggagaaucgcuugaacccgggcgcagagguugcagugagccgagagugcgccagcuugggcaacaagagcgaaacucugucucaaaaaauaauaauaauaaauaaauaaauaaauaaauaaauaaaauaaaaaagaaagcuaucuagcucuaggaaagauacauuuuuuuuuuuuggagacgaagucuuauacugucacccgagcuggagugcaguggcgagagcucagcuuacugcaacuucugccuccuggguucaagcaauucuccugccucagccucccgaguagcugggacaacaggcacaugccaccaugccuggcuaauuuuuguauuuuuaguagagauggaguuucaccauguuggccaggcuggucuugaacucgugaccucgugguccacccggcuuggccucccaaagugcugggauuacaggugugagccaccaugcccagacgauauuuuccuuuccuuuuuuuuuuuucuuuuuuaugacgagucuugcucugucacccaggcuggagugcaguggcucgaucucggcucacugcaaccccaccucguggguucaagugauucuucugccucagccuccugaguagcugggaguacaggcacaugccagcacgcccagcuaauuuuuguauuuuuaguagagaugagguuucaacguauuggccaggcuggucucgaacuccugaccucgugauccgcuugccucagccucccaaagugcugggauuacaggcgucagccaccgugccuggcuuuucuuuuuuaaaauuuuuauucuuuuuuugaaacugagucuugcucugucaacuaggcuggaaugcaggggcucaaucuuggcucacugcaaccuccacuucccuacaaccccaacucauuuuuguauuuuuguagagacgaggccucgccaucuugcgcaggcuggucuugaacuccugagcucaagugauccguccaccuaggccucccaaaaugcugggauuacaggcgugagccacugcacccagccaggaauaauauuuuccuaagguuuuauuguguuggucccaaauuaaaucaauugugggugaaugugucuaggaaaaaauauuguuuauucaugaaaauacuuuguauggcaguuuggccuuucagcuucauuaacacauuuuauuuccuuagcacucauggcucuuugcuuuuuaaaauuguuauaagauuugcuacuaauugaguuaaauaaacaaauggacuuccucccugcuaauauuucugaaucuuuaacaagcagaaauuuucucuuuaguuuuuugaccaggaaagaauugucgcugcuucaucaacaggauguguaacaguuuuccuucaccauccaaauaaccagguaaagaacuuuaguuugagaagugauuuuuuuuuuuuuugaaauggaguuuugcucuuguugcccgcgcacuggagugcaguggcgcagucucggcucaccgcagccuccaccuucugaguucaagugauucuccugccucagccucccaaguagcugggauuacaggcacgugccaccacgcccggcuaauuuuauauuuuuaguagagacgggguuucuccauguuggucaggcugaucucaccugaccucaggugaucagcccucuucggccucccaaagugcugggauuacaggugugagccaccgcgcccagccaaagguaaccuuuucuaauagacaugccuaguuaauauaagucccaguucauguuaaggguuuuuuugagucauuuagaaaaagcuauagagauuaauauuuuauuuauuuuauuuuauuuuauuuauuuauuuuuuuuuuugagacagagucucucucugucacccaggcuggagugcaguggugcgaucucugcucacugcaaccugcaucucucugguucaagcaauucucacaccucagccuuucaaguagcugggauuacaggcgcgugccaccacaccuagcaaauuuuuguauuuuuaguagagacgggauuuugccauauuggccaggcuggucucgaaccccugaucucagaugaucugccugccuuggccucccaaagugcuaggauuacaggcaugagcgacagccgugggccagauauguauauuuuagauguagguuaauucccauaagaauacaaagaguugccuuugaacauccaacugcuugaucccuaaaagucauuacuguaguuugagauaaauguggggcauuauuaaacaauauuccuuuuguaucuaauucaguguauauagaacuuugauggcaguaguuucuagauuucauuauucuaaaggaaaaaggagagauuuauucuuguagaagggugugagucagaauuuaaagauacucuuguugggaagaagugcuaauuccuuaguacuuugcuuuaauaguauccucauuucugaugccuagacucugucagucaaccagcaguggacuacagcucacuaccacacaggcccuggcaguccuuccuauagcagugcaccauguacagguguugugugcaacaacccagaaaucguuacaguuggagaggauggucgaauaaaucucuucagagcugaucacaaggaagcuguaagaaccauagguaagaaaaaucccagccuggccaacauggcgaaaccuagucucuucuaaaaauacaaaaguuaggcugggugugguggcucaccccggcaauugcagcacuuugggaggccgaggcagguggaucaccugaggucgggaguccgagaccagccugaccaacauggagaaacaccgucucuacuaaaacuacagaauuugcugggcaugguggcacaugccuguaaucccagcuacuugggaggcugaggcaggagaaucgcuugaaccugggaggcggagguugcagugagcagagaucgcaccauugcacuccagccagggcaacaaaagugaaacucuguuuaaaaaaaaaaaaagaaaaguuagccaggcgugguggcgcaugccuguaaucccagcuacucaggaggcugaggcaggagaaucgcuugaaccugagagguggagguuguggugagcuaugauggcacucugcagucccaccugggugacagagggagacccuguuucaaaaaaagaaaaaucauuguacuccuuucauccaucagaguaauugagcacuuaccauauacuaaguaaauacugccaggcacgguggcucaugccuguuaccccagcacuuugggagggugaugcaggcggaucacaaggucaagcgaucaagaucauccuggccaacguggugaaaauccgucucuacugaaaauaacaaaaauaagcugggugagguggugugcaucuguagucccagcuacucgggaggcugaggcaggagaaucacuuaaacccgggaggcagagguugcagugagccaagauuacaccacugcacgcuagccuugugacagagagagacuucaucuaaaaaaaaaaaguaaacacaauguuaagugauggagggauguaaaaauauauggccggguacaguggcugacgccuauaaucccagcaccuuaggaggcaaaggcgagcagaucauuugaggccaagaguuugagaccagccugaccaauauugcaaaaccccaucucuacuaaaaauacaaaaauuagcugggcaugguggcacaggccuguaaucccagcugcuugggaggcugaggcaugagaaucgcuugaaccugagagacugagaggcugcagugagccgagaucaugccaccgcacuccagccugggugacagagcaagacucugucucaaaaaaauauaaaauauauguacacaugugcacacacaacgcaaggcaggaucccuuugucaagacaguauguugaugagaccaguaugaaugacugacuagaggaaacagaaaccuuuuuuuuuuuggugagagggcauuaucagauaaaacaucuggaagcagguaguaauuaauaguuuuucuagguucuagaccauaaguaauacuaaaagauggcgugcuagacaaagggaauaggccagaggcaggauaaagacauucagagaaugacaaaaaguauaguuugacccgacuuuagauauuuauuuaggagagaugaaagaugaagcaagagagaaguaagcuggggccagauugcaaagagucuguaaugcaaaaucacagaaguuacaucuuuuagguggaaaacuaaguguauugguucugaacuaugcuucagccagacuucucugaggaaauuuuuuaacugucgaccacucuagaccuuuuaaaucagaaucucuaggaauugagcccaugaauccauuuuguauguguguguuuuguuuguuuguuuguuuagauggagucacgcucugucaccaggcuggagugcaauggcacgaccucagcucacugcaaccuccaccuccuggguucacgcgauucuccagccucagccucccgaggagcugggacuacaggcgcacgccaccacacccaccuaauuuuuguauuuuuaguagagacaggcuuucaacauguuggccaggauggucuugauuucuugacuuugucauucgccugccucggccucccaaagugcugggauuacaggcgugagccacuguaccuggccuuuuguguuguuuauuaugauuuucauuucugaguuaaguugcauuacuuuuuuuuuuuuuuuuuuuuuuuuugagacagggucuugcucugucacccaggcuggagugcaguggcaugaucccagcucauugcaaccucugccucccagguucaagcgauccucccaccucagccuuccagggaugugggacuacagaugcacaccaccaugcccagcuaauuuuuguagaaacgagguuucaccauguugcccaggcuggugucaaacuccugggcucaaguggucugcccaccucggccucccgaagugcugagauuacagacaugacccacugcacugggcgacauuacuuauuuguuaauuaaugaccauugccugguggcaguguagaggaguggcacaaacuaaaguccauaaaguauauguuaaauuaugaggcauaaguucuaaacacuaggaaaucaacaaaaaggaccauuaugacaauaaggagugacuucauggagagggcgagaguugaugagggugaaaaugaguagauuugggaugagucugcagaauaauacaagguuagaaugagcucuguaggaagcacuggaguuuggcucaauagaauggaaguucuaggucagggacuagugggaaguaagauuggguuuagaggagcuugaacaacucucucagaaaugcaggguaacaaucuuaagaguuaaaaagaaauguaugaaaacucagccuuccauuuagaaaacaguucaaggcugggccuggugggucaugccuguaauucuagcacuuugggaggcugagugaggcggaucaccugagcucaggaguucgagaccagccuggccaacauggugaaacuccgucucuacuaaaaauacaaaaauuagccaggcaugguggcauguaccuguaaucccagguacuagagaggccgaggcaagagaaucgcuugaaccugggaggcggagguuguagugagcccagaguacgccacugcccucuagccugggugacagagcgagauccaucucaaaaaacaaaaagaaaaagaaaacaguaggccaggcgugguggcucaagccuguaaucccagcauuuugggaggccgaggcugguggaucaccugaggucgggaguucgagaccagccugaccaacauggagaaacccagucucuacuaaacauacaaaauuagcugggugugguggcacauuucuaaucccagcuauuugggaggcugaggcaggagaauagcuugaauccgagagguggagauugcggugagccgagaucgcgccauugcaguccagccugggcaacgagcaaaaaaaaaaaaaagaaacagaaaacaguucagauguccugugaguaaauguuuuucccauccaaagagaauccauuuaaacauauacauuaaccaugcauuuuucuauagaaauuuaaauuauaaguuacuggaaauuguaauauaucaauccaugaaaggagugugauuuaagauuuucuugggaaaaaaaggggacucauuaacacauacuaccauuuuuuaaauuuuuagacaaugcagauaguaguacacuccaugcuguaaccuuucuucgaacuccugagauucuuacuguaaauucaauuggacaguugaaaauaugggauuucagacaacaaggaaaugagccuucucagauauugucacuguaaguguugauuuguaauuucaguaauguaauccacaaauuaauguguuagguuguuuauagcuacuggcuuuaagccauauugaauuuuaauugcauuuuaagagggagaucccugauuaaaauuugguagagcaagcauaacuugacgggguugguacuacuaugcuucauuuaguaauuauuuguuauagugauucagagccuuuacucuuugaaguuuguauuauuucauggagaacuuauuucugcucuuucaaugauuguuuaauggauaaaauauacuccagauguaaugauugggggaaaaauauaauuccaaauauuuuuucugagcagaaaucccccuuuguagguguacaacguucucucguaagaaaauagaaugugucacacugaaaaaauaguuacauaaacuaagcauuaaauaagaugauaaauaauauuuaguauauaauugauguaugaguuuuuaaauaauuuaacaaguggaaaugugauuuguacaucuuaccaucggauugucuuucauuccaugucuccaaauugaagugaaaaugaauaauuguggccuugaauuauuucaaaauuguacuauuuagaaauauaucuaauuuaguucauuuuuuuugguaucauuaagauucagccaggcugggcgugguugcucaugcuuguaaucccagcacuuugggaggccgaggcaggcagaucacuugaggucaggaguucaauaccagccuggccaacacagugaaaccccgucucuacuaaaaauacaaaaacuagccaggcaugguggcacgugccuauagaccccgcuacucaggaggcugaggcaggagaaucacuugaaccugggagccagaguuugcaggagaaucacuugaaccugggaggcagaguuugcaggagaaucacuugaaccugggaggcagaguuugcagugagcuaagaucgugccauugcacuccagccugggcaacaagaacaaaacucugucucaaauaaaaaaaagauucagccaguagcuccagccacuaaguugacacuuaguuaccauauaaaacauguuucuuggcugagcauggugacucaugccuguaaucccaacauuuuggaaggauuaucugcggugagaaguuugagaccagcuagggcaacacagugagaccccaucucuaccaaaauuucuuaaaauagccuggcacgguagcaugugccuguaguccuagcuacuugggaggcugaggcaaaaggcucuuuugagcccagcuugcagcaagcuguagauaggccauugcacuguagccugggugacaagacaagacccugucucucuuuuuuuuuuuuuucuuugagacagagucuuacucugucacccaggcuggagugcaguggcaugaucuuggcucacugcaacuucugccuacuggguucaggcgauucucaugccucagccucccaaguagcuggaacuacaggcaugugccaccaugccuggcuaguuuuuguauuuuuaguagagaugggguuucgccauuuuggccugguuggucuugaaccucaagucauccaccugccuuggccucccaaagugcugggauuacaggugugagccacugagccuggucucuuaaaaaauaaacaaaaaaaaacaggcugggcacgguuaccagucaucccagcacuuuggaaggccaggguggcuagaucacuggagccugggaguuugagaccaaccugggcaacauggagaaaccccaucucuacaaaaauacaaaaaguuaaccaggcaugaugguacacacauguacucccagcaacucaggaggcugaggugggaggauaccugagcccagggaguuugagccuacaguaagcaaugauugcagcgcugcauuccagccuggguaagugaggccuugucucaaaacaaacaaaaaacguguuuccuguguuacacaaagauaaauuauacuuuauuugauuuugacgucauuguuaucucccacaaaaggacuggugaccgagugccacuccacuguguugauagacaucccaaccaacagcauguuguagcuacugguggccaagauggaauguugaguauuugggauguuagacaagguacuaugccuguaucucugcugaaggcucaugaagcugaaaguaaguauugugaagauacagaaaguuuauauugggugaguuauaugacauauaauaagcaccuuuccauaaugauacauguggaucauuuuacaucauagcuuuuaauggcugaauuguguaaauuuaaauaguuauguaauuucuuuuuacucgacauuuaaguucuuuaacauuuguuuuuguuuuuuuggagacggagauucacccuuguugcccaggcuggagugcaauggcgcuaucuuggcccaccgcaaccucugccuccuggguucaagcgauucuccugccucagccucccgaguagcugggauuacaggcaugcaccaccacaccuggcuaauuuuauauuuuuaguagagacuggguuucuccauguuggucaggcuggucuugaacuccugaccugaggugaucugcccagcucggccuccuaaagugcugggauuacaggcaugagccgccgugccugguuuuuuuuuuuuuuuuuuuuuuaaagagacagggucugguucugucgcccaggcuggagugcaguggugcagucacggcucacuacagccuugacuuccagggcucaggugauccucccgcaucagccucccaaguagauaggacuauaggugugugucaccaugccuagcugauuuuuuguuguuguuuguuuuuuuuuuuguagauaugggguuucacuuuauugcccaggcuggucucaaacuccugggcucaagugauccucaggaagugcugagauuacagguaugaguuaugagccaccacaucaaccacagguuuaauucuuauauccaaaacuguaguuagaauccuuagauauuuaucucuguguguguuuuuuuuuuuuuuuuuuuuuuggagacagggucucucucuguugccuaggccagagugcaguaguggugugaucauagcucauugcagccuugaacuccuggacuuacacgauucucccaaagugcugggcauagccauuaugcccaugcccagccuuauguacuuauuuucuuaggauaauuuuuuagaaguagaauugcuaggccaaacauuuugcauagcgcauugacagauuuuucuacacaaaaauaauaccaguuuaagccaggcacauuggcacaugccuguaguuccaggcuccuccuacucaggagccugaggcaggaagauugcuugagccugagaguuugaggccagcuuaggcaacauaaccucuuuaaaaaguuaauaauacuaguuuaauccaggugaguggcaugcaccagcuucucaggaggccgaggcaggaggauugcuugaguccaggaauucaaggcuguagugcauuaugauugcaccuaugcacuccagccuggacaauauagugagaccccacucccugaaaagugauaaaaaucauaccauuuuauaugccauagugaagugugcaagaaugcccuuuucccaugcaaaugcaggcugucauauuuguuaauaaauguugugcuccucaauuuauuguugcaucacaucauuuuuuuuaacaugaacaauagauuuauaagcuuuuuuuuuucuuuugauucugguggagaugauuuagccggacagaaauuuuucauuuucucacucugucuuugauaucaugccagaauggauuauccuuuuuuuuuuuuuuuuuugagacagagucuuguucugucgcccaggcuggagugcaguggcacaaucgcgguucacugaaaccucugccuccuggguucaagccauucuucugccucagccucccuaguagcugggacuaaaggcauuugccaccaugccuagcuaauuuuuguauuuuuaguaggaaugggguuucaccauguuggccaggcuggucucaaacuccugaccucagguuaucugccugccuuggcaucccaaagugcugggauuacaggugugagccacugcgcccggcccuauauauuuuuuuaaaaauggggucucucucacccagguuggaaugcaguggcaugaucacagcccacugcagccucagccuugccucccuggcucaaucaguccucccaccucagccucccgaguagcugaggcuacaggcacgcaccccuacuacacccggcuaauuuuuuauuuuuuguagagacagggucucaauauguugcccaggcuggagugcaguggcaugguaccucacuuaagccucaaccuccuggggucaagugauccucuugccuugcccuucugaguagcugggacuacagguauaugccacuacaccuagcuaauuuuuuuuauuauuagauuucuauagaaauuaugauuccauaaaagauuuugaggaaaugauggccgggggcgguggcuuaugcuuguaaucccagcacuuugggaggccgaggcagguggaucaccugaggucaggaguucgagaccagccugaccaacauggagaaagcccgucgcuacuaaaaauacaaaauuagccgggcgugguggcacaugccuguaaucccagcuacuagggaggcagaggcaggacagucacuugaaccugggaggcagagguuguggugagccaagaucgcaccauugcacuccagccugggcaacaagagugaaacuccgucucaaaaaaaaaacaaaacaaaacagauuuugaggaaaugaggaagacugguaucuuucagaauugaaagugauuuuggaauauauagaauuucuuuggggcugggcacgguaguucaugccuguaauuuuagcacuuugggaguccaaggcaaacagaucucuugagcccaguuguuugagaccagccugggcaacauggagaaaccccaugucuguuaaaaauacaaaaguuagccagguauggugauacauaccuguaguccuagcuacucaggaggcugagauaggcggauugcuuaagccuuggaggucaaggcugcagugagccaugaccaugccauucugcacuccagccugggcgccagagcaagacccuguuucaaaaagagagagagaauuucuuugaguugaauuauguagaaguuugucacugaccuauguuccuaaaguaugaagcauacauaugugggcuaagaaauaguuuuucuugauaaauaaucaacaaauaaaaaauaaaaagcccuccaucugagacuggauccaaauucuuggaacauuuccaaauuuugguuugguagaagucaguugcuauuucugugauaaagaccagaaguauucagaaucuuggcauuaaccaauauuggauauugccucuuagaaauucauuuuuauauuucauuaggaucuuucucaguuuuuccaauaauauaaucuucauauauuaaugacacaggaauugaaaaauaagacaacuuaccaauuuaaaaaaaaacuuuuccguaaaagacagucauuccuagcugggcacacaccuauaauuccagcacuuuugggaggcugaggcaggaggauugcuugacgccaggaguagaagaccaagguagacaacauagcaaaacccugucucuauuuaaaaaaauaaaaauaaaauaaaauaagcuuuuucauaaaguaauaggguuaaauguuuuagcaaugauuuucuuuucuuuuuuuugagacguaguuuugcucuuuuugcccaggcuggagugcagugaugcaaucucagcucacugcaaccuugccucccggguucaagcaauucuccuaccucacccucccaaguagcugggauuacaggcaccugccaccacgccgggcuaauuuuuuguauuuuugguagagaugggguuucaccauguugguuagcuggucuugaacuccagaucucaggugauccacucaccucggccucccaaagugguaggauuacaggcaugagccacugcgccuggacauuuuuuuuuuuccuugagacagagucucacucuuguugcccagacuggagugcaauggugugauguuggcucauugcaaccucugccucccggguucaagcgauucuccugccucagccuccugaguagcugggauuauaggcacccaccaccaugccuggcuaauuuuuaguauuuuuaguagagacggaguuucaccacguuggccaggcuggucuugaacuccugaccucaagugauccacccaccuuggccucccaaaguguuaggauuacaagcaugagccacugugccuggcuacuauuuucauuuauuuccuugcccaguacgcaaauuuaguuggcuucuuuuuccuuucuuuucuuuuuuuuuuuuuuuucucagacagugucucacuuugucgcccaggcuggagugcaguggugcgagcucggcucacugcaaccuccgccucccagguucaagugauuuuccugucucagccuccuaaguagcugggacuacaagcacgcgccaccacgccuggcuaacuuuuguauuuuuaguagagaugguguuucaccauguugcccaggcugguccugaccucaggugauccacccgccuuagccuccuaaaguguucuuuuuccuuucuauguguuauagccauuggaaaguuacauuaugucuuuucuuuaauucugaagccuuuaauuuuuaggacagacuugaggcucgaagguaugugauggaggauaauggaagaugaugccuagagauggggguuuaauguuguuuguucagcgaaucugcacaggaaugagcuuauugauucuugucucuuagugugggaaguucacuuucacccauccaacccagaacaucuuuuuaccugcucugaagauggaucccucuggcacugggaugcuuccacagauguaccugaaaagucgucacucuuucaccaagguaaaacuuuuuaaugaauacuguuauguguacuuuuuuuuuuuuuuuuuaagacagagucucacucuaucacccaggcuggaaugcaguggcacgaucucagcucacugcaaccuccgccuccuggguucaagcgauucucgugccucagccucccgaguagccaggacuacuagucaugcaccaccgugcccggcuaauuuuuuuguauuuuuaguggagaugggguuucaccauguuggccaggcuggucucgaacuccugaccucaaaugauccgccugccucagccucccaaagugcugagauuacaggagugagccaccacaccuggccuuuuuuuugagacagagucuuacucagucacccagaauggaguguaguggugcagucucagcucacugcaaccucugccucucagguucaagcuuuucuugugccuuagcuucccuaguagcugggauuacaggugugugccaccacaacuggcuaauuuuuuuguauuuuuaguagagaugggguuuugcuauguuggccaggcuggucucaaacuccuggccucaagugaucugaccaccucagccuccccaaagugcugggauuacaggcaugagccacugugcccagccuguuauguguaauuuuaucauacuuuuauuuuguuuuuuuuuuguuugagacagcgucucacucugacaugcaggcuggacugcaguggcaugaucacagcucgcuacauccucgcccuccugggcuuaagugguccuccugccccagccucccaaauagcuaagaccagagaugcuugcaaccacaaccagcuaauuuuuuuuuuuuaauuuuuuuguagagaugagcucucacuaugcugcccaggcugcucucaaacuccugagcucaagcaaucuuccugccugggccucccgagguauugcaauuauaagcaugagcuggcuguacccagccauuuuauacuuuuaaauaccaaauuagacauccucguauuuuuuacuuaauggcaaaacauuuuuauucucuugccucagaguaaauuugaguaucacagggcuugaaaucugacugucaaguuacuuacuacuguauggcugauggcuagaaaugcuguaagcuggcucacuugagacagccaagguucuccuuugugagugccauuaaccuggacccucaugccauagcauagacaguggcaaaucuuucauauugcauugccaaguuugugugaauggcaagaaaaaaguugauauuugauguaacugaggguacugguuaaauggccugaucucaggccgggugugguggcucaugccuguaaucccagcacuuugggaggccaaggcagguggaucaccugaguuugggaguucgagaccagccugaccaacauggagaaaccccgucucuacuaaaaauacaaaauuagccgggugugguggcucaugccuguaauccuagcuauucaggaggcugaggcaggagaauugcuuuuacccaggagacagagguuucagcgagccgagauugcaccauugcacuccagccuggauagcaaaagcgaaacuccgucucaaaaaaaaaaaaaaagggcgugcuuuccucauuacagucaguuguagguuauggucagccaaagaccaugcacuuguaaucgggguuuauguguuuuugcauuuuccaaguuuccuguuuuugaggguuugucuguggcuccaaaguucuuuugcuuauucauuuauucagaaauauuuacugaaugccuaccaugugguaggcauucuucuagguguuaggacguguaacagugagcagaacgaaaugucgaaacgcauagagcaaauauucuaauaguuaaaaaaauagauaauguaucaguaagaguccaauuagaaugucagaaacuaccuuagauguagaaggaauuggucucacauguguuagaagggcugggaaaacaaaagguaauaggaggggugcugggagaacaaauaggaagaaaagggaaaacccagaaauaguaauuguuaguaccccugcuacuugacuguugaaaaugcuguaaaaguuuguucugaauuaggagaaaaggcgcucccucaaccaggcugaaacuaccaccaguguuguugccagaaaccuggagcaggaaggagcugcuucucccuuccgccuuccagucacccaccauuaauaccugcuauuggcaaggcccaucuggauggcagauggcaaagcagccuggaaaguggaguuuaccaacuucuaccuccuacaguauauaguggagcacagcaaaguggaaaaggaggccgggcgcgguggcucacaccuguaaucccagcaauuugggaggccgaggugggcagaugaccugaggccaggaguucaagaccagccugguccaacauggugaaacccugugucuacuaaaaauacaaaaauuagcugaacgugguggugggugccuguaaucccagcuacucuggaggcugaggcaggagaauugcuugaacccgggaguuggagguugcagugagccaaggucacgccacugcacuccagccugggcaacagagcaagacuccaucucaaaaaaaaagaaaaaggaaaauaacauggccaaauacacugcuaauuaccaugaagaagaauacagcagaguaggaggauaaagaauaaagacaggggugaggggagcuacucuagugagagucagaagaggccacuuggcagaaggaacauuugagcagagacuuaagagaagugaaggcauaagugacaugaaagcauuccaggcagaggaaacagcaaaugcugagggccugagacaggcagagaacugcaaggacaccacgguuggagcucaggcagcaggguacaguggugggagauaaggacugguggcugaggagcccugggacuuuguagcccaugauaaggacuuuagacuuaugggagggggaggagaaaaguggaaaacagggagaugaggaaggagucuuaucacaguggcuugaauaauguguuaaucuuuacagcguccaagagcaauguaaaauguaggggcaguaaaagauaaacagaaaaacuaaggggaaaaaaauucuaaaacuucuucagaaaaauucuggagcggagagcauguguggagcaugcaugcauguccaugcuauaacuucaucuacagagaaacaaacaguuucaucuaaggauuaacuaaguauguacuucguuuuuacuuccuuccuccccuaaccgcacagucuugaacuugcaaguuuacuuuuaaggaaccuugguuagacuggaaauaaaacuuuauucugugucuacuauugcaaggcacaguauuagacacugugaaaaaguaaaacauauaaaauaugcauccugcucuuaagacauauuuagucauggacagaggcauggauaguucaauuaggauauaagaauuguuauaaaguaguaaauuaaugguacauacaagugcugaggguucaaggaaagagaaaaacaugaaguagagguugucuucaaaguuuucuuagagaaggaaguucagccauauuuuaaaggaucagcaagauuuuaaauguacuaaucuuuaagcuucaagacauagggacuuggcacagagcacuuagcacagagccuggcacauaguagguacucagucauuuguugagugaauuaaauuuguacuuauuugauaugacagcaaguugagaggaaaguaaguugcgaauaaugacuaaaauugaaauauacugccucugccucacuuuauucuauaguaaguacagugcgcuguuagagauaaaaccuuauaaucuaguaguguucuaaucugcuuguaagaacauuuaucuaaaaagcauaagaaugaaagauuugagguaaggcgauuauauuuuaagaaauauaguaacaaauauauauuuagaaauauauuucuagaaauguucaucuagaaauaugucuagaaauucuuucucaugaucauuuuauuuuguuauuacccaagaguuuauauuuccauguauuaccuacauuuuugguuucuuuuuuuucuuuccuuauucaacuuguaugcuggccguuuugcuaccuuucugagacuuuccauuaaaagaugaacagaaagucaguugaaaucaccugcuuuuccugaagacuucgaguuugguauccauauuaucccauggaaauuugaauauuuaauaucacugaauaagccuuugguccaaaguggugauguauaauaauggaauuauuagccuauuauucugagaauuaaacacauugauaucaucaccuuucuaaauaucaguagaaguuugaauguuuacuaauauaaaaaucaucuugaaagauuucuuccuuuucuuuuuuucucccaggaggaagaagcaguacuuuuuugucucauagcauuaguaaccaagcuaauguucaccagucugucauuagcuccuggcucagcacugauccugcaaaagaccgaauugaaaucacaagcuuacuucccaguaggucucugucugugaacacuuuggauguuuuagguccuugucuuguuuguggaaccgaugcagaagcaauuuauguuacuagacaucuuuuuucguagaaguacuauaauuauaagauuucagauagaacaugcaauuagccuuuugaaauccaacuucugugcaaaauuuuaguaucagaaaauacgagauuugcaggggaaacaucaguaaacuaccauuaaugucaaugcccaguuuugacuuuuguuagccugacacucccaaacaguuguagaauccgauagaugacugauggcaaaagauugugaacauguggaagaaaaucagugggauucuggugcugaugaauagguugccuucagaguauuauugacagacagcuuguggaacuaauucuuuauuuuugauguugugggaauuaacacaucaauggugguuaugggaacuaccaauggguuccuacaauuuuuaucaguaguauguggcauauacaccuuccuaguggcaguugccaauguuaaugauuauucuuuuuauugcaaguauuuccuaugauccuuccacacuuuauuuccuuaauaauaauaaacuuuuucagaaagaauugaguagagcaaaaaugacaaagauguguagcuguguucaauuuuuuuuuuuuuuuuuuuuugaggcagagucuugcucugcuggagugcgguggugcaaucucggcucacugcaaccuccaccucccagguucaagcaauucuccugccucagucuccugaguagcuggaacuacaggugugcgccaccacgcccagcuaauuuuuguaauuuuaguagagacagaguuucaccauguuggccaggauggucucgaucucuugaccucaugauccacccgccucgaccucccaaagugcugugauuacaggugugagccacugcacccggccugaaauuuuuuuaaggugaaaauguuuugacaaguuccuuuuucagaauagguuuuugagcagaacucuuucagcuuguuagacccaacuuugcuuuuguuuagcuucacagcauagcugaaaguugccaaacuggacauugugcaauaaaguagaauucuauauugauaagcaaacuauuuccaaacuaaaaaugugauagauaaaagugugauuaaucaaaugauaugaucagaguaaagaauuuugccauuuugauccuuuuacuuuguuuuagccaccuauaguguuaccaaccaucuuuauccuugucugcagggauaauaaugaacuaauguaguguuuuaagauaauuuaaugauacuaucuuuccaaacuuuguuagauuuuaaauguauuauugaccugagaccuuaaugacaaaucacugcuauuagacaauugaaguguucauuuacuuuguaauuccaauaaucauaguuauggaauuaugguaagguuuugcuuuucuguccuaauaaauauauauauuuuuugagauggaguuuugcucuuguugcugaggcuggagugaaauggcaugaucucagcucacugcaaccuccgucucuuagguucaagcaauucuccugccucagccucccgaguagcugggauuacaggugcucaccaccacacccagcuaauuuuuguauuuuuaguagagaugggguuucacuguguuggccaggcuggucuugaacugaccucaugauccaccugccucagccucccaaaaugcugggauuacaggcuugagccacugcucccggcugauuuuuguauuaguagagacgacaggguuucaccauguuggccagggcuggucucgaacuccugaccacagguaaucagcccgccucggccucccaaagugcugggauuacaggcgugagccacuuaguauuuguaaccauaagagaaaguauauuuuaacagcauuacauuucaugccaauugacaaguuuugccaauuuuaauaagaaacuaagcuuuauguaauguaacaccguaauuuaugaauuuguucauugucacugccuuuauucaugaaacugucaaauagagugucuuucaaggguugcaggaucuuagagauagaaaguaccuuggugaucaucuccagccuaaauuucaucaucccuucuaugguauucccaacaaauuaucauccaaccuauacuuaaaaacauaugguggccaggcaugguggcucacgccuguaaugcuagcacuuugggaggccgaggugggugaagcaccugaggucaagaguucgagaucagccuggccaacauggcgaaaccccgucuccacuaaaaaugcaaaaaaaaaauuaaccgggcgugguggcaggcaucuauaaucccagcuacuugggaggcugaggcaggagaauugcucaaacccgggaggcagagguugcagugacccaagaucgugccacuucacuccagccugggcaaaagagcaaaacgccaucucaaaaaauauacauauauaaggagauaaaguuucccauuuuccaauacaguuucacauuugaacagcccuaauugauacaacuuuauggcaggguuuuagugugugagugggauccaaaacacucaauccuguaaaaggguacaguccuauuguauguuaacacacugaugaugugagccugugagaugagccaaucaccaguuguuauguucgaaucugcuuuguguugggacgcuuuaaugucaggguuucacuaaauaaaugaauuuucauauacugaa

SEQ ID NO: 192119 - RNA, 24540 nt, Homo sapiens
aaacugauucuuaacgauuuaaagaaaauuauauucaaguggcaaauuuggaggcaacaggcuacuucggaguccaugauaugagauggcguuuuaaauacauguuuuaucuucaagguuuucagcucuuuucucuggaccaucuggauauaaguugauagcugucacagguaugacguccacuuuauccaacugaagaauuccucugaaauagaaagugauuaauuacuaucaaaauuaaauguuuccucugccuguaguuugauagugagaaaaggcuacuucaagguuauaauauacaccuaagguuaggugcuuuugcuacauucuauuuaaaaauucauagugguuguacaaacugagcccaaagucacuuuaaccaaacuggcugagagaauagaaaggcaucgaggaaguucauuauuuccuauuuuagggaagaauaggguaaguauagaucuccaaggcagaguuagguuccuagauacacccaggcugagcaaaaagccuaagccuaagccucucucuaaauaauacucaccaccacaacacaaccuuaggucuuuagauaguguugcucuuuuuguuacuuaaaaucccugaccagagaguacgucuuuggauugaaucuaggacccugcauuguaaauucaguguuauucuaauaagaacaucaacggggguuaguuguuuauagaaccaaacagauucuaaaguucacaggggaguaacugcaagaacagccauaagauuuuuuuuaaaagaacaauggggagaagacaaaguugucuuaaguagcucucaaagguuuuauuaaaacaugauaguaggccagguguaggggcucacaccuauaaucccagcacuuugggaggccaaggcgggcagaucacuugagcccaggaguucaagaucagccugggaaacauggcaaaaccccaucucuacuaaaaauagaaaaaauuagcugggcaugggacacaugcagucccagcuagcuagcuauucaggaggcugaggugggaggaucgcuugaacccgggaaguggagguugcagugagccgagaucgugccacugcacugccgccugggugacaaaguuagccccugucucaaaaacaaaaacaaaacaugagaguaauuaaaacugugcuacuggcacaggaauagacaaauagaucacuaggacagaaaacaguccagaaaaagacuaacauauauggaaauuuaguuuauaauaagguaacauucuaagucaaugauaaauuacuaauggaaaaauggccucugucugggaaacaaaaugagaacucuagcuuuaaaaguauacagaaaaguaaugcuaaaaaauaaauuuuggcugggugcaguggcucaugccuguaaucccagcacuuugggaggcugagguggguggaucaccugaggucaggaguucgaggccagccuggccaacauggugaaacccugucucuacuaaaaauacauaaauuagccggcugugguggugcacgccuguaaucccagcuacucgggaggcugaggcaggagaaucucuugaccccgggaaguugagguugcagugagcagagauugugccacugcacucuagccugggcaacaaagcgagacucugucucaaauauauaaauaaauaaauaaauaaauuuuaagaaaauauaauggcugggcacaguggcucaugcccuuaguaaucccagcaccuuuggaggcugaagcaggaggacugcuugggcccaaggaguccagccugggcaacauagugagacccugucucuacacaaaauaaauuuuuuuuaaaaaaauggcugggcacgguggcucacgccugcaaucccagcacuuugggaggccgagacgggugggucacuugaggucaggaguucgagaccauccuggccaacauggugaaacccaucucuacuaaaaauacaaaaauuggccaggcaugguggcgggcgccuguaaucucaagcuauucaggaggcugaggcaugagaauugcuugaaaccaggagguggagguugcagcaagccaagaucacaccacugcacuccagccagggcaacagagcaagacugugucucaacaacaacaacaacaacaacaacaaauuagccaggcaggguggcaagugccuguagucccagcuacuugggaggcugaggcaggaggaucgcuugaacccaggagggucaaggcugcagugggccuugauagcacugccacuguacuccagccugggcaacagaacaaaacccugucuuuaaaaaacaaaaaacaaacaaaaaaagccccauaauuuuaagauaggaaagucuggccuacuuaguaggcaaaauaaaaacccuacaugcuguaaaggaauaacaugaauuacuuaggccuugaauuuaaagcuuuuguaugaugagauaccauaaauaagcaaaagacaaacgauaggcugggauuaguaaaaaaaucugcaaugugcauuacauauguauaacagacaaaagagcucuuauauacuaauaguuacaaaaugccaacacaauugaaaaauggccagaggcucuacguaagcaagucaugagagaaucauauauagccaauuaucacaaagauguugaacccacccagaccuaaacuagcaaagaugcuaguaagaugaaaaugcaaauuaagaugaauuauauuuuuaguagcaaaaccaaaaaagauuaucaucagguuguaaggaguuaauacaauuacuugugacacaguaauuuuacuuuuaggaaucuauucuacauaaauacacaugugcaaagaaauauaugugcaaggauguauacuagaacauuauugggauuaacaugaaauuggaaauuaccuaaauguuagaggaaugguuauauuaagguauaucuauacuguggaacaccugugauauuaugacuuguaaguuccucuggcuuccuggaacagcuccuaaaauccuuaaaucuccaaagugguaaguaucuuuuggaugcuaaugaugacugauggcugggggauccuggauagccucaacaggggagcugguugccagggguaucaaccaugagaucagucccaucccccaaccuuggggaagggaacgggguacugaagguugaguugaucaccagugaccaaugauguaaucaaucaugccugugugaugaaaccugcaaaagaacccaaaaggacuagcuuuggagagcuucuggauagcugaacacacagagguaugggaccuggauagaggugcaccuagggagggcagggaagcucugaaccccucucccccuccccaugucuugcccuaugcacuucuuccaucugccucuucauguuuccuuuguaauaaaccaguaaguggagguguuucccugagaucugugagccgccccaaagacgucccaagcaaauuaaucaaacccaaagaggaagucauggcaaccucuuuauacccagcuggucagaaucacacaucacaaccuggggcuuacaacuggcaucugaaggggggcagucuuguggaacuaagcccuuagccugugggaucugacgcuguguccagguggaaagugucagaacugaacugaauuagaggacacccagcugguguccacuggagaauuaguuauugguggugaaaaauccccacacacguauuggugcccaaacgugaaguacuccagagugucagaguaggaaaaaccaaaguauuuuuccuaugcuuugguuuuuccuaucuccuuuagaacuaugcagccauaaaaagaauagguaagcuauacauaauuaugacaugucaguuaaaaauaauauuaagggcugggcaugguggcugaugccuguaaucccagaacuuugggaagccaagguggaaggacugcuugaccccaggaguuugagaccagccugggccaaccuggccucuacaaaaaauaaauuaaaaaaauuagcugggcauggugacacacaccuuaguccuagcuacucaggaggcugaggugagaggaucacuugagucuugggagauugaggugagaggaucacuugagucuugggagauugaggcugcagugagccaugacugagccacugcauuccagccugggugucaaggugagaccuugucucaaaaauaaguaauaaaaaauaaaauagaauuaaaauaacuaaggggacaaaaaagaauauauguagugauaagaaaagaucuuaggucuaugguucccaaacugcacugaggucccuggguuggugagcaaacucacagaggcaccacagaauaauauaaauuuucaagagacuucauguguaauauuaccuugagguuacuucaugcuuuuaacauuagauugcaaaacauucaaugaagucaaucuuuccaaagcuggguuuugguggugcuagauuuggaaaguuuuuccccuccaaaccucauguuaaaauuuaauccccuauguuggagguguggccuaauaggaaguguuugggccaugaggacagauccuucaugaacagauuaaugcccucucuggaggggaagggaaugaguucucauuauucauucccuggagaccugguuguuaaaaagagccugacaccccccugcuguuccucuugcuucuuuucuugauaugugaucucugcacaugcuuugccuugcgaagcugcugaguggaagcagccugaggaccucaccagaagcccagcugauggcagcaccaugcuucuuguacagccuacacgguucuugcagaaccaugagcuaaauaaauaaccucuuuucuuuauaaaguaaccagcccagguauuacuuuauaagcaacacaaaauggcuuaacacaggugguuacuaugauaaaaagcaaauacuguacaaaacuaacacugaacaagaaaugaggaugccaauuuccagucugaugccaagauaugagguauuguguagugcucuauaggcacucacaucccauuaguauuucuuaaauuaguaauuuaagaacaaaauugcugggcgcgguggcucaccccuguaaucccagcacuuugggaggccaaggcagggggcucacgaggucaggggaucaagaccauccuggcuaacacagugaaaccucgucucuacuaaacauacaaaaaauuagcugggcgugguggugggugccuguagucccagcuacucgggaggcugaggcaggagaauggcaugaacccgggagguggagcuugcagcgagccgagauugugccacugcacuucagccugggcgacagagugagacucugucucaaaauaaauaaauaaauaaaaaauaaaaauaaaaaucuuuauauuugucuuuuggccuaaguauaggggcauuaaaaaaauuuacuggcacacuaaggauacuguaaaccaagaaaguuugggaaaccugugucuuaagugaaaaaugcaauguagaacaauuaacaaucugaguugauaaacaauuaugauuaucuaguguacauuuacauuaauacauagaauuuggauuaaaaaugucaacucaguugacaaugacuaccucuagguagaauaagaauugaagaacagagaagggauacuuucaguucauugcucucuauaguucuguauuaaauccuuuucuaccaggaaguaucugcaguacaacugcaaauuugguuuuuaauuuuauauugcaucuguuccugcagagaaacccauaacaaaacaauggcaaaagaaaaagaaaaacauuacaacaccguuuucuaugcagguauacauaauaaaguucaaaaaaguuuggaacuuccuggcagccaaaggggaaagaaaucuguuaaacuacagaauuuuuauuacaggucaagcaucccuaauccaaaauccaaaaugcuccaaaauccaaaacuuuuugagugccaacaugauacuuaaagaaaaugcuuggccaggcacagugguucacaccuguaauccuagcacuuugggaggccaaggcaggaggacaacuugaggccaagaguucaagaccaaccuagccaacauagcaagauccccgugucucucucucucucucucuauauauauauacauuuauaaauauuuauauaaaauauauacaaguauuauauauauauuuccauauaugcaaaggaaaugcucccaagagcauuuuggauuuuggauugaggaugcucaaccaguaaguauaaugcaaauguucaaaauuccaaaaaaaucugaaaucugaaacacuuuugguucuaagcauuuuggauaaggauauuucuauaucagaaaggaaugggaaugccaauucaguggaaauguaaacuaagaggugggaggggcaacuaauauuucuuuacucugcaggugcuuugcuugcuucaugacuuugacuuucaacaauccuucaagggaggcauuaguucaucauuacaccugaagaagucggagguucaaagaccucacaacaagcaaguggaaaaguaaauguucaaauuaggucuucuuuuccaaaaauccuguuacauaacaguauaaugcaauguagcuaagccaagaacuguggucaucugcauugagauuuguuucuguuaagauaauuaaaaugacuaaugggccaggugcaguggcucacgccuguaaucccagcauuuugggaggccgagacgugauccaccugauccaccugaggucaggaguucgagaccagcugggccaacguggaaaaaccccaucucuacuaaaaauacaaaaauuaaccaagcaagguggcgcaugccuguaaucccagcuacucgggaggcugaggcaggagaaucgcuugaacccaggaggcggagguugcagugagccaagaucaugccacugcacuccagccugggugauggagugacauuccaucucaauaaauaaauaaaauaaaauaaaauaaaacgacugauuuaacuugaaaaaauacuaacaauaauucauuuuaaauuuuauaauuuuugacuaaaaaauauacaaaaggaagucaaagucagucucuccaccucugcucucauucccacucauuagagauaacuuguuuucucauuccagaaauuuucuaugcauuuauauacacauaauacuuuuguuuuaccuaaaugugaucauacugcuuugccauauuuccccccacauaauagauuuuggacuuauucagccagagaaaaucucauuagaccucacugauauacaguuaagagggcuuuuauuuugcuuuuacuuuuuuuuuuuuuuuucgagagggaguuuugcucguuucccaggcuggagugcaauggcgcgaucucggcucaccacaaccuccgccuuccggguucaagcgauucuccugccucagccucccaagaagcugggacuacagaugggugccacacgcccagcuaguuuuuauuuuuauuuuuugagaugaagucucacucugucgcccagacuggagugcaguggugcaaucucggcucacugcaaccucugccucccagguucaagugauucuccugccucagccuccugaguaacugggacuacaggcgccugccaccacggcuggcuaauuuuuguauuuuuaguagagacaggguuucaucauauuggccaggcuggucucaaauuccugaccuugugaucugcccgccucggccucccaaagugccaggauuacaggcaugagccaccagguccaggcuaauuuuuuuuuauuuuuaguagagaugggguuuuaccauguuggccaggauggucucgaucucuugaccucaugauccaccugccuuggacucccaaagugcugggauuacagccaugagccaccgugcccagccuauuuugcuuuuauuuucuauuacaaacaaugcugcaaugaauauccugcuugucuacugaaauuaacauuuuaaacugauacucugggguugaaaauacaucaugaaguccucggguuuuguucaccucugaucauacaguugcauuuuccauuacauguauuuguuuccuuccucugcuacuagauuuuaaguucuuagcagaguuugucuuacuuacaucugaaucucuccaagaaugucuugaucacaauagcuauucaauaaauguguuucaauuuugcuaacauuggaagaugagcuagaaaaacaguagguguuauuuucccucccauuugucuuacccuuucuaauuuuuauauuuucuauucuaaaacauagcaaauaugucucacuuuuuaaucauuaaaaauacuaacauuucaaaaauaagaaauacuuacuuguauucagaaacugggaaaaacaccuuuaagaugguuauuaccacagcugcuccuguaauuccaaccaccaugauguucaaaaacugaaagaauacugggaaaacguugcuccagaaccuacacagaucuuuucuaaacuuuuccauccacugacacauuaccugaaaaaggaauuucgauuagauaugcaaguugcaucaaucucuaagaauaaacuuuaaauuuuuuaauguuuuagcuuugggaugauaaaaauauucuauauuuugauugugcugguaguuacaugggugacuacauuugucaaaacuaauuguauauuuuaaauggugauuuuauuuuagaauguaccucaaugaaguuacuuacaacuuuaaaaauuauguucuaacaauacaagcacaaaaauguuaauagccuguaaaauuauuuauauuguuuucuaacuacaaaucaagugaaaauaauugcuaauugacaagagauucguuaggcuaguccauuauaaacgaaauggagcagagucaacuguuuccaguaccuagagcacaagagaaggaagagaaagacaaacauauuagaaaauuuuagaauacaugggaaguucacuguguacaaaacauguuucuauacuuuaagagcgagagcagaacuuaaggucggcacugauggcacggacuaugaagacagucugcucuggggcugagcugcuaagggaggugagguagacaggguaaaggugcuacaguccagacugcugaagugaccucaaauaugcaagccugaccuucagugagaacuacuacuccuuuaauaccaaccauagacccugcucauuuaaaaugaauuuuggguaggagucuacuuaauauacagagagauaucgggauacucucugaacccaugaauauauuccugguaagcaguauaaaugucacagguaacaucugagaaauuaguaggugccaaugcauauuuauauguaguacccaacuuauuuaauccuuguaacaacuucaugagauacuacuuuacacugcuauucagauuaagugggugccccauuguacagauaaagaaacugaggguagagagauuaagugccccaaagugggaguacggggaaauaaagaguaauuaucggccggggaugguggcucaugccuauaaucccaacacuuugggaggccaagaugggcggaucacuugaagucaggaguuugagaccagccuggccaacauggugaaacuccaucucuacuaaaaauacaaaaauuagcugggcgugguagcgugugccuguaaucccagcuacucaggaggcugaggugggagaaucacuugaacccaggagguggaggaguaagccgagaucacaccacugcacuccagccuaagugacagagugagacuccaucucaaagaaaaagaaaaaauuuguucaagaucacacaacuagucagcggcagaaccagguuucaagccugggcaggcugacucuaggaaguauauucucaaccaccugagcugaaucacugggcaagauccugggggcacaaugcauauguguguaugcgagguagcggguacagaauaaacacagaaaucuggauaugagaaauaacuguggaauuuauaauuccaaccaaaugaaauccagcaccuugauaaucaugaucugacuacaauauuauuaaacaaagcucgaagaggaaaauaggaauacuaaaaauaucacauuaagaccaagaugaguccauuaucaccaaugcucuacaguuccauucuucaggauuuccacuccauuuuaaaugcuagggucgauuuucuucaucuuaaccaugaaugcuuaugauaacaccaaauacuugauuuaccuuauaugaagauggcggcucugcucugagaggaguuucagguaacuugccagguaaaacaucuucaucuacagugguuuccacauuccugauaagauacuggcuagugguuugcagugaacuaacacuuucuacccaggagaaagagcaacguuaccaaaaugcuggugucuuauccuacuaguccuaagauuacgauaccaauagcauuuaggauaguaagaacacauauuuuaccaugggagaaaaaauuaacacaucugaauguucacugauuuaaaugucagaagagaacuauaaacuaagacacguauaaggagcuaaagcaguuaugauucugucacauagaaagccaaaauuuuagaaguucuauguuucugugaaaaaaugaauaguucuuccucugaaugaaccuuuacaauagucuuauuacauauuuugugaucaguacccagaguaagaguaauuacugaaaaaugucacuaugcaaccagcacugaucacauucuacuaaugcuccaaauagaguccuaaaguccuuaaauggacauaugaagcaauacauguuaugaagcauuuuuuuaaacaagcucauuuccaaacauauuaacuauuaaagauaaauagcaacuuuugcaaauaguguaaaaaauaacaaaguucaagaguauauaaagcuaccaacuaaauaaauaaucuccuuaauacuuuaaauaauggucuuuuaaguuaccuuuuuuggagagguuaggaaggguaaauaaaaugucacugucucgagaaauagaguagagcaugcuuucuuccaaagggaggguauaguuugaaugucugaguacuccccgguucuuaacuaaaauaucaauuucagugacauccuuuugcugaaccugugaaagaaaauauaauuauucuuuauuuuaaauaguagcacagccccauaaaaauuuaaaagcaaauuuuccucccagauuuauauaacuaaaacauguguccuauucagacaauuacucuuuuuuuuuuuuuuugagauggaguuucgcucuuguuguugcccaggcuggagugcaauggugcgaucucagcuugccgcaaccuccgccuucuggguucaagcgauucuccugccucagccucccgaguagcuaggauuacaggcaugcgccaccaugcccagcuaacuuuguauuuuuaguagagacaaggaguuucuccauguuggucaggcuggucuagaacuccugaccucaggugauucguccaccuuggccucccaaagugcugggauuacaggugugagccaccaugcccagcuaacaauuacuauuuauuuccccguacucccacuuuggggcacuuaacuugcaacuuuaauaauauuccuguccugcuuuaacacuuacuauuauaagcuuaaucucgauucuacuucauuuacacacagagacuucauuuaccauagaggaaaugguagcagaacuaugagccaaauugaaucucuuugcuuacuuucuauuuaauaaugucuguacauuuuaaagugauacaaacauguaugaauaugggaaauuuuaaaaauacauuucaaaugcuaaaauaaauauacaaaaauucuaaauaauuggauauaggcaacauuaggcaccuuccuuaucaagucggaaacaaauaaaauaacugaacacaugcauaauaucuagcacaaaucuaaauaucauuuaauucccaauuaauaaacauacuaucuuacuuguuuuccaucaaucucuacuaccucuucuugaaugacaauuaguugcaaacuggaaccagaugucauaggccacucaugaacuaaaauccuuacacugacaauuccaaaauauucuuuuuccuccaaauuuucaagauuuucauucuucacuauaaaaaaaaaaguagugacaccuuugaacaaagauuaccaccaaaucugugagugagugugauuauuuugaugacauuuacauggaacaagacaguugaaaacccauuucuuuggcuuucuucaucccugaccucaaugcuguuucagauuuauuaaaaacaaagacaaucugacaaaucuuuaugacugcuuacacucauuugaaaggguaaaauguguugaucuuuagacuuuguaugaaauaccacacuagcaacaucuuuccuauucuuuuuuuuuuuuuuuuuuuuuugagauggagucuugcucugucgcccaggcuggagugcaguggugccaccuuggcucacugcaaccuuugccuccuggguucaagggauucuccugccucagccucccaaguagcuggguuuacaggcuugcaccaccaugcucagcuguuuuuuuguauuuuuagcagagauaggguuucaccauauuggccgggcuggucuugcuaacuccugaccucaagugauucacccaccuuggcugcccaaagugcugggauuacaggcgugaacgaccacgccuggcccaucuuuccuauucuuuuauacagguuggccaugaggaaccaacauggcacaacuauaaagccagccagaagauacagccaaucccacguuuuaacauaauaagcacauacauucauccauccacaaaauccugugagagaagaugcccaagcaguaagaacauugaguuuuuuaaucaauccuuuccccgauuagugacucauuacuauuagagagagcaggaauggggaaagagggugggggaggccugucauuucucucugguaaucgauaaugggguaggacuagcuauuguccacguucuucucuagcuaggaaaccucuacuccugcuccaguagaaacgggguguaguagcugcagcugguuuacagagccaacggcuacucuauuaagguagaagugcuaucgaaaaagauaaaacaacauacaccaaugcaccugucacagauggagcauuuuauuucuaucccucaaauaaucugaagauuuuugccaaacaggaauccagauauacaaucugaaugcacacccagcuguuuagucugauucugugcaucuauagggcuacuuccuuugucuggaauaucucaauaucuaguucauuaacuacuuacuauuacaagauauaccuaccuauucuccccugcuuuaguccccgccgccaaaccauucagacaacaugccaagcucgucucacugugacgugguuuucaguccacagccuccugcucacacaccuuuaguggcacuucugugaaguucccgguccucucacugguccuccucaggcuccucaucuggccccucgcugcuccucucucuagugugccuaauccuucaugcccuuugaaaagcaccacugucaaagguacccccucucucaugguccauccccguguuuuaacugaccauuaccacccgugggucuccuucguggaacagcaggcgcugugucagcauguccguaagcccaaagacuaagguacaggagacucaaugggugagaaaaugcagucauaaaaauacacccaaguggcaauucuucagccugcaaauuugguaccugauauaguuuggauguuccccgcaaaucucauguugagauguaauucccaauguuggaggcggggccuggugggagauguuugggccaugggggcagaucccucauggcuugggguuacggcaccccacugccacucuugcucucucuugcuccugcucugccaugugagauacuggcucccccuuugccuuccaccaugaguaaaagcuuccugacgccuccuuagaagcugagcagaugcuggugccaugcuuccuguacagccugcagaaccaugagccaauuaaaccucuuuucuuuauaaauuacccagucucagguauuucuuuauagcaaugugagaagagccucauacaguaccucuaauacagcauaaaauuaaauaaaaaacaacaaagcccuucauauugacuuccuuacugugguaggcggcuuucaaaaaugccccucaaugacccuugccucuaaggagucagacauuucugcaauuccucccucaagugggcuggaccuagugacuagucaguuaguuaccuaucuaucuaucgaucuaugaaugauuuuuuuuucuuuuuuuguucuuuugaaagagacagccuugcuaucuugccuaggcuggucuugaacuccuggccucaagugauccuccagccuuagccucccaaauagcugggauuacaggcaugagccaaugcacacagccuagugacucguuucuaacaaacagagcauagcccaagugauggaauguuacugccacaauuagauuauuaauggcuaugacuucugucuugcuaguacucuuuuucuuacuggcagucucucuuguccucucgaugaagcuaguugccauguugugagaugcucuauggggagcuucgugugacaaggaacugaggaagaccuucaaccaacaucuggugaggaacugaggccucaguucaagagcucagaaggaacugacuccugccaacaaccacaugagugagcugggaagcagauuuuucccagcugagcccugacgugauggcagccuuuugagaaccacaggacccugcuaagccaagcucagauucucgaccuacagaaacuaugaaauaauaaauauugucuuaggccacugauuucuggguuaaacuguuaugcagcaauaaacaaauacaccaacuaaagaaaaaguuucuuuaaagaauuaaagaagauuuguuguuguugcugcauuuaauguuuugaagauucuugcuguaacuggauaagaugagcauuuauuucaguuaucauagaaacaaacucagugcaaugacugggaugacuaaaagauggccauaagagaggagacaggcuguauuccacguccaauucccagugaauacaacaacaaaagaauuauuauuucaguaguacuagcacuuccuuucuuagcuaccauggaucagcuugcagcacaccaacccucuugcaaugaaccacuugcaaagaacugcuagaaaagauguaaaaaauacacacccacacauacacacaaaaccuacaucuguguagaggcaucagaagcuaaagacagccagcacuugaagggccaagaaaagagcucccugaggugaguacaauauccuaugugauuucuucccgcaaaggcauuugccaacucccagacagaacagguggagagguugaaaagcugaguagaaagcaacgacuaggaggcaaaaaagcucgacaaagugucuggcagucucacccagcaggggagaaaaugaaguguuuaaauguuaaaacaaaaaugcuaagcuaugcuuccacagccagcaaaaauagccuucuaaaaugaaggcaaagagauguuuucagacaaauaaaaccucagaccauucacugcuaacaaaccuguacugaaagaaauaccaaagggaauucuuuaggccgaaggaaaaugacaaccagggcacaaugcaugugugugagggcaaggcaggaguugcagaauguacagagaaauagggauagaagaaagaauuuuggaacuugaaauuccaaccaaaugauauagaguggagcacagauaggaaggaauaaagagcaaugaaaaagguaacuaugaugguaaacacacaugaauauuggacuacauaaaacaauaauuaugucacaugggguuuaagaacacaaagaguuaaaauauauaauaauaacccaaaggcaaaaagggaauaaauggaauuuaaguguucuaagguucuugcauuguuugggaagugauaaaaguacaaauuuauuuauuuuuauuuuuuaaauucauuuuuugagacagggucucacucugucacccaggauggacuacagugguacaaucacagcuuacugcagccucuaucuccugagcucaagggauccuuucaccucagccuccuaaguagcugggaaaacaagccugcaccaccacacugggcucauagguuucccuauguugcccaggcuggucucgaacucccagacugaagugauccuccagcuuuggccucccaaagggcugggaauacaggcaugagcaaccaugcccagccaaaaguacuaaucuauugauagcaaggguaaccacuaaaagaauaguaaaauuacguaaaaccaagacagaagggaacuaugauaccaaaaauaacuaaccuagaagaaggcaaagggggaagaaaaagaaacacagaacaguugggacaaagaggaaacaagaaggaggauuuaaauccaaauguaucaguaauuuuauuaauguaaauaaguuaaaaucccaacuaaaagacagacugacagaaacaacaagugggccgggcacgguggcucacgccuguaaucccagcacuuugggaggccgaggcaggcggaucaccugaggucaggaguucgagaccggccuugaccaauauggugaaaccccaucucuacuaaaaauacaaaaauuagccgggcaugguggcgggcaccuguaauccaagcuacucgggaggcugaggcaggagaaucacuugaacccaggaggaggagguugcagggagccgagaucgcgccacugcauuccagccuggacaacaagagcaaaaacuccaucucaaaaaaaaaaaaaaaaaaauccuauguauauucuuuguauuugcuauuucauccaaauaauauggcauauuccaaugcaacauaccugcuuaccuuuaaacaacucaaaauuuuuaaagguuaaaaagaaaauguucuacugacauaaggguagaagaaacugaauacuagauaaucagacaauucauuuucuuggcucuugcuaucccauuuacuaccuuuaugcacauuuuuuuuuuuuugagccagggucuuacucuguugcccaggcuggaguacaguggcgauccucccaccucucaggaguagcugggacuacaggcacacaucaccacacccagcuaauuuauuuuuguauuuuuugcagagacaagguuuuaccauguugcccgggcuggucucgaacucagggcucaggcaguucacccgccucagccucccaaagugcuagagccgccaugccccgccucuaugcacauucuuacaucguuaucuacuuaccagaaauacaguuucaucaauacugaucuuauggaaaauagugaauaugcgagaagcagccaauauaaaacaagaacagaguuuuaaacacauuaguguuauuguacauucugauaaugaucuguguguguguuuuagagauggggucuuguucugucacccaugcuggagugcaguggcaugauuauagcucacugcagccucaaacuccugggaucuugcuucagugauguauauuuuuacuuuauuuuuauuuuuuuugugacggagccuugcucuguugcucaggcuagagugcaguggcgugaucucagcucacagcagccuccgccuccuggguucaaacgauucuccugccucagccuccugaguagcugggauuacaggcgcacacaccacauuuucaguagagaugggguuucaccguguuggccaguuuggucucaaacuccugaccucucgugaucugcccaccucggccucccaaaguguugggauuacaggcgugagccacugcacccagccuauuuuuacuuuaaaauggaaauauauaacauccaaaaauuguuuugcuaauuuaguauuauuaaaaacagaacaggccaggcacaggggcucacaucuguaaucccagcacuuugagaggcagaggaggguagaugguuugaggcuaggaguucaaucaagaccagccuggccaacauggcgaaacccugucucuacuaaaauuacaaaaguuagccggguaugguggcacaugccugcagucccagcuacuuuggaggcugaggaaugagaaucauuugaaccuaggagguagagguugcagugagcugagaucgcaccauugcacuccagccugggugacagagcaagacugucucaaaaaacaaacaacaacaacaacaacaacaaacacacaaaaaacagagcaauuauggaaauaauuuaguaauacucaccuaucaaagucugacagcuuauucggguuacaccacuauuuacagguaagucauuuacauacaccuguccacucucauagguuauguuaagaacaaccuuaaaauaaagcagcauauacauuaauuccaauauuuauaaacaauagcaaacucuucaagucaaaaaagauuaacuaaaugagacgugcaaguuaaaaaaucaaauaagcugcauagcacuuagcuaaauuauauauuaaaaccagaaaaggagacaaaccugcuguuuagauauguccccaucaucuuucaguguaguuacauuaauucugaugccguccuguaaaacaaguauuguguaaauuggaaggugugcaucucacagauugagaacaacguggcuuucucuuuucccuccaauuguaucuauuguacaaucacuuauaacagcauuaagagaguuuaaaagaucaucuuuuccauuuuauagccauuuuuccacccuuauuuacaauuccaauuauuuauuuauuuauuuauuuauuuuuugagagucucacuuugucgccaggcuggagugcaguaccgcaaucugggcucacugcaaucuccaucuccuggguucaagcaauucuccugccucagccucccgaguagcugggauuacaggcaugcaccaccacacccagcuaauguuuguauuuuuaguagagaugggguuucaccauguuggccaggauggucuugaacuccugaucucgugauccgcccuccucggccucccaaagugcuggaauuacaggcgugagucaccgcgcccggucuaauuuuuuauaauauauacuuuuucuauuuacuugugaaaaguaucacaugaguauauaauaugcaaauauagaguuuaaaagaugagcacuccuguaaguaccaccgaggauaaaauauaaaauauuaccccuaccuuggcaggcucugcaugauugcccucuauccccccagaaggaauccuauacccaauuccauuugaaucauuucuugcuuuucuuuauaguuuuacuaccugugucucucucucuaaacaauauguugcuuaguuuuaucuguuucugagcuuuauguaagugggauaacaguacacauguauucuuccguaacuguaguugauacuguugaugcacauagcuguaaucacaguaguccaucucugacuaccaauuuacuuauuuauucuauuacccacggacaucugaguuguuuccaacuuuuuuccuuuuauaaauaaaguugcaaugacuuuuuuuuuuuuuuuuuugagagggagucucgcucuguugcccaggcuagagugcaguggcgaucuuggcucacugcaaucuccgccucccggguucaagugauucuccugccucagccuucugaguagcugggauuacaggcaugcaucaccacaccuggcuaauuuuuguauuuuuaguagagacggggguuucaccacguuggucaggcugguugcgaacucccgaccucgugauccacccaccucggccucccaaagugcugggauuacaggcgugagccaccgcaccugaccaaaguugcacugacccuuucuugaguguguuucuuauacaagcaucuguaaugcuccaauuuuauugccucucaagguauuaucaaaagcaggauacccaaauauugaagaugacaugcuuuauauacagaagcaagcacuauuuuaagaaguauuuaccacugaccacaggaacuacaaucuaucauuucuaaaucaaauucuuuccuaaguuuauucacaaauagacauuguuauucuggaauaaaaacaauacucucaaauacuuuuucuuugagguuguauuaacuuagaaaauaggaaaacuguucauaaacaucaaaaagaauauacaaguauaucugcuggcccugaguauccuaaauacuuuauauauaauuucccacaaaugagagaauaagacugaugaaauuucaugaggucgagcugauuccaggaauaauuugugaaagaggauucauaccacacaagaccaacaucauacauuuagggugacuuugguucacuucccaacuaggagccuaggaagcuuucuaacuagaaauuccucagaacuagccagcuuuuuccuggcucaccuugaucuagacgguuagaaccaauagugcaucuaaaacaaauccacauucaaugagcuaugagauugauagcuacauuguuuuguguccaaauucaagucauauggaucuccuuugcaaacuagagaauguauuaauuauaaacuauuauucuucuaacagcccagaaguaagccuccaauguuguucuaggaaaccauuuuauagcuucugccuuuuagcagugaacacuauauuguuagcaaguuacugaacuuuauauauauauauauauauauauauauauauauauauauauauauauauauauauauauauaaaaccuaccuaguaaaauuacagaguuugaaaaagacaauuaacagacacaagcacacuauauuuuccagagaaccaaguacaacaaaauuauuuucuggucuuucugaaugauuucacugcaaaagggaaucacacuccuuacugcccccuggccaggaguucagagccaggucauauuuauuguucuugagaacuucugauugaacuggaaguucaggcucguaagccaggguugcauauacuuaaaaagugcuuggggacacugaaaaguuucucccuaaaaaucuucaauucuucuaauuccuuuacucauaggaugcccacuggggacauaagugucuuccuaagaauaaagguaauagacagcugguuuaaaauacgucugagcgaaauauacaguuaugcauacaagaaaguaaguguccuccgaaugccucucuuuggugaccaaguuauuuuaguauuagaagaauuuacuauaaagacuuuuauuuuucggucgggcaugguggcucaugccuguaauccuagcacuuugggaggcugaggcggguggaucaccugaggucaggaguuugagaccagcuagccaacauggugaaaccccgucucuacuaaaaauacaaaaauuagccaggcaugguggcacgugccuguaaucccagcuaucugggaggcugaggcaggagaaucgcuggaacccgggaggcagaggcugcagugagccgagauugcaccacugcacugugcaggaugggggacagagcgagacuucacgucaaaaaaaaaaaaaaaaagugaccgggcgcaguggcucacaccuguaaucccagcacuuuggaaggcugaggcggguggaucacuugaggucaggaguucgagaccaaccuagccaacauggugaaaccccaucucuacuaaaaauauaaaaaaauuagcugggcgcaguggcgggagccuguaaucccagcuacuugggaagcugaggcaggagaaucacuugaaccugaacccaggaggcagaaguugcagugagccgagaucaugccagugcacuccagccugggagacagagugagacucucucucaaaaauaaaaaacaaaaaauaaaaaaauaaaaauaaaaauacaaaaacuagccaggugugguggcacgcgccaguaguaccagcuacucaggaggcugagauaggagaaucacuugaaccugggaggcagaggcugcagugagccgagaucaugccacugcacuccagccugugugagacagagcgagauauuccgucucaaaaaaaaaaagacuuuuauuuuucaaucuuaugugcaaucuuguauuaccucaacuucugacaacugcauacauaaaaacagaaaaaugcuuauaguccaauaaaucugagucaucggaagaaggcagaauuuuccugacuucaaccaguuuaauuuauaucagacuggaaacgaggauggacagaugugauaaagcuaguaauguuaaggguagucugguucugcacuguucaauaugguacacacuaaucacuugugacuauuuacauuuacauugauuaaaauuaaauaaaaauuuaaaaacaguuccucacuggcacuggccacauuucaagugcucaguggccacagcagucuaguggcuacccacaaggugagaaaagacauaaccaucaaggcagaaaguucuacuggacagcacuuacacaauaugugggaccacugugaaauucuuuccuauuggaaauguuucacaauaagacguugagaagacuuagaucaagggacuucaguuucccacagacacaguccagguaaugagauucucuuucuaguuguucagcacucauuuaaucugugaaacuuuuuguuguugagacaggcucuugcuauguuaaccaggcuuaucauccaacacccaacucuuggucucaggcaauccucuggcuuuggauucccaguagcugggauuacaggcgugagccacugcacccagcguaauaugugaauuuccgaguuuagaucuggacuuucugaaagugaaaugaaggcccaagaagggagaacugaaauaguaaaaucaucacuaagagccagccgacaaugcaguguauuuuaagccugcagucaaaauguauuuuucgcagauuauauagacguaaacaucucauugacacauaggugucaauuaugaaucuuuaaaacuugaaaaauaggaaaauaauguccguauuuccagaacuuuuuagaacuauuucacuuuuauuuggucccuuggugccuguccaucacauuccuauuguuuaaccagaugcaacugugguccacauauaauuucagauauaggugguucuuauggcaggcaaugucguggcuucuuggaaugcccugcagaacugagacaugcucaucauuuuuguacccacgugggguaaugucauuauccuaaaacguuaacacuugguuuuuuuguuuuuguuuguuuguuuuguuuugagcucccucacccaggcuggaaugcaguggcacgaucucggcucacugcaaccucugccucccggguucaagcaauucuccugucuccgccucccgaguagcugggacuacaggcaccugcaaccacgcccagcuaauuuuucuauuuuuaguagagacgggguuucaccuuguuggucaaagugacacuuaccgugcccuucgccuuuguauuuagaguguucauauucaagucuugacuaggaagagguguaccgacauaguuucuugucauucucagaacacuugcucuuuaaaauauucaaacuuuucccuaccauucuacugaaaaaaggcugauacuggccuagguaggcacgacucuacggcaggaauggugagcaucagccacguuuuaauguuaggaugccucgauucucccaccucagcuggcaucagaagcaccugcaggacucuccaacccggacugcugggccccgcccccagaggccgggcugaguccccaggggaugcggacaccgccgaucgcgccccgccgugagaacuucuccuccaacauccgacaaaaacauuacgucgcgcgagggccaggucucucccucugcccaccugagcccggcggagccccgcagccucggaacggcggacccucgcgaucgcaggccgagcaggcacaaguggccuggaaaugcgcgaagugggcaacuuccacacuucccgagcacacaaacauuccuugcccaagcgcuggcucuaccccgggaaggcgccauuacgaaggccugaucaccggcaaccgcgcgcuucgacggcaaagccccgucaggucgcgcgccggcuugggccgccggagagucgguguggaguggcucgaggcucacucacagcgacgcagccccagugggucccuuuccucuuaccucggccucccacgccgcccccauuuccuggggugcuucuccccacaccuccuucgggggcccggacccccgccccugcccgccggugggaugugggaagcgucacuguggacagcccgggccucccggagagucggagucguaaagcggccagccaggcccgcccugcccuaccuguggggcuccggacagcggcggcggcucgggggcgcccgucgucagccagccggaggcggguagcgccacgaacagcaggagccggagggcgagcgaccccgguggagcgcccuccaucuuggacaacccgggcagagggc

SEQ ID NO: 192120 - RNA, 329856 nt, Homo sapiens
ggcgcggcggggcgcggggcguggggacgcuagcgggcgccggacgggcgcggcgccccgucacgggcagcgccccgaaccggggccggacaccucggccgcucgggccgcggcggcggggaccaugccgaagaaagucuccugagcccggcaacuucggccccuccccgcccccacccggcugcccuccgcgcggcccuccccaugugcagccggccagccgggcucuccuccucgcggcggaugggugaccuuuuccuggcacgggcaggcugugggaggcagcggagcaggcgaugaagaagaagcagcagcaucccggcggcggcgcggaucccuggccccauggggccccuauggggggcgccccuccgggccugggcagcuggaagcgucgggugccccugcugccuuuccugcgcuucucccuccgggacuacggcuucugcauggccacccugcuggucuucugccugggcucccuccucuaucagcucagcgggggacccccucgcuuccugcucgaccugcggcaguacuuggguaaggaagcugggcaggcgcuagggcggcgccgacagcgcaaaguugugcggcggggagagggucgcggcggggacuucucgcgcugccaccgcgcgccgccgccgccccgggucucuccaggugcuaagcccgugagcaucugugccgcggucgggagcgccuucuuccucccgcgcguccgacuguccucaccgaggcgggggcgccgcuggguugcgcugccggcagguaccccggggcgaggcaccgcucaccuuccccccgccccaccuccgccacccggauccggacuggggcggaguggauggguguguggggugugccggaguguguguaucuucaggccuggcggcgcggggaguggcgaagggaagggaagguccucuucguugcauuguuagugaccgcaguucagucccgucccgcgccccggggaguguggguggguuuagcccuuugccaccguccgcucugagaauucugucccgcagaucccccgccugcccgccggcccuaguggcuccgcgcuguccccgggcuggcuugucccuuggcugccgcugcccaccccgccgcccgcagcuagccuggcgcggggaacggguugcauccagggguuuggggaugcccgagggcgcuggucagccuggccagcagugucgcccccaguaacccgaggauccucggcgcugugugcgucucaagcucaagucaaaacuugugugugugugugugugugugugugugugugugugugugugugugugugugugguuuauuaggagagaggccgccugucuuuagcagaaguaaggaagggguuugacgggagggaaagagccgcuccagcgagaaggcgugaccccgcagcucccucgucucggcugcgggagccaggggugccagggacaggcgagcgcaagcccaggucgcaaggacgaugcuggcacucgcguucgagccaagggaggaugcagaucccucccaagucuguggccagaagaggucgugcgggggugaaggcugggagagcuccagcuucuugcaagcauccgaagugauaagccugagcaucugcacgaugagagcgagugcggggaagcagagccaccgaagugcuggaaagaaaaugggccaaaugacccgggccagcuggaggcugccacaguuaccccaaacgucacuucguggcagaagccacaggucuagauaguagaccguuuggagaaaagagaaaagaaaaggaaaaaaaaaaaacccaaaacaaacaaacaaaacaaagcaaaacaaaaacaaaaccacaucagccaaguuacaaauguguuagggcauuuggaaauguagauguggauaaaauaauauucuuuaccuuguacaagaccucauauuuuaaaaguuacacuuuuauuucuuuauaaacuuuggggaacuacagauuacaggaaaaguuggcccaaguagauuuccauagcauuugguuucauagaggauuuggggcaauauauccuuuauuagggaaucaaaccucuucuuuucauaaguucuguauuguggagucucauagcuuccuccacucucugacaccugcuagugccacaaaaguuaacaguauuuucaucaccagcagcaaucccuguuaacaggcauugggaggcaagcguugaggcucagggucuuucuccauuaaaucugacagugaauucuuguggaaguucuuuuuaaguaauagauggaggccagggguguagggaaaaguguaauggaccaggauggaagucaucugugcucauuguccucaaagcaccuggccucguguaggguacucagacuucauaggccugguguuucauggcagaauuagaagccacaccugacugucaaugaaaccuccacccagcuccuaaaguuuugggguucugacaccuuucuugaggaagggaaauucugggaggaggaaggagcaaagguacuacugaggauaaaaucaagacauuucaacauauauugcauuaacauuuucacuuuauauuuccaaacaaugaggccuaauaaauuuggguggucaguugguagaagggugaauucucagcuucugcucaggaaacuaggaagaacugaaagauugaaugcugcuccuguuacuagcugaucauuauauuucugacugaugugauagguucaaaaugacaucauugugaacugaaaauagaauacccuuggccaaauuuguucccuguuacguaaauauaaugauuuuugggaaaagugggcuugugguauuuuggauggucuaaaauauaccuuuaauaauauaaggccacugugucugcagaauuacuuuccccuguuuuccuccauucuuuuauuuuagugucugucaaaacaaaacuugugguuaguaaacacauccucucaauuuccucagccaauuuuggcagcaaguauuuuucguaaauguaaguucauguaaaguaaaaauuuuccaaaucaaaauauguuuauaucaaacacuuuucuuuacagaguauuauuucaguauacuuauacaauauucuaugucugacacacaauggccacucaauaaauauugguugaauuaaugacccaaccuguuguaucaaacagguagugugauauuuaacguacugaauauucucauaggaaagccaagagacaguagcauucauaguaaaagcuaguauuuaucacgcaugugccagucagugcauacacagggugacauucaaucugcacagcaacacugucgguagguucuauuguuauuuccauuuucuguauggaaaaaaugagggcaaagaguuaugaaggacacauagcaagcgaggcaggacuucaacccaugucugucugauugcaauacccauugcauagcacuaugggcaguuuaagggagaaaauggaaggacagccaagaugcaaaugggaaucuaaagaucgggacuggcuaaaaacgauccaucacauuuacauccauaauuccacuuuccuuuucuugauacuuguacucugaguaucuugaggagccagcagagaagggaaauaauucaagcagcugguuugcuuuaacucuaccuuuccguauuaauccccacuauguggccuccauuuauuuagggaacuagacccucccugagcuggacaacaacugggaguaauguuggucggacucgcaucuuccgggcguuuucucuuucuuuagcaguugugcuaugucuaggcuagugguucccaauguggguccuuggaccugccgcaucagccucaccugggaauuugucacaaauguacaugcuaaggucuuaucccaaagcugcugaagucugggcacagggcccagcaaucugugcgucagcaaguccucuaggugauuccaacgcagagaauuugagaaccauuguuguugagcaacaacaaaguauugcuuucuggaggcuucccauguauuugagagaaaggaggaaugugaggcgggguggguagauuuauaaaguauuuaaagguacuuuaauacuuuaaaguauuuaaaaaugugauuuaaaaauguacaugguuucaguuuuuaauuucaacuuuuaaaaaugcaucuuguuugcuacuuaagccccacuguuuugagggaaggaccagccaacggcacccaccccagcuggcuuuagaccuuccaagguuaggagaggugugacgugaggaguaggcugacguggggcaaccggaaagcauaguguggggaaggacgagaacagagccacugaugaugcuuucucuuccccauaggagacaguggugaacaguccuucuuccuagucaauuuggggaaaggcagaguauguucuacuuagagaauguucugcuguaacacauuugaaaagaguaaaggaagugauggggaggaaaaucaugcaaggauaacuguuaucuugauuucccacccugagauuggguggagggggagcacaaacauacauugggguaaauagaaauauauagcaaaugcuacacuuaagcuuggagaccauggucuuuccaauucagugaauuuuuuuuuuuugaaauggcauucaaacuuuguuuugcuauggaaaacaaacaaaaaaucaaauaaaaucucccccagaaauuagguuaugaugcagccuugcugccaguagccuuauuacuuaugagcuguggaaauaucaaaaacuuggaauaagacucauugauauaaacagaauaagccagauggcuuacuacugaucuuguacaaccgacaaacucuaaugaucuaucauccagccuuggauaugugauuuagacuuuaugggagcuaaacuuguuggacucauucccagcugauaugcuuuccuuuccauuuuuaauuuauaccacuuuaaauggagauauagaacuuuaguucucagaauugccaaucuuuacguauauuauauaugagccuggcaauuuagagucaaaaaaugaaaaguaugucauguuauugaauuugaaauucucuaaguuuaagugcauuuaaaggaaaaugugaaaauagagguccauaucuguuacaaaauaguuucuuugaaccuaaaaagccaaauuuuauuuuucuucugcauuucacacaugguauaaauauaauacuuuaggcuccaaacaguaaucuaggaaaugaaugcauaaaauaugacguuaucaauagaaauuguugacauagaaaaaaugauauucuuguucauagcuacaaguuuauauugugggguugguuggggacacaguggcacuauauuagagaaaggauagaaaauggaauucagcuaugguaauccguucuguaaacaaauagcaugaauggugaaaagcaaucugccuuguaaacuauuuuuuaauguagacuagucuuaguaugaauugucuaagaacacauauaaauguggauuaucuaaauacugucuuucuucaaauucccugucaucaauccaggcuuaagacagugguuaguuuuguuuuggagaaacuggaaagaaaguggucaagguuuuugagucccaaaauaaauaguaucuuuugcuuccucagagggagacugaaggagcaaaaacaguagcuugaccugcagcuguacugguggguguccaugauggacaaugaaaacgcaucuuauuugauggauuguagcugcuagaauuauuaggaguugcugcuuuuuuuuuguuuuuuggaaagaagacuugaccacaaauuaauuuugucauaaauauauuuauuuguauuacauagaaacucggcuuuaagcaaacagugauauacauaaaucccuuuuuaucagaaauagggacagaaacacuaacauuucacaaaaauucuuauuugcaaaagucaauguagcaacuguuuugcaagagaauuccaaauaaaguacauuucagcauuugcuauuaguuuuuaaacagcuuuguugagauauaauucauauaccauauaauucacccauuuaaaguuuuuaauaguuuaauagcuuuuaauauauuauagauauguguaaccauugccacaauuuuagauuuucaucaccacaaggagaaacgccauacccuuuauccaacacuuuugccccaucaaccccaguccuaagcaaccgcuaauuuacuuucugucuguauagauuugccuauucuuggcauuuuauagaaauagaauaauauaauauguggucuuuugugauuggcuucuuuuacuugacauaauguuuucaagguucauucauguuauagcaugugucaguacuucauucuuuuuuauggcugaauaauauuuccuaagaauuuuuuuuauugcggaauaaaauguuccauaagacuguauggauauuccacauuuuguuuauccauucacccauuaauggacauuuggguuguuuucaccuuuugucuacuguaaguagugcugcuaugaacauuuguguugcaagcuuuuguuucaacaccuguuuucuguucuuauggguauauaccuaggagugggauugcugaaucauaugguaacucuaaguuuaaguuauugaggaacugccaagcuguuucuacaguggcugcaccauuuuacaucccccgccaagaaaguaugagaauuccaauuucuucacauccucacugccauuucuuauuuuccauuuuuuuauuauagccaucuuaauggguaugaagugguauauucauuggcguuguguuuugcauuaaugaugucgaguaucuuuucaugugcuuguugacuguuuguauaucuucuuuggaaaaaugucuauucacauuuugcugauuuuuuuuuuuuuuuugagauuggaggcucgcucuguugcccaggcuggagugcaguggcgcgaucucagcucacugcaagcucugccucccagguacacgccauucuccugccucagccucccaaguagcugggacuacaggcggccgccaccaugccuggcuaauuuuuuuguauuuuuuaguagagaugggguuucacuguguuagccaggauggucucgaucuccugaccucgugauucgcccgccucggccucccaaagugcugggauuacaggcaugagccaccgcgcccggccacugauuuucuuuaaaaaauuuauuuccauagguuuuaggggaacaggugguauuugguuacgugaguaaguucuuuaguggugauuugugagauuuuugugcacucgucacccaaggaguauacacagaacucaauuucuggucuuuugucccucacccccuucccacccuuucucccugaguccccaaaguccauugugucauucuuaugccuuuacauccucauagcuuagcucccacuuaugagugagaacauaugauguugaguuuuccauuccugaguuaccucaguugccuauuuuugaauuggguuguuuguauuuguguuguugaguuguaaacauuauuuauauauucuuaacaguagacccuuuucagauauaugaucuugcuauuaauuuggggguugggaaauaugauacugacuuaaauacaauacuguuauguauuguucacuauauuauagguguucaccuuaucaaggagcaagaaauuaguuuuauauguaaaugaguuuuaaaguguuaaguacgguaccuggguauauaguaaaaccuaaauaaacucuaaagauggauugaaaacaaggaucuguucuaaagaauccugggggucuuguuuuacaguuauggauuacuuugaauauuaaacacuuuacauuuaucucuaagguaugauaauucauggauaguuaacacuuaaccuauuuuagagaugucacaaagauugcugugacuuguauguggaauaugaauuuagcuaauuuuugaacagcagauuauaguacaaugguuauauuuugucuuuauauuugcucacuagaauggagccgaugagcucagcaggagaaaacauuuggguuuauuauguuccuuauacaauauaugaagcaaccaaggaaaucuuaagcauucucaugaaauuggaauucauaugcaauuuauuuuguauucauguugugguauaauaugaaggacaaauauauaggaacaguauuugcuacguauguuucucuugaguaaaauaacuuaugaguuuuaagaagaaauauuguuuuuacaaaaaugacagaaaauuuuaguagguuucaaaaauauauauaaucaaaauaagaagcucuaaaauaacugcagucaauuagaugcugcuuggccucaguuugaauaauuggcaacacucucugaaauggucugccucuaugucucuacccaaaucucaucuugaauuguaguucccauaauccccacauguugugggaggaacccugugggagguaauugaaucaugggggcgguuaacccccaugcuguucuugugauagugaguucucaugagaucugaugguuucuuuuuuuuuucuuuuuuuuuuuaauacacauuccccaaaacuggauuacugggguccaguauuccaauuaugagcauuuuuaauuuauuaaauuuuguuaaauauuuuagaucaaaauguugaaguaauuuacacauaauucacauuuccugccaccuccacagagcuagaugucaucucuauaguucugguaaucauccaggugaaaaaugguaauauuuuuuaauuauacuuuaaguucuaggguacaugugcacaacgugcagguuuguuacauacguauacaugugccaucuuggugugcugcacccauuaacucgucauuuacauuagguauaucuccuaaugcuaucccuccccccuccccccaccccacgacaggccccggugugugauguuccccuuccuguguccaaguguucucauuguucaauucccaccuaugagugagaacaugcgguguuugguuuuuuguccuugugauaguuugcugagaauaaugguuuccagcuucauccaugucccuacaaaggacaugagcucauccuuuuuuauggcugcaaagaucugaugguuucauaaggggcuuuuccccuuugcucagcacuucucucuccugccaccaugagaagaaggauguguuugcauccccuucugccaucauuguaaguuucuugaggcauacccagccauguggaacugugagucaauuaaaccucuuuccuuuaaaaaucacccacucucagguauguccuuauagcagcaugagaacggacuaauacacugucauucaaaauuaccagggaaccagauauagcugcuuagucuugaagcuacgccauaccucuuggucugucucaggguuuauauugauugucuauaauuuccccaaaacugccacugauucauuuuuguugucucgcugccugcuuagacuucugcuaaugucuuuguacugauuguuuaggaagguacaauuccaauuaggaucucuaaacuccuguaaguauuuguuuauuucaugaucucuuaugaaguuuugacauucuaccuuguauugugaucaucugugagcaagcaccuugaagggaggaagcuuauucagugcuucgcaucccugcucugacaucucuucugggugcuccacacaggcccucaggaaguggcuguugauucaguauauuugcugagcaacuguucuucacuaggauuccaaauccugcuuuguuuggucucuauuuagagaauauggggagggaugccaagaaggacucuagcucaguugaugccuuuagccuauuucuuucuugcucuuugaagcugaugcuccaagcaaauacauuacaaccacuuaugacauaugaguacauauaguuuuguuuagaggugguugcccauucuagaguguaguggugccaucagagcucacugcagccucaaccuccugggcucaagccauccucccaccucagcuucuugagaagcugggacuacaggcacaagccaucauaccugguaacacaaacauuuccuucugugcacagagauaacuguccacuucuuaccuuugggcauuuggaauuacacuuuuagagcucucucuguaauuaagaauagcugagaucaguuuagagauuugugugcauacaguuagaaugcaaacuucuuguuacuugucauuuucugaaauccuagaccaguuguuuuggaaguuugcagaauagcuguuauuucuguagguuagugucuucuuuagguagcaauuuguguuaaauuagccaguauguuucaagcaugacuuuaagucaugaaggagaugagaccguggaaugaugugauuuuugaaauagggacugaacagaguuuaaccuagaacugcaacacgaccauacuguaaaauuaggucucaauccaccaacccauuuacacuuguuuggugaaagauacuauaauaaccuuaagucauggcuuugauuaggcaauucuuaguuaauucauuaauagaugauuuaaauaaccuauuaccuuuaacuguacugcauuucuggaaacaccauugcuguuuuuuaguucaaggaguacaauuuucauaaucuugaugaaagaaaaaugagaauauucugagacauaugaauuccuuuguucagucauucaacaaauauucauggaaggccuucuuuggggcagaagcaucaggcaguaggaaggauauagguuuuggagcagagcuccgggugugaagcacuguguuaccauuuauuagcugggacagcuugaauaauuuuauuaacuucucugaaccucugauguuuugauguauacaauaggauuaauaauugcuguuuuacaggauacuucucuaacccaaggccugacauuuaaguucaacaauugccaauuuucucagcuuguucuuugcuucccuuuaacucccucuucauuuagcacacauacacauaugaguguacacacacacucauaucagaacacagcugggggaguauacagauucacugauaaccugacuuccaauugaaagaagcaaucaaaccuagaaauacacaauuacuucacuaguauuuggcaagggcucuucaacaccugacaaguuccgguaauucauccaucccacuaauuacauauauguaccccuuccugcuucuucucuucugcuuccuggagauagucuuuaaaugacacauuuuuugcacagccugauuuccucuguuuugaauuuauccacacuacuuuuuuuguuccugcauucacaaaauaaaaauagcuguguggagggaguaugcuggcgcuuacucucugggauagccagcuguucuaggauugcacuagugauccauaagauacauccuuucagaaauaaucacaaugccaggcauacacugugccugcucccagaacuucccccauucaugacgaaacuaccacguccaguaguacgcccacuuucuuuucucaguucccacuucccucucauugacagucagagcaagagcagugaaccgcagaagcagaucuugugucuucacuugcuuguuucccaagcucagccucucuguguugccuugcucuguuagccuccaguagguguugcggcaagugagagccauaccaucuggcauggccaaucacccaguuccuugagcaguugaaggcaaaugcugauuuuacauuauuucguagaaaguuguauuuuguuuggggaccuuaaaaacccugaccuugucauccagcacagagcuuccugcuuuaacacaaaggcuguuugacaugaaugccuucccauuggauaaacagaaccgucaggcagagccaugcggcuggauggagggggcacuaggccugggugugcagggugacccgacaauaagucaguugucgguguuaagucaugugagccuccaaggcuucagugucuucaucucuacaaugaaggaguuucauuagauccaugauucucagcuguuuccguuccuuaggacccucauccauagcaguguuuccauagggucuugacugucccuaugggaauacaucucaguggccaggagagggagaaagggcauggcauuggaaguccuuuuaaaaaagucccugagcucacgccuguaaucccagcacuuugggaggccgagguggguggaucacgaggucaggagaucgagaccauccuggcuaacauggugaaaccccgucucuacuaaaaaauacaaaaaaauuagccgggcguggucgcgggcgccuguagucccagcuacuagggaggcugaggcaggagaaugucaugaacccaggaggcggagcuugcagugagccgagaucgcaccacugcacuccagcccgggcgacagagcgagacuccaucccaaaauaaauaaauaaauaaaaauaaaaaaauaaaagaaugcggcguacgcggugguucacgccuguaaucccagcucccugggaggccgaggcggacggaucacaaggugaggagaucgagaccguccuggcuaacacggugaaaccccgucuguacuaaaaauacaaaaaauuagccgggcaugguggugggcgcuuguagccccagcuacucgggaggcugaggcaggagaauggugugaacccgggagguggagcuugcagugagacaagaucgcaccacuguacuccagccugggcgacagagcgagacucugucucaaaaaaaaaaaaaaaaaaaaaaaagucccugagguaauuuuucugugcacucccaggggagaguguuucuuuucucuugagaaucacugaaguagaucguucuaagaucucugcuguucuucaaaucaugugcugaaagagacaagaggucauauaauuguagcaacugaaacaaauauaaggcuauuuucuuuggacccaaacacuuauuuuaaaaauugcagaagucaagugaccaaggcaaguagaauacacaaaaacauuuuaggccaucguugucauuuucugagucuuaaucauaguuaaauuuuuucuaaaauuaaaaucagcagugcguuuccuccaccuccgccagaacuugcucuagaaauuaggggaagcagaauguccccaggaaguccuaagagagaagaagcagaguaagacauggguuuccagaguuuagagucucacuaugugauaggugaaagcuguguuguugaugaggauuugcacagccuccucccgguugccugcuacugaccaucccauuucacugugggcagcuccaguggguaagaggguucuucacaguguggugagcuacuccuuucuagccuccauccauuuuuugcuguucuucuggaagcuauauaggcuugucuauuggacuuuauagucuucaaauaauugaagauacuaaaaugacuauuaugucuacccugcucugcuacacacauaaaucuuguccagacaaauaggucuguuuaccaguacuuucucaucagaagucauuugaagacacagaaaguaaaaaccacaaagaaaaaaaaaacuauauuaaagugaaagcucaacaguaacaccccauaaccauagcaaaacaaaacaaaacaaaacaaaacaaaacaaaaaaaaaccacaaacaucuccccaggaaauagaacuaauaugcaggucuuuaaaaguucaguuuaucaaugagaaaaagauaaaccaacucacgagauaaaugggcagaguacaggagcagucacagaagaggagacacggcuggccaguaagcacaaagagaaaugaaaugguuuugauucccuuacacaucuuagcccccuuccucugucuacauggcccguaaaagccacagaacugaacaguuuuccaguucccucagugagccugcuuugugcagugguauguuacugucagaagggauccucuucgaagcugugguauuugagaaugacugcuccucccaccgcuuuucugaggguguuagcaggagugcaacagagccuuacuucaaggcccccagcgggcuggcuggaacccugcuucagcuccuccaagcacgugcggccaaguucugggagccacgucgauguggguugauggguccccugagacgcccucucugcucagaacacagccaguaagccaugggcagaucacaacaaacagcacccugccuucugcuccgccucccuccaucuaccacacugccaaguuccuaagaagcuuaggggagaaggaacugcuguggugcuuagaaugcagugucuugccugaaaguauuuucucagucuuugagaaaacaguggaacugacucaucuggucagagcuuuacagaaaugugauugcagaucucuugcaauuucauucugcuuuagugucagaauucauccgacaacgugccaaaaaaaaaaaaaguguguaaaaucacauacagauuuagauacuucaagaggaaguuauuuuuaccacaguggggaagaaaccagaaagugccgauugguggagaaugcccggcagggcugaggaaggagggugggcaccugagcaaccugggccuggccacacucaccccugcagccuugccagccuggcccggggauugugguguggucaccucuuagcagguggagggaggaguuccuguguggaagaucugcuugaaggaggaaauguugauauaacccccgaguguggagccaacuucagcagugcgggguuaacauggguuacucuugaaaauguguugcgugcucucccaacaguccauagaagcagcucucuaacagcugcaugggacacaaaaguaaaaauggagaaacgauuccagaaaaccacauaaauauaaaaaccaaauggcgcagugucuuuauuuuguuuuggcagauaacaggauugaggccaccuuguuuucuuugcucaugcauuucccaacucaaaaggcuguucuuguuugcuuguagagcagagauccaaggccugagagacccugaaauguuuguaguuauauucuucauucgugcugcgagauaaagaguuuucccagaaacuaaagggagggaacaggaaauauuuguuaagauccauaaccucuggcuuuugucuccucuuuucaccugggcaaaggauaucagugauaauauuuugggucucauaagaugaugaauuguucaaauguauuuggagaauacuuuauucaagcaucuuugucuuucuuuccuauuccuuguggcugaagagaggcaugugcuuuuuaugcaagggucuugaaauguaugcaguuaccaugguggcacucugucucugacccaaacucugucauagaguguauguuuagccauguuuucaggggugcuuccuagcguggucaggagaaacugcuagagcugaauuugguugcugggcaggcuucuaucuuuuuuuuuuuuuuuuaauagaugcagggaguauaagugcaugcuuuuuacauggguauauugcauaauggugagguuuggguuccuaguguacccauuacccaaauagugaacacuguacacaaaagguaauuuuucaaucaucaagccuuuucucccucccugcuuuugagaguccccauugucuguuauuucccucuguauguccauguguacccauuguuuagcucucacuucuaagugagaaugugugguauuugaguuuuuguuucugaguuacuucacuuaggacaauggucuucagcuccauuccuguugcugcaaaagacaucuguauauagaccacauuuucuuuauccagucaucuguugauggacaguuaguuucauucccugacuuugcuguugugaauagugcuaugauaaacauacaagggcagguguuuauuugauagaaugauucuuuuccuucccguagauacccaguagugggauugcugggucgaaugguaguucgauuuuuaguucuuugagaaaucuccauacuguuuuccacagagguuguacuaauuuacauucccacuaacaguguguacauguucccauuucuccccauccuugccaacaucuguuguuuuuugacuuuuuaauacuagucauucugacuggugugagaugguaucucauugugguuuuaauuugcauuucucugauaauuagugauacugagcauuuucuccuuuguauuuuugugggcugcuuguauaucuucuuuugaaaaaugucuguucauguccuuugcccacuuuuuaauaggguuauuugcuuuuuucuuguugaguuauuugaguuccuuguauagauucuggauauuaguccuuugugggaugcauuuuugcaaauauuuucucccuuucugcaaguuguuuguuuacucuguugauucuuucuuugcuguacagaagcucuuuaguuuaauuaagucccuuuuguuuauuuuuguuuuuguugcauugcuuagccauauauucuuugcccaggccaauguucagaagaguuuuuccuagguuuucuucuaggauucuuauaguuucagguuuuaccuuuaagucuuuaauucaucuugaguuaacuuuuuauaugguaagaaaagggguccaguuucauucuucugcauauggcuguccaauuuuuccagcaccacuuauugaauaggguauccuuuccccaucguauauuuuugccaacuuuguuuaugaucaguugguuguagguaagcggcuuuauuucuggguucucuacuaucuucuauugcucuauaugucuguuuuuguaccaguaccaugcuguuuugguuacuauagucuuguaguauaauuugaauucagauaaugcuaucccuccagcuuuguucuuuuugcuuaggauugcuuugacuauucagggucuuuuugguuccauaugaauuuuaggauuguuuuuucuaauucugugaaaaugacaucgguaauuugauaggaauugcauguaaucuauauguuacuuuggauaguaugggcauuuuaaugauauugauucuuccaauccacaugcuugggaugcuuuuccauuuguuugugucaucuacaguuuuuuuaaucaauguuuuauaauucuuguggagauuuuucaccuccuugguuaaaugcauuccuaggaguuuuauuauuuuuuguggcuauuguaaaugauauugaguucuugauuuggcucucagcuugaacauuauugguguauagaaaugcugauuuuuguacauugauuuuguguccugaaacuuuacugaaguaauuuaucaaaucuagaagucuuuuggaggagucuuuaggguuuucuagguauaagaucaugucaucagccaacagagauaauuugacuuccucuuuucuaauuuggaugccuuuuauuucuuucucuugcuaucaggggaacccacccccgauaauucaacguggguucuuuucuauuuccuuaagugucggccggucugagaaauaaagggaaagaguacaaaagagagaaauuuuaaagcuggguguccggaggagacaucacaugucggcagguuccaugaugcccccugagcuguaaaaccagcaaguuuuuauuagcaguuuucaaaggggagggagugcaugaauagggugugggucacagagaucacaugcuucaagggcaacaaaaggucacaaggcagaaggucagggcgaaacuagaaucacuaaugaacuuccauguccugcugugcacacaaugucaggguucaagagcagagaaccggucugacuagaauuugacaggcuggaauuuccuaauccuagcaagccugggggugcugcaggagacuaggguguguuucaucccuaucuauaucugcauaaggcagacacucccagggcacccauuuuagaggccccgcccuaggaaugcauucuuuucccaacgcuguuaauuauuaauauuccuuacuggggaaagaauuuagcgguauuucucuuacccauuuuggguaauaagagaaaggcagccagacuuuaagguuaucucccuuguucccugaaaaucgcuguuauccuguucuuaaggugcccagauuucauauuguucaaacaccacuuauuguuucagcaccacuuauugaauaggguauccuuuccccauuguauauuuuugccaacuuuguuuacgaucaguugguuguagguauguggcuuuauuucuggguucucuacugucuucuauugcucuauaugucuguuuuuguaccaguaccaugcuguuuugguuacuaucaucuuguaguauaauuugaauucagauaaugcuaucccuccagcuuuguucuuuuugcuuaggauugcuuugacuauucagggucuuuuugguuccauauaaauuuuaggauuguuuuuucuaauucugugaaaaaugacaucgguaauuuucaaacacacaugcucuacaaacaauuuguguaguuaauacaaucgucacaggguccugaggugacauacauccucagcuuacgaagaugaugggauuaagagauuaaaguaaagacaggcauaggaaaucaugagaguauugauuggggaagugauaaauguccaugaaaucuucacaauuuauguucagagauuguaguaaagacaggcauaagaaauuauaaaaguauuaauuuggggaacuaauacauguccaugaaaucuucacaauuuauguucuucugccuucagccugucccuccguucggggucccugacuuccugcagcaucuugccuaauugcucuggcuaggacuucuacuauuauguugaauaguguagugggaguuggcauucuugucuuguuccaguucauaggggaaguucuuuuaaauuuucuccauucaguaugauguuggcuguggguuuguccuauauggcuuuuauuauuuugagguauguuccuuugaugccuaguuuguugagggcuuuuaucaugaaaagauguuagauuuuauggaaugcuuuuucugcagcuguugagaugaucguaugguuuugguuaggcuuauaucuucauacuucauuuguuuuauggcauaaugcguuucugugccaaaauauagccucucuuccccagauuuuuucccugucaccuugucagaaugauaguugacuuuguuaauugcagaguaagucuugcucacaaggcuuauucuucauugaagucucacaucaaugagccuuaaaggaucagagacacauguucuccuaucacucucacccacucacccacuugcucucacccacucacccacuugcucucacccacgcacccacuugcccuccuuuauauuuagcuuggcagucuuccucuguuuucuuuuccaucuagacagguucauuccuucaacaaaugcucaucaagcaccaguuauaugcugagugcuaagauaaucaccguauucauggggcuguguuguaccuggagggacagagaaggacuuaagaucccguaugagguguguugaacagggggaguuaaaagagguaguagaggcagugauuggucaugccuggauaugguuagacugauuaucucuuuccuaaaggcccuguugaugcuaguagaucaggagguacucaagacuggcugcaugauagaauaaccuggagaacuuuggagaauacagauauguguucauuuggucaaggguguauguguuaaaagcuccauggguaauucuaauaugcaaccaaaguaaagaaccacuguagcagauacagggucggagaguuuuguuugugcaguaaauccucuuacaguacuauuuagggaugcuuuaucuuaaucuauaaucuuuauuugucuaugacuuauaacacuuuagcuuacagcuucucuacucuggcaucucucaaacuuuaaugugcaugcaaaucacucgaggauuuguuaagcuauagauccugauguagcaggucuggaacugggcuugagauucugcauuuccagcaagcacccagguguagcugagguugcaguuggagggccacauuuugaguagcaagggucuauaccauagcauuucugggaaauaaugaauaccuguaaacaacaaauaugucaggguucagcuuagcucauuaaagaucugugcuauuaagcauuucauagauaucuuuuaaacugaauuuucauucaccaguuugauuguuccaauuuaagaacauuaaguauuucuuaagugagaaucacacccuuguaugauuucaaguuuaaaauggcuguuuuuauuuaucuuuggaaacuauaguauuaaaauauaggcuauuuggaguuuugugaacauacagauuuugaccuaaugucaaguuuguuaauaagcauugagagcaaaccaacuggucuuagagaugaaguuucuucaaauaguuguugcagauucgguaccguuuuaccguuugacuguuaggcauacuaucaaaauucauuaccaaaguuuccugacauacaaauauucuagguaaaguuuuuuuuuuauagccagagaaaauaauuggaugcacauagagugaauaauuagaaugacucuguguaauuauuuaaaaacacaauuuuaagaauuaauuaaaacuguuaauacaugcucauuguaaaauacugggauacaggaaaaaagcacaaagaaaauaaaacacacauuaauuucuuuguucacaacugcuuugguuacaugcuuccuccacucuguaguaucauagauaucguuucacaucuuuauauauuuuuuuacaacauugguuuucaugguggcagaguggccugugaauauacuauuaauuccuauaagaaggcuuuuuugauauuuggcccauuucuaguuuuuuuugugguuguagguaagguugugaugaacauuauuaaauuguugcagacuucccuauugccuugggauaaauuccuagacuuggaauugcugguuaaauguauaccaauuuuuaaacugauuuuacaaaccggcacauugauauggcuuuguauauuucacuaggagucuauuaccuguuuugccuauacccuuaaaaacacuggaugcaaucuuuuaaaaauccuuuacucauuugauuggugaaaaugauacucuuauucuuuaauuugcauuuguuucaauauuagugaaagugaaccaguuuaugcuuguaagacaugggucuucuuuugggaauugcaguuuuaaauuucuuuugcaauuuuucucuauagauguguuccucuuucucuuaucaauucuaagaguucuuuagagaugaaggauauuaacccuuugacauacaugcaaguaauaauuuccuggcuuuuuauuuguccuuuuguucuaaaagucaguuucuuuuauuuuuccugugcauuaauuacauuuucccauuuauuauucuuuucuuugcuuuuaggcuuagaaaagacuuauaucccaucagauacaaauucucuauauuuucuucucauucuauuguuauuucacuuuuucauuuacuuuuuaaaucccauuggcauuuauuuugguguaaaguaaauuaacucaaugauacugcaugucugucuggaaacaaagucgucauuuugaaugauauccuucuuuaacaguaaaugaauuuuuaaaacauuaaaaugaauugauuugaguugaaagcuuuuuagaggacuuuugaaagcccuguuuguuguuugauccuaaauuuuggcagugggagugcuucugaggccaucuggucccucuucgcgauacuagaaccugugcuugggccucucccuucugcugccucucucagcuaugauucucagcacagguccacagaugcccuuguuccuggagagaacuuuuguccccacaucuguggaaccuguaguugcuagcucucaggccaggcagacauggccacuguccucccuggaccucuguuggccuggauugcccaugugcaggauuggguaacuguauggaucucagccuccuggauuccuacugggucuugagcaaaaaacacaaccccuggacagcugcaugcagccuugcacauacacccuuugggugagcuccucaacaacagccuggcugucuguuugggguaucucaggaacacagacagcacucauuugaacacuauuuguauaagcagcuagauggugaucauuuguuuaguuccugugaauugugguccuuuuuaaugucuacaaaauucaaggcaccacagacauuuaaaggccaacaagauggaccaguagagguauauuuucuguuuaggaaauuacauuuucuucugugaauuugccuuuaacgggauguuucauaucacaagaggcaguguaguguuaacaaaacauugggcuucaaaucagaagucuucuguuuguguccuggcauugccaccgugcagcugugugaccuuggguaauucacuuaaccucucugagucucuguuggaacuuuagagggacucuuucuguucuauaacaccaccaucaaauuauaaagagacugcugugugguauucuccagccuagaauacuguggaaauuugcauuuguaauaccuguuaauacacauacaugucuucaguuuagucagucauucagaagccugagcacagcagguggcagaugggaguauaggaauguaggagccuguguuuguguguguguguguguguguguguguguguguugucuucaaacaaacucauaaaaauucugccgcuaggcauucacaaacagugguuguuuguuguauagaucccuacucuuucugucacuuuuuuuuuuuuauaggaaaagaccuucuaagauuauguaaauuacauuuucguuuacuggcuauuuuuaugcauuuccuguucuuucaaaggacuagauaaaaauuuucuguauguccuaagaucucugacugccucacuuuaaauuguaaagaacgauuaagaguucuaaaacauugacccugcgaucauuggauaagauuuuaauuuuuucaagauuaaaaaaauugagugugcuaaugacauaaagguucuugcaagagcugcuagucuagccucugauacagauguguauaaauucaucaucuucgugcagacauuauugguaauagagauuugcccacauaacauggggagcacagaggagaagagagaaggagagggauucagggaaaaggugacacuugagcugggcauugaagcauaaauaggcauuuucuauguaaagaugugggaaaagggcauucuagauucuagaaagaagagcacgugcaaaggcaagccacugggcaaaauuguggcauuuuugggcacacgaagcaguacagaguggcuggccagaaaccaugguaggggaagggaagaggguugcugcaagguaggcgccuacaguaaaaggaacuuguacguuacacuaacugguaugcaaugagaagccaccgaacauuuuuagaccacagagugagagcagauuucuuauucacaaacucaacucuauaaacagaaaggaagagcugaagccaugagagagccuagggcaggcgucugauacaguccucauauuugaacagugcuuuacaguuuauaaaguacuugcaccuuuguugucacgugcaccucuucccucuccugagugguggguguuaagcuuccucugcagacaaggagccugaauucagagacaugaauggcccuggguugcucagcuggugcagcgggcagagggagaggucaacaugucaccgagguccuuugccuuuucgccucaugccacagggaagcauauuucagcaaaauacugaaauauuuuuccaacuuuuuaaaugagauuugacuuucaaaguaacuuuaaucuugauuaaaaaaaaaaguuugacaagacaaacaacuuuuauccugcagguauugauuuaguagaacagagugaugucacugugccuuguugcugacauuuuccuguuaugauagccuucuacaagcugaugguuuguuuuuucugauuagcuaaaauggaaagaaaaaucuccagugugcuuuuauuaggauaggauauaacauaucuuaauuuauguuucaguuauuucaauaacuuugaucauaccauuuugucauagauuaaguuggcauugaggcuguaauuucuugcuguuuggaaaugacucuuuauugaguaaggcagauuuauuuucuuugugccauuauugaagauuauagaaguggcucugcuuccauuuuaccuaaagucgcauaggcuguggcuguugagcuugcauucugagcguagcuuuuuguagagcuguucagccuuccaacgcuuguuggaugacauccagccccacccuguucugccaccugcucuggagaggucuaaagcaaaauguuccagucauuuuuguuucuaaaccagaagcaaguuucuacaucuuuaauuuuguuaaaauauaguuggaagagaguaagucuaggucacagaaaauugaacugugcugagauggaguggguagguggauaguccuuuagauaaugagucgacuauuagaauuuaaaggcaucuuucuagagaagagaugaagaagaaaacagcucuaacaggugcuccaugccccaacugagccugucugaacuuacacauggucuagaauuuauuggaugauauauguuuacuaagguaauuauaacauguaccugaaaugagagaguuuuugcagguaacuacuaaauuuguagcugaauuuucuggaggucaaagcaaaaagggagugaaauguaucauauguuaccauuguccagucuaaggugcacacuagcucauugggaaaggguggccucugucuuccuaccucccccaaaaggagauaucuauucgaucuuagagaaucauagggacaauaccuccuucaauauuuuuuuuuccccagaaauggggacauguucuucaugaggcugcacuauacauuggcuguuuauaaaagugaaagcauaauaucaaaccacagcucaguggugguauuucccuggggagcugaaccuuuacaguuuagguguccuacuuuucauugguuuuauguguuuagaaaggagagagaauagaauauugaguuugugccuggugguuucucuuuaucgguuucugcagccuuauuuuuggcaggaacaggauagcagucaguugaaggaugcuaugugcccaagguauaacaaaucagugugaaucgcacugggugggugauuaaggagccaggcgaugugcugguuccuucuucccucuuacugagcagccugcuugggguuggcugggccugguggagaacuuaccuugggugggcccuucugaccuuuuuuuuuuuuugaguuggagucuugcugugucacccacgcuggagugcaguggcacaaucuuggcucacugcaaccucugccuccuggguucaagcgauucucaugccucagccuccuaaguagcugggauuacaggugugcaccaccaugcccggcuaauauuuggcauuuuuagaagagacaggguuucgauauguuggucaggcuggucucaaacuccuggccucaagugauccucccaccucggccucccaaagugcugggauuacagguugagccaccguguccagccccuucugagcuuucaguguuacuccccaucccuaagacaugagaucugggccagaaucuuucucagagggggaaauuccaaaugaacauauuuugaaugucuuaaaaccuuaucuguuagaggaacuuuuaagaaaagaucaaacauacuuccaauuuuacaauaguugucaauuagaggauggaauugauuuuacuauuuuucaacaacuuuauuaacauuuuuuugcgaaccucuuuuuccaauucagcaaacuuuugcaagucuugacauauucuuauucuaggcauugguggguacgugaucucacaaaauuguuuaaggaauuuuaaaaaaaauuauagaaaauaggaucuauguugaaagaauuauaaagugcauuacaauuugagacuuaaauuuccauaucuuuuaauuuuaccuaaauuuauaugaauuuuaaaauggugauuguuggccaggucugguggcucacgccuguaaucccaacaauuuggguggcugagaugggugggaucaccugaggucaggaguucgagaccagccuggccaacauggugaaaccccaucucuaccaaaaauacaaaaauuagccggcugugguggcagaugccuuuaaucccagcuacucaggaggcugaggcaggagaaucgcuugaacccgggaaguagagguugcagugagccaagauugugccacuguacuccaaccugggugacaagagcaaaacucugucucaaaaaaaaaaaaaagugauuguuuuucauguuuggaauuauaugacauguauguauuaagagucuaauuuauuuuucaaguauaaaugagguaaaugcaaaucccagaagacuguuuucuaugcacacacaaaacuacauuucuuuuaguacacagggaaagguaaauauucaaauucuuuccguugggugacauuuuguucacauauuuuuguagggcauccauacuuuuguuuuacacugaacaaaaggacagugugagggacagaugucagagugaaggugugaauuugcaccaaaugccagguuuagggcucagaauagcauuuuuuuguacguggggcgccaugaacgcaaagacuuccagcgggaugggcguugagcagggauugucuaagaggaaucaaauugccaaaugucugcugccagauuauucuucccuaaaauugaucucccugagaacuugucuugcggcccaauucccaccagcuucccucuguccuccccgacuuuauaaagaagcuuaucugacucuaugcuggugucaaacaccuccagguaccaaaggaagaauucaaaauccuggcauggagaaagugaaugacuagugacuacagcaaacccuuuugcaggucacguggcuccuauucuuggcuuucaaccaaagugaaggaggaucuaaucuaguuauccccucagguagaucaccaacagaucacuaugggauuuagaaagauguuaaagaagcgugugacacggcuauaacuaaacacucuccauuccugucuguuaaagcgaacaagguuauuuuauauauauauauauauauaaaaauauaaugaauaaauaggaauaaaauugaaaucagugaaauuuacuuauagacaaggcccuauucacuguauuuaugaucaaauuccacuuuugauuuuaauuauuugugaaauguguaaaaucuuuauauuguuuugaucaacugugaaacaaagguaaucuuaauaauaacucaaauucaggauauauaguuuaaacuuuuaaagcauuauggucacaagaauauuuuuuaaaugaauuuuacuuuaccuacauaguuuugucauguagaaauagaacagagagaucaauacaguaauuucaagcgugaaguauaaucuguuagaacaaaaaucuguggggggaauggaaugaaaauacaagcugaaaaauuuguuacucagacuuucuuuucagcauuuuuuagaggauuugugaauuucagagaaaaaugagugcaugaggucaggugcgguggcucacgccuguaauccuagcacuucgggaggccaaggugggcggaucaccugaggucaggaguucgaaaccagccugaccaacauggugaaaccccgucuuuacuaaaaauacaaaauuagccaggcaugguggcaggcgccuguaaucccagcuacuggggaggcuggggcaggagaaucacuugaaccugggaugcggggguugcagucagccgagauuacgccacuacacuccagccuggagucugacagagugagacuucaucucaaagaaaaaaaaaagagugcaugaaagaaaagcuuguuaauuccuccuugacuucauaaugaucucaccucuaacaaggguuucccaauauugagaauaucuuaaacauacauaugcuauccucuccgucccuccuaggcccgcccucuaccugagguaacuaguauucuuggucuuguauuuauuguucucugccaaguuuugcagggcuugaauauuaugugaauuugacagcuuccuuuaggacaaagaauaaaacauugucaguuaaaaaaaaaugcccacuccagugcagugucgcccagcgugagagguuguguggagaaggggaaguuaggauggagcgaggugguggucuuuaccaauggcaguuuccuuuugcagauuuugcaaaaaaaacgugagcaugugcguuuauuguuagagccaccccucagacuuggaaaggagcucauaaaaguaagggcuccugaaauuuaaacuucagcagucacugugaaacuaccucuguguauguguaugugugugcaugugggugugcauacacacauacaucccugaaaacuguguugguuuuaguugauuguaacucuuuuuuuaauuaaauuuuuuuuuuuuuggggcggggagagagucucacucuaucccccaggcuggagugcaguggcacgaucuuggcucacugcaaccucugcuuccuggauucaagcaauucuccugccucagccucccgaguagcugggaucacaggcacacgccuccaugcccagcuaauuuuuuuugaaauuuuuaguagagaugggguuucaccauguuggucaggcugaucucgaacuccugaccucaggaaaucugcccgccucagccucccaaagugcugggauuacgggugugagccacugcgcccggccugguaaaauaugaauuuuauaccuuguucuaggagaacaggacguauauauuugauuguuauugcuauuguuuuauaacuuggaggaauuaugagcugaaauuuuauuacuuacacuuuauuuucugcauuuuuuaaaggacaugugaauuccagagaauuguccuuauuuauuuuggcugaauuaauagggcaaauuugccuccucugaaggaaaaaaaauagacaagaaagaucucuuuaaauaccagccugguguuguucuguguuagagaaauucuggcuuuugcuucagaccuccaguccugguuuccagaagaggagcacuuucugguucucauucaggcccuuaguggaucuucuuccaagauuuuuaaaaauaugaccauuagcuuacauuuuccuauguguucaauccucuucucagcagaaguguuugcgguggauuuuugagggugggaguguggucaaugacgcaacugagccuuucagggacuuggaaauaaagcuguuuuauugugaugaccaguuuugugcagaaucaucucauucuuuucugcacguggugaguuuugaagugaaacuuaaaguuuaaugagauacagcagcuggaguugggcauuuugaaaagagguaaagagagauaauuguaguaaaacauacuguaaggccuuacuuaucuggaauagcauggaaugaagagcuccagauaaugguguuuucuagaaagugaaaguuuagagcuuuaaccaucauacccuccccuuuuuucuuuaaccauuuguuggaaaucucuuuaaaacauauuacacaugguuuucuucuccaguggaacuauuagucaucguuugaaucucguaagacauuguuucuggaaucuggcugugauacagucaucuccucuggauccgucaugaugggugggacccgcuguccugcccuuaccuggccuuggucuguccugcugggugcacucuugggucuguuguagguuugcaucuccuguguggucccuuggccuugucccugcucucaaguggcuggucguagcagcucuccaucccacuaaccugcugauucuaacaggcaguaaauucagggagcaaauacagaacguguuggaauuuguaaaacagcaggaauggcccucacuggagcuccaagugcuugcuggauguuuccucuccuggagacaggagccguuuuuuccuggugugccggcucacuuaccgcacuuaaaaccgacugcucuuaaugaauaagggaacagcgugccucaucuuuaucucuuuaccucuuuuagacguuaggccauuagcucuuauuuucaguuguguucuacauaagcaagccugauggaugacucugaauaaguaaauaagauuuaauugaauuaugcaauuuucaguuucucucagauaauaccaaaucaaacaaaggugaagccaaacacacauaaaagauucguuuugcuaaagcacagugugaauauuuuaauugacuuuuauuguauagucaugugccacauaaugaugcuuugguaaaggauagaugcuuauucugaugguggucucauaagauuauaauacucuauuuuuacuguaccuuuccauguuaauuuuuuuguuuuuugagacggagucucgcucugucacccaggcuggagugcaaugacacaaucucagcucacugcaaccuacgcaucccggguuccagugacucuccugccucagccucccgaguagcugggauuaugggcaccugccaccacacccagcuacuuuuuguaccuuuuaaauagagaugggguuucaccauguuguccaggcuggucucgaacuccugaccuuaggugaucuaccugccucggccuccguaaucccaaaguguugggauuacaggcaugagccaccacaccuggccuagguauauuuagauacacaaguacauacuauucuguuacaguugccugcaauauauucuguacagucacaugcuguccaggucuguagccuaggagcaauaggcuauaccaucuagccuagguguagaguaggcuguaccaucuagguuuaugcagguucacgcuuugguguuuguacaaugaugaaaugcccuaacaaugcauuucucagaauguguccccauucuuaagcaaugcauagugguaguuacauaucaacaaaauugaaaaguaaaaaauaaaaauaauacaauaauuguaaugauaaacugaaauuuuaaccuucaccuuagcuauaagaauagagguauagccuccuuucccauaaggauuuccuggaguacagagcccuaguuccaaauuuuuuuccaaggccacucagaaaggguuguuaagcuucuuuguuuucuguuuuaaacaagaauuucagaagcaagauguggagauuuugccuauuagagauuuuuuucuuggucuuauuuucuuuuauaucaagugauuugacuaaaggacugaaaguccugagugaggauccagggcccaggcagacauacuagggccuugugggugacagaaaaaggcacuccuugggacuaauucuacaacggugcccuuccugaggcgaacacuggcaccauggcuugugaauggagcauggccucccuuucagccccugaccccuccucccaggccacgucaggcagggcacucugguguggggugcaguccugugacaaucccugcaucaguguggggccuggcaggaacaugguuggaggcucacagaucugaguccuaaggcucgcagggucuguccagggcaccuguaaguaagccaucaucacugacauuguguugauuuaagaauugaaacuccaggccuggggcaacuugccgaggguuauaaagccauuacaugguagggaguggggucuugagccagagcucuggucaucucugaugacgaccaaggcccaccccccuccaucccauccggaauccagauugcauugguugagcguaucaccccucucuucccucuguuuuccauccucaugguggucacagcagcucagcccauugcccucuucugcaaggccgagcccacccuccugggcugcagccauagcuguggcuguccuuacccgcuguggaugccgcugugggacuucucucuuuuucucuccacaaagaaccaaagaauguucuuuguggcacauuuuuuuuuuuuuuucaaccagaaaguacuaccucaagccuccuggaaaauuccuuauuauuucagaaacaucacuguacuucuuccguugacucagcacuucugucuccuuuucaaguguggauuucagacccuugucauucuauggagcaaaugaaauacagucuugaggagaagcauuacguaacauuaaauuucaucacagcucuuuuuaagaauacuuugagaauuucagaguguuuucaagggaaucucuuugacguuaguuccuccucuugguuccucaccagauaaaggaaaucuccaacucuggggaagacaugugagggaagucugggagaaugucgugcauugacacccaugaacuugcugacaucuggaggaaugagcagggcugagagaauuccgguccugguccugccucuguugcucccaccacgccagggaaauaauaauucccacucagcccgcuccacgggaugucguaaggacaaaaugagaugugauauauguggaaacacuuggaaaauucagacguuaaagugacucuagaaauguaggugucaucauggcuggaaauauuaguauagcuuugagagaaaaggacauuuuuggucaaauaaguuuacagaauagugaauuauucucuccuugugggcucucaacacgucuuaacauuuuaaagccuccccuaaguccugcaggaaagaaauccuuuucgauucuguuuaacuuaguguuucucaguguuuuuucccccuccuguuagcugccucugugaacugcugugaguggaguucuuggagggcuugugaacucagcagaaagacuuugugauauuuauuuuggcugcuuauuuacucagguuuauuccagauacaggaggucuccagacacugaguuauagaucagugagguauuauuguauuuuauuauagacacauacauauacaaauacauguguguguauauauauacacacacacacacacaaauacauguguguguauauauauacacacacacacacacacuuaugcaggaauaccuuguuuuauugugguucacuguauuguacuucacagauaaugcauuuuaaaauaguaaauggaagauucguggcaaacuguuguugagcaaguuuaucagcaccacuucucauuuuucuuuuuuuaaaacuuuuauuuuagguccagagguacaugugcagguuuguuauauagguaaacgcgugucaugggaguuuguuguacagauuauuucaucacccagguacuaagcccaguacccuauaguuauuuuuucuguuucucucccuccucccacuccccacccuccaguggaggcccuggugucugcuguuccccucuuuguguccauguguucucaucaauuagcucccacuuauaagcgagaacaugugguauuugguuuucuguuccuauguuaguuugcuaaggauaauggccuccagcuccauccacauuccugcaagaacuugaucucauucuuuuuuacagcugcauaguauuccaugguauauauguaccacauuuucuuuauccagucugccauugaugggcauuuagguucauucuaugucuuugcuauugugaauagucagcaccauuuuuucugauaacauaugcuuacuuagugccucuguaucauauuuugguaauucuugcaauauuuucaacuuuuucauuauuauuauaucuguuauggggaucugugaugaaugaucuuugguguuacuauuguaauuguuugggggagccacaaacugcacccauauaagaaggcaaauuuauucaauaaauauguguguucugacugcuccaccuaccugugguucccugucucucuuccucuccuuggaccucccuauucccugagacacaacaauauugaaauuaggucaguuaauaaccccacaauggccucuaaguguugaagugaaaggaaaaguugcacauuucucaccuuaaauagaaagcuagaaaugauuaagcuuagugaggaaggcauguugaaagcugaaauagaccgaaagcugagauaaacugaaggcugggucucuagcgacaguuaaccaaguuuugaaagcaaaagaaauguuguugaagggaaugagaagugcuauuccggugaacacgugaaugguaagaaagcuaaggagccucauuacugauaccgagaaaguuugagugguccggauagaaggucaaaccagccacaacauugcguuaagccaaagccugauccugagcaagguccuaacucucuucaguucuaugaaggcugagagaggugaggaagcugcagaagaaaaguuggaagcuaccagagguugguucaugaaguuuaaugaaagaagcuguuucuggaacauaaaagugcaaggugaagcagugagugcugauguagaagcugcaacaggucaucuaggagaucuagcuaggaucauuguugaaggcagcuacacuaaacaacagauuuucaauguagacauaacagcuuucuauaggaagaagaugccaucuaggacucuaguuacagaggagaacccgguaccuggcuuugaaucuucaaaugacaggcugauuuuccuguuaggggcuuauguagcugguaucuuaaaguugaacccaguguuuauuuaccguucugaaaauuguagggcccuuaagaauuugccaaaucuacucugccugugacagcauaucuguuuauagcaugguuuacugacuauuuuaagcccauuguugggcuuuaaaaaaauagugcucagaaaaacagauuccuuucaaaggucacugcucauugacaauguaccuagucacucaaggucucugauggagauguacaaggagauuaauguuguuuuaaugcuugcuagcacaacauccauucugcagcccauggaucaaggacuaauuuugacuuucauauccuuuuauuuaagaaauacauuucuuuuuuuuugaaacucagcucugucacccaggcuggaguuuuuauaaggauauagcugccauggauagugauuccucugauggaucugggcaaaguacauugaaaauccucugguaagaauucaccauucuggauuccauuaagaacauuugucauucauggaagaaggucagaauaucaguauucacaggaguuuggaagaaguugggaugacaucgagggggucaagacuugaguggagaaguaacugcagaugugguggaaauagcgagagaacuaaaauuagaaguggaaccugaaaaugggacuaaauugcugcuaucucaugaucaaacuugaacagaugaacagaugaggaguugcuucuuuuuuuuuuugagacagagucucgcucugucacccaggcuggagugcaguggcgcgaucuuggcucacugcaaccuccaccuccuggguucaagagauucuccugucucagccucccgagaagcugggauuacaggcgccugccaccaugcccggcuaauuuuuguauuuuuaguagagacaggguuucaccauguuggucaggcuggucucucgaacuccugaucucgggugauccaccugccucggccucccaaagugcugggauuacagacaugagccacagugcccggccaaguuguuucuuauggauaagccaaaaaagcggcuucuugagauggaaucuacuccuggcgaagacgcggugaacauuguugaaaugacaacaaaggauuuugaauauuucauaaacuuaguggauaaagcagcugcagagcuugagaggauuggcucuaguuuugaaagaaguucuacucuguguaaaaugcuaucaaaccacaucauaugcuauggagaucuuucgugaaaagaagaguacaucaauguggcaaacuucguuguugucuuauuuuaagaaagugccauagccaccgcaagcuuuagcaaccaucacccugauccauuagcagucaccaacaucgagacaagacccuccuccagcaaaaagauuaugacucacugaaggcucagaugauuguaagcauuuuuagcaauuaagcauuuacaauuuuuauauuaagguauauacauuauuuuuagauauaaguguauuauugcacacuuaauagacuauaguguaacauaaacauaacuuuuauaugccuuggauaacuaaaaaacucacuauauugucauauuugcuuuauucugguggucuggaacugaaccuccaauaucucuggcacacauauacacaaauaacauuucuguaaucugauaguuuugccagauaagucauauucucauugacuaacagagcucaaguuuuaaucaacccagcaaaaagcauuucucuccuggaguuuuucccauguacaccuuuccccugaagaagcagacguaucauuauuuuaaauaauucuuccuucuuaggaaaaauuauaggcauauuuucuucucacagcuaccaaauguccuugauaucugugcaugcacauuuauauguaaaaucagagcuucuugugguuuuagaauuggaagaggccuuagagaugaacuugucuggugauucucaaccccuaagcauguucuuaacgugaacacuugggaguggaagccuggggaaccugaaauaacuacacauuuccugcuaaccuucuaauuccuagucugccauccuugcaguaguaagguuccccugugcagugggaauuuucuguccccaggggguuggggacagaaaaauguugcacuauagaucucauccaaccccgcauuuuacaggugaagaugaugagcuacaagauucaaugauaucuucaaagucacacaacccggccuagaaauaggcugcugcugaucaauccacugcuuucucugccuaugaguuuuccccaaugucagugauuucuguccuaccucuguaauuuacggcauaucacgaaaccccaacccucauacgcuucaucauuuuaaauaaagacugacuuuuauaugugaauaauuuaugaaagaaacuguaauccauauucgauguggaaauguaaccacauuucacucacuaugaaaaagguaacacuaaaaauaaaugcuaugaaaaaauauauuaaauuuuaacuaaaguuccccacuuaaguuucugagccugaaguuuucucucugcuaaaaagagagauuaucaaguuaugaagaguuuaaacauaacacuagccccaaacgaugacacucuuuuuauguaaucggaauuauugaaugaaaauuuugaaggaaauaacauucucucgacauaaguccaggcaguauuuacuaaccaacacaccaucucaaauccucucaaguuccaccagugagugagcuguguacccauucacgaggaacugucucccaaaagggaagcuauaucaggcaaaucauaccucugucuguaucuaagcuggcuggaagguauuagauuugguggcaaucagaguauuaauuggaaagaacaaguggaaaauuguacauauauuggcuguuuaucuuguguauguguccacagacacccuuagaaaaacugaaagcacagugccugcgauaugauaaaagcucaguaaauauuuguugaaugaauugaugaauaccuggugaauggcaagcauucugccucaagucagguagaaacaauagacugguaaaagcaaguugcugcauuuuguuucaaggcacuuugaaaugucuuaucaguggacaugaaguauagaagacuuagcagacucaggaagagcagagcauggccauggaauauuuaacagauaaugaagagcauauauguggccgggcgcaguggcucgugccuguaaucccagcacuuugggaggcugaggcagccggauugccugagcucaggaguugcaaccagucugggcaacacagugaaacccugucucgacugaaauacacgccggcuuggcggcgugugccuguagucccagcuacuagggagguugaggcaggagaauuucuugaguccgggagacagagguugcagugagccgagacugagccacugcacugcagccugggcgacagagcaagacuccaucuuaaaaaaaaaaaaaaaagcauacaugcauuuaggcauuaagaugcuauagaccauuaucuuuuauagucugugucacacuucauguuauguaucaagaggagaaaagcaucucagcccaagauuugauuccugauuuuacuacucaauagcuagaugauuuggggacaacugcauaauaucuuugagacuacuuagauauacaaaugaggacuaugauaaugccuaccucaaagguuguugugaggguuaaaugaggcaaugcaaaugaaaauugcuuuauaaagacuaaagugcuauauuaauuugccuuuauugaaauuacauacuauuaaaaugaccagcgaacuaccauuugugcagagugguugaagaauauggcaugcugauuauuugaacauucuggauaauagaaguauaguacaugucuuucugguuaaaaagaauuacaauaaaguauucuuaacaucaaagcuuacuaacacaacuaaucguuuggaugagauuucaagauauuucuauauauuuugugggcagcacuugaacacuugaauaguauaagauguugaggaaaaaaaugcuuaggaaaagaauacacucuaacugauaccccaaaccauguauguuaaaaaaguaguuccuuaaaauauacauuuacucauuauugaucccuugcuuauaaaaaauguaugaauugaggaaccaucauuggauauacagaaguagaauuauagaauuuguuuuuauggguauuuugagggguagaaaacaagaauuauuuuauuuugcccuguucagacaaaaauaucauguuagcuuuuuaaauaguauauagugcaauuggaacucaaucuuaagacauuuuugcuuaaugaaaaugcuaccaugacagaucuuuuuuuuuuuuccuaacaggauguauaugauucucuuuucauuaaauuugccucaaagaguuucaacucucaauuuuuagacuaacuuuacuuuagauaaaaggguuuuuauacuauuauuucuuuuuuuaaauuuccagcuuuuauuuuaaguucagggguccgugugcaggaugugcagguucguuacacagguaaacaugucccauggugguuuacugcacagaucaucccaucacccagguauuaaucccagcauccacuagcuauucuuccuaauccucucccucuucccacccccugcccucgaaauggccccaguguguguuguuccuccccauauaucgauguguucucaucauuuagcucucacuuauaagagagaacaugcuguauuugguuuucuguuccuguguuaguuugcuaaggauaaugaccuccagcuccauucaugucccugcaaaggacaugaucucaucccuuuuuauggaugcauuguauuccaugguauguuugugccacauuuucuuuaucaagucuaucacugaugagcauuuagguugauuccaugucuuugcuauugugaauagugcugcaaugaacauaugcgugcaugucuguuuguaauagaacuacuuauacuccuuuggguauguguccaguaauacgauugcugggucaaaugguauuucugccucuaggucguugaggagucaccacacugucuuccacaaccaacaguguaaaaacauuccuuuuucuccacaacuucacuagcaucuguuauuuuuugacuuuuuaguaauugccauucugacuggugugagaugguaucuuauugugguuuugauuuacauuucucuaauaaucaaugauguugagcuuuuuuucauguuuuuuggcugcauguaugucuucuuuugaaaagugucuguucauguccuuugccugcuuuuaaugggguuguuuuuuucuuguaaauuuaaguuccuuauagaugcuggauauuagaucuuugugagauguauagauugcaaaaauuuucucccauucuguagguaguuuguuuaccuauugauaguuucuuuugcugugcagaagcucuuuaguuuaauuagaucccauuugucaauuuuugcuuuuguugucuucaucauuaaaucuuugcccaugcauauguccugaaugacguugccuagguuuuauucuagguuuuuuauaguuuuggguuuuacauuuaagucuuuaauccaucuuaaguugauuuuuguauaugguguaaggaagggguccaguuucaauuuuuugcauauggcuagccaggucucccugcaccauuuauuaaauaggaaauccuuuccccauugcuuguuuuuuucagguuugucucagaucagaugguugcagguguguggccuuauuucuggguucucuauucuguuccauaggucuaugugucuguucuugcaccaguaccaugcuguuuugguuacuguagcccuguaguauaguuugaagucggguagcaugaugccuccagcuuuguucuuuuugcuuaggauugccuuggcuauucaggcucuuuuucgguuccauaugaauuuuaaaauaguuuuuuuccaauucugugaagaaugucaauggcaguuuaaugggaauagcauugaauguauaaauugcuuugagcaguguggucauuuucaugauauugauucuuccuauccaugaacaacccaaauagugacagugcuauuaaaaaauuguaaucaaagccacugauauuacaugacaaaucuuugugaguacuuucuuccuguuagaucauuuuaaaauaguuuacauucuugaauuuuuaagucaguuuuaaaaaauagauugcuuguauuagucuguuuucaugcugcugauaaagauguacccgagacugggaagaaaaagagguuuaauggacuuacaguuccacauggcuagggaggccuuacaaucauaggggaaggugaaaggcucuucuuacauugcagcggcaagagagagaaugagagccaagcgaaacggguuucuucuuaucaaaccaucagaucuugugagacuuauuuacuaccacgagaacaguaugagagaaacugccccccaagauucaauugucucccucugggucccucccacaacacaugggaauuaugggaguauaauucaagaugagauuugggugaggacacagccaaaccauaucaucguucaacuagaaaauauauauauauacacacacacacacuuagugaaaguuauuuuauuaauuagccaggauaaaccuuauuuaaacuauuuagauaugagucacuuugaggaaagguuauuauaugaaaauaucacugaaauaaucagaaauuucuuuaaaaaaugcuguuaugcuauaauucauuucauaaaguucugcuuacauucauaaacuugagccguuuguacagaucacuuauuauccucauauaauaauuuucugacacauccaaucugcguggcugugauaaaaaaugauccaaaauguugaccuauaacgugucuuaagagcucuuaaaaaaaagauaaaauccuugaaugaugccaggcaucuagaauaaaauugucaagagaaacucaacuaauuuugagaucaaauuuuaagaucaaaucuuacuccuuuauuacaaauguucaguaacgaucucaucaacaugaugucuguagcaaauuauuuuuacuuaagggcucagcucugacauuugaagugaaugguugugagugccaguuuaguucaggaaaaugcugugguuaagggcuggcccauuuucacauggaauaauauuauucaggucuuguuuugugguauuuauguuguaaauaauacauccagaguccauguagcuaccuaugccugcccgugaaugauaccuacuuagcguugucuuagauccaguggcaauaacguuuaaaugcugaaggaaauaucuuuugguuugcugagaguuuuaauuaggguucacuuugcugcuaagacagcagcauuuaagcuacuagguucuuggcacaauauuguuuccauauuucuuuuucuuuccagaaggcuuaauuauuucuucaccugaauuuuaacaaccauuuuagcugaaugaucuagaaacuguccuccucaauguguguucugagucagcagcaucagcaucaccugugaacuguuagaaaugcagaaucucaggcccaccccaaccccacugaauuucuuagaagcugcauccaauggaagcaucuauaugaaccacacuuuugaguagcaaggaucuagaguucuugugcagaucucucucucucucucucucucucucucacacacacacacacacacacacacacacacuuucaaaaguauuuuauuuauauaaauguuuuugaucauugaauuaaaagaaaauaaugcaacauugaaaauauguauuuuuugagacagagucucacucugucacccaggcuggagugcagugaugccaucucaguucacugcagcuucuaccucacagguucuagugauucuccugucucagccucccguaauucagaauuacggaggcugaauuacagagccuccuguaauucagccucuccuggaauuacaggugcccaccaccacacccagcuaguuuuuguauuuuuaguagagacaggguuuuaccauguuggccaggcuggucucgaacuccugaccucaaaagauccacccgucucaguuucccaaauugcugggauuacaagcaugagccacugugccuggccaaaaauauuuucauaaugaagacucauaaauaaauaucacacaugucagugaaaaccaaaagcuuuuuucugucaucaagauuucaggauucuuuuuuuuuuuuuuuuuuuccagcuuuaagugccuauccuuuuugucugggaaggcugauuucuuuagcucuuuucuuucucugggaauaaugcauucgcauugcuaucguaguuauccuugcagcggugucagacuuuagcugcuuccuguagcucguucccugacaguguucauguagcgucuccuccuaaggcggcagccucgcuggguggauugagugguuaccuuggaucccuucaugcccgugcuaaucucacuccgugcucuucugugccuccaacuggaaugaaagcuucugggaguagagaccccguuuugcugucugcucucuccagcgccucaugaugucagauguagaauaauccuucacuauauuugcuguuucuggaauaguagagaccacaagguucugaaaaagaggccacugguucagaugagggcaaggcaguugcccagggguagauggcauaccuccuuggcgaaucugauuuugaaguccgugcccugaaucaccuccacgucccaccuugugccuggugaaugucagcccugcacuguuaaggugcuguagcggaugcugugaugugccaccguucagagaggcacucaggcugccagcuucugagcauggcuaccgaugugucauggcugggucccuccuucagccuggaaggagugcugugccccguguggaaggaaaccuccucgcccaagguuaugccucuccucucggggcaucccacauccaaugccugguugauguggggauacaaaggucugauccccuugcgucaaucugggacaacucugaugggccaucccaguuccagagcuccugugggacaggcugagcuccguugcagcugcaucgcaguuugccuucucucucugcccguuccugcgucuccacuccuuuguagguuguaucugaguacaugcacaucucucccucaggaucugcgcaacaguuaaaggugcacgcguuagugaaaccucgcaacacaucagugaccaggguuacaguucgcugacuacugaaucuggacuggaaccuuuuucaauucagugcuuuucugacuccaccacucugacucccucaagugcagugguucucaacagaggugacuuuguucuccaggugacauuuggcauugccuggggacuugagauuauuacuggcaucuaguggguagaggccagcguuguugcuaaauguccugcaaugcacaggacaguucccgcaggaacaauuaucuggccccaaaugucaggagugcugagguugagaaacucugcugaauguauggaugagcauuggucaccaagauagaggagaagaauucaauauugcucuuccauuauauuuuccuaggauguggacucuauguuuuagacaaucuuccguauuaaaacuaucaugugaauaaauguauuuuuguuacauauguuuucuggaguuuacauguauugguggacaacacauaagaagugcguagggucagagaaaugccacucgaggucauuauuuccacucaauugcucacuggggaaaaaacaaacaugaguucuauucuguaaucaguacugcuggcaacaguacugaucacuaagcacugugagaagcacauuucaguacaauacucuuguuguccuaaguucugugaccacuuuuccuagauuuucuguuuuucuugggauggaaauaauaaauacuuccucuugccuccucucagucuagaguaacaauaagggggacauguaaauccaggaauuucacaccaggauccuggagguuagcuuuccuguuuucuucuugccagucuuaugcauuacaugggaacucauaucuaucagcacaaaacucaguaaacgauuguugagcgaguaagucaggaccaacgcgucaaucacaugaugcaggaugcuguaucuaagcuugcacacuuacuuuaggaaacucaaauggaaaccccacucucaaauagucuaaucuaauuaccuuugguucuggaaagcagcauccaagaggaaagagauuguaaaauccucagaggaagcggggaaagugggucugagaagaggggacgagagccuaggagucagcagguagcucaaaggaugagauggaugucucucucugcuucuuuccaaucuuauggaauuucaggauauugguauucacuguugcugaugaccuagagaaugauacuucccauuaaugugaguuugaaaauaguuucuauccuugaauaaauuaugcuuggcaccgugcagaccaaaauagauucaaguuaugugaguuucauacuugaccaaaaagcaagaggcugcgcgucauucagagcugaccccgggcuggcaaugagagcucacagucuugcucuccugcuaauaccaagccccucagugcucagcaaaccccaaagucgccugggccugugaacuguguaaacuauccucccagacacuucggacuggagaucaagacaacuuugaaaaaucuuccgaaagggaacaugagguccaccuggccauaaagugccuucccugugucaccuuuuugcugucagcuuguggcucaaggauguuguccaaaacugcuggagcucacguuucaggcagagaugugugucucauguagcugggccuuucaauuuaugggaaauguuauaguuuaacuuuagccauuuucugggaucuauuuuaaaacuccuauauguggggagagacaaauuuaauguuuaacacaacauugcuuugacugucuuuugcuguacuauucaaaaauuaauguuacaugaauaggaacucaaacacagcugauaggaaaguaaauuagcaaaacuuccuccuggggauaauuuuuuaaauauccuuugaucuaaacauucuuuagaaaauuuaucuuaaggaaauaaucauagaugugguuaaauaucuagcuacagacaugauuguuacaguguugauugcaauaaugauuaauuauaagcaaccuaaacaucaagaaaagcaaggaguaauuaaauaauuuauuguacuguauggguaugguaugacuugugauacagcaguugagaaagauggagaggaccacuuaaugacaugaaaugauuuuuaauauuaagagaaacaagauuauagugauggggaaugaucccuguauauuuauucuaaaaauguagccaguaguuaucucugggugaagagauuaugagcaaguaauuuuuuuuauguguauuuuuaauauauucuacauugaauaggaguuacuuuuguaauauguaaaaaaaaaaguuacuaaaaauaagggugauguuugugaaacacauaaagaaacguacgcaaaucauaagugacagcuuacugaauucucacaaagugaguucaccuauauaacccaaaccaagcucaaacaggauagaccagguccccagaaaccccccuccucacccuccaccgccucuaacugcagaggggagugccuguuuuuuggaacuucauaugcagucauguguugcuuaacgaugggaacacauucugagaaauguuaugugcuagacuuugauaugacugacagugcagcggguuuguuuccaccagcaucaccaccaacaggugaguaaugcagugcacuacaucacaauggcuaugacauuucuaagccauaggacuuuuucagcuccauuaucaucuugugggcccaucauuguauauuuggcucaugacugcaauuggaauaauauaguaugucuccuucugaguucguggcugcuucugcucaacauuauauuugugaaucauucauauuguuucuuuuggcugcaguuuguucaauuucacugcuuuacagaguuccauuguuugcauauaccaccuuccauuuuacuguugauugauggacuuuuggguugucucugguuuggcacuauucugaauagugcugcugugaacauuguuuugguuaacaucagcgcauauuucuguuggggaguaccuaggaauggaaauacugauuuguaugguauguuucuguucagcuuucauagacacugccaaacaguuuucuggagugguuguaccaacacacacuuacacuucuauauuuuccagugcugaucacaagauuucuccaagauacuuucaacuuuccugaauuauuugaugcugucauauugggaauaauuuuuaucucuguuaguugaauaucaaauugauguucuagaaaacucuugagucauuaccuacauuuuuuaggugagugguguuugauggcucaagaugaaccuucucuuuccucagaacagcuuuaaguuucuuauacuucuugugauugaagagcaggugaccauguuuuucuucuaguaacugcauuauuugaauuuugagaguaucauacuuuuuuauuccacugaagagaaauuuauuuuuaaugaagcugcuuuuugaguaaaaaaugcuagaguggugugauuagaaaauacagaauccuuuucuuucuuuuguaaguguugucagcuuuaggagauuugaugaucuuauaagacaaccuuuuuuaaaaagucaguguccucccauuuagaaauaguugaugaacuccugggagaccagcaaucccuacugccagaaaauuuaguuccuauguugcuugcucgaucccagagccagaccauuuaccuagcucuggccagauagaaguggcugcuuguacagaaagaacaucggguggaauaacaaacucagaacauuggaugauccaacaaaagcuuuguguggaaggucuuucauuugaggcccuuaaauacauggaauaauuaaugaaggguggaaguuggggaacuuauuccuucuguuucuaccacacugcuguggguauccuucauccuuuaaacacuccuuuucgucucugagcauucacuggcuaagaacacagguccacagccucuuugacggcugcguugucuuuuccacguucuaaggaaaggcagucagucagucauacuaaagacugacucauguuguuuuuaaauauuaaagggcucuguuguugaggcagagccuaaccagucuucaguuuccugacuucuguuucugguccaguugcaaagaagccuuucuguaauuuucuguaauaugauuuguacuauguuuuucaucauggaaaauuaaauuucaaaacuuuacaaagcuguaguaagaaauauuugagaaguaggcuugggauggaggugugcacugaaugagaagggacaggaggguguccccagcuugugauaccaauguguggcuggagacagaggcucaguugccuggucuucgauguguucaggaagugcccugacggugagaggccuguccuggcugguuaacuuuaaggguggccuggccugcugcuuugcucacaagcaccugcaucucauggcagaugugcuucugauuugugauacaaaguaucuccuuguuugauuucuuggacuuagugugaacauguuuucuuaaggaguagguuuugggcagggcacauuacuaagucuuaaaaagcuuuuuuucucuacuauauaugaaaaaaaguccucucaacgccugccguauuuuacccagggacuuuuaaaaaaacccaacuauacccuuagguagaauagcuucuuccauugggguugugggaugggcgugggucuguaguccaugguuuguucugcucuaaaaucuuccaucuuugcugagaugacguauuuuugccuucuaacagaccuacaaaaccaugacacagacuugauuuguauaccuguuaugucagguaugauaaauguuaauguaauaauauugacucauuuauuuugccgauucauuacgggcugguuaaagugauaaacaaccauuaauuuuguuuuauuuccagagacaauuuauuauaagcagaacaaaagguuggcuuuuaacuacaccugcauaugcuauccucaggaaaauauuuauaguuuaguuaaucuuguuuaggccuaaaguaacugugguuuaaucacugaacaaacaagauaggacagcgugguggauaauugaaccaaaauucccauugagaugcaugggggcagacugcucccaugugguuucacagcccaagaaacugaaggguaguuuugaauccucauccucucuaggaugaggauugagaugagaagcauggcacuuugcccuuuauuucaguauauuuauccauacaccuacaagggacauaagauuuuggucaaacauuucuugauaauuguauauaaguugaaguuuuauauacagaaauuuucuugauaacagaaacauuucuugauaauuguauauaaguugaaguuuuauaauucaaauuguagguucagagcuggaagggaaucccagcauuugggaggcugaggcaggcagaucacaaggucaggaguucgagaccagccuggccagcauggcgaaacccugucucuacuaaaaauacaaaaauuagauggacgugguggcacgggccuguaaucccagcuacucaggaagcugaggcaggagaaucauuugaaccugggaggcggagguugcagugagccgagauugugccauugcacuccagccuggacgacagggcaagacucugucucaaaaaaaaaaaaaaaaaaaaaaaagagcuggaagggagagagugaagcacacugaagugaaaaacugauacccguuaggcuucaaggugaagcccagguacaccugcuucccuaguacaggcucucuucaugccgcaguguugcccuuuaaaaaccaacuuucucugauaauucuuuuuuuuuuuuuuuuuuuuuuugagauggagucucccucugucacccaggcuggagugcaauggcgugaucucagcucgcugcaaccucugccuccccaguucaagcaauucuucugccucagccucccaagaagcugagauuacaggcgccucccaugauguccggcuauguuuuguauuuuuaguagagacgggguuucaccaucuuggcugggcuggucuccugaccucaggugauccaccggccacuuccaaagugcuaggauuauaggcaugagccaccgcgcccaaccuucuccgauaauucuuaauaguuuagaaagcacugucagcuggguguuguggcaugcaccuguagccccagcuacucaggaggcugaggugggaggagcacuugaacccaggaguucgaggcugcagucagcuaugaucacaccacugcacccuagccugggcagcagaaugaaacccugucucuaaaaaugaacgaacaaaaaccaaacaaacaagcaaacaaacaaaccccacaaaacaacagcaacaacaaaauaauagaaagcacuauuuuauaugcugcuuuauauacuuuaguucuuacaaauaaauccaaaggucaauacauuguaaaaacaaagaacugugucaaaaaacauuccuaauauguuauugauuuauucagcaagcuuuuauggaacaccugcuaugugcuaggcauugugguaugcauugggaauacaaagccuuaaugauuuuaagcaccuguucugaagggaagacaguaagaaaagugaguguucagaguacacagugauaagguaugugauggaaaauguauccuucgaauguugugggagcguagaggggugguaguuggaauaaacgugaaggucuucccagaggaggugauauuugcauugaguuuugaaagacaacgaggaguuguucauaggaaggagggaaggaaggcaguucagacaagaagaacaauaugugagaaggccagugugaugauuuugagaacaccauucaacaugucuagagccuaggggaugaagagaugggugcuaggaggguaggagugguggcaaaugaugaggccagauagguaagcaguggcaaguuuguaaagagcacaccaguguacuccauuaagggguugggaguuuggccaucauucuaauggauggcaaaccauuugaaguaggugggcaacauggucagguuugaauuugagaguguucacccggaagccaguguugggggaauggugugcaagagauugagguggaggcugggggcagauauacaaguaauccagcccagagaagaaaagagccugcaccgagcaggcacaugauggagggcagaacaggacauuagagaaugagaaucuccuggacuugguagauugaauguggacucagggugagucuaaccacacagcucagcuuugagcuucccucagagccaaggggaggaguggguacuuuuagaaagaagagauuucauugauuuguucuguuuccccauuugcuaauauaugaagaggagugggcuuagugguggggaaugggagggaggcuaacgggcuguguuuggggaaggcugaguuuguggugcagguggguuggguuuucucagaggaaaugauacagaucacgcucucaggagcaugcuguggccuggagauagaggcuguggaucaucagcaugauugcccuguaaauuagaggauggggaugaaguagccuaggaagcgaguguaagugagaacuaggaccaaggauggauccuuggggaccacucauauuuaagugaugagccucaaaaggacacagaugcuggaggacaaccaggacagugauguuaugggggccagggaaggggagagcuucgagaagggaugcucaccagggccaaacacugccgaaggugcuuagcccagagucagugcucauaaacauuuguuacucuuuaguguuaggaugacagaggagagggaaaugaaugaggcuuggaguggucaggaaaagcaaugcaggaggagauaggauuuauuuauuuauuuauuuauuuauuuauuuauuugagauggagucucgcucugucacccaggcuggagugcaguggugcgagcucggcucgcugcaaccucugccucucggguucaagcgauucuccugcguuggcuucccaaguagcugggacuacaggcaugcaccaccaugcccggcuaauuuuuguauuuuucguacagacgggguuuugccaugucagccaggcuggucucgaacuccugaccucaggugauucaccugccuuggccucccaaagugcugggauuacaggcaugagccaccgcauccggccaggagauaggauuuaaauaaaggcuuuaaaauuuacguagguuuggauaauagagggaaggugggcaggcaucccagguuaagguaguaauuuagcguggucgcacacuagaagacuucucugaggcgugggaugggggaguuauuugcuuacaaguuguuaucuccacagauugacgcucagcucccugauggccaaggcaacugugugcuuuccuuugugucugucaaucauuguagcaagguuuuuggcccaaaguggucaguuaauagauacuagcuggaagcauugauaaggugggcgaaguuggugguucccggcaacugagugguaaaacucuacucucaggggucccuucuuguucagggaauguauuugcaucccucccuacuuaaaccauuuaagaaaaagaguguucuaguuugccuuuuuuaucugcacuuagguccccaucacuccuuuucuuuuccaaccccguucccucccuccuucccuuuuucucuuuuuuucuugccaauuucuuaucucucucuuccugcaauuccuauuuguauacucauucuuuaucagaaaguaccuagaagcugauaaagcuuguacuuaauccuuuauuuuaccuauaugcaaaauauugcuggcauccuuuugauugguggugauguucauugcgaaauauuuugaaucuuaaucuuggccuguauggggaaguagaauuagaaggagguaucagaggaacucucucucucacucccucucgcccucuuucucucucuuguguuuuaauaaauaucaaugcuauuaaauuugucagguaccauuauaaaaauaguugacauuaaaauugcaaacccuaaggugaauacgagagcugucugcauccugaugaggaagauucuuuacuuuccuagcuuccaugagucuuuaauuugaauauggauuuuaugaacagagucuaauaaaaaugcugggcuuuggcaucagaaaaacauggauaaggcucuuccucaguggugcucuaugggcaguuacugacccucacuggguuuuuaaaucuguaagucugguucagaagccagccucauaaggauuuugugaggauucacugaaauacuguuugcaaauuaccgaacacagggccuguaucauagucagaacugaagguucccuucuuucccuuacuucacauuuuuacuucaucuuucuuccucccccaucuuuuguccuuaauuagagcagagcauugaaaaucagucaaauaaucuuuuuaugcaggaaaagaacuuccuuccccuuauuuauuuaagaaucuggcuuugaguuugaguuggaaaguguccuugucuuaugguaugagaguuugggcuaucaucugugaccugcguuacugguuaccaggaaugauuauauaguugcuuauaaugggccacuuuagauuuuugcaagguauauuuguaucaucucugauucacaauucgagggauugccaaaaaaaaagggguaggguuuuucuugcauaguuacuguuuugguuggcacagaaugcagccuccucacccacccucuuuuugauuauagccaaugauuacauaacauuuucagaucagauuuuuuuuuuuuuuuuuuuuggaaagcuuuuggagacacguggcucuggaggaauccucauggaaucuuaaaacccugagggaauucaagaagaaaacuauuccacuugcuugccucuggcugcaucuauauuuaaauuaucuaagaaagauauugguaaauucuucuauuuuuaggaauuagaggagcuuccacuuuucucuuaaaaucaaauucaaagagcaacuuuuuugacaagcugaauagaucuuugaaguuaaugaacuggagcauagcuugcaacuccaucagugagguugaucaggagugaagcugccucaucagcuuagucucuuggaaguuaaauaguagaaagaacauuuggguuuugagaacaugaggaucuaguuuugcuguguauugugucuauugaugcauuccugggggauuuuucccccagagguauuuuauagcuuugauuuaauuuaauuuuauagcuuugauuugauuucaguguacuucaucugugggauuucauggggucuuguuaaggguguuucucuacagaguuguuuuaguguuuacuucugacaagugcuccaggacaucuuugaucugagaccacuuauguuaaucucuuauaaugaggguuccuagacuagaugguaggguagauuuucacaacccaaauggcagugagcuuccaauuaugaauuuucugggaggauuuuucuuuuuucuuucuuucuuuuucuacccagagcccauaaugaggccagcauccuugcacagggugugguagaugugugaaggucucuguuuuacaggagguacuugcuucucauuccacuccacuuuuugcagccaagauuaaacccucaacccucuuuggccaucaacuuccaagcuccugguuucucacccucauccuccuggggcuuccugagcaucagcacgugcuuagcagucacucuccccuuucuuuuuggccccggcauaucucauucucucucugagcccaaccaagcuuguaauaugauguuuauuauauuuuauccaacauuucuagguauuuuuucuugggaaaguuuccagguugucagguugacucugucugucaggucaaauagauggaaguugaaguuugaagauuuggguuaaaguacugguucugcuaauuguuucucuggcuuugcaugagugauucugucacucuuaaauuucaguuuucucaucuguaaagggagagggugcauaauaccucacagacccuuaauauacugaaaaguuuuccauguaagcaacuucacauugugaaaacagccuguagugcauguuguugacauccugcccaaguccccaugcggggcaaaugcucccauugcccagcgcuuguugaguguacauugcuaaggcucauagcugcugcuucucuggagaacugcauccaaaucccuaucccagacucugcuucuagggaagcuaaccuaaggcaucaucacaaugcuuccccccaaccccaaggaaucguaguucuuacaaagaugaauuacuuugaaaguuuagauagaauauaauaaaucagcaaaucaagaauaaaccaucugccauauuuuugaaauuaucuuuuugucauuuuaauuuuucacuugugagaacacaauguauauguaaguuuauuuaaggcucaauggagcaagacuuugauggaucugggcauaaaaguauggguaggaaagauuaucugcagcaacucaauucaaaauuaagggcuaagggcuucagagaucacuuuaagucacacauugauuucauuuucucucucucucaugcuguuucccucuauauggagaauuuuauauacacucucuuggcucuuaacuacagccagauuuguaagugacgagaauugagggccagggugggaggaaaugcuaauauauugucccagguuuuaugcuugggaagcaugaagaaauucaaagagaccaagguguucucaggaguaaacauaucccuucacccaaauaggcaagaacaauuuuagaacugaaaucgugaaaggggucuuagagcuuugagcagaacgguagacccagaaggaggcuauuuugguccccuugcuagcacagauuuugauucaauaucucugagcuucauuguuuuguaaggauuaaacaugccuguuagauugucuucuacaaggcucugaauaaaugguaauuauuuuauauuauugaugauggugaugguaugaacauuuuuauuauuaucaucauuuuuauuaucguuagagagugugucuuccuaauaaauccuguggcaggggcuggaguucugauuuuagagucuguggaauaagaugauacuguugcaauugcugacuuuucagauuauaguauuuucugccaaagaagccugguacuuuguagauccauagaaucucccuagaaucaagaguaauucuccuuccccucucucucaauccauuucuacucuccuucuuggaaaaggaagaaagaaaccuuaggcaugguaucaaacugaauuacaagaucuugauucucgguucuuaccauuccugggauauucuagagaccugguucuccuccauguuggccagaguccauauucauuuugggcaucaacccuaacagaaauuuauacauaaucuaucauuaguccugaugacuuuacuucuuaaacaccucuuaaguguuauuacuucuguccaacuccucuauuaacaccauuauagaagccacaaaauuaucucccguagguuucuguaguagucuucuaacuagcuuaccuauaucaacucagauuucaugcugaauguucucuccucuggagccagaauaaaauuuccaaaauguaaaucagauaaagccucccagcccccacaacucucccacacugcccccaaacccucagagguuuucccugacucccagaacuccuucaguguggcugaggaggcccuaccugcuccucuugcuucuccaucauuccucacuuuguucuggcucuggccacacaggccuucuugauuuuccccugcuacguccugcugcaggaccuuugcacaugcgggauucaccugggauagucugacauuacuuaaccccaacuuguccuucagaucucaggagagucuucccugaguugccuugugaaacucuuuccuagcacuccaucaucucccuggcuugauuaugcacuucgugcggccagagaauaugucugggguuugucuccacuguauccucaaggccuacaaugaccuggcacauaaggaccccguaaauguuuguuaagugaauaaauaaaagaaaugagggaaaugcaggaacugaagacagggcaacuggccuccuuuugaaaaacucuugcaacucaggacguggcuuguaugaaucucugagucauugucguaucaggagucagauggaguggccaauguagaaugcucucaucucagagauagagagagggaaaugguccuucucuucacauucgggaguuuacagcugauuguguuuauaaacccucccagcaagaugaugcccucuaaauguuccccucccccacucagcuccauauccccuguugucugucugcacugugugugugugagggggggucaugggccccucuuauuccaccugcuguaaggccacccuuggugacugcagugccacaugcaagggugaaguggucuggugcuccucugcguguuuacaaggcuuaauuaauaagugucccauguaaacagccugcaccauguacgugccauccuuacauuuccucccuaaacaggcaaggcuuucuggaaguguguuucaggggggagaagucaagcuggaauuuuaucauuuguuuuccaaugaguauuaaaaacauuugucuuuaagguuuaugugagaauaucauauacuggaaaugugauuucauauuauuuugaaaucagaguucagauucauaaaaucaauauuuaaugggaaacaugaaauuguaauuacuaagcacuuuuucggugugcuuacuauuuuuauauguaaauauauauauaaauauauauauacuucauuuuaugaaccaucuauaugguucauaaaaugaaaauauacuggcaaaauauauaaaauucuaauuuuugcauauaauauuuuuccaguauauaaaccauguauauauggauaugguucauaaaaugaaaauauacuugcaaacuauauaaaauucuaauuuucacauauaguauuuuuccagugugcugucccucuauguuugcauauuuauauuuuugaguuucacgugaugaaaauccuguaucugaggguugauaugcacauguacauaaaguagaccauuucguauagcuaagggcuucacauuuuucuucccauauaguuuuguuuauuuccaauuucacauuugaaggauauucuucaguauccccaagucauuaugcaauuugguuguuuauguaaauguccucaagggauucugaacgagaaauauuucacuguuuguuacguuguguagaaauguucacaaaucauguuaauuugaaaaagaauaggaaaugaauaaucugccugcaguuuugauuccaugaucaacuauccaaggucaacuggaaaaagccugagauguuggaaaauuaguggaaguuuuuguguuuuuguuuuguucuucuucuaaaagguauguagaaaaggcaugacauaaaaaggggagaaaaauucugucuuuaaaacucaguaucguaaaaggucauuugauuauaagugaaaaugacaauaaaauggugaggauuucuggaauaaguuucccagaauagagaguaccucucuuuuuaaggcuauucacauuuggagaggaaauugaaaguugauguaauuuuccaacagcauucagaauacgggcuuuaaaguuucauuuucuuaaacuuuucauaguccuucagaucauuuggcacuuuggaaauuuuaaauuuccucugcugugucuugaaaaguggugaaugauuggaacacccagauuaugaaggagguuagaacacagguuuuauaacuucaaaacauuuuucacauucuuaucucuacugaaaaacuuuauggagccugugaauagaggcuuuaacugcagaauucuaccuuaggugcucuuaagcaacugucggucuuuuucuauuaucuuuacagauguacuagagcuuauucaaggggaaaaaaagaugugggcucagcuuuacaggaacugggaggaccaguuucuuugcuggccuaaauauacauuuugagaaaucaaagggacgcuuuuuuuuuucuuuuguccaugcauauaguauaauugcggcuuaguuugaaaguagcccgugcuuuacuguuuauaaccugaaccaugucuauucaaagugaauuuugaggagaauauugaauuggauucaccuuuugguuguuguagacucaugcuaaaucagacuaaucuuuaggcauuugccucaugucgauauuauuuuaaaaguggucacuauccaagcuuagucuugaaacuuagaaggauuuaccuucccuaugccuuucuuuguuuuugagacagagucuugcucugucacccaggcuggagugcagcggugcgaucucaucucacugcaaccuccaccuccuggguucaagcaauucuccugccucagccucucaaguagcugggacuacaggcacacaccacuggcuuuuuuuuuuugguauuuuaguagagaugggguuucaccauguugcccagcagucuggucuugaacuccugaccucaagugaucugccugccucggccucccaaagugcugggauuacaggcgugagccaucgcacccggcccccuaugccuuucaaauucauuuuuaucuuagucuguugcuguaacagcaugccugagcugacucacuggucuggaggcugggaaguccgagauuguggggcugcauuuggugagggccuucuugcagcaucaaaacacggcagaaggcaucacauggcgaggaugcaagugcaugagauagagagcaagagagggagggcccaggcucauccuuugaucaggaacccacucccuugauaacugacccacucccacuauggcggcauuaaccuauucaugaggccagagcccccaugaccuggucaccucuuaaaggucccaccuuucaacacuguugcaagagcaauucaaucaauaugaguuguagaggggacauuaaaccacagcaguuuccuuuuaugucucucuuaaucucuguguauugaaaguagcuaaguauucaaguuucuaagguauaaaggaguggagcgaaggaaaaaucccccaaaagagggagaguuacuuugucaaagccuagaaaauaccucucuuaugagucuggucaguuccuccauuagcugcagagagugagaagcauuagccccuuuacugauacauuggauagacaacuggaaaaauacaucugauuaagccucugccacauugccuaauuggaauggagagaggcaacacugcucucaucauccuuaccucuuuaggccuucaaaggaggaaucaaggaauggaggaaaagccaggccuguggguuagugguuucaaucccaguucuccauuuaccaaccauguggucauuaacaaguucccugagcuuuuguuucuuucgagggauaauaaugaaguuaugagaauggaguguauauuugccuaguaugugugcaguaaauacugguuuuccucucucuucccucuggaaggucagcaagcaggucaggaguaggagacagggggcuggagcaguaagaugaacuaugccaggggcaacucagggugagacagugcgugguacauugacagauacagcuuugauuucuucagcaaggguguuagggggcuuggguaagaagcaagaaggaaaggcuguauuuucauauugggaaaucaugauaggguggccuguaaccagcuugggaugugucuaguacaucugaaagggauugcagaaucacccuggaugcuugugauauaacaagaugucagguguggauaucuaucgaugccgugguuuaaagaagggaaugggaauaagcccccugaacucacuuucuagcugagaagaaaccauccaggaaguagcaacaagacaccgccuuguucauagaacugaacuuugagcccuggucaaugaauacuuaacuguaggccacgaacagaagccgguggggaagccagggugggaggcagggcuggggcugguugggguuacggguaucagugguauggcuaagacauccaaggacaggcacccuugugcuggaguuuccaugggcauucuaagguggagaggaguaagagacauucgugguggaaucagugggucuccacacacagaaagggugcuccaggcaggccgugagggagccuagugccccucuuggggacauucgcuuuucuuacccagucacuuauguucuguggcuuugggaccagcaagagcaacagacacccuauuccuccacccucauaggcgaauguuuuccuuccuuuacuuuucuuaaaaauacuuuuuaccagcauaagauccuaaacaugaccccuuuccuaggagagauggcuuuugccugcuugugaggggggugggcuuucuacuccugcccuggcagccgccacccuuuaccugggauggggauaggugggugggaggcuuucuugccccaccccuaguagcauauggcuuuugccucaugcugaagcagggucagguguggaaugugggcagguuucugucccuccccagcaggagauggcuuuugcuugauauaaauuaaagaagcguugggauauggguggauuuaauaccaccuguuauggacugaauguucuagugucuccccaaauucauauguugaagcuucagcccccaaugucaugguauuuggaggcagagccuuugggaggugauuagguuuagaugaaaucauggagauggagcccucaugaugggauuagugccuuuauuagaagaagaacagacaccagaacucccucucuucagcaugugaggacacagugagaagguggccaucugcaagccaggaagagagcccucaccaggaauugaaucugcugggccuuugaucuuggacuuccccaccuccagaaugaugagaaguaaauaucuguuguguaagccacccggucuaugguauuuuguuauagcagcccaugcugacuaagacacugucccucacuggcaacuaaucaucaccuuguacucgagcgaggccugaagugcagaugggcuugucaggaaacuccugucaccaacucaaaccucagcagggccugugcccugagcacagcucacucaggccuuuggcacuguccucagaguuucucaggggaguucagaguccuguggaaaaagaguaggcaguagggacagacuucucguguuuggggaucucagaagucuuaaucugucacacuaaaccacacggaauuucuuaaaaccuuaguuuuuuguuuuuuuuuuuuuucucaccugcuuuucuugcugccaccucuuucucccauacacugucaaagcugaaacagugcuuguguccuuucuuccucagaggugcgugucacccuuugaaagucaguucaguugguugccuuuccaucucaacacucuaacgugcucaaaaaauuagauuuuguggauuaucugcuuuucuuauuguuagggcaggagugguggcauucucuggcagucuucuguauccuuagcagaaacagaacugggaaggguauuuggaaaguagaagcuaggagcuaggugugcugauugccucugagguaucauuguuuauagcaguccuacguuuucagauuaucucaaccugcuggaagcuucucugucuuuugaauaccuuugccauucauguacauacccaucagugagucucaggguuggaagacaccauaaaugccacuucauccaaagccacaguuuagucuccaguucacauguacugccuuguggcaucauuccagugguugucuuaaucuuuuuuuuaaauauuauauuguucagcccaguguguauacauauccauccucaccccaauucugcugcuggauauaaauuggcagcugcaacaguaucauguacagaaaguugguaucaauuugagagggaaggaguguucucugcuggaggacagggaggagacagagccaucuuaucuguuuuucccacauuuuaaaaugcauugccaaagucaauuuuaggaugcaguuggguuaaauuaguagcuagaagauaaaacccaguagccagaagcaagcugaacauuaaaacuuugggacucugaccacaguauugaacauuauggcugaccaucaugggguuaaaagguuaggaagagaguggaccaguagccauauauuuuuagccugcuuagaauuauaguugccuuuggaaauuuuugguaaacucccauagaucaggauuagaauaaaggccauaaauaugguucaaaaacuguacuuucaacacuucauuauaugguuugcuauuggcuuuagugguagugcauuaucugaauugauguaaauaguauuuaaguuugucuuuuccuaugaguaauaaguauuguauguagauauuuccguuucuauuacuuaaauagauccccacaguaguuugguacauaguugccaugcacauaauuacugcauggcuauuauuaggaaaauuguguggguaaaauccauccugcuauuuggcucuguuugaaccuugaugcccaucugcuaagcaauguggggucaaaauaaguaccaggguaguucuggccuuggccuuuuuggaugugggcucaacucucuuuucucucuacagucccuaaaacuauaauacaaggugucaccagagaggaagagcaauuuuuuuuaaaaagccuauaaaauuauuacuaccagcaccauacauugccagugaaccugacucugguguuaaaacuacuucucaaauaguaucccuucauaucuauccuuaugaauuacagauuaucagcuaaaauacaaaauaauuccccaaagaaaguugggaguauuguauacuaauuaaucugcaucaagucauaaaagaaauugacauauguaaggugaugacauugaguuuuuccaagcuggcauuuucaaguuuuaugaaagguacaccaguuuaucauauacauugauuuaaugugauuauuauaucagcuaucuauugccacaauaauaauaaugcuguguaacaaacaaccaccaaagcccacuggcauacaaaggauacaucgauuauugcucaugaucuaugggucagcugggcaguucuucuggucuuaccugggggacuuacuuauguguuaugacuccccagcugguuggucugggaguaguuggcucaccuguacaugguccuucaucuuccaacagacaaaccuaggcuuguucuuuuagugaugccuggguauuaugagaguggaaaggcagaggcuauaugaggccuaagcucaaaaccagcacaccguuucuucucugcacaccacagcaagccacaagucuagcccagauucaaaaaaugaggaaagagacucugcuucucaaugucuuauagcaaaaaguauggaugucggaaugggugagaauuggcgccauuuuaaaaauuggucucauucugguuacucuggcugcuuagcacauucccuaaaacuuagugacaugaagcuaucuuauuuuguucacagcuuugugguuuaggcauuugggaagggcucagcuuggcaguucucauuugggagucacuuggcucacccacauggauagcaguuggugucuacacauggcuuuugcagcauuugaguagucagacuuucagcaugacagguggcuucccucagaaugagugucccaagggaaccaggcagaagcuguaggacucgugugaugcagucuuggaagcugcgggucuucacuuccaguaacuucuauugcuaacaaacaagccauuaguaagcccgaauucaaagggaggcaaaauacaucucaccucuuggugcaaggagugucagagagguugcaggcauguuuuaaaaucuccguuaaucuaccacgauuauucauggagagacaucaguucccucauucugcaaugucaggucacagugcuaugaucuuuaacauucaccauucacauuaaauagugcauuugcaauuuguauuugcagauuuuuuuuucuuucuuuguauaguucuguauauuuaaaaguaauccaggaaaugauuaaggguagcuauuuauuuaauuccaaauuuucagugaucuuuaagaaaaugcauacaugcauacuuucuauauuguuuaauuagugcauguaucugcacucuguuuuuucaagccauuuuguacacacaugcuuagagaaaacacaaaaaugcuuguaauuuuaacaauauccaugaguucaucaagauaauauaucauaauuugcuuagcaguuuccaaguuugaguaccucuguuauuauaauuacacuaacuugauagcaccacguauugguuauuuauugcaauguaacaaauuaucccaaaacauaacaucuuaaagcaauaaacauuuacuaucucaugcaguuucugggggucaggaauccaagaguggcuuagcugcucauuaggucucucaugagguugcagucaagcuguugccuggggcugcagucucaucugagggcuucacuggggcuggaggauccacucccaacuucacucacauggcagccagcaggagacuucaguuucuggccacaugggucuccccauaggggugcucaugacaugguagcugacuuccccuggaaugagugaugagagaaagagagagagagcccucaaaugcaagucauguuuuuuauaaccuaaucuuggaaguaauauaguuuaacuucugccauauuuuauuggucgcacagaccaauccugauacagcaugggagaggacuguucaugggugugaauggcaggagguggggaucacugacaggucgucuucgagccuggauacuacacauugcuauaaacaucuuucaaaaaauuccuuuuuauugguaaaugauaagggggcauuuacuuuuagcauaucccccaaugcagaauuaucggaucauacagaucaacaauuuaauagugccccuuuuucauguuaagguauucauguauauauacacacauguauguacacacacacauguauuuacauuguaagauuuucuuauguguuuguauuuuauauuuuuauguaauuauucuuaugguuuuaaugugcacauaaaauucucuacauuuuacaaagcauguaguugcuagcaaaauuccaguaagugcccucaguuggcuaugguuugggaugggaaaugagagagggaaacugcugaguccuauuaucucccagaacccuuuuuuucuuuuaaauuuugugccugguuucuauaaauuaggccauacugcccccaaccuaauauaagccauugccaccaauaguuccuauaacagaauaauuuuuuuuuuuuuugagacagagucuugcucuguugcccaggcuggagugcaguggcacgaucucagcucaccgcaaccuccaccucccggguucaagugauucuccugcgucagccucccgaguagcugggauuacaggcgccugccaccgugccuggcuaauuuuuguauuuuuaguagagaugggguuucaccauguuggccaagcuggucucaaacuccugaccuugugauccacccaccuuggccucccaaagugcugggauuacagaagugagccaccguguccagcccagaagaaauuuuaauuggcaagaaacuugaccauuacgaaauagaauguguccuucaccauuuaugcugaauuucaguugugccaucuuuauauuucugaggcaauguaaagcaaaccugcuguagaccaggauacugaaagggccauucuauaucaggcaauuuuugaagccuuuauuacaaucugugaacuaauuuaauauguuauaaaugaauacucaauuaauagucauacauuuugaguccacacccccccuuugccauuuauaugagauaaaauauaacuguuucauuuucaugucuguaaaaaucuuuucggccuuuccaggaacccaucuggaugcauuuacacgaugcacuuuccaucauuucaaaauuuauuaaauuuuauagcaccuuccauguuaugggcgcucaauaaauugccaucaccaaguuaaaugaugggguaauaaggacaggacucugguuguucacacuaaugacacaguuugcauugaugaugaaguccccagaacagagggcaggaggagccaccuguaugaggaguguguggggaggagcuguccuuuacagcccgcuguaaggaucaugcuguacaaauaaaccuaacugugugggugguccuuucucugcccccuucugcuuuuagagacuuagaagagcugccaaaguaccuauaggagguguuugauuuaaaaggaaacacaccaguuaugccuucuuguaggggcaugugagccaguagaguuugcagcugcauggagagaugaagcaaaacucugaacauucaacugcauuaaaaaaaaaaucaugccaagagggccuuugagcaagaaauucuugcagauuuaugacacccgaugccugaacucugugugugacaucaggguuauggcucuguaagcucuuaacccugcagcugacccagucagcuucuggcuguacuagggguugaugcgguucacugugguuguuuguagaccucagaaaagcacgaugauuauuuacagauuuccagaaucucuacuggauucuuugcuuuuccuuucucacaaggaaacuuuccaggauacagagcacaacaggaucugaauggcagugaauucucuuuaacauaucucuucagggugaugggggcuucacugguauagaggggucagggucagccccuguuguuucugcuuauggguuggagacccccuauaugugcaagaaauacacuaagccaacuuacuccauuaaugaugauagcauggcuuuguauauuaggaugugugugcauaugugaaugauaggauauacguuaauaguuuguaauaauaaaagauugaaagcaacauaaaucugcauuaaagacacuuauuaaaaaaaccgugguauauccacacaauggaauacuaugcagcuauaaacaagaugcaccaauauggaaugaacuccaacacuuacuuguaaaaagcaagguacaaaguagagcauauacaugaauauugauugucuuuaaagaaaaggaaagagggagaauaugcuuguuugcuuaaauaguauaacauuugucuggaaggcuagauaagaagcuaauaguauuaguugccucuagggaggaaacugaggaguuggaggacacacauggaagggaugcuguucacuguacagccuucuaugccuuuugaauauugagcugaauaaauaaaauauugaaagaagacaguguuggaauaaggccuggggaauugaagcuugggguggaggugacaagugaaccccaagagggcaggaagccaagccucugccccacuccccugcuuuuuuuuaaccauacggucccaguguagauguagcuagcacauguagauccucaauaaauauuuguuaacugaaaaaauacauaccacauggaaaaaucacccuuuaauuuuaauguguauauuacauacuuaaaaauaucauugccauuaaauaugaaaauugucuugaccagaaagaaaaacaaaaacaaaaaaagaguucagaacaaauaguggucuuggucaggagaaaaugaguucggguuuggauacauuauuuuuaucaguguuucucauguuuuuccuauucugugugaacuccugucuucagauuuaaauaguugauuauaugaacugaaauuguagaaugggagaauuuuauugcuaaucagauuauccuaggcuuugugguuagagacaggcugugaguccugagucugcuuuucuuuucauuauacucagcuucccaccuuuuuucuuaucuuccugucugggacauuucauugcuuaugagcuacagaccugauguguuucaugccaaagcauaaacucuuuaagggagauuggcugugaccuacacggcacccacauucugcaacacgggauuguugggugccucaggaugggccagcugggguguagauagagcacuugaaauuacacacuguguuguuuucacugggauuugcacacuugaguuaaaauucucagaugucaagaaaagcaaaccaauguuuuguaaugcaccacaguccccugauuggucucaagcagugaauugcagccacauggucaccaugaggaggaggaugaaugacagcugauaucaacaugaucauuucaggagaaauaugacuagacacccagagagacaaguggauuaugcaaagaggggaacccuugcacccacuugagaagugugucucaguuuggggaagaauaauuaaauuccaaauugagcauguuacugaaaggagagacaggauaaaaagcaacuaucuuuagaccccugaugagggcauuucuacaaagccuaauguguaaaagaaguuaauagaauucuauacaacauaguaaauagcugguuccuauuaaaagaaaaguuuucugagaaaccaaaacccaacaaaagagucaugcccucaaguauaugugcauggacuugugaggagugaguuguaaaguauuaagcaauuaagguuuauauccacuuacuuacauauaagaaaaccaaagcugaguuuaaauggcuaugauaucggagaaacagagaauaggauauggaacauuuauuuccuuuuuuuguauuuaaaauuuuuuuucaacaaacagcugaauguuacacucauuuguggaguaacaaauggucccuggaaugaauauaucucucuuuugagcuuucuauuuggauaauagaguugccacaaaccauuacccccaacagaugcaguccuaucuucccuugaagucauggcccuuaaggucuuaaauuuggcacuguaagaguuaacagggaaagcuguaaacauccagauucccgggccccacuccugguuaucaagauugaguaaauugggauuggaguccagagauaggaauaguuuugaaguaugcuaggagauuuuggugcagguggcacguggccuacucuuucagaaaccccuuuccaguguuucuguuuguuuguuuauuuuugguuuugguuuggcuaaauaaaggcuaacuuucacuagaaagcaaagccaagaaauacuaaagcuggggucagcaaaccuuuggcugugggccaaaucuagcccuucuuuuauuuuuguaaauacugcuuuauuggaacgcagccaugcacauuugcuuagguauuguugaugaaaagagucaaacucuguaaaauauuugaagagauuuauucugagccaaauaugagugaccauggcccaugacacagcccacaggauguccugagaacacgugcccaagguggucggggugcagcuugguuuuauacauuuagggagacaugagauugaaaucagguacauuaagaaauacauugguuggguucagaaagucaggacaacuggaaggggugggggagcuuccaggcuauagguagauuuacauuuucuguugacaauugguugaguuuaucuaaagaccugggaucaauagaaaggaaaugucuggguuaagauaaaggauuaugaagaccagaguucuuauuugcagaggaagccuucagguaguacgcuucagagauaauagguuguaaaguguuucuuaugagaccuaaggucuguguugagaugaaugcuggagaaguaucaugaggcauguccuacuuccaucacggccugaaccagucucagguuaaauuuuaagagugcccugguugaagaggaaguucauucagacagaugggggaccuuaggauuuuauuuguaauuuacaguauagucuguggcugcugucacacuacaaugacagaguugagugauugcaaaagagaccgcaaaaccuaaaauauuuacuaucugacccuuuacagaaaguuugccaaccaccugcuaaaggaugaacauuuaccugauguguuacauuuacuccccuuagaacaaauaagaccuucaccaggagacuuugauacuuugcuagucugucggaagucugucuccaauagccacauaugauaaaaugagcuagaauggagcacguucaaaacacaagauugaagugaaguggcauacaucuugcagucgacgaugugucuuaggccacugaaauaaaugauuucauuuuauuugccaaagugugacuuggggugaaggagacaccuggccuggccucgugcuagauuggacccucgauguguacacacgacuuguucuaauaucacuuuucauuggaaguagacaggugcaauuaaguaaccuagagaaggggguaaaacacaggucuucauuuucccauugagagagaacucugucccuaauucaguuggugggaaauggauuucuuggcuuugauaauuaagcuggcaaagcaaauuugguuccaacauuuuaaugagccaguguggguggccaacaaauugcagguucagacguaaauguuucaaaccuggguggcuggcuuuuaacccuggggcaaauucuaugaugguaaggaaauuuuaggcugguagccaaguucaaagagucuuugccaaauauuaagaaaaaugccuauuugaggcaauuuuaaguuauuugaggacaggauuauguuguucauuggaugugauugagaugauaaauuaacaucauuugaguccacucaaauuguauacuugugaacauucauaccuguguuuuugugucugaacuucauacacagaggauuaucuugaaagagagggagacaugagaaaggagaaaguggucuugcuccucucuuccugcuuuccagugcccaacugcuaagguauucaggccugguuuucugucuggggauaaucaaaaucuggguucuuauguaauguaagaccacucuuuggggaaaaaaaugaguucagaccugagaaaugaaggguuaauacucauugaauuuucacuuucauggagaggcugcauuugaagcaaaaccccgcugggcucugugagcgaacuuugcaucacaaagguagggcagauuugcagaagaaaguaauagauuucaauuuagguugcuuuucagccugaaaaauagucugaauucuauuacugauccuguuagcagagauaauaaugaaaugcaaagcaaguaugguuuaaauguuaaaaaaaaacaaaaacaaaacuuguaaaaauaccacuguggguucuugauuuaugcuuucucauuacucaguaggacaaaauacgauuugacauaauguucacugugugguuacccuggggucagaaaacuaagcccuguuaccuaauacuucuuacauuugcaaaaguaaucacgacugugacucgaaucggacuggaaaaucuauugacuuagagauagaaagauauuaggaaucucuuacguuacuuuuucuuauucaccuacugacaacuuauacagacuuuguaacuuuucugaugaaaggguauccagguggauaauuacguauuuuaugcucuuaaacaaguuaagaacuggaguuguauuuuuugcuauuguuuuuaaaagucaauauguuguggcuguuaaaaagcauuauuuuguguauguaucacuaauaacuuauguuagcacauaaugaguaugaccaucaagaucaguaacacucucuucuuucauuguaccaaacauaauguagccugccuggaaucuuuuuguguaugaaaaagaaaaaaauagcaucuuccauuggaaguucugguuaagaguagccuuauuaucuacaccuccuuccaugaaacucugcuucugauuuccuaacucuucuggggguuuauacccuucagcuuuuuccacgagcugcuauuucuuucuagaaugcuccgaaggcccaucuguacccaugggggccucucucuccgggugccagcuuaguuucagguuguucacaucguauuaucuguguuccccuguuccucuagguagcuaaaggucaggucuggcuccuuuguguugcagagccuggcaugcaguaggugcuuagugacaaccguuugaggauaucgacauacuaaaauccucuaaucuuuuuccuuuaaauauacuuauucagaaauaauuacaaacuuauggaaaaauugcaagaauauaacaaaaaauucccauaugcccucacucagaugccacaaaacucaagguaaucauacuuguuuucucucucucaagacacgugugugugugcauauacacauucucuuucuguauaucauuauuauuuaauuuucugaacuauaugaaaguugguuguugacacagugccucauuuaccucucaaacuuguucucccucuaaaaaucuguuuucuaaaagauucagaauucucuuuuaccuaaccacagaacaaccaucaaaaucaggauauuaaccucgauauaacucuacuauugaaugcauaaaccccauuaaaaauucacugauuaucccaggccgggcacgguggcucaugccugugaucccagcacuuugggaggccgaggcaggcggaucacgaggucaggagaucaagaccauccuggcuaacacgaugaaaccccgucucuacuaaaaauacaaaaaaaaauuagccagguguggugguggccgccuguaaucccagcuacucaggaggcugaggcaggagaauggcgugaaccugggagguggagcuugcagugagcugagaucgcaccacugcacuccagccugggcaacagagcgagacuccaucucaaaaaaaaaaaaaaaaucauugaguaucucaauaaugucuuguauagauagaucuacaaucugauccaggaucauguauuacauguaauugucauguaguauuuuuuuuuaauuccuuuuuuuuuuuuuuuuuuugagacggagucuuacucugucacccaggcuggagugcaguggcaugaucucggcucacugcaaccuccaccucccagguucaagcaauucuccugccucagccucccaaguagcugggauuacaggagcccacuaccacgcccagcuaauuuuguguauuuucaguagagucgggguuuugccauguuggauaggcuggucuccaacuccugaccucaggugauccaccugccucagccucccaaagugcugggauuacaggcaugagccaccgcaccuggcuguauuuuuuuuuuuaagucuaauccaauaacguuguagaauuaccuugucccuuaauuugguaguguuggauguuuccucauaguuagaugcaaauuaugcugucuuuuuuguagaaauaaauggugcagaagggaggcugaguucucagugcaucauguuagcaaguacgugaggcugacuugucuuaucacuggugguauuaacuuuuaucacuucaauaaaauggcaucugccaaguuucuacaugauaaauucaaguaacaaguauuuggugcuuaguaacuaacagguaguuaauaaauauuuuauaaggagccacuaaaaacuauguaaauauucuguucuucauuagaauuuuaucuacccauuuuagcauccguugaugauucucgucagaaucaauuauuaccaaauggaugccauuauuaccaaauuggugccaaauggugauuuucuaccuucucauucuuuguagauuuauaaguugguauuccacugugaaguagaaguuuuucucccccguuuacuuauuauucauucauuuaucuuuaucaguacagauucauggcaucuuacuugauucaauggucuauauuccauuacuaucagcauuuauuuugaugcucaaguuuucccagauuuggccagugggaaucucaucaacuugugucuuguguucuuucuacauguccccgucauccuuugagcgguucccuuacuuuauaauaaaacaagauguuucagacucaccuuuuauguucccugcacuauaaucagcuauuucuuuaaggcugucugguuuuuuuuaguagagaauaguguuuauuaaccaagaucugggugcuguguuugcacauugcuacuggaagguugcugcuucuagggaacagagauagaaaaauauuugaguguauacacgugcacacacacgucuauaucaauuucuagaugucugucuauacuugaaaaaucuuaugcuuacauugguauuccaauccuaaucuaacacucuagguuuguucuacucuuuccucuuuccauauuuauaacucccucuuugagaagaaacugaccuauguuguugucaauauacuuacauuuuugcucaagccucuguguacacccaauucucacacuuaugggcugccuccuuugcucugauccacuggcccugaccccaaaaagacgugauaauucuuaauuggcaagauagaugaaacugaaguaaggagagaaagagacugaauguauagaaagagaaaugagagagagagaauauaguauucugcauagucuguaaaaccaagccccaugcauugucucaaggcagguuuuugacuucuacagccucaguagccaugagguaugaaauaucucugucggggaauaugaguaauuugccauuucuucaaugauacaaacaaaccugauuucccuuauuuugggaggggguuugugaucucaaaugugaagcauaguuaauaaggauaaaacguuacuuuugcauugaaagcaaaaaucuuaguggaagaacuugaaaaggcaaacuauauauauuauggauagugcaaacauuucuguguguguguaaagaauaaauaagauuuuaauuguuuuuauuaauaaauuaaauaaccuaaccaguaaaaagugcuaauagagcugauguaauguauuuacagcucuuacuuaccuggcucuuaaaugacuuggguguguuuguauuuguggguaaguggguauaugugcacauguggacacacacugagagugguguguuuccccacaucugucuacaucaccagagagguagagauaauuuccuuuaguuuuagaagagggacuuggcagagacuacucuuuuaguugaaaaauguaaaauaucacaugaaguguugauuuuuggagugcuuuucuugcauaacuacaugcuuuuucagacuacagaaagguuaaugacaaaaucugaaagaaugauuuagaaagauuuuuaucuaaauaaagcaaacuagaaagaaaggaaguuuaucacugacauuauaaaaguuacccuugggaaaauaguuaccuauaaauuaaucuguggcccuuugcucuaagaaugccuuuuauaucuccagcuaacaucagaucuucuugaaaucaauaguaaucugauugccuccagagaacaguugcccuccuguguuuuaagccacagaggaacuguacauuuuugugauaagcauaauuuagaggagaauuauauuuucuuucuuaaucuauuaccuacuggugcugccuuauccuguuacucacauuuccuuuucaucauuaaguugauagcacagaaaaagaaaugugauauuaguauugguagcaguguaccuuaauuuggaaggguaggaaauaauagcuuucuuaaacuguaccucauguguuacaaagauuagcccccgugucuaggguaucaguuaacauugcucucugguggauuuuaucuuguguucuguagacugcgaagagauuuuuauagaauuuuagaugcagaaugaaugaaaggagaaaaaucaccuucaguugaugaugcaggauguucgaugcuauuccuccuccagguagacuucuagucuuccacuauuugucugcaagcaauuuucgugucacuuauaaauaaucaaaaaacggaauccauguuagguuuaaagaaaggauuuaggaaucugagcacggcuuugacugauacaaggagauaacagaaaaagcugaaauagaggaaggaaaugagaguggaggacuaauaauagcaggaaaauuugaagauauaguuaauguucugagaauuuuuccacugcaacucaacuauuaggcuuguuaggagcaucugaguguauuuagcuucaugaacuucaacucauauuucuggacgccuaaguucaaguuauguugaagaagcaugcucagauggucuggagaaguuagguguugaggguugaaucacaggaauguguuggauaacccuggguguuaccuagcuuugaaaagaagaugauucaggccaagaucuaugucccagucacuaggugauugugcaguauagguacaguaagagacauuuccuuggccuccugcucaacaagcucagagccaauguacaguacuuggucagcaaaacaagagucuucuuugaagacuuagacugugcaguauaagaaacuugcugcuauuggagagcuuuggagauccaccucugggagggguggauaccauucugacacauccaaucaccaucaucaguagagaucacugauacauugaagaggugugagcuacugggagaugguuuuugcuaggagguuuacucauuauuuauuuucacuaccgcugagucaaauucaauggggguagaugguauuuucuuucuuuuuuuuuuuuuuuuuauuauacucuaaguuuuaggguacaugugcacauugugcagguuaguuacauauguauacaugugccaugcuggugcgcugcacccacuaacgugucaucuagcauuagguauaucucccaaugcuaucccuccccccucccccgaccccaccacaguccccagagugugauuuuccccuuccuguguccaugugaucucauuguucaauucccaccuaugagugagaauaugcgguguuugguuuuuuguucuugcgauaguuuacugagaaugaugguuuccaauuucauccaugucccuacaaaggacaugaacucaucauuuuuuauggcugcauaguauuccaugguguauaugugccacauuuucuuaaguacagaaucuggucaauagaguuuccugggucacuugaaucaugguuaccuguggcaugguaugggggugagagguggggugacacauccccuuucuagacuugagagacaggcaguggacaccaaaagugggagggauguggguuggcagucugacuaauauguccccugaugauaggccagcacauucuguuauuucgguuggaggcugaaguuauuuugcugggcaggcuguauuuaaauugcuuguuuggcuucaguaguggcaaagauaggaacacagguccuuugugcauccccuuuggaggagcacauuguuaauuaaacagugggugccuacuuacccaaaaaagcauugaaguuagauacaaaacauuuuuaagccuaggacuugagccauguaggcacuuaaagagaagucuaauccuuggcauagcuggcaaauacuuuauggcuuauugucuguacuuuccugagucucaagcaccuccuggaguucacaagcuaucugaaauugcccaggaagaaguucugguaaugcauuaugggaccauccaucuuuccacggaucugcugguauacaaaucucaagagagcaagauauuggcguaacauugccaugagcucaacagaagcugacucagcugccuuuaugcccaaaggaagaguucucagccuaauagaugcagaagagagugaccagcuucuccauguuuucccaugguggggggaggagaaggcucuagaauaauguggcaucugggaaaagaggaaauacagggaagguuggccucagugugaauuucuacaagggggaaauaccucccucauuugaauuaugagaagcagaguuguagguagggguguugcaggaauaggguugaggagggggcagauagagcuauuaagaggugucacaaagagacacugagagcugcuaguccugcaagauaucauggaaugagucaagauugggaccuggaaaucagagacaagagcaugaauuugacaguggauagauaaaugaguucugucuaagagcauccuguuuuguuuuguuuugaaauggagccuugcacucugucacccaggcuggagucaguggugcaaucuccacccacugcagccuccgccucccagguucaagccauucuucugccucagccucccaaguagcugguacuacaggcaugugccaccaugccgggcuaauuuuuguacuuuuaguagagaugggguuucgccauguuggccaggcuggucuugaacuccugaccucaggugauccaccugccucggccucccaaagugcugggaucacaggcaugagccauggugcccaggcuccuguuuuuauucaucauguuuuuuuuuuuaaaugaauuaacuacauagguuauagaauauucacuugauugucauuauacaaaaaugacauguacuuuuuauauugaauuguucacaguuuuguucuucuuugaacacuauucuuccuagauaccuaaacuucaugagccauuucaauuuucugggcaaucauuggcauggucuaacuuucaacuuuauguaccuguauuaguuuucuaugcugcuguaacaaauugucacaaauuaaguggcuuaaaacaauccacauaccaugggcuaaaaucaaggggccaggagggcugcuuuccuuucuggaaguucuagggcagaaucuguuuccuugccuuuucagcuucuaaagggcugccugcauuccuuggcucaugcccccuaauaccaucuucaaagccaacaaagucagguucagugccucucauguugcaucuuacugacccugcucccaucaucacagcucagucccugacuuucuguucugccucucugugauuacaucgggcccaccuagauaauccaggauaaucuccugaagucucuuuugccaugcaagguaauacauucacagguucugggaguuaggccauaaacaucauugagggccauuauucuaccuaccaauaaauaagggcauuguugauaccgccugaaaugcagaagaugcuuguuguucuauagugcaugugguuuauguaugacauaaaguaugacucacuuugggguacgcuggcaaauggacuuuuggacaguuccaauuaucaucagaauagauuugcuaauuuaauucuacuuuuuagaguggaauuagauucugaaguuuuaaaauuacgugagauuuguucuucuaacagaggagucuguagccuuucauugaaaaaagaagagucuggggccggccgcggugguucacaccuguaaucccagcacuuugggaggcagagauggccucacuugaggucaggacuuugagacuagcuggacaucauagugaaaccuugucucuacuaaaaauacaaagauuagccaggcaugguggcgcaugccuguaaucccaacucaggaggcugaggcaggagaauugcuugaauccaggagguggagauugcaaugagcugagaucacaccacugcacuccagcucggacaacagagcaagauucugucucaaaaaaggaaaaaaaaaaagcgucuaaacucccgaagagaggauucagugagaauauuagucaugauccuggcuugccauuuucuuaacuuugaaauuauucuaguuuguaaaaaaaaaaaaaaaaaaccaacaacaaaaacacuaauugugaauuagauuguacucuguauucauuaaaagaaaaacuugacaugauauuuagaugaacauaugcgguuuacuaaaacagaugguagagaauuuuuacccucaagcauguauuuuuaaaaguguguuuuuguuuuuaugacuuuuugaagugauuggauuaaggagaguaagaaauucuuccuauaacaaucuauuuucauuuguucuuuuuggagaaaaaaagcuuuuucauagagguugucaaauguugccauauguuuaagaaugaauuugaaccauucacuuucugaaucuuaaucccuucugaauuauacguaauuugacagaagucaaauauguugacuucugucaaauauauauauuugucaaauauaucugucaggauauaugacgucugucaaauuacguauuuguucaacuuaggucugauaguggaugcuccuaaguacuuuguuagucuauauuauuuauuuauuuauuuauuuauuuauuuacaaagaacacuauaauugugcucuuucacugguuuuuauuuuaaugccugacuugaggucaagaauuauguguagaaagagcacagacagaacaaaaucauaaguuaauaaugccguuauauuacuggaaaaauuaagcaugcagagcuaguuauagcaguauaauauuuugggaaaauauuuaaauuaucguaugcuccuuagguuuuaaaaaccuauguuucauucacuuaagacaagcagauaaugugcuauuaagagcacagacucuggaaccagauugccuggguuaaaauucuuggcucucacuuucuagauuuauguccuuggcagguuacuuggcaccacuugguuucacuuuucucaccuguaaaauggagagaggacuaaaugaauuuaugcacauaaaacacuuggagcaaauaaaaguauuugcaaugaugaugaugauuguuuauuauuauuauuaagcuuuggagcaaaaguauucauuaaguaaucauuacugaccaccuacuaaguaucagacacuuuucaagucuuaaugaaucauuaaauuaaucagaucaacaucagaaacaauuuaauguuacaguaacauuuuauaaccaauaguacauugcgguuaacuuuucauuaguguuccauuugaauaagucagcugaaaacagauuugccucuuccuuaaaaauuagaaagcacaugcuauuuauuugggagggaacaagcaggaauugcucaaaauauacauaaccuaccagaaacacaauggcaccaauuccuuggaguaagaaguggaaaauucauuuaagaagagaugugcuccagaucuagcugaggguacccagggacaaaguggacauuucaaguuaagcccugggauggauggauggauggauggauggauggauggauggauggauggauggauuuuagugacguuuaagauuaaccauguuucacauugcuagaggaaagaggucuuaauguacgucuuuauaugggcgugcaccucugcaccuggguccgcuguaaccaugcauauggcuuuggccuugcucaucccacacagccaugugagcaggcacccucugcacuaaugacccucucuaggcccaacuucccuaucuggaaaaugcagaaaucuucagccaugugugagcaucauugugaagcgggcagagcacaugggcuaauuauauauuguaugagauuccagacacaagaauuaaguguucucugugcuguucagucuacuuccaaaauccggcucaaauccaccccacucucaccaucucuacuugcccuuuugaggccaucauuucucugcuggacucugcaccagccucucccugugaucacuguguucuccugguuucaugacucacagacgaguguucuccuuauuuuuacccucgguuuguuuggaaugguuggggguucacuuuuauauauucagaaacacuuguuuuaauacuuuguucuuuguaguccucuucuuucuaauaguuacucauagcuucaauucucaaaacacaaaacaauuuuaccaacccaucauuauguauuucucuacuugcuuuggucugaccuagggacuauuauuuuggaagguguuuuaaaaaguaauuucauaguuugugacuuaaagugcaagaacauccugggguuaguagcacaggaaaagacuugcauaucacuuuguuaacauuuaaaaaccaccaggcacuacacuuaaaagauggaugaugaaugccacauaaagccuacaacuccugaagccucuuguccaugaggcugggugagugaaaaacagcaaaaccugagaucugugauuuuuaagguaauuggagaaaccaauaccucccuaaaauaguucccuuaauagagugacuuacugaauugcucaaaguucagacaugaggaggugcuuuguagaauuugcuggaaacuggaccacacccaccaauuucuugccaguuuguggcaagugggccagguuuugucuggcaacaugaugcaugcauucaaaaacuguauuuucuauuauccuuucauuucuacauuuauaguauaacuaguuuagagcacaaaagagauauggcaauuaauaugggaagugauagacccaacacauauucuauccaauucuauccccacaaagacgaccggacuaagcagcagccccagggucuugccgcaucguuuccuuucgggagcacucacccacaauguguugggugccacaaugcacugaaaaugugaccacugcccuugaucauagaacuauggaaccuuagugcuagaugagaccuuagagguuuucuaguccagugguuuuuuggauuagaaacuaggaagagcauuacuuggggacugucaaguaaaaacauuuuuaaaaauucuaccaucaagaaauuacgcuaagugaaaggagcaagaugcaaaaagacacuguuuuaugauuccacucauuugaaguaccuagaguagucaaauucauagaaacgaaaauaaaauggugguugccagagacaggggggaggaggaaauggggagcuauuguguaauguguagaguuucaguuugggcuaaugagaaaguuauggagagggauaguggugaugacugcacaacauugugaauguauuuaaugccacugaacuguccacuuaaaaaugguaaauuauauauguauuuugccacaguaaaauucugcuuucaucaccguugcuugaaagaaaagaaauuuuuacauugaaaagaaaggaaaauuaaaagaaagaugaaagaaaaagaaagaaaaggggggggugggaagaaucaaucuugaaggaaauuccuuuaaaaugauuaaauauaacuuuaggaagcagaucaacacauugcccuuugugcccuuugcuuucgucuuucucacagacuagaccagcgccgacuguuucgcagccacauaccagcaucuggaagcuacuguaacuucugcgguacaauucucucauuuugcagaugaaaaaauucaggugcagagagaggaagugucuuuuccacagccacaggguguauuugugacugggacagucauuucaugacucacagacaaguauucuuuuuacuuuauuauuauaggaaauucgccuuauaguuuaguuuuguuuuauuaagucuuuauugcuauuggcuucagauuuaguuaucacuuauagaaucccuucugagugccaggcauuguauuuucuauuuucacuuagcagacauuuauauagugcuuaucggaagcaagacacugugcuaagugcccgacaaauaagaagucauauaauccuaacaguaacccucagagaugagaacaauuguuauccccuauuuuaaaaauaaggaaaacuagcugagugcgguggcucaugcauguggucccagcuacucggcaggcugaggcaagaagauuguuugagccaaggaguuuaaggcugcagagagcuaugauugugccacugcauuccagccugcacagaguacagcccuaucucuuaaaaaaaauaaaaaaaagaaaguaggugggguggaacugagacccagauugcuuaaauacuuucccgaagucauauauagggcuaguaagugguggauuccaauucaguuuugacucacugcaguuaaacucaauuacccaaccugaugauaaacaaugggucuaauacuuguaaauacauuugguagaauauuaauugacuuuacuuauuuauuuauuugagacaaucucucucuauugcccaggcuggagugcaguggcgcagucucaguucauugcagccuccaccgccuggauucaagcgauucugccucaaccuccuaaguagcugggauugcacgcaugcaccaccacgcccaguuaauuuuuguauuuuuaguagagacaggguuucgccauguuggccaggcuggucuugaauuccugaccucaggugauccaccugccucggccucccaaaagaauauuaauugacuuuaaaccaaacaccguaaauguguucuuccugacucugagauguaucugaggauauugugagaucuuuauugaaaucauccaaaaugggaugccaaguuuuggugugcauauuaauuuuuuuuaauccuugaaaaaacuaucaacugaacaucuugcuuauggauauaauuuacaugucuuaguaugaagcccuuaggaucugaguacagcacaaguguaauuuaaagauguagcugagacagaccaaaaacugaucagcaucccauagagugaaauaaccaugugccgcguuagguuggggugauggugucaggacuaucacacauugaguugguuauaaaccugauggugauuuaguuguuuggaggagcauuuucaucagaaguccaaguaaucuugcauuggaaagugaauuagaaaaugcaaauccaguggcaugagccuuaggauacaauaccuuauuagaguugggauacccaguggugcaguguagucaguuucuauuuggagcucggucagaugaguuuuaguugauauuuagguaaggacucaaaacuccugaaguauuauauucuuugauuuguuuuucaacuugcuucuuaaaauuaacaagcaaugccaagacaguauuguauuucuaucuuuucuuugucauaacugucagaacaaauagcccauagaaaagcaugagaaaaagccuucaucucaaaucguuaauaacaagaaaagaaaguauaggagcucccuuauccaacaccauuugauggaaucauucuugacccccuguccuccugagaaaaagcaccagaucauucaugaccuucucaccacugcuucauuuaggacuaugaagacaguaucauaggguauaaugaaacaguuaucugcaaugauagaaaaauaguauaagcauguuuuuuaaaauuguggaaccugaccaggcgcaguggcucaugccuguaaucucagcacuuugugaggccagggcggacggauugcucgaguucgggaguuggagaccagccugggcaacacggcgaaaucugucucuccaaaauauacaaaaauuagccaggcaugguggcauguaccugugaucccagcuacuugggagaaugaguugggaggaucgcuugagccccggaggcagagcuugcagugaccugagaucgugcgacugcacuccagccugggugaaagagagagacccuaucugaaaaaacaaaaaccaaaaaacgaaccccaacuguggaaccuauagaaagaaaacuuagccuuggcuuuaaaugaggagaaccagaaaguuccagggagaaaaaguauauguucaagaugaaaaggauaccuuguggucagggaaauuuagguggaggacaagcagguuauagauguucuaguuuugcuggaaauagugucaccuuuccaacugcccaccuauaaacuucacagaguuguucacugucuagaucuccagcucagagaagcagagugauuaaaauucaacaugcaugaaucucaauauuauuuuugaaaaacaugccuuuaaaaccacccauuucaucaaaaagguuaaagggaaaaacauuucucaagaucuaagcacagucuuaagggcuggcguaaaccgugacaguuuaagaaugaaguguuuuucuuaucaauaugagcauucugugaaaugguugauuuugacagagguaguugcuguguugaccuuuucaccgucuuguuuuuuguucauaaauugaugcuguuauugaaacaauauggguaagagucugucuuagauauguaauuuuuuccauuuauugucuccaugguuuuacuuuguuuaacagauuuuaaagacuucaaaagaauagcacuaauauacccaggagaaaaagucacauaaaguuauaagguucauuccauuuuaaccgugaauacauuuaaacaaagauaaauaacauccaaugucaaaauaaucuuaauuccuugaccacauuuuaaaaauaaaacaauuuauuaccauuuaguuacaucuuacaggaaaacccuuagauaccaguagguaaccauuagauuuuucuaggugaaaguaaaucauuucugaggaagcauucucuuuaccaaagcagcauuauuuccaauaaggaagccacucauucauuuaguccuugguuuauuaaacaguuacugaggcugggcacaguugcucaugcuuguaaucccagcacuuugggaggccaaggugggcagauugccugagcucgggaguucaagaccagccugagcaauaugacgaaacccuguccauacaaaaaauagaaaaaguagccaggcaugguggugcacgccuguagucccagcuacucaggaggccgaggugggaggauugcuugagccugugagaaagaggugaaccgagauugcgccacugcacuccagccugggcaauagagagagauccuguuucaaaaaacaagaaagcaaacaaacaaaaaacaguuacugagggcauacaaugagcuaggcacuaugcuauguggggggauuuuuaaauuugaaaaauacagacccugcuaucauggcauccacacuuuuaaagauaaauuucuuccacaguuugcuaauagaaaacagccauuuagcaugaccuauuaauauggagugcccaaaguauacaaauaaauagucaaucuuuaaggcaauauguugcuaccaacucuaaauuuuaucccaagaaacuugaaaacuuuuuauugaauuaaauaggaauauaaaacauguuaugaucccuaugcaauauacuaagcccucuggauccucagguucugugucuguggauucagucaaccaaugaucaaaaauauucagaaaaacacaauaaaaaauaauaauauaacaauaaaaauaauacaauuaaaaaauuacaguauaacuauuaauacauagcauuuacauuguauuuaguacuauaaguaaucuagagauuauuuaagguauacuggaggauguauguauguuauaugcaaauacuaugccauauaauaucagggacuugagcauccuuagauuuuggugucugugggguuccuggaacugguaccccuugaauacugauggaugacugacauagaagguggucaacagucuauuuuccaguugggagaaaggcaguagccuaguaagcuuucucagagagucugugucuuaaucaaacgugucccugguccccugguauugaauauuagucccuggucaccucuugucuuggcuuguuaagguuuaaugacuuauccuucaagugguuuugucucgaagagcucaaaugccaucauuuucugagucuccaaucugucauuugucauguugcaaaaugggcacuaugauuguaccaagccaggcaucccuggcacuccgggaauacuggccagucuccaugacuuguggggggcuuuaguguuuuccaagaugaggccugguugauucauuucugaauccuaaguauugagguuuguguacaaauacggaagugugugggguaggaaguuccgagcaaucagcuuuccuuggaaaauauuuuuccuuuucaaauuuauggcuguuuuuuaaaaagggauguuagaaacuuugguuaauuuaaagauggguauguguuuuccucuaaugauggcacacaguuauguucagugaggacucaaggaaaccaccuuuuuuguugucuggccaauaacuuacugaaaugagcagugcugauuuacaggucugggugguggugacugaaggcagaauuuuggggaguuucauuuuuuguuuaauuugaacaaucagaguucaucguguuuugcggaagaggaggaaaagcagcccaaacccacacgggaggguugggggagcaucugcuugacagcacucucaguuaagcccugcagcuacgugugcucaaagauguucucgccaaaagccaaugcuaauuuaauguguauggaaauuauuuauucugagucaucaguuacuuuucuuagcuauaguuguuauugguacuguaaugacuuggcagcguuucaucauuuuuucuuaugucuggcucacauuugcguguguuaacuccaucucacaaaaacccaaacaaacacaaauuucauaggaccuacuuggcaucuggcaguguuugacacaacuaccuaauuccuuuauugaaauucaugauugagaugguccaucuugaacugauuccagcguucaggcacgaaccuuuucgcugagucgccuugggccaaucacugaacuucucugagcauuggauucuugguacagggauuggauuagaacucuaaguuacaucuagcucugaaggaaauuagagauuuuugaacuugaugaacauuuucuaauuguuccuaggguaaaugugccacucuuuaagacuuguuacuauuuuaagaugccacuggaaacacagaggcccugcaaaaagauggacauuggguccaccaaguauccagacaggggcgggguuggaugguccaggaguacacaggugaccuccuggggagccaagguauuucccccaaggugggugagaaagcaggacauuuucaggugaaacagaugcucaacagagccaagcuuugaagacacuuacauuugggggacuggacuacaagaaaauaugaguaauucucuuuagaagugguaauggaaaaccacaagaaucaggaucauuuuccucagcugauaacucaugagggcauagaacagaauucuagaucauuccguggauauuugaggaagacuuauaguucucaaaugaucccauguauacugauagguauuaucaguacaccugauauauauacugugauguguguuagcauuuuagguggcuuaauacauaauaccccuuuaguuaucuccugaauuuuggagcaauuuuggaccauugaagacagguaauucaugucaaaaaaaauggcuuuugauuugcaucccaaagacucccuaacucuucuccaaauugaacuuaucccccucaauccauauccucaccccuuccugggacaaagccuacuccaugcagagaaccuaguagcaaagaguaucagaaucaaggagauagguuuguucuaaaaaccagaaauguuuucuugcuuucuccaaaaguucaucuaucagacagguuacuaaaaggagaugggagagaugucaggccaggaauauccuguagcugaaguuccuucacuuggaaucccaaggggugggaaggaaagacucuuucuaacaauuagcauugaacucauuguugcauugggaauugcaguggaaaaauaugaggauauguauucaacaaauauuuauuaaaugccuaccaaguacaaagcacuuuucuggguucuaagguacagcagagaacaagagauacaaggucccucuuuuuuuuuuuuucucuccuuuuuuugagacagggucucacuuuaucacccaggcuggagugcaguggugcaaauacaacuugcugcagccucaaccuccaccucccugggcucaagcaauccucccaccucagucccccaaguagcugggacuauaggcaugugccaccaugcccagcuaaauuuuguauuuuuuguagagacgggguuucgccauguugcucaggcuggucuugaacuccugagcucaagcaaugugcccaccuuggcuggcaugagccaccgugccuggccaaguucccucuucuuauggaacuuacauucuuggagggggaagguaauaaguaaacauaugaauaagaucuuuucagauguucauaaaugccuugaggagauuaaaucaguaucauaugauagagagcaacuagggauagagugaaggaaggugacucauuaaauaggugaccaggucaggccacucucaggaggggccguaugggcgaaggagccagccacaugaaggccugagggcggggugagagggagcagcuaguucuaaggccccagguuggaaagggcaggguggacucaaggagcagaaggaaggccagcgugugcaggugauggugaguguggggacagugccaggacacgaggucagagaggaaguggguccagaucagcuaggaaugugagguuuccuccuaagauaacagaaagccuuuagaguauccaaacagguguauuccaaucaccuagggacuucagcugaagaccaugauucaggaagccuggcagggccugaaauucugcauuucuaacaucuuccugggaugcuguugcuguugcuguugcuguugcugcugguccauagacgucacugucagugucaaggcucuccuucuccuuuaaaaugaucacuuugggccaggcaugguggcucaagccuguaaucacagcacuuugggaccccaaggugagaagaucacuugagaccaagaauucgagaccagccugggcaacauaauaagaucccugucaccccugucucuacagaauuuuuuuuuuuaaugaucacuuugcuguguggagagugaagaaucacagaggaagaagaguagaggcgggagaccaguuagaagcugcugaacugcaugugagggcauaggcauccaggauagugugacugcagcgcgaggcuccaaaauaaaggggcccccagcagguccccugaauuguucugaauagguauaugcccccauaugcagcugcccaauauucaauuucauuaucuauuuaaccggcuaauauucggauucaacuguuguucauugaguaccuacuauauuuuagaccaagcacuccucaaacuuuaaugugcagaguaaucaccuggaaucuggcaaaauguggauucaguuaaacaaaguuuaugggaggccauuguuuuggauuagccucuugcacucggccgcagcagaauagaucaaaccagaauggagucacuuagugcuaagugccguguauacaaacugaacuuugaaacaggccaguuuuccuaaacaagaggagguuccaaucaaccugagucagcauaaucaggaaggccccucuccuuuaacccucugaggaaaguaacuuugaaaccaccaguucacuuuuuuguuuucugucucugcuuucuuucacccuuuucugucucuaaagccaaccucucugcucagcuccuuggaacaccuauuuuguuuuauauagaaugagguuuugccugauucuagaaucaaaaaugaaagcuuauucaaucuguaaaauaaaucuguuguaauuucaucuuuugacaugauuucauagggcugaggugagucccgagagucugccuuucuaagaggugacguugaugcugcuacaccuaugguuuucaaaucacacugugaggcagagucacuugggaagauuuugcaacuaccaaugcuuggaucccaccaaaaauggauuaucagcuucucugauaucagcuucuccuccaacauuuggaggaucccaaaugugguauuuuugaagaaguuucccagaugaugcuaugguacaguuaaggcugagaacuagaacuagaagcuuucagccaauuucccugguauguggcuaguauugcuuccauuguacagagaagguaaaaagggguaacuugccaaaggucauuuggccaguaaaugguaagguggagguuucaacuuaguucuaauuccaaauuuagagcuuuuuucauaguaccacacuaccucccuacuucccuauuuugggcaaaacucacuuugcuagguauugaagggaauguugucugagucggacuccagucaggaaacagaaacucguuggcuauugcaaacagaggguaucuaauacaagagguuugguacaaugauauugagagggcaagaggaacaaaaggaauaguugcagaaggaacccaaaggaagguauguucccagagaucaggcaaccucuaggauccugggauggaaacuuggacuuugcaucuggggcugcacugcuagagaugcugcuucuggugcucaugcuggaaccacuggagccagguuucucccagacccucagccccaugugaauccaaacccuguuucaaaaggaauguccaugggaaaaugggguuugauuuacacguucaguuuucaggcuacauuugcuagaaugcaccucuuuuguaugugcaagaaugccaauaggugcucugaaagcugaauucuuuagcuauucgucauauccuagugguuagcaucagaaggaagccaguacaguugggucucgguaucugcaggggauugguuccaggcccaccugcagauaccagaauccaagcaaacuuaagucccacaguggacucugagggaccuguggauacgaaaagucagcccuccgcauccacaaguuucacaccccaagaauauuguauuuucaauccgugucugguugcagauggaaccuuuggauauggaaggcugacuguauuuugaaaaaaaucugcauauaagugggcccgcccaguuugaaccuguguugcuuaaggucaacuaaugcucuuuggcauuuugggacugccccucaccuacugaguccuucaccuguggagccccagcagcuggacacccgggugcucagucuuccacugcguucacugcgucuuccccuucaguggucacccuggugggugguggucgcacagcuugguguguguccuuaccaugcuguagccucugguauuuauuaaugaaaacuuuucuuugugcgugaccaucucugcuuugcauucuucccaaugaccaagaacauuuugaaaugaaaaaaaaaaaaacccaacaaaaacaaaauuguaaaauuacaaugacucuuauugauauuuugauagauuaaaaaaaaagacuaguaagauuugaaauagaauaaaacguauuucuuauagcuugugaagaauguuuuuaaaaagcagaaagaucuccuuuuauuaagugaauacauaaaaaugaugauagaaaauuucuuauggcaucaguaauuaauuuauauucauuaaacaaauuuccauaccugcauguauuuacauaauuuccuucucuuaugauuaauuuaauacuuaaggagaaaaugaauuauugauuauuuuaaugccagaauuauacccugccucaaguuucaucugugggaagugcuauuccauguaacuaaggagacagaaaauccccuaaguugauagauugguuuguuuccuguucuacuuugguuuaauuacuauuugauaauuacuauuuaaaaauuucaaagcacuuuucauuuucucccuagcugugcuuuauaauuugcccaagggggucuguuuuguuuuuguuuuuuuuuucugucauguguuugaauaaauagcaaauuguugcugcuuuuuccagggaagaugcaaaagagcugugucauauuucuuuguguaagcaguuuucugaauuauuuucuuuggucuaccuagaacaaauaagucucugaagaauaagaaugaacacuuaacuuuucacuacccuuaaaauacuauaauagcaguacauuaaucaugugucaauuaaaagccaaagggggcugggugcaauggcccagacccauaauuccagcacuuugggaggccaaggugggcagaucaccugcgguaagggaguucgagaccagccuggccaacauggagaaaccccaucucuccuagaaauacaaaaauuagcuggacgugguggcacgugccuguaaucccagcuccucaggaggcugaggcaggagaaucacuugaacccaggaggcagagauugcagugagccgagaucuuaccaaugcacuugagccugggugacagagugagacucugucccaagaacaacaacaacaaaaaucaaaagggccucccagagcagcacauaguguuuuugcugucauucuuaggaucucuaaagucugccauuacgguauagaaagugucagugaaauaaggaaaauuugucuuaauuacuuuccaggaaaaaccaagguaggccucaguuaauuuguuguguagacaagaaggggcuuuccaacccauccuuucucaucuguguuuugagggagagucagauggucauaugcacacaucuguuauauguaacugucuuacaccaaucauuauuuuauuuacaagaucuagcuauuugagagagauugcaaaaacugguuuuagcugcuuguguuucaagucagaagugcgugaaggaggucaggccaugaucacuacaguguggaggccgccggcugacuuuguugaggaaaaugagguccagccuguagaagggagcuagggaguacagagcccgaaggaaggugguggggaguuuucucgucugcacaucccucccucugugguuaucccagcaaagugggaauauuauuuaaaccauguacugcuuuauuuugcuggagcauuugauauguuuaaaaagugucagaccauuuccucggcaggcauaugcuugcacuuagccuuaauuccuacccuuggagaaggcaaauacagcguggcccucgucuguauauuuuaagagguuucuuauaacaggccuagucuguggcaauccuagugaguaguacuuaguggguuuacaaaccacucugucgcggugaugacauacucugugugguucugggagcuaaauaaaacaccggaaauagauauuaaauaaaauaaagaacacgccuauguaauuauugccagaaaugaaauuuugcaacccuaaauuugaauguggucuaggcaccugaagauuccuguagcuaaacaaacaucauuucccagauuaaaauuucaggaaagcaacgucuaucaagugucuuauuuggguaaaauauuuugaaaauguuuugacugaucacagggggaaugggaagcagaugguaagugagacaggugccccuaaaguccacauccccuucugaauggcuccauuuccuauuacauuagacagcaaaggccacuggcccaggccaaugucacuuauguucugcuaggggacuuuuggccaacucagaagauauugguccuuacuguggaauuguuuugugauuuuaaaauauagaucucuuuaaacccugaaaaaauauauuuuuaaaaggacuaauuuuuuaaacggcagugauccaaucaauaugauugcaguuugagcuuaaggggcacuauucucacucaagucuuuggauuuuucuguagccuuucccaaaagugagcuaauguuuugaagugucaguuauuuacuucgguucugucugguagaaaauacacaaguugucucauuuaaucaugaagguaacucucuucggcauuuugcagguaagaaaauugaggcucuaagaggugaaguaauuugcagaagccacuggaaaguggcugauuccagauuccagacccagcucugucuaccuaaaacuacaucaucucccuaaaacaccucacuagccaugcuccaaugcaaaugggccuagcaaguucaaauacauuuguaauuugccuagguuuuccauuuagcugaaguuaaccacacuuccaguauaauccagguauuuaugguuuuuguguuuuguuuuuuuucucccauuuacagcacuuagcauaauguucugcauagagcacauacuuaaugaauacuugcugaauuaauucauuucagauacguugagccccgugaaagcugcuuaauuuagaaggcucagaguaacuuugguuaaaaagguucagggauggauccucuccacccuuucguucaccugguaaaauacuauuucaaggacuaauuuauaccaucgucuccuuuagguagcuuucucugacccacuuugucacugaggcagaauuguuuccucaucucuguaugacuuagcacuguuuauguacuuccaugucacuuuuuuaaaagcaagaaugaaaauaacuuuuauuuauugugcaaugugcuagacauuaaacuaaauacucuacacauuuugucucuuuaauccucaaaacagcccugggagguaaggcuguuguccuauguuacaagcgaggaaaguggggcuuaaagagaauaaguuacuugccccaggucuuacaguuagugaauuucaaagaugcaguaggaacccaguucucgccuguuuucaauauauucuuuucuuauuaagauaaaauuugcaguaaugugcacauaucuuacauguacaguuugaugaguuuugauaauacacacaucugcuuaaccguugauccagucaagauguagaacauguccacugaucagaaaguuaccucauugccccuucccugucugcuccagccacucaggauuagggcugccuguucuuuauuuaaaucaauuaauuuauuucuuauuuuauuuuauuguuucucucaguugaauuuuauuuuauuuuuuccugcuuuuauuuuagauacagggguacauguguaggauuguuacauggguauauuggacccaaguagugagcauaguacccagugaguaguuuugcaacccacgcuccugucauuuccugccccuguaguagguugcaguguguauuguucucguguuuauauccauaugugcuuaaugguuaccucccacuuacaggugagaacauguggcauuugguuuucuguuccugugcuaauucacuuggcauuauggucuccagcuuugcugcaaagaacaugguuucauuguuguuguuuuuuuuaauggcugcauaguauuccaugguguauguguaccacauagucucgauccaauccuccacugaugggcaccuagguugauuccaugucuuugcuauugugaauagcauggugauuaacauaagagugcaugugucuuuuuugguauaaugaucuguauuccuucggguauguacccaguaauguguuuagcugggucgagugguuguucuguuuuaaguucuuugagaaaucuccaaacuuguuccacaguuugaaacuaacugaacuaauuuacauucccaccaacaguguauaugcguuucuguuucuuugcagccucacagggcugcuuguucuugaacuucauagaaauugaacucuagaguauguauucuuuuuucucuuucaugucuuuuacucaaaauaauauuuuugagguucauccguguugugauauguaaagauauccacuacaucagugguucauugauuuuuauugccaagcaguauuccauuucaugaauauaucacgguuuauuuauucauuguccuauuguugggcauuuggaugguuuccaguuuggggcuauugugaauaaggccacugugaauauucuucaucuauguacaagaauguacaaaaaucuuuuugaggacauaugcuuucauuucuguuggguaaauacuuaacuguguaaucccugggucauagaguagaaacauguuuaacuuuauaagcagcugccaauuuuccaaagugucuguaugacucuacacucccacuaacaaugugugaguguucuaauucauaucuuucccaauauuuaaaaaguuuuaugcuacuuuaaaauaguccucuuucauuuaugcagccaaaaaacacaugaaaaaaugcucaucaucacuggccaucagagaaaugcaaaucaaaaccacaaugagauaccaucucacaccaguuagaauggcaaucauuaaaaaguuaggaaacaacaggugcuggagaggauguggagaaauaggaacacuuuuacacuguuggugggacuguaaacuaguucaacccuuguggaagucaguguggcgauuccucagggaucuagaacuagaaauaccauuugacccagccaucccauuacuggguauauacccaaaggacuacaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuaugcagccauaaaaaaugaugaguuccuguccuuuguagggacauggaugaaauuggaaaucaucauucucaguaaacuaucgcaaggacaaaaaaccaaacacugcauguucucacucauaggugggaauugaacaaugagaacacauggacguaggaagcggaacaucacacucuggggacuguuguggguuggggggaggggggaaggauagcauuaggagauauaccuaaugcuaaaugacgaguuaaugggugcagcacaccagcauggcacauguauacauauguaacuaaccugcacauugugcacauguacccuaaaacuuaaaguauaauaauaauaauaaaaaauaaaaauaaauaaauaaauaaaauaguccucuuucccauuugacuuugagccugucaaggucaggaaacauguaccauucauuucugcauccaccaugcuuagcucaguguguggugcaauaaauaugaugcacaugaaacuauaauuugagaauuguagaaacaguugucaaagucccuuucagcagugacaaucuggaaaccuaaccaugugccauggggcaugcagguaguuuuacacugaaaagacuuuggauaguugccuucagaggguagcagccuuucaaaggugaaguggcagauuggugaucuccagaaggaagugagugaccagccaggcaugggcucuccugagugaggcaggcuggugagucccacugugugcugggaggccaugcuucagcaauauguccaucugacaugaacaguucacuuggauaucaguggaagccauaaugucuuagcuugucgaccucugaccugcuaucuuuuaggaugauguuuuaguuaucuguagcaauauaacaauaugagaaggcacuuagcagcuuaaagcaacaccuuauucauugcaacacauacuuauuaucuccagguuccugugggccaggagucuggcauaacuugacagagucuucugcuucacaaggcuacagucaaagugucagcuggggcugugggugagucaaagcuugacuggggaaggagcugcuagcaaacucaagugguuguuacaggauucaggucaacgugggcugguggauugugggccucaguugccugcugaauguuggccaggggccgcccaagguuccuugcuguuauaaauuuguguaauauaguugcugccucagcauucauuuucaggccugacauaagauguuugaaacccagucacucccugucaccuuuggcccaguuaaaauuuccccucgugugguuguuuguaauuuggccuccuuauuccuuacacaaggacaugaauaccaggagguggggagaacugggagguucucuuggagucugucacagaugguccauuagaauucuuuuuaaaaaguggaaguaauacagauacugugaggaaaguaguuguuuugacccaaagagaauauuauauuuuuuacuguucuaaugaauaguuucaggggcuccagcuuuaucuccaacacagagagccuguucuggguaaauuaucugcaguucauguucacuggcacagaagauugauuggaaaacaugaagugauuucuggauaaauacucaucaguggguucauucagugcagaugaauugagucuuuucuauaaucucccacuggacagagcuuuugcuuugaaauuugucauggguuaaagagauuggcagagugacccccuauaaccuaaguguaggaagccagauauuuuugucagcaaauuugcuuaucuggaauggaaugauuggcccugaccagacacggaaaaaaaucuuagggucauauaaaaguaacuugucacaccuguugggagaaucuuuuuaagaaguaagucacauguaugagaaacagagcaaacaaaauauuuuacuuguuaggagauaccuggaagauguucaggcuuuaacacuuagcuuuggugaguuuagacagucaaggaagacagcagagucuuguucugcccugaccaugguauaguuauucuacccauucuugguuguuaaaaaaaaauucaauguuuuuucccgcaaacuugaacuaagcacaaaggcuuauuuucaguuauaaaaaacaugauuaaggcugggcaugguggcucacgccaguaaucccagcacuuugggaggccgaggugggcggaucaugaggucgagagaucgaguccauccuggcuaacauggugaaacccugucucuacuaagaauacaaaaauuagcuggguguggugaugcgugccuguagucccagcuacucaggaggcugaggcaggagaauugcuugaaccugggagguggagguugcagugagccgagaucgcaccacugcacuccagccuggugacagagugagacuccaucucaaaaaaaaaaaaaaaaugauuacacuauucuaauagguuugaaaguuuugagaaacuuucaaacucuguuucuuauacacagagagagagacauaugacaagaaauugauuacaggaauuggcuaacacauuugaggaggcugcaaaguuuccauaggcucucuucgagccggauaaccaagaggggccgguaguguggcucaguccaagucagaaggcccaagaaccaaggaggcuagugcugucacuuucgguuugaggcuaaagacccuagagcccuagggcccacugguacaaguccuagaguccaaagaccaaggaaccuggaguccucguguccaagggcaggagcagaaggguguccuggcucugcaagagagauaauuugcccuuccuccuccuuuuuguucuguucaggcucuggaugagugggcggugccugcucuuguugaggguggaucuuccccacucaguccacccacuuacaugccagucuccucugaaaacacucucaaggacacacaggaagcaaugcuucaccaagucauccaggcaucccucauuccaauuaaguugacgccuaaaauuaaccauuguagccauagagcugaauguaaaaauuuaaaaauucaucuccuucauaagcugcauaaaccuccuucuuugaguauaagaauuaaucaucccaaugaaguagaaaauaguauauuuaugucaucuaguugaaaaaggcaauauuaauagacauuuggaaacuccuuuugccacauuucaaguuuauuccgggcaguuuaccuugagaaaaaaaugccucuuuugauggaugcuguauuaguccguucucacacuccuauaaggacauacuugagacuggguaauuuuuaaaggaaagagauuuaauugacucaccauucugcaggacuggggaggccucagaaaacuacaaucaugguggaaggugccuuuuuacagggcagcaggagagagaaugagugcugagcaaaaggggaagcaccuuauaaaaccaucagaucuugugagaacucacucacuaucaugagaacagcaugggggaaacugcccccaugauucaauaaccuccaccucguccugcccuugacacguggggauuauuacaauucaaagugagauuuggguggggacacagagccaaaccguaucagaugcagaccgaaagagcaauuuuauuuuaguuacaacauaauaaugguguuauauaguguauaacuauaguuauauaguuacauauauauaguuacaguuauacagugcuuacugcuuauuaugugccagauacuguucuaugugguauaugugugugugcuggggauauauacccacucuaugauauauacuaauucucaccuugcugguucccugguuaaugagcuaaauaaauauuugaugccuacccacuuuauauuucuaugaguguaguguuuucacuuuuugaaaauuauacuuuagucaauucugugauacagauacuauuauuauuccaguuguauggagaggcacaugagacacagagaaguugaguagcuuccccagggcuucauagcagcccacgguggagccagcauuugagugccagcagccuggaccagcgucugcucuuaacuaucaugcuacaccccgucuugaagaauuuauuuucuuugcauauguaggccauagccacccuucugacacuaaagaagcacaaucaaccagaguccaaggcaaaccagcacauuucaucuacggagagcaaacuaaucaaaaaagcacgcuugcuccagccugacccaagcaucuggguuaggacaaccaaucuaagaaagcccacacuucacuauuuuaaagaaaauaaauccuuggcaauaguggccucauuaugauucugaagggcaacauaaaaugcuucccagaugaauuaguaaacaacaccaaaaguugcaggaauggauggaggucugugaagugucucaaugggcaacuggaagugcagccuccagguugacauaugggauuacagaggaaccaagaagggaaaaaugauggaaagagaugagcaguuucugaagugugguugugguaucacugaugucguggacucuacacugauaccugcccucacuaugauucccguugucccacucggacgaggccuucaacagagcugcauuuagaagccagggaagauuuucccguuguaucaucuguggucuuucuacuggcaacucucaugggauuccuuggcuggaggguagagcaaagcaucagaaccccuaggcucugccuuugaaacuccccauaucauucagaaugggcuuuaaauggcaucugugccauuccagaacucacccuugugaagcugauggcucagggcuuccugcucuuguuuggagguggugucaguaggggcagaggaaggcucagccagucuuuguggacccugguagccaggcucgcuccugcuccuggacauuuugagcaacaaauggcuauugucauggacuuuuagcaucccucaucccugacauguagccucgggacagauuagccagcuggauuuacuuuaagaaguauguauaauauauuuguauacacacacauauauauacguacacauuuacuuauaguuuuuacugaugauaaaaugaaauguuaccaguauaaaagcaauuuggacaucacaaaaaauuauaaagaaaaaaaugcaaaucuugaacuagaaaaaccaagguagaaaauuccuggaaauccagccacucacagauacugcuuuauuuacuaaaaagggaccauuagcauuuuaaauaccuuuucaugcaaaucucuaugcauauauacauauaauguauaucucuaugcauacagauacaacuguuugagaauuuaacuaugcuaagcagacuguuggcaaacuuuucugcucagccaggcgaccuuuauggucaaucaaugcugguguaaaucaccauuuuagcccauagaaauaagaagaauguugugacugggcuuuccuguggugaggugacggcugggaauagaaugaucagaacaucuggguucgugcaauuuuuccugaaccuuugcagacuuuauguguacauugggacgagggagucacuaaagccgaggggagcccuccagcucacugcuccgacaacuuagagggcaagugccgaaacagaaguggcugguguugacugcauguuuacgguggcugccaacugaggggcugccccugaugaggccgagugagugaggcccacacugcauguggcugggaaagguuucaaaccaugacuucuuaccuuuguucaaaccagaugcaaggaauccgaggaugaugucuggguacugauuuaauuagcagcaaaagggauuaagcaaaccagcaaucaugcucuuucaucucuguccagaaaaggcguuuuuaccugcacccaugguugugaaucugugacugaugccaguguugucauuaagaaaggaccucaagcaaagcagagucgggaacauuuuguguuuaaaauguuuagaaacaaacauggacagagcccacugauuuuuccucugggaaaaagacagucacuguaaauagacaaauuacacugaaucuauccgaaacauauguugcguuuggcuaaaugcuaaucucuuauuugcccuccugcugccaaggcccgugcugcgugcccuggaucuggauguguguuuaaacgauuauaguucaggaaaagagccuaggccuguucauguuccauugaggcuccuguucucagacuuacugauuuucaaucuggagauuuuacugaaauauauauuacagucucuuaccauguaagccaagucuguuuuuacuuuauccauuuguauggagaaauaucauaauccucagagaucuggagcauaggagauugcuuugagggcauguaggguaggagcugccuagugaacuguucacuuggccuggaaugucuuucucucuugccaauccccaccuuuaucacuuaauuccuauuuaucuuuuuuauugaagcucagguagcaucuuccccgggaauccuuugcugaccgcccugagccugaguugguuauuccuccacugggcuucccuagcugcccacugcuuuccuaucuccaaaccuccccagacuuguaaggucugugagggucagaaccccccaacccccauguguuaugcccagcaccgaggacagugccugucacaugacuuuaguaaauaccuguugaaugaaugaggacacuugucuucuuuucuuuucuuuuaaaauucugggguacaugugcaggacauacagguuuguuacauagguaaacgugugccguggugguuugcugcaccuaucaacccaucacguagguauuaagccccacaugcaucagcuauuuuuccugaugcucucccucccucccccaacaggccccuguguguguauuccccucccuguguccacguguucucacuguucagcuccacuuauaagugagaacaugugguguuugguuuucugugccuguguuacuuugcugaggauaauggcuuccagcuucauccaugucccugcaaaggacaugaucuuguuccuuuuuauggcugcauaguauuccaugguguauauguaccacauuuucuuuauccagucugucgucugucauugaugggcauuuggguugauuccaugucuuugcuauugugaauagugcugccaugaauauacauauacagauaucuuuauaauagaaugacuuauauuccuuuggguguauacccaguaaagggaucgcugggucaaaugguauuucugguucuaggucucugaggaauugucacaccgucuuccacaaugguugaacuaauuuacauucccaccaacaguguaaaagcguuccuguuucucugcaaccucaccggcaucuguucuuucuugaguuuuuaauaaucaugauucugacugauaugagaugguaucuuauugugguuuugauuuguauuucucuaaugaucagugauguugaacuuuuuuucauauguuugguuggccgcauguaugucuucuuuugagaagugucuguucauguccuuuguccacuuuuuaaugggguuguuuguuuuucuuaaagccauuuguucuucaacaggggacuccuguacuccaaguaacacuuucugcucccagagccacuucccuacccccugcauacccaaaauacuggggugauauuuuagauuuccaguccuccagauacauaaggacaaaaaugugcaaccuuuugcaucauauaacaaaguucuuucuuucuucccuaacagauaucacacaugaugaagucugauagcuagugucggguaguugacagaaaaacaaacaaaaagguuuuuuuaaauaaaaaagcaagccugugggucuucagaauaaaaucacuuugauucagcuauaaaaauaugacuuagaaacauugcagugagcauugccaaauacagcuccucugcuaccgucuguccuggagcugcacaccugucccuguaccgcugagcccacgcuguaggaucuuggaauuggggcguggacuuguucauugugagcacacagaauguggacaugauucugaauguguggcuguguuggaacuugcccaaucuauuucaagaugauaaauuacauacuuccggaaaggcuauucuguuuuccccacagaagaucuuaacuacucuuugucuucuccuuuuauagaacugaaaauuuaauuuugucuaaaugugcuuuucuucauauuuacuuacauucucagcauuacaguauacugucuacagaaacacaguccuaguuuuucauuuuaggaaaaggugauucauuauggaacaaaucuuaauuuuaauauuaccaugcuuugguagaagucaguguuggaaaacucuagaaaguauugccuuggaauaaaaauaucaggugggggaaggagcaaggauagcugggggagggcugagcuucuauuuccugaugaauugaaguucacauauggauggggugagaucaugguguaauacacaaaacuugggucaagaggguagaaauuaaagguaggaaaacauuuuagaagccucuguugcugaaauauuuuugcauuguaguggauauuaauuauuccgauguuaauuauucgcuaggggucuguguuaguccauuuucacacuacugauaaagacauacccgagacggggcaauuuacaaaagaaagagguuuaauggacgucggguuccacguggcuggggaggccucacaauuaugguggaaggcaaggaggaucaagucacgucuuaaguggaugccagcaagcaaagagagagagcuuguacaggcuuuuuaaaaccaucagaucucgcgagacguauucacuaucacgagaacagcacgagaaagacccgcccccaugauucauuuaccucccacugggucucucucccuugacacgugggaccugugggaguuacuauucaagaugagauuugauggggacacagccaaaccguaucagggucuuuccugguuuuuacccagugugcuucaaacagucauugcuuugcagccuacuugccucgccggggauuuguuaucuccucucauagugcucuaacaauuuccuuuuguucucagaucacugcccuuucucaccaggggaggauucacucacagaaagcagguagugggcugucuuagguaaagaaauacccacuucuggugaaagccaggugaggaaggccagugggaacagacgggagagaaggaacaagcucucugcugggaaggucacuguucccagggaggacuuauuuggaggcugaaagccagauaacuaagaaaauuaaaugguaguuuccaaucagaguaaaaaaggauccaaggaagguggggaugaguuucuggaagugguuuuggcagaaggcaguuucaucuuuccaugcacuugcacacagguagaaaucugcauuuuuucaccugaguuuugcucacuaauguucauaauauuaauacuucgggagaaaaaggagacccuuacgaugagauucacuagaaagcugagcaagacauguauccuggaguuggccacggguaccacugcagaugcugggcaauacaguuuguguuguguaaauuauacacacuugagcuggcaggaacuagggcagcaccuggaccugacaaaaaagucaauugauagaugacacauuuccuccuuuguauguuggugaucaauucuaacuuuuuacaaccuagucaaauugcuuacagcugaaaaauaugggguuuuguuuuguuuuguuucguuuugagacggaguuucacucugucacccaggcuggagugcaguaacgcgaucuuggcucacuacaaccuccaccuccuggguucaagcgauucucccaccucagccucccaaguagcugggauuacaggugcgugucaccauacccggcuaauuuuuguaguuuuuaguagagaugggguuucaccaucuugaccaggcuggccuugaacuccugaccucgugauccaccugccucggccucccaaagugcugggauuacaggagugagccacuguggccagccgaaaaauauguuuugauuaauauuauguaagguaaauaggggaaacguucacaaagaugauucaugcuaaacaaauaaaaccagagccacauccaucagcauaacguagugcaauaaaauguuauauaucaaaguacgcaucuacuaaguccuauucaucggagacagccacaggugauaguguaugggcagaggugccaccaaccuagcauguccugcaugggggcuuuucccuuagucaauaaaggccagugacuaggcgguagcuaccucuugaagagaugggacuaggguugcggggcgggcuuucccacauaaucucuugugggaugucagagaugaucuggguaaaucacguguuuaugcgugaguuauuugccuuggucaggaaggcugccuuugaacugacuagaauagaaaaaugacagguguaaacuugcccuaaguuacauuucagguuggucuucauaccaaagcuuauggagaauugggaucuaaacuguuacugugguugaaucccugacuuucucuuuuuuccuccuuuuuugaggaggaaaaucagagauaacauuuuagaauaaauaauuuauuauagcugaauuacuuaauacuggcaaugagagcuuugugauauauauauuacauuauauaauaaauuacauauauuauuacauauauuacuuauauauacauaauauauaaacuauaugccuauuauauauaauuuaaaggagggaaugaauguagguguaguaguaugucaucuuagaauuuuuugggcuuuucaucauuuuuaugaggaagucaauuaacaacaucuugaaauuguuaaacacauucagugaacagaacuuggcuucaacugugaauuuucaccacaagcucugcaacaaauuguagggaugcucuaaggagagccacagcuacucucacggucagagcccccuaagcacacacauacacaccaagcugauucugccugucauucucaugacuauacgguuucccacuguaaauguauauuccuuuuaucacaacugaguugagucauagccauccuuuaaggcacagcgaauguauuacgcccaccguaaguucugccaacauuguaucuacuccuucccgugaaugcacagucaauuaacacaacuggguaaguauaucuaacuuaccaagggcagaacuuagagcacagacuguauuugcaccaugacauuagauacucgguuauagucaucuuaacuccaauucugcauaugaggaaaagagacucagaaaagcugaguggcuugaccgauauuguagagcuuauucauggugaagauuccagguggucuugaagugcucuuaccccuuaugaaauuucccagaugugaggcagauguugcagugagcugagaucaugccacugcacuccagccugggagacagagugagucuccaucucaaaaaaaaaaaaaaaaaauucccagauguuugaggaggaagaagcauagcaagugcuucuccaccucuguuuauuuuuucugucugauccaggucuggguggcuagugguugagaaaccacaggauagugguuucuccugucagugaauaggaaucuucauuaggcaaaaaacaacacuugggcgaaaaugaaaaaaaacccaaguauguguugaaugcaaagaguauguuuacuuguagcaacauuauagaauauauuguguaaugcaaacauacacaaugccuucuaagacugugaaagcauuuuuuauuagucaguguucuguagaggcacagaacuaauaggcuagauguauauaugaagggaguuuauuaaggaguauugacucacacgaucacaaggugaagugccacagcaggccaucugcaagcugaggaacagggaagccaauccaagucccaaaaccucagaaguaaggaagccuacaguacagccuucagucuguggccaaaggccugagagccccuggaaaaucacugauguaacaagaguccaaaagcugaagaacuugggucugauguucgagggcaggaaguauucagcaugggagaaagauggagaaagcugauuugauggugcccacccagauagagggugggucugccucuccaguccacugacucaaauggcaacacccucacagacauacccaggaacaacauuugcaucuuucuuuuuuuuuuuuuaauuauacuuuaaguucuaggguacaugugcacaaugugcagguuuguuacauauguauucaugugcuauauuggugcgcugcacccauuaacucgucauuuacauuagguauaucuccuaaugcuaucccuccccccuugccccaccccacaacaggcccgggcgugugauguuccccacccuguguccauguguucucauuguucaguucccaccuaugagugagaacaugugguguuugguuuucuguccuugcaacaguuugcucagaaugaucguuuccagcuucauccaugucucuacaaaggacgugaacucauccuuuuuuuauggcugcauaguauuccaugguguauaugugccacauuuuuuuaauccagccuaucauugauggacauuuggguugguuccaagucuuugcuguugugaauagugccgcaauaaacauacgugugcaugugucuuuauagcagcaugauuuauaauccuuuggguauauacccaguaaugggauggcuuggucaaaugguauuucuaguucuagauccuugaggaaucuccacacugucuuccacaaugguugaacuaguuuacaguccuaccaacaguguaaaaguguuccuauuucuccacauccucuucagcaccuguuguuuccugacuuuuuaccauucuaacuggugugagaugguaucucauugugguuuugauuugcauuucucugauggccagugaugaugaggauauuuucaugugucuguuggcugcauaaaugucuucuuuugagaagugucuguucauauccuuugcccacuuuuugaugggguuguuugauuuuuuucuuggaaauuuguuugaguucuuuguagauucuggauauuagcccuuugucagauggguagauuguaaaaauuuucucccauucuguagguugccuguucacucugaugguaguuucuuuugcugugcagaagcucuuuaguuuaauuagaucccauuugucaauuuuggcuuuuguugccauugcuuuugguguuuuagucaugaaguccuugcccaugccuagguccugaaugguauugccuagguuuucuucuaggguuuuuaugguuuuaggucuaacauuuaagucuuuaauccaucucgaauuaauuuuuguauaagguguaaggaagggauccaguuucagcuuucuacauauggccagccaguuuucccagcaccauuuauuaaauagggaauccuuuccccauugcugguuuuugucagguuugucaaagaucagaugguuguagaugugugguauuauuucugagggcucuguucuguuccauugaucuauaucucuguuuugguaccaguaccgugcuguuuugguuacuguagccuugucauuuaguuugaagucagguagaaugaugccuccagcuuuguucuuuuggcuuaggauugucuuggcaaugcaggcucuuuuuugguuccacaugaacuuuaaaguaguuuuuuuccaauucugugaagaaagucauugguagcuuaauggggauggcauugaaucuacaaauuaccuugggcaguauggccauuuucacgauauugauucuuccuauccaugagcauggaauguucuuccauuuguuuguguccucuuuuauuucuuugagcagugguuuguaguucucuuugaagauguccuucacaucacuuguacguuggauuccuagguauuuuauucucuuugaagcaauugugaaugggaguucacucaugauuuggcucucuguuugucuguuauugguguauaggaaugcuugugauuuuugcacauugauuuuguauccugagacuucgcugaaguugcuuaucagcuuaaggagauuuugggcugagaugaugggguuuucuaaauauacagucaugucaucugcaaacagggacaauuugacuuccucuuuuccuaauugaauacccuuuauuucuuucuccugccugauugcccuggccagagcuuccaacacuauguugaacaggaguggugagagagggcaucccugucuugugccaguuuucaaagggaaugcuuccaguuuuugcccauucaguaugauacuggcuguggguuugucauaaauagcucuuauuauuuucagauauguuccaucaauaccuaguuuauugagaguuuuuagcaugaagggcuguugaauuuugucgaaggccuuuucugcaucuauugagauaaucacaugguuuuugucauugguucuguuuauaugcuggauuacguuuauugauuugcauauguugaaccagccuugcaucccagggaugaagcccacuugaucauaguggauaagcuuuuugaggugcuguuggauuugguuugccaguauuuuauugaggauuuuugcauugauguucaucagggauauuggucuaaaauucucuguuuuuguugugucucugcccggcuuugguaucaggaugaugcuggccucauaaaaugaguuagggaggauucccucuuuuucucuugacuggacuaguuucagaaggaaugguaccagcuccucucuauaccucugguagaauucagacgugaauucgucugguccuggacuuuuuuugguugguaggcuauuaauuauugccucaauuucugaaucuguuauuggucuauucagggauucagcuucuuccugguuuagucuuggggaggguguauguguccaggaauuuauccauuucuucuagauuuucuaguuuauuugcguagagguguuuauaguauucucugaugguaguuuguauuucugugggaucggugaugauauccccuuuaucauuuuuuauugugucuauuugauucuucucucuuuucuucuuuauuagucuugcuagcggucuaucaauuuuguugaucuuuucaaaaaaccagcuccuggauucauugauuuuuuuaagguuuuuuugugucucugucuccuucgguucuguucugaucuuaguuauuucuugccuucugcuagguuuugaauguguuugcucuugcuucucuaguucuuuuaauugugauauuagggugucaauuuuagaucuuuccugcuuucucuugugggcauuuagugcuacaaauuucccucuacacacugcuuuaaaugugucccagagauucugguauguugugucuuugcucucauugguuucagggagcaucuuuauuucugccuucauuucauuauguacccaguagucauucaggagcaggucauucaguuuccauguaguugagcgguauugcggguguuccuuaauccugaguucuaguuugauugcacugaggucugacagacaguuuuuugugauuucuguucuuuuacauuugcugaggagugcuuuacuuccaacuauguggucaguuuuggaauaagugugaugugugcugagaagaauguauauucuguugauuugggguggagaguucuguagaugucuauuagaucugcuuggugcagaacugaguucaauuccuggauaucccuauuaacuuucugucucauggaucugucuaauguugacagugggguguuaaagucucccauuauuauugugugggagucuaagucucuuugugggucucuaaggacuugcuuuaugaaucugggugcuccuguauugggugcauauauauuuaggauaguuagcucuucuuguugaauugaucccuuugccauuauguaauggccuucuuugucucuuuugaucuuuguugguuuaaaguguguuuuaucagagacuaggauugcaaccacugcuuuguuuuguuuuccauuugcuugguagaucuuccuccaucccuuuauuuugagccuaugugugucucugcacaugagaugggucuccugaauacagcacacugaugggucuugacucuuuauccaauuugccagucugugucuuuuaauuggagcauuuagcccauuuacauuuaagguuaauauuguugugugugaauuugauccugucauuaucguguuagcugcuuauuuggcuuguuaguugaugcaguuucuuucuagcaucgauggucuuuacaauuuggcauguuuuugcaguggcugguacugguuguuccuuuccauguuuagggcuuccuucgggagcucuuuuagggcaggccugguggugacaaaaucucucagcauuugcuugucuguaaagaauuuuauuucuccuucacuuaugaagcuuaguuuggcuggaugugaaauucuggguugaaaauucucuucuuuaagaauguugaauauuggcccccacucucuucuggcuuguagaguuucugccaagagaccagcuguuagucugaugggcuucccuuuguggguaaccugaccuuucucucuggcgcccuuaacauuuuuuccuucauuucaacuuuggugaaucugacaauuaggugucuuggaguugcucuucucgaggaguaucuuuguggcauucccucuauuuccugaauuugaauguuggccugccuugcuagguuggggcaguucuccuggauaauauccugcagaguguuuuccaacuugguuccauucuccccgucacuuucagguacaccaaucagacguagauuuggucuuuucauauagucccauauuucuuggaggcuuuguucguuuauuuuuacucuuuuuucucuaaacuucucuucuugcuucuuuucauucauuugaucuucaaucacuuauacccuuucuuccacuugaucgaauuggcuacugaagcuugugcaugcaucacguaguucucaugccaugguuuucagcuccaucagguuauuuaaggucuucucuaugcuguuuauucuaguuagccauuugucuaaucuuuuuucaagguuuuuagcuucuuugcgauggguucgagcauccuccuuuagcucggagaaguuuguuauuacugauugucugaagccuucuucucucaacucgccaaagucauucuccguccagcuuuguuccguugcuaccaaggagcugcauuccucuggaggagaagaggcacucuauuuuuagaauuuuuggcuuuucugcucugguuucuccccaucuuugugguuuuaucuaccuuuggucuuugaugauggugacauacagaugggguuuugguguggauguccuuucuguuuguuaguuuuccuucuaacagucaggacccucagcugcaggucuguuggaguuugcugcaggucacuccagacccuguuugccuggguaucaccaucggaggcugcagaacagcaaauauugcagaacggcaaauguuccugccugauccuucuucuggaagcuuugucucagagggguacccggccguaugaggugucaguuggccucuacugggaggugucucccaguuaggcuacucgggggucagggaccaacuuaaggaggcagucugucuguucucagaucucaaacuccaugcugggagaaccacuacucucuucaaagcugucagacagggacguuuaagucugcagagguuucugcugccuuuuguucagcugugcccugcccccagagguggagucuacagaggcaggcaggccuccuugagcugcggugggcuccacccaguuugagcuucccggccacuuuguuuaccuacucaagccucagcaauggcaggcgccccucccccagccuggcugccaccucgcaguucgaucucauacugcugugcuagcagcgagugaggcuccaugggcgugggacccuccgagccaggcgugggauguaaucuccuggugugccauuugcuaagaccauuggaaaaucgcaguauuagggugggagugaccugauuuuccaggugccaugcgucacagcuucccuuggcuaggaaagggaauucccugaccccuugcacuucccgggugaggcgaugccccgcccugcuucggcucaugcuccaugggcugcauccacuguccgacaagccccagugagaugaaucugguaccucaguuggaaaugcagaaaucacccgucucuguauugcucacucugggagcuguagacuggaaccguuccuauucauccaucuuggaacuuccaacacuuugcaucuuucaauccaaucaaguugacgcucaauauuaacccucaccggaauguuauguguugaggcaauaauuaauaguuauccuugguuguuucagaaaaugucaugauuaauaguuauaguaaagggaggaauuguaacuugacaaaauaguuuggucuaguguccaguuuacagggcauugagaugguuuucugguuucccuuguuuugcccucaguacacaaugcucaguauucagaaaggcugaugucuauuuucuccacaagugcuaauaaaaauuuuuaaaauguggugugcauuauuuauauaguuguuuuauucauaaaagauuuaaaaucuagguaagcuaacucaaaaugcgacuuuguacucugcgauuuuuaggccuagaaguggucaugacugugaacauuauguuggcuuggaaccuuuaaaaguucauuuggucuguacugcagguggcauuuggaugaaagcacaggugguacauacaguacuucgaugacuccaucuguuugguguggcauguuuaagaaugacuucuguuaaagggauuugacucgaaaugcaagcccucuuuccuggcguguuggucauuuuugugacauuagugguggaaaagaagcucaaaauggucucuggaguggaguaacagcagggcuuacuuuugaaauugucuuucaaaugcccuuuugggcauggggucaccguguuuaaagcuuuugaaagacuccccacagaaaugaaucaaguguugcauuuucagugugguguccaauuuugugaucagagguacuguagaggaaagucggguguuuucuuaaauuccuuuuucuuuuuggaaaagucauuuacuuauuacguuuaauauaaagaauguuuuaaaaagagagagagagagagagaaaacaccugguuguuagacaagcuggcuccaugccaaagugaaaugaaacauacagcaaucaaaugucauuagcauccagguccggcauugacccauucuuuccuugcugaaauugugugugugugugugugugugugugugugugugugugugugugugugugaauucagagaagaggcaaauuaauguggcuuagaguguugaaaaauggacuuaagaaagaaaauggggauaggaauggcuaaaauuuggauagguggaaagaugggauaaaaacacuccaggugaggaaacaaacuuuuguuaacuugacuuugaauauuuuggggacuaugcauggaauguaugucugaggcuuuuaaauugagaaagcaugcuucguuagacaauuaucucuuacauguaugcacagccuuaugugacauuauuuauauaacuuuagaauauauguguguguauguauauguauauguguguguauguauauauauauacaaauacauauacauauuggggaaagaaagaauuaauuagacuuuaaauucuucccugcuuuuuuccaugacaauauugauuauuuuauaaucaauauuuagugauaacuaaauauauuuagugauaacuaaauaaauuuagugauaacuaaaaaaugaaauaacauaguuuagaaaaccuacgaugagcucccaaaccuuauuucucucguuuauuuauuugaaagacauuuuucaaaaucugccccuuuauuaaauugcugauguuauacagacagaaaaaaccaguagucggggguagaucugcaaaauaaggacgucaacuaugggcuguggaaaccggcucuuccaaaucugugcugccccuaccauuggcuaguugucccuuccuggggaaauuuuuugaccccuugaggguuguuuccucgucuacaagaugcgaaaacaacauccaccugaagauugaaugagagcacuaccuagugaguugccuaaugaacaacucaugauagacauaauaaaugccaguugcauucuauuuuccuguaccucagaaaaauaucaaggcuucccuaccuaaacauucauuuuccacugcuucauaucucuauuagcuaguauaacuucauucucucuuuccagcuuucaucagcacaauuucauuauaauauuaauuucucauuuauaaccccguguuauuguuuuuauucuccuuacaaguuguuuuugcuucaaugccucuuuguacuaucaugaaauauauuuccuccauugcugagugaucucuucaauuauucucuguuacauguaccuuccuuugauuuaucuuuuuacgaccuccacaaggcauuuuuuuuuucuuuagguuuguaauggcuuugcuugauucugaaacggucauggccucgagggcaaccagagucuuguucuuacugccugcucuauggcuucucuaguaaaaccucagcugugaaagcaaguaucuuucacuucuccuaugcucaacuaacuucagucuuuguguccugagaucagacaaucucacauccacguaaccccagguccuaccacugcacugggcauaaaccaacacauuugccugcuagucacaguagagaaaaaucugugaaaccuuugucauuuggcaggcacaaagucauucuugagagaaaaacccaguuugcauuaaucaaacagcuuucccuucccauuucuaccuuucuuugaggcauuguugaauacacacacacacacacacacacacacacacacacacacacacauauauauguacguauguauguauuuuugaaagccauuuuauuuguaaaauucugugcuauagcaccgacucuuuauaaagagucauacccauguuaaaaugucuucuugauaucauuaauauccuucuucuugauauuuauuauucauacuuugauaugguuuggcuguguccccauccaaaucucaucuugagauugggugggauggagcuggugagagauaauugaauccugggggcaguuucccccauacuguucucgugguagugaauaagucucgugagaucugaugguuugauaaggggaaaccccuuucgcuuggcucucaugcucucaucugccaccauguaagaugugccuuucaccuuccgcccugauugugaggccuccccagccacguggaacugugagucuauuaaaccucuuuuucuuuauaaauuauccagucucagguaugucuuuaucagcaccaugagaacagacuaauacacacuuguuuguaggauugaaaucuacaugauaaauaaggugauuuuuaaaagaugagcaguuugcugugcuuguugcuguaagggaucuucagggagucccugaaucugagaauuggaaguaagguuggaagaucauccugugccucccuccauccaacacaguaaucuucuuaaugucucagucagaggcuguucaucacugaugagccugccacugaugagcaguccuggcaucaucacuuccucugcaaaggacacugugaucugaggccccacuccaugucaggccacuccuuagacaaaagcucugucuucugaugagcuucugcucccuuuugcaccaugauaaugacuuuauuuuuaguaaggauagacucacucaauugauguuuucugcuguuggggaaaaauuguuuuauuaagaagcauuuuccaacaaguaaguugauguuaaguaggcuuggauauauuuggaauucacgaauguguuuucuccauuaguucccugaaaaccagaaaacuugacguuuguuuuaaugcaaagaugaacucugguuuuguccaacagagcuagugcuggccuuugcuuucaagcccuguaaucugcaucaacccucaaauucagugauucaaaagugagugacucacuucgucuuugaaaagaccgugaauauuucuagauuuaugagcaauucaaaacagccaggcuuuuagaagggauuucccaacucauuuuguugaaagguaggacuaagacuucucuagaaaagaaaccgaucuacuaaguacuaaagaguauuuaugagccacgguagacuuuauuuuucagaaucauacuacaaguguaggaauacccaaacccugccaggguuuugaaaauuacauuaauuuaugcccagguauaacccccccaucauaaauccugaaaaaugugcaggaagacugugacaggccauucuaagagcguaacaagggcuacaucuuucagcaccagacugauguuuauguaugugacuacuuggaagauguuuuacuuaauguaccauguucuuaaauuggcucuauuuuaaauauaaucguaagaguuacacuuuauguuuguaugccagguaguuuauaaaugaugauuuuaaccacuccccguuucacaccaccccagccuuaugagguaaguuuuauucuuccugcuuuaccucuagggaaacuaaaacucagaaacugcaagaccuugccaagguuacguccaauaaguagaucacuaccuugggcuguuggcugccauacucacauucuuccccugcauucuuucccuugugccuucagccuaucuuuggaaaggaauuucugauguuaaggcaccuauuuguuuggcuuugguguaguuuuguuuuuugguguuguguuuaucugugcauagaguaacauauggaggucugggaauccuuguuuaucuuccaaaauuauaguucugugaaccacaaaauuucacguaaauccuauuaaagcugaugugaaauagaacuagagagaugauaggaaaaggagagugaugaauuuauuaaagcuuacucccuuuuaauagacaccaucaggcucauguguuagguugcuaguuaauuuugugaggauuaccuuuccaaaugacuucaauaauuuccacugcucuauucaaaaccuuauuuuacauuugaaggccuaauaaagaagaaacuaugauccuuuccuuguguuacuugaaaguuuauaggaaagcauaaucccagaugggaugguucuaucugucccacaacaucuguauaagaccgacgcuggcaucaaacgcauuucauccacacacgcuuccuaaaucagcaucagcauuuaugagcaacucuucaagucucuuguucacaugcaugucauuuuaaugcaguuuauuugaaacauccgguagaauguuccuucuuacccguuucccuaaagcaugagaagaauuggcaagugaugagucauuucucugucaaacauaggauugaugcauuuagaauguggaagacacagucaugaccagucacaccaggccaugggccagaaacccaucaaacaggaggcagagcuggaagcacaauuuuauuuuacccauuuaaaauuaugugugcauugacaccaaccuucaugcacgugacccauaacccagcaagaauuauuucauucauagaaagucaccaaggccuacuuaguccucacagacuacuucuauuggauucuggguuuagcuuucccccagcuucacagugguaauguuucacacacacacacacacacacacacacacacacacacaguggcagcaggaaaccagucuacccauugccuugcuguguauaccacccuggacugagacuugaacccaguccgagcccagcucugacacuacccagccaugugaccugggcucagcuuccuuuccugugaagggugagagucucagugcccuccugaccccugggguugaugggaggggcugcugagaugaugugugacaacauuaaaguucugcacgcauguaagcucauuucagaugugccccaaucccuuuggcaucuuugugaggacuuccauuugccuuuugaaugagacuaccucuucugauuuugguuucaagucguaaacacaucuuuaacuuagacucaccauccagcaguccccuggguaugcagaugcccugcacucuucccagugccacacccugcugcaggugcauggugcccuggccaggugcgccugcccuucucuugcugucagcgucccucuuuucuuccagauacagcuggggagacucccuuuacauggagaugugccugacuccacuacaggaugcauuuacuccggucuucucuugguuacucacaguggccuguucccuccugaccuggggcccagcacaggcugcccaccaucuccugggaugcucucacccucuuuccugcucuuccuggaguucagggccucuguucucccuucucacauacaucacucuguauuuacucuuugaaagacucaucacacucauaaaucaauacuuauuuuaucauccuuuguuuaaugucugucaccucuuuuucugcagacuucugagggacagugcuauggacucaauggcugugucccucuaaaaucuauauauugaagcccuaacccccagugugaugauauuuggagguggggccuuugggaggugauuagguuugaggguagggcugccaugaugggauugggggccuuauaaggacgaaggagacagccaagcauucucucccucucucucucucucucucucucucucucccucucucccucucucucucuguccuucucucucucugucccccucucuuucugucaugugaggacacaggcaggaugagggcucucacuggaacuugagcaugccagcaaccugaacuuagacuuccugccuccagaacugugagaaauaaauguuugcuacuuaggccaccuagucgguggcaauuuguuacagcaguccaaacuaagacuguauccccaggauccagcacaaugcccagcauagagauuuucaguaaaucuuagaugggugcaguagugacuguccugccucugauuucuacccgucaccugucacacucccuuuauacuuucccagacagcuagcauuucacucacauugcugcacaggccuggucuccuaugaguuugaguuauuuacugaaauugauauucacaaguauuacuucuuuucaacaaacaugcuaaagcaugaacuucuacauuaguguaguaaccuugguaggcuguaaacuccccacagccacaugcaggacacuuggaguauugcuuguaggaauugacuucaaggcuugaagcuuuuaagaaaaguucucucaaugaggauauauguguguccuuagagaaagaauuucauuacauaagagaaacccacucacuccaauucagguuuggagaguaagcuagguaagcaagcuugaaaauugugaccacuuagggucaaaaauggcagguaguaagguugucaugcuguggagugagcaagcaccuggggcuguucuuaaccuucacuauuaaccagccgugugucuuagcugaauuacuuaaccucucauugcuuugauuauuuccucuguaaguugaggggugugguguacuauaucuaugguuauuuuucuguucugaaaucguguauguggcugugugugugcaugcacgugcaugucgcgggugaaauguacugacucguaacaaagcuugagagaaaaucaggcuuaguacaauggcaguuugguuggauuaaagcccccuuucaaagacaacacucuuaucuguugauguucuauauguuuguuaaguaaagcaauacaucaaaacuuuucaaaucauggaauauuuaaaaaaugauaauauuuugaugguacacugaaguaaacuggugagaugauggugucuauaugaggcuugaugaaaacuuucaccgcauauuuuuauguaauuauucauaaaacaaaauacaaaauauuagggaagauauuaaauuuugaaguugugggaaaccuccaaauaaaaaauguaucaguuuauaauugagagugaugaccucucuucggauuuccaacuugaaaugcuucauucagcagucuucagagagucaccacuuacaagaaauuuugcucauagaaagaagugacaaaaaauaaaaaaucauuuucacaacuauuaacuuccuauugcugcuguaacaaauuacuauaaauguaguggcuuaaaauaacacaaaauaauuaucuuacaguucaucugaacuggguuuuaaugggcucaaauuaagaugucaguagggcuguguuccuucuggaggcucuaggcaagaauuuguuuucuugccuuuuccagcuccuagaagcugucugcacucccugacucguggccccuuccuccaucugcaaaacacauccuccagcgucacaucucuuucucccacucugacugucuugccuggcucugacaaggacacugugauuacauugauucgucccaaguaaucuaggaucuuccagcauccuggaagcugccugcauucuuugacucguggucucuuuugccacguaaaguaacggacucacagguuuuggagaugaggacgaggacaacuuugggggaaucauuguucagcuuaucgcaaccacccuucaaaaauucccaucaacugaaauuauguuuaaagaaucaagcagaguuuccuuuucuguugcugacaaaugugaugcugaaauuucuugcaauaaugugaauggauuucuaauccaagaucacuuuuuauaucaaauauuucaaaguaauggugacucugcagaaugggcacacccuugcagagcagccaucuuguagcuaaccgggaccaggaaaaggacacgucagcuagaagaagacaggagguggccagaggcucugaguggcugcugagaugggggcccccaucucacuugucccucuccacccccuguuaucacccugcugagcacugugcuggcuccuuggguucccaggugaugaggcucuucagcagcccuuuguccucgaugggcgagggacacucugccugaaguacacaucuagcuggggggugcuggauguugcucccagagcugagaccccacuuugcuuaggccaccccugaucuagacagaucagccucaaagggaugaagaucucacaagccugccguggcucccaggugggaaucuaagcaaggcagggaguguguggguauggaacagggcuucagagucaggcuacuggugucaaacccaggaccuccugaugauuagcugccugacauggugcaggucaccucaccuuccugagcagcuucuauuguaaacugggguucuugccuccuagguugcuguagaaugagguccggagagugcuuugcacagugcugagaacagcaucaaugcugaucacugaugaugagaaugaggaugcugguguuuucagccuugucuuguuuucuuucucccaggguaaauucuuagucaucuucaccuuaccugcucuguacuuaucaggggugcuucgugcaauaagcacaugauggaaagugucaaucguuguggcagccacaugacaucuagguccugauagaagaggcccuacccggcugcugguuagaggcuugccaugugcagggcuggggcugcugcguuagcagguguguuagcauuccacaggugagaucaguugacuguagcaauuacuucaaauggaaugaaacagaagccuuaagugauuccaucucucuuugauacuccauuucuaccugcauaagaucauauaacauuaugaugaauuccugagcuaauuuggaaauuauacauauuuauauuucgguuguuauuauagcaguagugcacugaucauuugauuccgaaaguaauuuccuucuacaaauuuacccuugacauucuaaaauguauauucagauuuaauggaaaaaaagauguguuauaaaacaaggcaguguuuuugagccugaaauaguaagggaagagcauuaauuugcuuuuaaguuuaauuagaaauggaaugacuuucuaaaucauaauugauagcauuuuaauuaggauauuauuuuucagugucuggaaugcucauuuuucacauuugagaucaagaaaguacuuuucgggauauguuugccuuuguuaaccgguugggugagccuuccagauuuuuuuaagcagauauuuuuguaaaaauauuuaaauauugauuguuaauaaagccauuuguuuuaauucaguggaaaauaauuuuauuaaggcuuaaauaaagcugugccagcaauuuuccuucaucacaguguuuuggggcugcauuaauuauaagcaauggagcugcuggagacauuuacacagcacacaaauuccucauuguuagcaacggcuggugugugcugacagcuaccucuuagagaaaugcaacccaugguuuaacgguggaaaguguggcauuagcauaauuucuuggcagggacaaagcugggguugcagcauugucuucaacagugacuccuucguuaacagugucuuaucaaggccuggacucccggggcgacaugccgccacaugaucgugucauagguaaccggaauccugugggaaauggcugcuucugaauaaaaggggaaggauuuaaauugcuuaugauuaugauuugaaaaggaccuguggaagaaagauucugaaaggaauugcuuguguuugaucaaaacugacacagugucacggcagcuucuuugacauugacaguaaugcauguuauaguuuccauaaggugaucuagaauuaaaacauuguauucuucagagaccaauucagacuaaaauagaucugcuaaugcaaggcuucagagucaagaauaaauuauagccccugagguucuggaaguucauuugcauauuguuaaguguaguucagauaauuggaaaaaauuuuuuguaaauuuuagaagauauaucaagacaguauuggaaaguaauagaaaauaucaaauaauuauuuuauauuaauauuuguccuuuauacaauaaacuauucccugaccucaggauuccuuuugauuuugugaauaauaaauagaauuauaaaacuaaauauaacuggcugggugcgguggcucacgccuguaaucccagcauuuugggagacugaagugggcggaucaccugaggucagggaguucaagaccagccuggccaacauagugaaaccccaucucuacuaaaaauacaaaaauuagcuggacgugguggcacgcaucuguagucccagauacucgggaggccgaggcaggagaauugcuugaaccugggaggcggaguuugcagucagccgagaucgcaccacugcgcucccgcuucggcgacacagcaagacuccgccucaaaaaaacaaacaaacaaggaagcuaaauaugacugguaaaauuugguaauauaagaugaggaaguagcgaccauuuauugagcauuuacuguauccuggacaggcagugugauaagugcugcacacauuuaauacaucuaauuuacauuugauuuuaaauuuaaauuuacauuaaauauauguauuaagcuguucuugcauugcuauaaagaaauacuggugacuagguaauuuauaaagaaaggagguuuaauugguucgugguucuguaggcuguacagaaaguauggugcuggcaucugcuucugaggaggccucaggaagcuuacauaugcauggcagaaggcgaagggagagcaggggucucacaggacuagacaggaaugggagcaagagagagagugggggaagugccacacacuuuuaaacaaucagaucccacaagaacucacuaccacaaggacagcaccaagccaggagggauccacccccaugacgcaaacaccucccaccaggccccaccuccaacaccgaggauuauaucucaacaugagacuuggaggggacauccaaacuauaucaauauauuuaauuaucuuaacucugugacuuacuguccucaaguuguaaauggggccauuaaacaucaagaaaauuaagugauauuuccaaagucacucggcuaguagagggcaggucugagauuugaacccaggucauuugauucuggagccugcaggauugacucuacaaccccugggccauguucuuugucacuacucaguucuacugaauccauuaagugauuccccugaggcuccuuuucaccaucccucuugcauaagcgugauugugucugauuguggcuauuuaaaauacacagcacccugaucauucauuucauaguccuuucucuugucagcaauucuaccaauuucuucuuuauucguuuuguuguuuuuguuguuguuguucucuauuggauucacgugggcauggcauugggcuccucugugcugaccacguuuccuuaucuccucuccaucccagucguacagccuggaaagagggggugcguuucagggaugagaccagaggguaucuuugcuucagauuuuccagagccuucuuacuugcggauccugugggcccaugaagugugugggggaucauguaugaguguggggggucauauaugaguuggggggggucauguaugagugcggggaucauguaugagugugggguuuguguaugagugggggguuauguauuauugugggggucguguaugaguaggggggucauguuugagugggggguuguguaugagugcggggauuguguauaagugggggcaucauguaugagugugggggucguguaugagugcggggggucauguguggguggggggaucgugugugggugcggggggucgugugugggugcggggggucguguuugagugcggggaguuguguaugagugcggggggucguguaugaguguggguaucguguacaaguguggggggucauguaugagugcagagaucguguaugagugggggggucguguaugagugcgggggucguguaugagugcgggggucguguaugagugcgggggaucgcguaugaguggggggaucguguaugaguguggggggucauguacgagugcuggggucguguguggguggggggguugugugugggggcaggggaucguguuugagugcaggggaucguguaugagugcaggggucguguaugagugcgaggggucguguaugagugggucguguaugagugugaggggucguguaugaguguggggucguguaugagugcgaggggucauguaugagugcagggggucauguaugagugugaggggucguguaugagugggguggucguguaugagugcagggggucguguaugagugugaggggucaugaaugagugcgggguuggguaugagugugaggggucaugugugaguguggggucauguaugagugcgaggggucguguacgagugcggggaucauguacgaguguggggaucguguaugaguuuggggggucauguacgagugcggagauuguguaugagugggggggucguguaugagugcgggggucguguaugaguggggggaucguguacgaguguggggagucauguacgaguguaggggucauguacgagugcggagauuguguaugagugggggguucguguaugagugcggguaucguguaugagugcgggggauuguguacgagugaggagaucauguacgagugugggggaucauguaagagugcgggggucgugugugagugcgggggauuguguacgagugaggagaucauguacgagugugagggaucauguaagagugcgggggucguguaugagugcggagaucguguaugagugcggagaucguguaugaguacgggggaucauguaugaguggggggggucauguaugagugcggggaucguguaugagugggggggaucguguaugaguguggggaucguguacgagugcggggggucauguacgagugcggagauuguguaugagugggggggucguguaugagugugggggaucguguaugaguggggugucguguaugaguguggguaucguguaugaguacagggauuguguaugagugcggggaucguguaugagugcggggggucauguaugagugugggggaucguguaugaguaggggggucguguaugagugcgggggucguguauuagugugggugucguguaugaguguggagaucguguaugagugcggggggucguguauaagugcgggggucguguaugagugcgggggucgugugugagugcggaggucguguaugagugcaggggaucauguaugagucggggguucagguaugagugguggggucagguaugaguguggggaucagguaugaguguggagauuguguaugaauguggggauuauguaugaguauggggauuaugugugaguguggggaucauguaugagugucuccaggacugacagaauauccccuggugguuuaagucaaguggggcccagagaaacucuggacagauagagggugaugcucuuaguuccucuuuuuacccauaaaacaagagguucaacagaacaauacauuguuugcaggaacaauauguucugaaauuauaagcucugaaauuuauucuugaaaagaucuuuagggccccagaaagguuuaggcucccauaugguuuaggggauaagcucuaugcccggaggugcccugugccagcccacucccaggcaaccugugagcuaggccuggcccuuuacaauuuccuugcacccccuuggagcaggugcugaccagaacagcuugaucaccuuccccugucacugggaguucugugaucauccacgcuccaucagcauucucuuuugacaagaagcuuguuuuguauaaucucccaccggaaaugauggaaguggccugagaugaagaugagccucgguaaaaucuguuauguuuuacuucuggaaagugggauucagccuggauuaugaaguacaugaauuuguguuuugcagcucaguggcucucaaccuuggcuagacaguagaauuaugugaggaacuuuaaaaauaccaaauaccauggacuugucccagaauaauuaaaaucagaaucgcuaaggcugggcccugacagcaacauuucuuaaaagcaggcgaguagaaugugcagagagggcuaaaccuugagugagaagauggugaggcagugaaggcggcucuaauacugcuacugcuacuuguaguagugcagcuaguacugcuagugaacaguuacuaggugccuaucaugugcugguguuguucugagcauuuuucauagaacaaaauuauucucaugcauuccuuacaauaaccuaucagcuuauuucauuuucacugauguguacuuggaaaaccuugaggagguacagcaguguauucagagugaaaucauguuucauggggcauucucuacuacaaaggugaaguuuaaccuguuugucuaggugcaagauaucugacuuuucuuuuuucuuuuuuuuuucuuuuuuuuuuuuuuugacaaggucuugcucuguugcccaggcuggaggcuggugugcaguggcacgaucucagcucacugugaugucucccuccuggauucaaguaauucucccaccucagcugccugaguagcugggauuacagguacccaccaccaggcucagcuaauuuuuguauuuuuaguggagaugggguuucaccauguuggccaggcuagugucaaacuccugaccucaggugauccacccaccucagcuucucaaagugcugggauuauaggcaugagccacagcacccagccagaucucugacuuuucauauccauugucuugucauagaagacuuagguggucuuggacagcaaacaugccuugguucugccagcugagacccagguguaguacaguaaacagugaucuucagauucugaguuacaaauccuggccuccuaauuccuagaaucagacuucacaugaguuucuugaaaugcaucuuugcuaaaaauauuuuauaaaacugccaaaguaaagagaucuugauaacauacugccaugcagagacucagguaguacauacaaaguccuccaagugcuccaacuaacuccuguguacuuggauguaacgccuuuguaccuuuccaugugaucccucauguuacauuuacaaccucccugggagggcuccaucaugaagggcuagauggguaaggugaaauuuagauuguguuguaauuuagcugguugcaaaaucugagaucacuugccuucuagucaggucauuuaaaaaacauauuaggcagggugugguggcucacaccuauaauccuagcauuuugggaggccaagguggguggaucacgagaucaggagaucgggaccauccuggcuaacauggugaaaccccaucucuacuaaaaauacaaaaaguuagcugggugugguggugggcgccuguaaucccagcuacucaggaggcugaggcaggagaauggugugaacccaggaggcggagcuugcaguaagccgagaucacaccacugcacuccagccugggugacagaaccagacuccgucuaaaaaaaaaaaaaaaaauuaaaccguuaguguaguguuguugguuuugguguauucuucuaucaauguauagaguauguaaccaccaccaucugcaagguauagagcagcagcauggaguucccagggauggacuagggcgucaaagccaccuuuugucuccuccgcuuaccugaggggccugguuaagcuuaaguuucucuaagagguuaagcucuauggccagcccucacuagugauuucuuggcaguuaggugacaaacucagaaaguuuggcugaugauaggaaugggaaugugugaaguuuuucccgcuugacaagacacuguaauucaugauccccaucagagggacuugagccaugaaaacaaggcuggaaucaaaacucuaaagguauagguuacuuuucagaaaaaaaugaacugauuuacccauagaggccucugaaaauaagaauguccugccuggcacagugcugccgucuggaucugagccuggggugcccuggguggguauagacaggacauguggaggagggugucaggagcgugcuuguccucuguccugguccagacccuugccagcccacuuccaccuuuucuucccuuccccgaauuuagaucuugagcuccaugcucaaaggccuggagaguuuggggcugcccuuccauccccacaacuuaacacccaccaucgacuccuugacaaggcagaguagccagaagcuccuuugaugccugggagccucuccaagaaagcucguuuugauaacagcacucauccuuugaucuccacagggagcaaguuaccaacuucauuuuuuaaaauucugacaguuuuguugacuuugcacucugaugaaagcguaaaauccuaggaugaaaagcucuaccuacauaucaaauaauaaaauaguuauacccuagaagaagagaaacucacugucuccugcuaaagaaauaccuucugucuaugcaacuuuucuuucccccuuucuauaccucucuuauaagggcaaagcauuuauagccucugaguucuaagaaaccaugggagcacggugaucugcuggugagauaaccgagauaacagggcccaugguccaggugccaacaccgaggacccuuguuccuuuaugugcacagaaagaagcauuaaagagaguugucucauuucugguugggcgcaguggcucacaccugcaauccuagcacuuugggaguccaaggcggguggaucaccugaggucaggaguuugagaccagccuggccaacauggugaaaccccaucacuacuaaaaauacaaaaauuagcugggcauguuggcgggugccuguaaucccagcuacucgggaggcugaggcaggagaauugcuugaaccuggaaggcagaggcugcagugagccgagauugcgccguugcacuccagcccgggcaacaagagcaaaacuccaucucaaaaaaaaaaaaaaaaaaaaaagaguugucucauuucugugaugugacaucugauuaugaaagucuucuacagugaaggaaugggggaggaggaagguagaaggagggaaaagaaagaaagaaggaaggggaaagauaagaaaaugacgaauuauauuagaauauuuuugcauuuuauggagcaggaggugucaacaguagucagccuguauggguuugaauuccgcuguuuguuuacuggagauguggguaaaaugcuugacuaauauugcuuugaggggcgcuugugaggauuagauaaaaugaucuuuacaaagugccugccaaguaguaaacacucaauaaagguuguuauacaauccaguggcaaaaaauaggauuuucauuucuuauuugguuucuagauccuucuacagaauaggaggugcucuguaaauacugauugaauauguagaugcgagaaugccuaaugaggagguagagaacuagugcggcccacauugcccacaucucuucuuaccaugcugaggaacuuuugucaugcguauccgcgcaucucaauuuugagguaaugcuuaacucuaccagggaaagaauuuaguguagacauaacuguuaagacagcuacaaagccaguguccuuaaaacaaaaagucauugaauagaaaagagauagaauugaccauuuugcugugauacacuguucucuuauuuuaguauuucucacuuagaacuaacaaagguuuuaacuguugagucaaagguaugccauaggacuuagaccaauaccagguggaagguagugagaaggauugucuagaaggaagugugagaugccguuagacauccaagcugaggugcuaaggaguuaguagguacccgagcuuggaguuugaggaagcaaucaggcauuuaaaucauucuuuuuaggaguuuuuaggaacuucaguucuuauggaaacauugaguauucuacacauccauguaaaagcuuaacagacuggacuuccuguuuccacugagguugaauagaaaugacaguaacaacagucacaauauuuaacuuuuaucaagggcuuacuuggugcuuaauccugacuugggugcucuguaugcauuauuccacuuaaucccagaccaugucuaugaccuggauaccaucauucucuucauuuacacaaaaagagauagauacggagaaauuaagaaaaugacccaguaucauacagauagcuaagucauggcauugaguuauaaggggauaaauuaugagauggacuucugcacaauguguguccucuaaaauaggucuuuucccccaaacuccaugauuagugcuucuguucacuuauuaaaaacacugggccaggcgcaguggcucacgccuguaaucccagcacuuugggagcccgaggcgggcagaucacuugaggucaggaguucaagaccagccuggccaacauggagaaacccugucucuacuaaaaauacaaaaaauuaaccaggugugguggugcaugccuguaaucccagcugcucgggaggcugaggcaggagaaucgcuugaacccgggagacggagguugcagugagccaagauugcaccacugcacuccagccugggcaacaaagugagacaccgucucaaaaaaaaaaaaaaaaaauugcagacccuuuggcuaaggagcaaacugggcuaauguacuaguaauaguuccuucuuacaagccauugcuaagauuuugguauaaagaguuaguuaaugugguauuucguucauuaagugaauacugaguaccugcuauuuuccaggcucuguucuaggaacugaagcaaugaacaggucacacaagucccuguucucauaaagcuuguacacuagcugaaagagaaagacgguaaacaaguaaaugagugugcuauuuuagacaggguauucagagugggcaucuauaaagaaguuccauuugaauagagacugaaugaagaggguggggaagagcuuuucuggaagaggauagagccaguucaaaaggccccucauugacaagaggcuggagugcucugaaccacagagaaggcugugguggcuaguggugcauggagggggagguggggccugggugaugcagggccuuacagaccauggcgaggagcugacucuuuuguguguagagaaauugaguuuaagcagagggcuaccaugaucuaguagauaaggcugaacgaucucucugguugcuauaugaguaggagaggaaauuggugauagagacacaaggcaucucucauauggcccagagggacuggugagaaguggucagauuugaguuauauuuugaaagccaagccaauaggacuugucuuuggguugguaccuauagcauaggggaaaaacauggaucaagaaugacucuugggcuuuggccugaaaaaugggacacguuuggaggaagggauauauuguauaacccaauaaggaagacaguggaggcagaaauuugcaggauggaauuggagcaaauaggguucuguuuuggacaggggaagugugagaugccuuuagacauccaagcugaggugccaaggaguuaguagguacccgagccuggaguuugagguaggaaucaggcauuuaaaucguucuuuuuuaggaguuuuuaggaacuucaguucuuauggaaaauuuaguauuuuagaaauauuuaguuguugaggcugucuucgauccuugagauugauuccuggagaacaugcuggugugugcugggauuucucacgcuuccccuggggaaggcauauucccaugcugagcagaugggagcuccaggcagccgcaccagcugcacggugguagaauauuucuaaauaguucucuaggcacaggcagcuauuuuucugaauucuuugacucauauaaccucuuuacuaaauccaacauagaucuuacauccuauucaugcacgcucucaguggaguucagaaguacauuaauuaaggucuaacaaauuguucaucauguucacauuuaaaaggguccuaaaauagcccaaucaugggcaugcuggguguuuguguuuaagugucuuauacacuaaaacuggacccugauguuccuuuacuauauacaaauggccacugugaacaccaagugggcuauaaaucagaagaugacaaagaaaaggggaaggaugaugacucaguauggaaaaaccuauaagccagaacccgcuuauuuauuauguuuggauacauuuccccaguucaacugucccuggcuuaagcccugcuucccccuucuuaguccaguuucuuaagucauuuuugcucucugcugucaaaagcaccuuucauccacucagacuaagacacugaccuuaucccccaaucaucuacuguucucuagagguauucuugcaguuccguuccaugauuuucuacauuucauuccauuagcuuguuuggucauuuuuacuuuucuggugagaugauuuucccuagacucacaagaguuaccccucuuggauaggcgccuucgauuauacugauugcaucuuuggcuccccaggugaucagaugucuccagaugguaauguuuacagugccugccucacacagaagccugagauggcaggaaggacucuagguaggcuuuucagauggguagaugccugaacaugcucuggaaaaaccagucuucucuccucucugcaguuuaccagcugugugacugugcauagguuacugaguuucuccaggccucuguucucuccucuguuaaaaggggacacuucuaauccaucucugguauuugcauuaaauagauaaauaccuguaaagcacuuagcagaguagcugcuacugaaaggaagucaguaaacuuuaauucccuuccaaaucccucugagucuuuuauucaucaggaaacaauagccgugcacucugaauacacacaugccaguaaauggcuauuagugaagacaaaucaagcuccggaagcaagcuagccugaagagagaagagaaacagacaauuuuaagacaaauuggagaaagagaguaugggguucaggaccggcagcaucaguaucucuugggaacugguuagaaaugcagguucucagacuggggcugggcagucuuguuucaacaagcccugcggguaauucugaaguacaauaacauuugaguaccaauggucuaagcuaaacucagcagauaaugggugagaauaauggugcguguuacuguguguguuauguauguuugugugcauacauaaccauguauguagaauguuuguaacagcugaaacuauuaaucaaacauaguaauaucagcaaaauccagucaaaccagugauuaauuccccauuuuucuuugguacuguugucugagcagaaauacuguauaacuagaaugcuuaucuucaauaacuuugcacuaaauucauuugggauuuaaaaaacggauucaucaacuuuuuccuuuauuuucuaggaaauuccacuuacuuggaugaccauggaccaccuccuaguaagguaagaucuuugcuugugauauaaguccccuuuuucuuuuaucuuacuuacagccuccaacaagcagaacagaucucuccuggacacgaaucauucacaagaaacaguagaugacauaugugaaauugauguuuaacuucuaacaaggaggaagcagaaaagcaugaugauagcccagaugacagggagaaggagccauuguugaaucaguggcuguugcugcccaggcauuggagccugagacugacuucagaccucuggcagcuucuccuguuugcaccucauuuucauuugccuuggcaucgaugcuggcccacagugugauagccacacccggccuccccaugccuucgggcuuuggggcuagacucacaucuguccuguucucuccagccuaacuggguugggauacuccacuugaggcccugccaauaccaccucaaggcugcccuggccuggccugugaguccacuuuuguuuuuccuguaagcaguuuugucugacuuaaggggcagaauaauccuuuaguauaguuucccuaacacuguuuacuuucuugagcucaaugaaaaccgaaugcuaaucuacugaaaagugagcaaacuagaacaaauugaucauuguauauaagaaaauacaugcaaugcaauuacccuuuauucuaaccguaugucccuuguacuuuuuugacaucauuuuuuuuccuucuaggaaaugauggggauuguugaucaguacuugggaagggguugugcuuggcaaaauaagaaguuggcaacccucuaucugucacuucaagaauguucuuucuggccugugaaaucuuaaaguguagauacaagcacucuagcucucccuguacuugguuguuuucuuagucuuugaccacuuaaggugaugccuacaaaaugcaguuguaaauacacggugagaagauaaugaacccccaaccuuagaggcuuuggggaaauuuacuccuguauuaguccauuccugcauugcuauaaagaaauacccgagacuggguaauuuaaaaaauuccacaggcuguauaggaagcaugauagaggcaucuacucagcuucuggggaggcuucaggaaacuuucaaucaugguggaaggcagagaggaagcaggcgcaucuuacguggccagagcaggaacaagagggauugggggagguaccacacacuuuuaaacaaccagaucucacaggaacucacugucgccaugacagcaccaagggggauagugcuaaacccugaaaauccacccucaugauccagucaccucccaccaggccacuccgacacuggggaugacaauuagacaugagauuuggguggggacacagauccaaacaaaucagccccaaaguauguuuagaccacccccacauucaugagcaugaacuuuggaagaagauauuucuggauucaacacugacgcugccacuuucuagcugugugacaguggaugaauuacuuaauauuuugagccucaguuucucaugugcagggugggacuaaaaauaccgcuuacagcacaggaugccuaaaaugauugaaugagcugauguaugaugaacacuugacacugacaugcgauaaacauuaaaucaaggguggcugcuguuaacuguacugcaguaacauuaaaauuauugaugagugguacagcaguauuuaucacagucguggaaugguucuaccacuugauccaccaccuguuuauugaaugccugugaugcugcaggugguagaaauacaaauaugaaacaaaacaagaacaacaacaacaaaaauagccucuauucuagaggagcaaaggaauauagaggauuauguucucucuggggauaaggaccgugucuaacucgucucaguauccucacauucuuguauuagccucaaugcacagaggcacaucaugacuauucauuaaauuucacugaauuagaccauggaauccagagcuggaaucugaauuaggucuucuggcuuccaucccagguucuuucacugagccaguauucucaaacuuuagcuugcaucgaaaguaccuggaggcuuauuaaaacacagauugcugggcccaggccccagagugucugauucagugggucuggggugggagcugagcaugugcauuucucacaagcucccacaugaugcugaugcugucagucuggaguucacauuggagagccacuguucuaaaggccaugaauauaaagagaaccauuuccuuagacauuuucugugguguuuuuacuguuaauagccuagagagagugauauggcuauuaucuaaaguuuauuuauuaauguaaugaugacucaccauuguaaguuuucuuguagagaaaacauuuuuagaggggucaguuaccugccuaggagggacaauagagggggaaaagaagaauggugccgaagguccugguagguguccucaccagugacuuccuuuuucucccagguagggaggggcaaggugaagcacuccauagcccccugcccugucaugauauuauugaguuggauuagguggcucugucaaugggacccaucagcuguuuuccucaauggcuuuuuguuccuggcuugguaaacaggauuuuaucuggucugaagacccagacccuuuuuuuaugaacuugccuuuuugaccuuuuuccuugguggccagccugagucaacacuuuggucuuccugcuggucuugcuguggcuggguugucuguccugccugccucuuugcugggauugucagugccuagauucgguguuggcuggcuucacuuccccuucucccauagggucuucccuagcugugccucuucccccugccccuacagucuggucuucaacucccccauaucucccccaaccccuaacuaaagcuucuuguaauaugcaaaaaugaucagguuauagcagauuauucagaccccuuuagaguaaauccaguuuuauaaacucuuuacuaaguuugaaaauugggagcauaaucucuuuaaaucagcagaaguuuaccuaauacagaagcuuucacuauaacuguauuuucauuaucugggauuggagcagcaaaauacucuugauuuucuaagcaguagccauaagaagaagaauauaaaaauggguaaaaauauuacugguaugugaacaucuucucauccguucuuauugcuucuggcaggguggaaaugaaucucagaagugaugaggucagacuuccggauaaaggucccuuaaguguccccugggguggggccucagugguuuaggucuguagaccacuggcuuauccagggacaggguggcaugcagacgaugaggacucacacaugccuggccucuggaaugaacccuuacccuggcagggaaaagcaagacucaguccagacccaucuuuuucauauuugcuuagugcucaaaaaauaacuuuuugaugccaagacugaaagaguugagaucuagauaaaauaagauuuuuaaacccugaaaauauacugacguuacaggcgaguucucauuuuauuaaauguucaauuucacaaguuucacauuccacaaguaauagccauuuagggaauggggugugccacacaacacauacugggcccccguccucauucuguccaauauuuucauaagaaaaaacaaagcccucugauuuucacuuguuuuuaaaauccacuugaaccucacagcucaccucgguuuuugaacuaagccgcuauuuacaggucgauguuaauauuuucuuucgguugccacauuuuaccacuacuuuguauguacacagaauacggugguuuaagguuagagcacugacuaagaaucaccauggagauuucuagcaaaugaaacagaaagauuauuuuaaguacaaaaacaaaagcaugauagcucuuuuugugaaauugcacgcauauguuuguauguaugccuacagagacaagccuggaaaggguaauaguguuuucuccaaguggugagauuuugggaagcuucuacccaguuccuuauacuuuaaugcauaauuugaguucauuaaaguaacaccugcucaaucuaaaaaucagaaaaagaaauuuucugguaugagagaagauuacaguuggguuuaaaggcuucagugccguggccucugcagcaucaugugcaguguccacagacccgagaagcugacguuuccccuccuuggcuucacuucaccugggacguggguaccuggugcaagcagcgggcagcagcaaugauaaguucuguugguaacaaacaggauguggauaucauuucauauacauugacaucccaaaccccauagauaaggagagcuguucuaaccgccucaaagauaauaaaaucgcuauccauaucuguuuuuuccugugugccacacacuaugcuaagcacuuugcaugcaaaauuuaaucucuauaaaugauauaagagaggaaguaauuuuuaaauccuuacuuuacagauaagggagcuggauuuuagagggacaggcuaacuugccaaaggucacacacuaaguaagcauuggacuugggauuccagcccagggcuguguauagcuccagugcucauguuuuuaaccauuucaaaauuacuaauuuaaguagaaauacaauaauuuucuaccuuauuucuaaauuuuugcacuuuuaaauaagcaaucugguacauugauuaguauaauacacaaauuuuaaccuucaguauaccagaaaaaaauagucaucaccauuuaccauuuggguucaaaggacacuuaauuuuuuaaaaucaaugcagugaaccuuuucacaucuacuuuauccguuuucuuccaguaaccuuuguauacuuagcuaccuucagcaccugaacguuuucaaacuguauauaaaguaaauuuugguauacagacuugaaaaggugaaagaauaccaucccacauucauuuagcaaaacaggaugguccggguucuuuucacaaaauauuauuugagggaauccuuccucuugaacgacugacuguauaagaauagcauguuuucuuuuuguccuuagaaauauauuguucauucaauauauuuagagagucuaagagaauuaaucuaucaugucaucaucugaagagucguagucugacguuucguuuccaugaucaauuucaucaucaucauuagagucuucagugccgucgugugauggcuugcauucaucucugauguuucuguuguuugugaaaucucaucucucuuucugucaguuaucuucuuuuugucauuauaggcaagaaugaaaaauuugaaauucuccacucuagucaaugaaauuaaaacaaacuacaaagaugaugucucuagucuccuuuuauauccuccaaaaagaugauguaauacuuuggguaauacaauaagaaagauggagggugaugcaauagugacaauuuauuucacuaaugaaucauucccuuaggcucacauuguuuaauaugguagcuauuagccucagguagcuauuuaaaucuaaauuaauuaaaauuaaaaaaauaaaaauucaguuucuccauugcacuagccacauuucaaauucucuguagcuauaugcagcuagugguuacugucuugcacaagaaaaauagaacauuuucaucaucaaggaacauucuacugaauggcaguguucuaauccauucuauuguucuuauauuuuucuauuacuuuagucuucuuaaaccuuauuugggaauaauugauauauaacugguggguaauuguuccugagaugauaaaauagcaaacuguuucaagauauaggaauaauaaaauuacaaagaugccauaauggaucuuagauuuucuuaaacggucugcuggacccauaugguaguugcaagguagaaugaguuuuauucucuuucuuuuuuuaaaaaaaaguauuuucucuuuuucuuuguaauaucucuaagaaagaauaaaguuauaaaauauuaauccauacaaauagcuagaacugcuucaaauuuauaaaaccuaaaaaacuaaaaguggguccaauggaugcuaauaguauauugaggguuaagauauauuacugauaucuacacuuacauacaaaagcauuuuuauauauaaaauauuauguuugcauauaaaguauuaguauucaaaauuccguuguaaaauggguucauuagaaggcggcuuacaauuauuaugcugauccagcaaucuccaaaugaaugagaaguaguaauaugaacugagauaauauuuguauagugcuuugcagugucuggcagugaaccauugcucaauaaaguugaguccuuccuaccuacacccccagaagcuaauuucccuuuaguauugauuguuuaaugccuacuuagucuaagggaucaggaagacauuuaaagaauugaagaugaucucuguaaucuaacagcuuauaaucugguugugucaugagguuugauggaaucaaagacagagagcacaugcuucugugacugauagauucuuaagucuaagugacaugcauucauccaaguguuuacuaugcaucaaauuugucuugggcucugugcugggugcugaggcugucaggccacagaaugcacagucuaugcccuccgggaguuuaguccagucaaaggacaggcuggcaaacagauucauacaguaaguaugcuaagugggcugcuggaugcuaugaugaggaugcacacucaacacaaggagaaugcaggaagcucaacuugaccuuuuuuccaggugcaaguccugaaguuugaauaggaggaacuaacuaggucagauaaccugggaugcggacaggcaugguggcuuaugccucuaauccgagcacuuuuggaggcugaggugggaggaucgcuugagcccagagaguuggagguuacagugagcuaugauugcaccaccacucuccagccugggugacagagugagacucugucucuucaaaaaaaagucuaggauggaaaggaugagaagggaugggccucacugcuggaguuuuaagagugguaggugggaaauugagauaugaacugcuuugaggagcuuggcuuuaacaggaaagagagaaaagaugauaggcaguggaguccaugucuacguaauuguguaguaggaaaggaaugaucagucacaaauccaguuuugaauggugucauggauugaauuauguuuucccaaaagauacauuggauccuaaccccagaaucugugagugggauccuguuuguaauuaggcucuuugcagaugaagaugaggucauacuggagaaggguggacccuaaagacaaugauugaugucuguauaagaagagggaaauuuggacacagagauagagacccacaggagaaugcaguagggacaauggaggcagauugggauuaugcuguuaugcugccacagaccaagguacaccaaggauggcuggcagccaccaacgagcagagaagcauggagcagguucccccuccaaacccccaggcaggagccagcccuauagacaccuugauuucagauuucugaccuccugaacugugacgguaaauuucuguuguuuuaagccaccaaguuugugguacuuuguuacagcagccccagguagcaaugcaaauggauugaguuuaauaucuucaguuacuaggauacuauuaaguauuaugccuuuuaggcauuauuugauuugauuuaagaaacauugaaaccauuuuuagaagcuuaucaggauaauuucagugcuuuuuuuuuuuuuuuuuuuuuugagauggagucucgcucuauugccaggcuggaguguaguggcgcgaucuuggcucacugcaaccuccgccucccggauucaagcaauucuccugccucagccucccgaguagcugggacuacaggugugcaccaucaugccuggcuaauuuuuguauuuuuaguagagacgggguuucaccauguuggccaggauggucucgaucucuugaccuugugauccacccaccucggccucccaaacugcugggauuacaggcaugagccacugcgccuggcauuucagugcauuuuuaaguuuuuuuuccaaccuuccauaccacucagguuuuccccccaaccuucuuucuucacuuuuccucaucauucucauguuuuuagcuguguuauuagccccaacauucucuccaauuucuucuauuuaaaauucauuccugcuguucaaauuguguuaucuucuacacaaaaaacauauuauauuacaucauauuuuucucugaaaaggaucucagugacaauucauuuaagacaaaguuaccgaagagagagauccuguugccacacaacagagggacaugagagcaacaaagaaaaacaguaaggaagucugcugucucucaaacaaugugccccuauuucuacaggaaacuucucagccuaacuaaccguuaggcuaacaauaugauacaguuuggcugugucccuaccaaaaucucaucuugaauuguagcucccauaauucccaaguguugugggagguagccagugggagauaaucaugggggugguuuccuccauacuguucuugugguagugaauccaucucacaagaucugaugguuuuaugaggggaaacugcuuucacugauucucacucucuucucuugucugcugccaugugagaugugccuuucaccuucagccaugaucgugaggccuccuuagccauguggaacugugacuccgucaaaccucuuucuuuuguaaauuacccagucuuggguaugucuuuaucagcagugugaaaauggacuaauacacaaaacuaccacaaguuccuaagaaagauuacauuuuuuuccccuuuuaauaacuucuuuagauuuagagacacauugacagaaagagguuccauguucuauaguaaagaaaccaugauguccauuccuugcuuugagcuuaaagaugaaaacccaaauauauuauaaugauaguagguaaauuacuuauagaagguauugggaguacaaugaccuucaguuggcuugguuaagcauuggugaccuuggagaagauuucuggauccaaaaguccccauuucccggagggcaggauugcuggauuuuguguguauacacagucuccuuugguuagcaucacuuuuacuugcaagaguagauuucagagaaaaaugaauuucuuguuucugucucccaaaaccucaaagccuauuuuucaggauauagacaugcccauccaccugguuuuccucuucucugugaggaccugcaagaagcaaauaaaucucuggcacaaaauuguguugugugcagggccgcccugccuagcaugcuuccauguggccacagcuccugaagccauugcugcugcuaagagggugccccugguuccacgcuccuauucauuguucuguaaagaacaugcgaugugguaaaaacccacauugucugauuuucuuugaaaaacaaagaacuggcguucucaagaaguuuauaauacuuucuuauuuuugucuaaggcugaaaugaugaaaccucuuuauuuucaacuuuucaauuauuuuuaauuaugaacuauuccaaacacaaaaaaaaugaaugagacuaauaaaauauauauccaguauguccaaugcacucacccaccccuuaggcugaaaacaugugacuguguuaauuugcugcaugcuuccuucugaacuuucuguucauucuuggugccugggaggaggcugagaagcaucgguuuuagaaucagaucucaguucaaauccuagcuacgucacuaguuacccuagguacucuaaaugaguacgucaccucuuugagcuucaguuuucuauuucuaaaagaggauaguaaugcccaccucuuaggauugugaggcugaagugagaucacuggaaugcacuuagcaugaugccugacacaugguagcacccagcaauggguccuugguucuauagcuguuuccuugauguagauucugguaacucaguuugcuauaacuuagagcaagccuaguucccagucccccaccccaccccacacccuauuuucguuggaguuuuacuuuuauuuuacuuuuaaaauuuuuuuaaaauuuuuuugagacugagucucacacugucguccaggcuggaguauagugguaugaucucggcucacugcaaccuccaccuccuggguucaggugauucuugugccucagccucccgaguagcugggauuacaggugugcacuaucaugcccagcuaauuuuuauauuuucaguagagaugggguuucaccauguuggccaggcuggucucaaacuccugaccucaaggaguuugagaccugaccugccugucuuggccucccaaagugcugggauuacaggcuugagccaccaggcccagccuuaucuuuuuauuuuuaauuuuuuuuuuuagagacacagucuugcccugucacacaggcuggaguacaguggcacaaucauagcucacuguagccuugaccuccugggcucaaguuaucuuccugccucagccucccaaguagcuaggauuacaggugugugccacuaugcccagcuaacuuuuuuuuuuugguagagauggggucucacucuguugcccaggcuggccuugaaccccuggcuucaagugauccuucugccucggccucccaaaguguugggauuauaggcaugagccacugcaacuggcuucuuuggauuuuuaaaagcaauuacaugccaauuggcagaccagauacgaaucucuuaccuuauaagaacauugaggucuuguagguauccccgcuuugaugccuuugggcuaauucaggacacuaagcaaggccuuucacaauccccugccauuuuguuuuuuccuaagaauauauuguucucuguuucaaaccugacuuuaccaaaaguccuuuaaaaaaaaaaauccuacaaaaguacaaaagugaagcugcuuuucauuuuauggaagaaucaauugcacuggguaauagauuuguguuuaaugauucaugauaaauauaucagguuuagagaaagagagaccuagcaagacagaaugaggcugggaguuaggaaucaguuucacucugaugaacaugaccuugaaagagucccuuccacccucucauuuuuuuuaucauugcaagugauaggaaaauuaaugaugugaacauuuuauuuuuaaauaauuauaagagcuucugagaccacuguaugcuauaaagaacuuuaugcuuugguauucuguuggagauggguaauuaauagcuuauaagguaaaauaaucugcaaaaggaaaacaaaucaaccuuacauaauaggguuauuguuuuuuuaaucccgaagucgccuguauucccacuucacucuuacuucgcgcucaucacauuucuuaaaccauuuauguggaaguguuuggcccagcuggcugcuuucucagauuucaacuuucaguggagauccauguccaaguucagacacaguccuaaauuuaucaauuuuaugagcauguaaugugucuacucuugcccaagaagaacauaaugaauucauuucuuccuccacaaauguuuagugcuauuaagcacaucuuucauuuuucuaauuaaaaaauucugugaagccacaguuuuaaaaauauguaguuuauguaauuguucuuuuaguaucuuccccaccccaauccccaggggccaguuaucauugauaagauguucaccaagccuuauccagaccagccucaguuacaaaaucaugagcuuaacugguuguuggggcugggcugucuauaacaaaaaugaagggcuuuaaaugaagcaugaaauuuuaaaauggcacauuguuguuggaaagcauauuuaaucaagaaacugcuuuagcaaauuaagaaaacccaugccaccauuccuuggcagaguggcaguugccucagggcucugcaaguuguaguaacuuaaucaucuuagcagcucccaauauagcauauagcuaccuaauccuuuuuuuuuuuuuuuuuuuuuuuuugagauggagucucgcucugucgcccaggcuggagugcaguggcaggaucucggcucacugcaagcuccgccucccggguucacaccauucuccugccucagccucccaaguagcugggacuacaggcacccgccacuacgcccagcuaauuuuuuguauuuuuaguggagacgggguuucaccauguuagccagaauggucucgaucuccugaccucaugaucugcccgccucggccucccaaagugcugggauuacaggcgugagccaccgcacccagccuaccuaauucuuuucuuauuuuuuauuagauuguaugaucauuucuuuguuuuaaaaauuaugcaugcuucuauuauguuuuaauuuggaaaguacagaaaauuauagacuagcaggaaaaaauaauuacccacaaugccaccacgcaagggcaacuaaaaugaaccauuuucacccaucuagucuuuauaguauauuaauaauauucaagccuccugucacauuuguugcaaauauuucaucaguccuuguauguuuaaucaaagucgugcaugcacguaacacacagaguuuacagaaccaaagugcuuguugaaaaacagugguccccgauggcgcccugcacgucacuuucugcucuuuuaucugguucuuuaguauuaacuucauaucccugguuaaccuguuauguugcugcuuccggauuucacucagcuuuaggcauugucugugcaagagaaggauuuagcucuuucacugcagcugacccaccucccaccccccaucacccuucugugccaucuagccuucuugccuagguguauguuauuggggcuaaaucaaugcccagugauuuuauuguugcaacuagguagacaggagugacagcugagccauuaugauuaugucuccuuuccugcuuaucuuuucauuuccuuuauaacaaauaauucucuuguuuuguaaauuuauuuacauacuuuucuaugauccccaauuuauccuugaacucuucuucaguuguguaaaucucccuggagccuucacacacauuagguguugugucaguguggaguugaugaagucucuccuggggucuucuugccugcucccaucagaacggcuugcucgcucaaccucaugcucaggugugucuugggaucuccuuucacucucuucuguaucgauaugguuuggcuguguccccaccuaggucucaucuugaauuguagcuccaauaauccccacguguugugggagggacccagugggaggcaauugaaucaugaggguaggucuuuccuuugcuauucucgugauaguaagucucacgagaucugaugguuuuaucaaggggcguuucccugcacaaacucucuucucuugucugccaccaugugagaugugccuuucaccuucugccgugauugugaggccucccagccuuguggaacugugaguccauuaaaccucuuccuuuuguaaauugcccagucugggauaugucuuuaucagcagcaugaaaaugaacuacuacauguauucacuccuauuuccugcauuaccauauuguauuuguuccuuuuugcugcuguaacaauuacagcaagcuuaguagcuuaaagcaacacacauuuauugucuuacaguucuggaggucagaagucugaaaugggucucacugggcucaaauugaagagucagcagagaugcguuccuucuggaagcucuggggcaaauccauuuccuugacuuuuccagcuucuagaggccaccagcauuucuugacuuaugucuccuuuaucuucaaggccagcauuguugcauccucagaucucagacucuccuucuccucucuccuuccuuaauuuaucaggacccuugugauuacauuggacucaccuggguaauccaggauccucuccucagcucaggauucuuaacuuaucacaccugcaaaguccuuuuugccauguaggguaacauauucacagaauuuggagaugaggacaugggcaucuuugggggaccaucauucugccuucuuuccucagccuccaguagcuucucaagaacaggcgcaugggacagaagucaucugaaauacugcauuucugaaaauaucuuuauuucauccuugauugauaguuugacaugauauggaauuccagauuggaaauccauauuaaucaagauagguuagggugaugcaauuauaauaaacuccaaaaucuuaguggcuuugcacauucgaguuuauuucuugcuuguauaagaaauagcuuauauagcucagggauccaggcuguuuccaucuuguggcauuaccgucucaacacaggaccuccaauguuacuguggcacagagcagagaggaacuagaggggcacguagggagacuuuucagcccuucagcccagaagugacccgugucacuuuuuuuuuuuuuuuuuuugagacagaguuuugcucuugucacccugacuggagugcaauggugugaucuuagcucacugcaaccucugccucccggguucaaaugauucuccugccucagccuccugaguagcugggauugcaggcgccugccaccacgcccagcuaauuuuuguauuuuuaguagagauggggguuuugccauguuggccaggcuggucucgaacuccugaccucaagugguccacccgccucggccucccaaaguguugggauuacaggcgugagccacugcgccuggcugacuugugucacuucugugagcaguccauuagccagaacuugucgcaaggccccacuuaacugacagagggcugcaagauagagcauaugaauacucugagcauugacuaucucugccacaaaaucauguccccucugaguaugaagguuuuugccaguuuuauucuagcuuccaguauuucuguugagaaaacgaauuccugauuuuuuauaugaacaucuaaucugucucuguggaagcuucuuauucuucguguucuaaaauuguauaauucugugucugguguguauaaguuucauguaccauuccagauacuugguggacuuugcaaucuagaaacagauacccuguucuggaaacuuugcuugauguuuuauuuuccagaaagauaggauuucacucuguaacccaggcuggaguacaguggugugaucacagcucacugcaaccuugaaauccugggcucaagugaucuucccaccucagccuccugaauagcugggacuacaggcaugugcaaccaugccuggcuaauuuuuuuuuuuuuuuuaauuuuaauagacccaaggucuagcuauguugcccagccaggucuugaacuccugggcuuaagcgauccucccgccucagccucccaaagugcuaggauuacaggcaugagcuauugcaucucgccugguuuuaauuuuuacauuuuuuaaugaauuuugagucucacguuguugcccagguuggucuugaacuccuggccuucagucauccuccugccucagcuucccaaagugcugggauuguagcugugagccaccuugccuguuucuuccucuacauuuucauuuuuugucauucugaaccuacucuuauuuggauuuuggaccuccaggaguaguugucuguguuucuuggccuuguuccucucauuuuuucuuuucuuugucuuuuuugcucuacugucuagaagaguuuugaaacugucuuccacuccuucuguugcauuucuuccuugcuguucucauauguuucauuuacaagagcuuguuguuguuguuguucucugaauguuccuuauuauaacauucuuugguuccauacggggucuuuacauuucacacuaaagguuauuauagguauuuuuauuauuuuuugguugcuauucuggauggaauauuuuuccacuauguuuuaaauuuauuguuguaauacugaaaaauuacugauauaaugucauguuacugaacuuuuuauuucaauaauuuuucauuuauuuucuuuuuccuuuuuuugauagagaaucacauaauugacaaaaagcaugcauuuuaucucuuuauccaauucuguuuuaaguuuuauaacauuauccagaauaauauuauguaauguaaaguccauggugggagacuguguauuaauuaucaugucccccacauuuaggacauguaccuauuuaguugacaauaaauacaugucaaaugaaugaaugaugguuauagacaguaucuuucuuuugcuucaaguuuuaauaauauuaaaaauguucugucauugaguauaauuguaauuuuuaguuuaagauacauauucuuuaucauguuaacaaaauauuauuuuuaaauuuucugaaagcauacaguuauucaagaaaauauguuuccuuuguggguugugaucuugcacucaggaacaugugcugaauuaguuuaauucaacuuuauuuuauaaacuaauagggguaaaaacuaauggggacagacaguuugagacgugcagacaggcacuauuucucaguauuugauuuguuguaacauuuuuacuggugaccggaagaggaaaugcucagaaaaaucugaguuugcaggugacucuaauaugcaggugacucuaauauuuuuucugguacuacugaaccacaggacuaucuacuaagcucagagucucugucaccuguaauguaggggcuuccucccaggaaaauacugcagcccaaagaggcugucaaaguacuggacacccuggagcacagaauauaacagugucuugugcaagccaugauuuaucuaugucagagaguuucuaugcaguuuuagucaacaaagaccaagagaggcauaacuggcuggagaacauucagaaacuaauaaccaaaaugaucuugggagguagaagcaaagacuaaauuaauuaugauucuugucagaagggacauugacucuggaaaaucaucaaagccuauaaaaucagaagcaguguguuugaggugaacacaaaacucuucaccaaggccuugaacacaacuguggucugaaauuaaauagacucaaagugccucaaaucuuaaauacgauauaucaaagacaaauugaaggacaucuuguuucuugugggggauaguaaacagcuggacuucauuugcccaaaugacaguacaggccaaaacuauaaaucaguuccuauaaaaguugauauauauucauggaugaugaauccacaguagauuaggaaaagugcaauguuguuuagagggacagccuaauauuuuggaguugauguucuugaauccaguaagaucauucuuauuuuauauauauaauaaaauaagaaaauuagcaaaaauuauuuccaauaugaauauuauuuagugguuauugacucuuauuuacaauuuaguaaugcuuuucuuuuuugagacagucucacucugucacccaggcuggagugcagugacacaaucuugguucacugcagccuccaccuaccagguucaagcgauucuccugccucagccuccuggguaguugggauuacaggcacccaccaccacacccagcuaauuuuuguguuuuuaguagagacugaguuucaucauguuggacaggcuggucucgaaccccugaccucaagugaaguccucagucucccaaagugcuaagauaacaggugugagccacugcacccagccaauuuaguaauuuuugguucuugucuccaaagcauucacugggugcuccugcucagauuccccaucuuguaaggcuuuccuugaagccuccaccuccugcagcugcccuaggcagaagcucaauauugggaaggcaucagcagcaggaguuugaagauccugguccaagucccggcuccuacuccuccuaguccucauccuggcaaagccaaguacucucucucugaguuuuguuuuucucacuuauaaaauaggaaguaaugauuucccaguauucuucacauucacauuuuugugaaaaggaaaucuaguuaacauuucuagacgugcuuugggagccauaaggugcuggcuucgcaaugauggguacagauggaguggccuguuuuccaaaccucugagucauuacuucucucuucccuggucccugacacccugcgaaugaacccccauguggccucuugcucuggcaagcugguuugauuaugugcagggcuccucugccccugaagccuaaagccuagugaaaggcagacuggguggagacccuggcaguucucuucuaggcucacacccucaucuugaccuucagcuccccuuccuccacuccauggaaacagaauugucaauguaucccccuaaaaccuaggguagagcaaaaccagcuggaccuuccccucugccuuucccuggggugagaccuagacuccccauuggcucccuuccccuccccagcccccauuaaggggaaauugggagucauuuacuuucuguacuagcugugugggacaugagagaaaaaugagcaaugugaagccagccaacaacagaaggagacccagggaaggagccaaguggaaaacagccugaaaaaccuuugugccauccuuugagcguaucauuuccuaccaccagagccuaauucuguccuugaggaauauaugaucuuaagacuucaccuccucuaagaggaaggcagccuugggcuccuguuagagaucuuagugugcaaaacugcaaagcacuuagaaugucacuucugaccuuauaauauucuucuguaacaauagcuggcacacaucauuauacaucauacuguuaccgguaugcauauauuguuaucuccccagcuauauuguaauuccucaagggcauggaacauauuuuauacaucuuuuuuggcuuaauggauauguacuaauuauguguaccuagaggaauccuuucaucuggcagucagagguauccagaaugaacuugucaguuacguaagccccauccagcaugauuccaugaugcagugccucuagcgcggugcuguaggacgugaagcaucacaggugauuuggagagguggaugcuucuugcccagagucacuuaccugccuggcuuugaucuucaugcuucugccguuucuuucuuccucuucaaaaccagaugucuuccuccccuuggccaaaaagaauauaccagugaagugguaugucagggcauuaauaaugagaagugugcagacuguaguuuaugaggauuucagguucuuugauuuagaauaugauuguuugcuacaaauuaacuucaucaugggugaauauagcaaaaagugggcaaaaguaacugaucugggcuugucaucugugcacuuaauggacaagguaugaggguuaucuaauugauguuucuaaaguuucaaaauguguucagauacacaauggucacugaggagagauguuauuagcuugacugccauuguauuagguuggugcaaaagugauugcgguuuuugucaugaaaggugauaguauaguauuugggggcuuaacuucugaagcuuagugaaccuacauucacuugaagacucugccucuuacuaacugugauuugggacagauuucagaauuucugcuguccuguuuccucauguacaagggauccuauuugauaggguuguugagagaauuaauugaaagaaaccaucuaaaaugcuuagcacaggccuagucuauccuggauuaaugaaagucuagucaguuguuggcaugguaugaguuaguggguuugaugugcacacauaaaugccugugcaaauacugaggaaggguucuaggagucacagcaacaagcagaguuugaguuauguaagccuucaaaaguguguguucugaccacugauguugccauuucaaguuauucuaaacugguuaaccacagaugggauuaaagcaaaaauuaugaauauauuuuauuuauuuuauuacgguaagacaaaauaacagauuaacguguacacaacaaauaaugugagagaaaaaaaaucucuguuugguaggauuaguguuuucacuuguauucagucuggccaacacgggaauugaugcuauuuuaaguauacuuuucagccauaauuauccaaguaaaaucaaaagcaguuguuuauugaaaaguacugcauuuaagauaagaaauuuaguauauugcagaccacaguuuggagaucacacugaauuauauccuacaaggaaauaucauucuagauaccuuauagagguguacuuauacuaaauguuacuccagaucucaggaagcauauguuguagggauaccacaacacacauaggggagaaaugcacuuuuaaugagcccuacuaauuugacauucauaauucagaagggagauaggcugacaugggccuuuuucucuguaaagaucaagaaugugacagaugauuguaggaacaauuacuuuacaaaagagaaccaccucauuucaaggaccucuuagugcaaagaaagaaaaggguggccauuuucuuauggccuucagucauuucuuugguuuauuuagcacuggcucagguacuaguuucaggguguaaaaauccccgaugcagagaacauucugcaacucugcaauacguacagagcccuagaauggaaaagugcuaacgaauuucaugaccuaauuuaaauuccccaguguggcuaauuggggaacuguguuuuacugaucugaauugcuaauuuuuauagauauuauuuuaacagcuguccauuuguaauuuaugucaggguguuuccagggcuuuuuuuuuuuuuuuuuuuuuuuuuugacagagucuugcucugucacccagccuugagugcaguggcacgaucuuggcucacugcaaccuccgucucgcagguucaagcaauucuccuaccucagccucccgaguagcugggauuacaggugccugccaccaugcccagcuaauuuuuguauuuuuaguagagauaugguuucaccauguuggccagguuggucucaaacuccugaccagggucucauuuuagcuaaguguaauuguauauguuuuguggcauuuggcucgagucaaaucaauuuuaaaucugccagaaaaguuuguuuuaacuaguuuuuauuccuaguaaaaauaggcucucauuacuaauuauuuugaguagguauauauaguauauuuuuaauuggugauauauuggaauacccuuuuagaauaauaauguuucaucuaaucagaaaucuaaacaaccacuuggugauuacuguguacucaaagccaguuaguacauuagcgaagucaccaaaagaaucauuuccauuucaaaaucuugggcguuuggugguauauauuuuuauuuuaguguaugagaaagucaaccauugcuaucccaaaugacagaaguuauucuuuugcuuauuacauuuaauuauuuuucuuugccauuuaauuguaauacagggcuucuauauuuugaauguguguuaaacgaauuuagauuuauaauuuuauauuuuaaugauuaauaucaaauucucuuuuuaacucugugaacaugagucauuugaauuacucaguuaugcagacaacauauuuucagcuaccuauaucuaguucaaaacgugccaaugaaagaucuguuuucccuuauuuuaguuacaaaugaucuuguaaucaggauuaguucaaaaagaacaaaauauuuuuacagcauaacaaaaggcuguugaugauaaaccugaaucauccauuuauuggaggucugagaacuuaaauuagucuaucaguucaugugaaucucuuucuuaaaccuuagcaaaaaacauuucaauaguuuacucuuaaucaucuaauuauuuacuguugauuuugugguuguaugaccauugaaugcuugaauuauagcucaaagcuaucauucauucaaaauuaaggauuacaaggauguguuuucauauauuguuuuguauuaugcuacauuucacuuuuuauuggaaauaauauuuaucuuguaauuuucucuuugagaauaaguauauuuugguaaaauuccucuucaguucacuuugugagaaauucaaauuuaauaggcaguaauugaacuuuuuuaaaagagcacugaucuuuaaugguaaucauugugauggcugcuaaaggauguaauagguaguuucauuugccuuugguccugagcaaucugaacaacagaauuccaaaagucccauucauauagagagaugcccgugcgcuuccuaccgcucagauacggucaugguuuccuuuuaauggugguaauggcaccaaaaguagauguuugauuuuuuaauauucuuccacauauauguauaaaauuaaaauuucccaucuuacucuaaaaagacucuacuuguauuccaauugcaggcacccaaaggugcuuugugcaggcaguuuuuguuuaguuuuuguuuuggcaguagagccuguagguccucagggaugcagcggcucucaggaucuacauuauucaugcaucguuguuuaacguccuucuagcagcaaggaugugugcuggcagaccaccuccacuuucacuuagaaaauugccagcuagugcuccugccuucuaagugauuacuuugcuuugcucgaaguaucuauaugaagauaaaucuuuugcuagguagcaauuccucaagcacugucccccccgccacagcaaaaaugauggcagauaugguguguucaaaugacugcuaaauaggcaagcugcauuuucacaggauaguguauaauauuuuaagaacuauugucuugauuaugcaaauauagaaagaacuagcaaagcuuacuggggaaaagcaauaggaacuguucugcauuguuuuuggggaagaaguguuugcuauuuaaugauuuggaaguuugcuucuuguuauuggaacuuagcauuaguuugauuaccuugguaaauacacauacauuucacaaucaaaauagauuauuuaaaucucccaagguagccugggaugcuuuuuuuuuuuuuuuuuuuuuuugagacagaguuucacucucguugcccaggcuggagugcaauggcacgaucuuggcucaccacaaccuccgccuccuggguucaaacgauucuucugccucagccucccaaguagcugggauaacaggcaugcaccaccacacccagcuaaguuuguauuuuuaguagagaugggguuucuccauguuggucaggcuggucucaaacucccgaccucaggugauccgcccgccugaaccucccaaagugcuggcauuacaggcaggaugcuuuuuugacacccccacuucuacucagcuuucuuuccuuccuucagaacccuguucagggugugaaggacaaguuaagccaucuccgucucucucauacugcagcccaccuguucuuuaggucauaaccacagacucacaucuuuaaagaaaguuagcaaaucaacucagaacccuuacaugggucuuucucuccugcugucucaucaaucagagcaaguucaacuuucuacuaaauuuaucuauauuuauauauguauguuuauaaaagguaugaguuaggugugcaaaaauguaacauuauggguuaaauaaccuuauuuaacccauaccuuacaugauuuaagguauuacuaaacaugcauccuaagguaaauaaacccagcacaggaacugcccauuuccacugaugauagaaaggugucuguuucuaaucguuuagucucagcuucucaggggucuccccuucucauuucuuucuuccuuucuccuuccggcugauccaaguucccagggggccuuuggggaacagacccuuguccaggcgcuguccucuguccaggauugucucaguucacuaggccuggucuugggauucagcccauugcuuccacgucugaauuggcuggcccugaccccuccagggucucuggugaagcccagaggcccugcauccccccuugcccugaccccaggcaccucuagcccuuuuuucagagauucagaaaaguuccagaaauguucuuaucaugaauugccccaggaucgugugucugagaaggucacucagucaucaccacucugaagcucaagcucuaaugagaagcuggaccucucucugagagguagagccucagagcucacacccugggaggccagcuccuuguucuguaggacucccagaacauuaucugcgauuucugucaaccuguucuucccuagaucacuuggcccaagggagagaaccacuagaccuuuuccuagggacccaaacagcuucugaaaucugaucuuguccuucuuuauccuuauccuguugacugacggaaccuuugucuccuuuugggaggcaacuagcucuuaccuuauucuuagcaaucuuugguucuguugauacacuugaugccuuccccuucaaguuuuacucuuuagaauuccacaucacucuccucucaaucauuuggcguuggaaaauuuuggcuuucaggacaaauagcuuucccaaaaagucacaaaugaaaauuuagaagcuaaaaagagaaacagaagauagaaaguaauuaucagaaaaaaaaaaaucagacaugaaaccggaauugucuucuuuuguauauugucuccauuccuuuuuaaauuacaucuuucuuuuguucuuguauuaauugucuuauuaauuccaugcuuuuuggaggggaaaaggauggagaaagugguaaacagccucaaauccuuuuugccagcaaagaaaugaucauuuaaaauagauucaggccggccauaguggcucacgccuguaaucccagcacuuugugagacuaaggggggcagaucacuugaggucaggaguucaagaccagccugaucaacauggugaaacccugucucuacuaaaaauauaaaaauuagcugggcaugguggugagcaccuguaaucccagcuacucgggaggccgaggcaggagaaucgucugaaccuuggagacggagguugcagugagccgagaucaugccaaugcacuccagccugggugacacagcgagggucuauuucaaaacauaaaauaaaauaaauuggaauacucuaucuaugcgucuuuuauguggcaccuuguguggcuuuccugaguucaaauaagccacugaaaaaauaccucagugaaaguuucaauccaugaguuguuucuuuucaucucaaggcugcuuaucagaggacauaaaacagcauuaacugugacagaagaaaaggacgaaggccgagcaggcccauaucccugcguaaguccugaaccaugcuucguuaaagucuguacuuugaagaguuucaggccuuguuguuaaucaauaacucuagccauguagugugcaguuuaagagaacacaaggaucaaggagaagcaacucuuaucuacauugcuuuugccuguaauggcuuccauaauuuauccacaaggagaaacaagcaaugagaaaaauccucccuggccggucagagccuguucauauuuuggcaacaaaugaagcuaaggaguugucaggugugguagauuauucccaagaggauguguuuuauuuuuaucuugugaugaaacgcccucugaugagcacagcagauagcacuuuuaacaaacucucuuuggagaauaaguauuuaauucuauuacagaaugccaacaagguggcuguuucacaaugaacuguccccugugaaguacuguagagcagauacagggugcaccucaguuguuauuugaaggaucaguuaucagugguaaugugcacuuaaauccacugggaaucuugugaaaaugcaguaggucuggagaggggcccaagauuuggcauuucugacacgcuuccagguuauuuuaaugccuggucccuguuucucacuucacacagcaaaguuuuagagcaccuuagagaucucaaauaacuuugugcagaaauuucuuacuggauuaguggagccaguaaggacuugcaaugccauuggcuuuuaugggccccucagcuugccaaucauuagggaaauugcccaacuggaaacuaauagcuuaagcaaggaaaaucccgucccuggccaggacagcaccucugcaaacauccauccggaauugauucugauguucugacugugcaucggaaggguagcuugaagaaugccuuuauuuuagacucugcccaccugcaggcuacaggacucauuuccaggacuguguaaaacauuguaucuauaggagcaagcaauuucuacaguccguauuugggaccaaaaaucuuuuuuuuuuuuuuuuuuuuuuuuugaggauuggaaugaccaaggaaccaguuagaauggaucagauguauuucuguugauuuacaaaagauaauuucauugucaguaaugaaugucccuaaauguuuuggacacaauaaggaguuucaggagaaaaccguaauagugaguaguuauccuuuucuuaggauuuugauuccuuaacaugaaaugcugauuccaaugcuuuggcuuuccuaugucaguucauacaaacuucugauuuuauuaauuauugcuucuguagagaauaaucugccauauuagacgaaagucauuuuaucaaaccaaggaaaaauauuaagucuacuagaaaauauaagaguuuuauugacuauugucuuuaaauuuuuuuaaaauuauggaacaguuuaaauguacaaaaaugaaaguauagguuacaaagcccuauauacauuaaucuucuagcugcacugguuaccaacuuauggugcuaggggcuaaaugugucuccccaagauucauauguugaagucuaauccccagugugauagcaguaggaggggagccuuugggcagugauuaguucaugaggguggaacccuuauaaauggaauuagugcccuuauaggaagagauacaacuugcucuuggacuucccauccuccagaacuaugggaaauaaguuuucauuccaaugcaguauuuugaugaaaaugugucauaaguggugcugaauguuuuccauuguacugcauuaggagauacauaagguuugguuucucuuuuuuugcaauauuguuaaauacagucuuaacuuuaaguauagucuuaacuuucauacucucauacgagaguucagaaaucuuacccgaaacucgauucuaccuuugauaaaugaaauauggcagugguccccaaccuuuuuggcaccagggaccaguuguguggaagauaauuuuuccauagauugggggguggguggggaggaugguuucaggaugaaacuguuccaccucagauggucaggcauuagauucucacagggaacgugcaaccauuaauauaucccuugcauguguaguucguagucuuuucuaugauauguaguccaauuuaauuugcaaugguuugaauguuuguguccucccaaaauucguauaccagaaccuaaucccuaaugugauaguauaagaguucacgcuccuaugagaauauaauacugccgcugaucuaauaggaggcagaggucaggcaguaaugcucacucgcccgcccaccacucaccucuuucugugcagcccaguucguuacaggccacggaccaguaccaguccauagcccaggggugggggaucccugaaauaugguauauagaacuaaauauauaaaaucuaauauauacauugauauuuauacauguaauauaaaagauuaugucuuucaggcuucuauaacaaaauaccauagacuggguagcuuauaaacuacagaaaguuauuucucacaguucuggaggguggaaggucaaaaggucaagaugcuggccgauucagugucuggugacugccugauuccugguucacagauggugccuucucacaugguggagggggcauggcaauucucuggggucuuuuuuuauaagagcacuaaucccguuuaugccucaggaccuaaucacuuccccaaagucccaccucuuauacuaucacauuagggauuagcuuccggcauaugaauuuugggaagacacaaacauucaaaugauagcagauuaaauuggacuacaugucauagaaaagacaaaauuaaaguggccuauacaagauagaaguuuagcaaaucuaaagauaggcaccucugagugguaugacauccccacagucauccaggaaccauauuuuugcguguaugucuuccaugcuuaagauugccucauguuccaaaauggccccuggagcucuagccaucauaucugcuucucuggcugguaacauaaauggagauaagaggguaggaaaaaaaagcccuaccucccaggucagccagucccagaccccaaacaaggaugucugcauauuucaaaauggcaauucauaccuucaaaaaaagcaggaaauguuggaaagucaggauucccacugugggaagcugucaaaauauuaauaagguauuucaaagacuuugggcagccacaaacgauaaacauccauuacauguaguuuagaauuguauccuagugcaacuguuauuaugugaacaugauuaccaaaucuuggaaagaaaagauuggcucaaauaugaaaaauaggggaaugcauaagaauccagagaaauccuuugcuaacauauugucaguauuugauaaauuuuuguccuaacaccaggcugaaauggaagcucaacucagguuugcccaagaagaagcaggacuccugauuugaaggguggugugggggaggguuucuagcagggaauggaugcuuaagccaguggugggacauagauguuacauaguuuuccucagugcuauaaagaaacaugaaacaaauagcuucuccagcaaccagagccaacagacugucacuucucuaaacauuuaagcugcuuuccugcaguucuauuuucaaaguaaaugaucuauucagcuguuugcuuuuguuguuuguuuuggcaggaaauuugaauagggacagaauaauagcuaaaauugauugaguacuuacugcgugccacacacuguuuuggguaguuuacauuuaaacaucacaggccauaauauuggcguuauuacuagccauuuuacggauggauaaacuaaggcacagagagguuaaguaauuugccgaaagggaugcugcagguaagagcuagaacugggauuugcacucuggcacuaugcuguauuguaauagauccaccguaacacauauccucccgugaguauauuuugcaaauugugaagggaagcaaggggagggagaauggggcauuggcucuaaguugcuucauuauagagagugaaacggggagaagagauugucugggguucacaguguuagugcagacaucguucuggauccugggugccgcccccucuuuagcgccucacucacuggcggaucuuagcccaggaagcugagggcaaccuuaggcccuagaacuugccacccaucugagcucccguccuccuuucugccgcuccuucauguccuccacuucugagagcaguuuugagucacaucccuugugggagaugccucagcccuacccugaaacugaacccugcccccacauagccccagcaccuugcguuugagcacaccacuucccagguugugcaggccucagauuuugaguacagugucguaauacguauuuggccuguaacuugcgcugagaugcauggauaagccauuuuaauuuagcuguauagcaaaacccauccuugacagaaaguguggacuaacacagaggcaauuucuuccugccuugcucaucacguugcauaguuagagccaaucccucaagcccuccuucccuuccucccuuccagcucccaugugcuccucuggucugauucgacaccauggccuagccuugugcagugugcaaagaggagaaaggagugaagaaagggaagaggaggggagggguccuaggcagggcuuggaggcugugacagucacccuguaggcuccaaauugagacaguggccuggggaggaaaggcugcuuagggcagcagcacccccccacccuccuuucuucccccucagccauuugcucuguuuucuggaauaucugccucucucucauccaccaacuguauacacugccgugagggcugggacuuaccuucauagcugcauuuagcccauuaccuaguacacagggccaugcauauagcaggaccucaauaaacauuuaaugaauagaauucaguauuuauuaucacaguccuugaacucacaaaagcugaagucacauacuaacuguauauaaagagaccgucuuuaccccaugagucuuaaaagcgggguugcuuggaccauucgucaauggaagaauuacguggcgugcuguuaaaaauguagguucccaggcuucaccugagagugugauucuguggagcugggggucugaauuuuuaaccuguguccccagugacucuaaguuacaggccaaauacguauuacgacacuguacucaaaaucugaggccugcacaaccugggaagcggugugcucaaacgcaaggugcuggggcuaugugggggcaggggucagcuucaggguagggcugaggcaucucccacaggggaugugacucaaaacugcucucagaaguggaggacaugaaggagcggcagaaaggaggacgggagcucagauggguggcaaguucuagggccuaagguugcccucagcuuccugggcuaagauccgccagguagaccguggaacucauuuucagaaaugaccgaagcagcauuucuugaucuuucuuaaaacucugucgcucuugcuugauacucuauacugcccucucugugcauugauaacugugggucccggguggcugcaaaccacaugugccaugcaccagaaggggcauuguugugacugaggccggaugaccuuaagaaugaaacccaagcccucgugggguuaaaauuccagaaguaccuuaguauuugcugcaaaaccaucgguaaggaggaaaaccccacugcuuuaugaauugaauacuaaccuggaacuacucccaaaucaauuggacuuugguuucucauucagaaucuucacugaauguucuuaagugaguuuuaagauaccauuuccauguaaaaagcuucuaaagacuuguuugagaguguacuuggaaaagaagcauuuuuauccggucuuacauacguaaucaaaauuaaucgcuuuucccccagccuaucucugcuacuuucagcuguuaaauagccauuugauuuaauauagcaccucauucuucagugaucuucagcagcugacaccugaauuugucugcagacaaugugcuuuuuaaagaauuggccugcuggugcuuuugauguaaauuuuauagggccaucaucuuuagauuuuucuuuaucaaacaaaauacucucuuuuuuauuauucuuacuugcauucucaugaugauuaaaauaucacaggaaaugugugugguugaguccauauuuccuaacuauauuuuaugauuaggcuccgccagauggcuccuaccauacauaauaaaaugucagaggugcagcgguaaccucguuauggugugcauuugaacucaguccuagcaccgugcuaggucccuaggcacauccuuuuuucuuuacuuuccuuaucuuauucuuuuuauuguuaaacuuuuuuuaguucuauuuuuaauuugugcauuuuuguuauuuggaagauagcuuuguuagccaccuugcaucccuucuggaauagacuaggagauguauaaauauguaucuuuaaugaacaugaauagagaaaaccaagauauuucuauuguccagcuuuugguucauuuugauucccaccaccaucuuugcauggcuguugcuguaagccugugaucuuuacuauaguacucugauuuccugcaagaaaaaugaaacugaaccccguuaauacccagucuccaacucccaagcauucccuacauacaaaugcuuccucccacacaguuaggauaugucuuucuccuccagauaccucuaccauggggugcaccuccaccuccucuccaacaaggcugucaaggguucugcuaccuccucacugccacugagcgccuuccaacauggcugccaccaccagaggucuugccagcucacagcuguaauaguuccugcucccacuaccugcuccagcccagccaaaggaaaugucagagucaguuagaagcugggagaaccccucuaucucuccauagugugcucagugucagagccguguguguguguguguguguguguguguacacuucuguugguaggggcuacaaguagaugacuaucaacaccugcuucuauagccacagugaauucccaguccagcagggaagaagguaugucuuuaagguuuuucuacauaaugaaauaauuaugcuuucauaaucuugucccacagguaccaugguggucauggcaaaaugcagaacccaaaaguuuucaaaauaguuugucuucugaaaacuguuauucagugccaaguuuguucuugauguuuuucuucuaaauauuuuguccuguuugaugaaacaaguaaucuauggucauuauuucuaaaacauauuuccuuuuuuaauggcuauggcaccaguuaagccuuuuagacuuuccaggguguugccagguggcuucugacuacugucauccauuaaaauggcuuaauuugaguuugaggacuagacaggaagacacagguuuaaaggcccauauuuacuagaauaacauuguuaaaaggaaacauuuuaauaaauuaacaguuuauuugagcaaaauaugauucauggaucaggcaguuuucaaaaucauaagagguucagagagagcugcacucugcaucaugggcaguauuuauagacagaguagaaggcagguacacaaaaaacuugauuccuuacagcucagcuuugcguucacuggauguggucugaucaguugguagccuguuauuggcugaagcuuagaccggcuugugauuggcugagacccagcuaucuuuacacaaauuagacucccaauuauguuuccauucauuuaaauacaugguagauuuuguuucaucuucaggguuuuugaugcuagcuguugaccuuuagaggacacauugugagccucuugguccuaauugcuguacguuuugagacagaucuugcugaugucuuugguuccagccucgcccccaccacuccauccuccacacuggccaauguggucucucuggaggcccccugcuucacccucuucugaugcccugaggauggagggguaggagcaaaguucuucccucccuuuuuccacuccaacccuccugcccacccucgagagguuucuuuguuugcuuuuauuuguuuuugagacaagaucuugcucugucacucaggcuggaaugcgguggcccaauccuggcucacugcaaucucaaccuccugggcucaagcaauccuuccaccucagccuccugaguagcugggaccacaggugcaugccacuaugccuggcuaguuuuuguuguguuuuguagagaugagauuccaccauguugcccaggcugcucucgaacucccaggcucaaccuacucacucgucucuaccucccagugcuuuuguuuuuuaauaauuccuugugauuucuugccugcucuuuuaaaagcaagacugggacucuuuaagagaugguguguuauuuuuaauaaaucucuguacccugaccguguucccaucaggagcgucagaaggacaaacagcagcuaagugagccucuaccagcgaguguuauagaccccuuuauaagcucuccucauuaggcauuucuggcaccuaaaauagauggcuggagagguaauuagaugcaguuacuugcaaaagucucagaggcauuuucuugauaguacacaagaggagucuauuaauuaguucuaacaaggaagguuuaaauaacaucaguuaauggccaauugcugguggcaaccaggcagacagaauccagagucccugggcugagcuucauccuuugccuggaaggggaagaguuccaugaagacagagcuccugccuguagucucucugggaagauuaaauacauacagauuaaggaguugagaauaauuuagugccaagcucuguacuaauaauuguaaguccaacaagugaacaggagaaucgcccagagauggagaagacgugaguguuuggguccaacagcaaucauaacuugcuuuuuccuaagugauuuuguguguuguauaguaugcuuguuguuuguugggugguugugaaaaagcauuccauccguauggggagauuaggcuggagccccaaaacaaaaacucuaccucuccagggacucucugucuggcagccuaugaggaacagguauuguguuagaauuaauuaagcauuucccucucuggagccauccuuuggaaugcacacaucccugggaggagagacccaccaagcuuucugcacuccaggugaacagcuauagagaaacuuccucugagcaggauggaccuggagcauccuuguggguuauggaagcacaggaaggggacagaggcccuucagcauccagucgcagucaugaagugccacuccccauggucuggugccucuggagccccaucucccuccaguuggcuguccccacugccgccacccaugccccacucuuccacccugugccccagccaugugauacaucucuacccagagcagggcuccaguccccacccucuccucaaacacccagcaucaucagagccagaauuaguaaggaggacaucggccacaggaaacaaccucagauuuaacaugagaggggaguggagaagagagcacuggaaagucucaugguggggaagagagauaaaauguacacuauuguuuucaaaaauguaauucuauucacauaccaggaaauucucccuuuuaaaguguacaauucagugguuuuuaguauauucacaaaauuuugccaccauuaccacuguccaauucaaagcauuuuugucacuccaaaaagaaacccuguaccuauugacugucacuccccacaucccccaugaccuccaaccccugacaaccacuagcauacugccugucucuaugauuuugccuacaggauucugagcauuucauauaaguggaaucauacaauauacaauauguggccuuuaugucugacuucucuuacucagcauaauguuuucgaggucuguccauguaggagguaucaguucauuucuuucuauggcagaauacuauuccuuauuugcauagagaugaucuuucuuuuucuuuuuuuuuuuuuugagucggagucucgcucugucccccaggcuggagugcaguggcacgaucucagcucacugcaagcucccucucgcggguucacaccauucuccugccucagccuccucaguaccuaggaguaccuagguacuuuuuuuuuguauuuucuauagagacaggguuucacuguguuagccaggauggucuugaucuccugaccucgugauccgcccgccucggccucccaaauugcugggauuacaggcaugagccaccauaccuggccuucuuuuauuauuauuauuauuuuauuuauuuauuuuugagauggagucucucucugucacccaggcuggagugcaguggcacgaucucggcuuacugcaaccuccaccucccagguucaagcaguucucaugccucaacgucccaaguagcugggauuacaggcaugccccaugacaccuggcuaauuuuuuaauuuuuaguagagauggaguuucaccguguuggccaggcuggucucaaacucuuggccuggccucaagugauccacccaucucggccucccaaagugcugagauuacaggcauaagccuuuuaguguccagcugccuguacccaacucccacccuuaaaaaaaaugcuuaugcuuaaaauagugacauugcauggacauaccauguuuuaguuaucugcuuaucauuucaugggcauuucagucgucuccacuuuuggguuauuaugaauaaugcuucuacgaauauuucaauacaagacuuuggggacauaucuuggguauacaccuaggaguggaauuucugggucauauaguaacucuauguuuagcuuuuugaggagcugccagacuguuuuccaaaguggaugcaccauuuuacauuccaccagcaauguaggaggcuuccagugucuuuguauccuugccaacauuugucauuguucaucuuuuugauuauagucagccagguggcuauaaagugguaucucauugugauuacuccauguuuuuuaaucaguguuuaaaggguuagcauguucuguguuucagggauauaagcaaaaugcuagagucucuuccuaauuauuuuuaguuacaguuuuaagaauaauaggcuuuggcugggugcgguggcucaugccuguaaucccagcacuuugggaggccgaggcggguggaucacaaggucaggagaucgagaccaucaccugacccaggaugagggauuggccaguagggugugcucagaauuuuagccccuccccacuccugggggccuuuguccagggcaggacuuagauauacaacuguacuuggauuguaguuggucgcuuggaagccagauaggccgggguuccuguuuucagcugggcugagggcucugacauucaacaaaggauuuaaugccccuggaccucgguuuccucgucaguaaauaauauuggugauauuuccuucugaugacuauagcccucuuaugguauugugaugauucaaugaaaugagcuuuauaaagcagcuggucuaagaccugacaaauccaagugcuuacuaaacaguaguuaauuuuaugucuuauccuaagggacuugacacagguauuauuuucucuagaagaugggucagcaaacuaugacccauaggccacaucaguguaauauuuuaccucccacaagcuaagaauuguuuugacauuuuuuaaaggguuguaaucaaaacaaagaauaugugaccuaaguuuccugauucuugcucuaggcccuucucugacagccccucgucccugcccugcucacccccacuucagggccagaugucccuacucauuggucccuuaucaccuuguacuuaucucugacauagcccuuuucacaaagaaaucccuaggagacaaucagcagcuucuccaucacugcauccucgggcacacaguaggaaguuagcagcugugaguucagggaaugaaaggggaguuggggagaagaggacacugaagacgguuuugccagccacacaguuuugcuuaaguccuaaggggagaggagacuggcacuuggcuuuggcuguccuccugugcauugcauuugagcagagcaaugcccuugucccaauuguauccccagauacguuaguguggggggacacucugaauuuccccuaggccgucacaugugggcuggacuucccaggaacacauuucuugguaauucacaacucccuuucggagaagaaacuuggccuguggguaacagaccccaacccaauagcucuugggccucuccuggaaagacacagcuuucucucagccaggcugcaugaauucaggauuugcauucucuugguuggggcugggcugagagaagguggaaugcguguuuuugagauucuaaauaagaaaagcaggcgugacuaugccugcuugauucuauuacuuuggggcauuuucaaagaauuucuugucuccacuuauuuuucuaauauucauguuuauguugaauuccucaugcagaaacugaugcauugcuuuuaccccagagcuuucacugacguuugauggaauuagcucugcaaacacugcugacaugaugugcccuccuguuuugguuccuucuguacuaaacaugauuuuuacaaugaacuugagcucuguguaugagagaaaaagaaggagacugauuugugaccugacuacuugcccccauaaaaaaguccagaagagcccaccgauuaaagcauauaagaugaaggcaggacagcaacggucugaggggagcagauguuuaaggugcuuccagcaaucugaguugagcgguuuacaauucucaggcaaaagcaggcacaagcuuuuucaacagauaaggaacaccuuuaaaaagaaagggacgaaugcagaugaaggacuugcaacucacaaugacuuuuaaacuuucuacaaaaaaaaagaaagaagaaaaagagaaaaaaccuuuaaaguuuauaguaguagguuuuuuccaaagguugccaauguguagguuguuugcaaacauugcccaguggaagaaaggggggaauauuuccaagucacaauucuacacguuuaaugucaaagccuacuaaauauuacuccucuugaaucuucaaaggaauuguguauaaauuccugaaaaauaaaauugcauuucugcacuuggaugcaagugacccuuuggucacuccccaugaugacuggaugaacauaguuuaaccuugagagcaacucucacaacuaggucaaaaguuguuuauugaccacauaauuuccaggugcaagaugcuuugaauuuuuaaugcgcuuacacuaaaauuacacaggggcugaaagauuguuuagcuggacuucugagcaaaugagugugguuguuauuguuguuuuaaguagaccacauacauucacagaagggaacuuuaccgugaccuagcagauuacaaaaacuacagugaguuccuuugacagcuugugaguagagaaauauauuuauaacaaacauuucuucuucuccagcuaccuuuggcuuccaaccauaaauauuuuauaaacuacccccagaaauguuuaaugacagacuuuuaaaguaauugaagaaagaaagcagcacacuuuaugagauccuuuccacugacauauuuugaucaucgauacagcauuucgaagcuaauagugcuguuacuacaaugucaguguacuacaggaucaaaaggaaugauaugagacuuagaacucuuuucacugugagugcacuugauuuugauuuucucagaggauaauaccuguagccauuuuuaaaaaugaauaaaauuagcaaaaaauuaaaaagagaaaggccuauaucagaaaugcauugggcuaacaaacagaaaaccugacaagagugacccacacaaguggagagcccuuuuuauuucaugcauuaagcaguccaggucuggugugguggcacugugauaucacuggggucuaccucuuaucuucguucucugucuucauuagcuugcagaucuuggcuuguagcauggcccucaugcuucuugccucauggucacaggauugcuucugcaacucuaggcguggugucuguguuccagggaggagaauagaauggaaagucaaggcagaggacugaaaaacaaugccagaggaaucugucugucauuaaaaauugcccaagaggccaacucagcaguguucauuuauaacucauucauuuguugaaugaauggacagaacuccaucacucuaucacucccaacuucaagugagucuagggugacuauuuuuagcugggcauauuguuaccuagaaugaggucaugguuccuuuaggaagagaggaaaguagauauuagguaagcaacuagcagaaucugcuauaggggguugucauuucaaaauauucuauauaguuaguaauagguuugaaaaaauguuuuuuuuucauauugaaggugaggacucuauggggaugaaagaaagcaauuaacaauacaauaaugggguauauuuaccuucugaauuuaaaauauucucugaagacauuacugcuggagcaugguaagaauucauccaucauucaguuguccuuacguccccguuauguauugagcuaaguacaguugcaaagagagagaacaaaacaaagagagagugagaaagagagagagagagaaaggggagggaaaggggaggaggaggaccagugggagggaggaaggggaaaaaucauagaaauacauugaagucuuggccuucccauagccuuacaggcuagugaguucaucagguuagcguaauuggugaaaaaacaauuauauaaaccaucauaccacuaauugccauaguugaacaaacuuuacuuuggauuuucugguagccaagaaaaaauggggccauaaaugguaaugucguucucauuuuccaugagaagaaaaaauaauacagucauuuguccuacaguguaguggauuagagagcuugaguaccagcucuggaauagacuuugaacaaguuauuuaaucccccuaauucccagccuuuucuucuuuaauaugggagcacuaauacucaugguucugaggucauuuuacaaauuaagugagauauugcgugaaaggcaccaccaaauuaagagcccugggaugaaaaaaaaugagaaagauagaagacauugugcucaaugacauccccauuccaaaacagaacuggauugugagauguccuaucauauggugucacuugagagcugccaaggauaugaugccaaaaugucacucagucaaagcagcucuagauggggccaagaaguuaugcuucaauagacagcuuuuugaugguccaacuuggaccaaggcuaaaaauucaaaauguacagagaaauggauggagucuguauccucaaacaaucucccuuacuuuugacaucuuucagccagcccuuugauagacauaagcagcucuccauccaaggguacaguccccagugaaggccuggaggggagguauuugugucacugguggaggaugagcuccugcacuacaaugacauagguuggacaguggccuuacccagacucugacccaagcaagugcucaacccaucacuaagauuuuuuuuuuuuuucacucuauugcccuagggcaacuacagucugagaucagcaauagacucuuaaaaccuggggcucuugcccucauuuuaaacuucuguuuccuucauuuguuucuuuaacuaaacucuccugaugaggauuuucuuauugcuuagucagguccaacuucuugaccauuauaggggaagucagaaguuuuauauccauccagugagucuagcuauagagacaauuguugcucuauaaacugucuuucucuuuuccucuuucuaucagaucacaaaaucccaagagauggaaaauaucuguaucaauuuauaaaaauauuuuuugaauaaugauuuauuuuauuuagcacuguuugauagccugaauguaauaacaguucccuauaggaaauggguucccccauccauccugguggagauuucugaaaaaucuguuuacccaggaccagguaacagaugaaagcaaaaaccagccaauagauacuguggaaaagagcauuccaugaucagaucuaugcugguggauugcgucuagauuccaugccacauuuguucaaaauuaauucaauuaugaaaaagguauacuugugaaaagcccccaacauguaggcaguuaagacauaauuucaucugagagcaauuuaaaugucuuauugccaucucuagcuaaaaauaccuuaugauuucuggauucuuguguggaguuaaucucccagcucaaguucaccuuguugcuaauucucuaucucauuucagugugggaagcaaugucauuuuauguagaaaggaauguauuucaucucuccucuucuccagcuaucagcaaaucuaugccuagggcagggagcagcuguggggauauggauaggacacagccauggauccuucgcacauguugagaauguccuugguguuugcugcucuuacucccuuuucuguagaugaggaauggagauuuucaugaacagguguuugaagaaucaagaacaacagggccuuugaguggugggguacagcagacccuacugguuacuuacuccauauccauucucccacagccucccccucuuuagcagaaaucugacuuguucaaguuuuacccuaagaggaaggcaguuccacccuagcucaugagugaguccugauuaaucuaagccuagcaugguugucuuauuuccuuugcucauggcuaguugagauguacacuggaaguuuagaccaaaccaauggaacaugagaaauuuucucagggccuucuagguaggauuuucagaucuuaaaggaagcacccaggaaagauagucucuucuugccccagacuuuguaauucugcaugggauggcuggaacugcagcagccaucaugaaacauaagaaaagcuagucugaggacaaugcuggcauuuccaggauggaagagcgagauggaacaaaaguauggaaugaggccuaaaaccuccauaccuaaggacuuuuguaagagaauauauuuuccuauuuauuuacgagagaauguauucucuuuauuguuugaguuucguuggguuuuugguuaccugcagauacaagcauccucguauugauacauggagauguaacauaaagcagagaaguucuuuagccauguuuaacccauuuguucuugagcugcaacucaguuguccugcuguguugcuaugcucaguauguaugaggggaaacacuaggccagagaguugaugaauuuuguaugguguguuuuccuugcauaucauacgugcaacacacagacacacacacgaugugaaaaaugccaagaagccaauuccacauagccaaaucaaacaugggagggaggcuagaaaguuucuuauuaaugcaaaucaauaagaauuggguagguguacuuugcaaagggaaaauggcuaucccuuugaagccauacaauuucuagagauaccaagacuccguucaaaugccguguucucugugaccccuucccugaguucucaaggccaaguugaucaccccuuccguucucauaccacuguaugcauaucucuaguggggcgcuuaccacaugguaucagcgcaagcagugucagcguucaauucccuuguuagauugugaguucuuacagggcaagagacuuguuguaaccuuugauguauucacuuauucaacaauuauuuauugagugccuacuaugugccaggcauugagcugaacacugaagauacaauagucagaaaaagcagauguggccccugcagucauggaguuuaaaaucuagugagacaggcaaucaaauaauuacagcagucaaccaauuucuuaugccuaaccaaaugacuagcacgcaguaaaugcucaauaauuacuugcugaauuuagucacagaauuuucaauauucugugccaccuuuuaucuuccuggaagcuagccuaaguucauacgaugguggaaaaccuccuaggggaaagagaggugaagcccccacaugcaggcuguuuucaagcaucuguuuguauugcacuuacuaaugucuuaauggccaaagcaagucauguggccagucuagagggccguguggaaggaaguuacacggugcagggauaggaagaggugugacuggucaggggccauuaucguaccaaucugccacacuauuuuaaauuauggguuauguuauauaagccuaaaacucagcuaagagauuuaaacaaugaucauuugaaucuaagaauaaguuucucaguacaauucacacucaagaaacuaacauuugauucagacauuucaaauggaaaauaaugaugugauucacagugaacaguauauccaagcuuuuggucuuaaaaucuuugcacagugcuuugaugagagaggagucuuggcagccaaguguggcuguuuccccagccuuuauacuauuuucagugagggcagucucuucuucugaggguuguaaugagaauaauggacucuuuccccacuaacauccagagaagaucauucuaaaucgagugguuggcccaugccaacaauaucugcuauaaauuaugaaaccuccaaucaauaaucaauacuucuccucuauuuguauaauagcaaaugaguuuugagguuggacucagaguauaaauuguuaacuaaaacaaaauaggauaaauauagagaaaugaaacuuagcuuuagagcagacucuuaaaccuuagaagucuguauaaacaaaagugucuaugcauguuuuauuuggagauuugugugauuaaacaaaaauguauuacagaucugaauggagagucaaauuaagugugugggucuaguggagagauuaucuauccaaacgcauuuuuguaauuccguacucugguccaaaaguuaauguaaaaagccaaucgaauugauuaauacuaaaaauggaacaacugcaaacuagaacuaauuugagaacccuccuacuuucauccucagaguuugucuaauaaggacuuuuggacgacugaauacauagcauguaagaaaguguuagaaauggcuacaagucugaugugacugcaacaauauuacucauaauguuuuugagcacaacaaaaacauacaggguacauccacaugcauaacagauguucacgggaagaugagguuaaacaggacuuccacauccacguggguuucuccacuuaauuuugaucauaaaagccauagagaaguugaaaggccucuuagaagaguggacagaagccgccaagcacaagugcaguagggcuaccuuguguaugcaaaaggaagacaagucccacuuggaaauaugccuucaggaagguuuagccucgcaaacuugcacucucccauugugcuuacauuucauguguguggcauguggauuucauuucucuuucugucaaacauacaaguauuccauggauuccuauggacccaacugcaguuugaauuuuagaaacuguaacauuuuuggccgagcgcggugccucaugccuguaaucccagcgcuuucagaagccgaggcaggugaaucacuugaggccaggaguucgagaccagccuggccaacagggugaaauccugucuguaauaaaaauacaaaaauuagccaggcaugaugcugugugccuguaauccuagcuguucaggaggcugaggaaugagaaucacuggaggcugagaagcagagguagcaaugaaccaagauugugcuccugcacuccagccugggcaacagagcaagaccucgucucaaaaaaaaggaaacuguaacauucugugguaaugagauacccaguuuauggcugcuuuuugccuauuauuuguguacugaccacagaagcuuaaaggguacuguggcauuaaaagugaaucucuuuguuccucauauguauauuuuuuucauauuuguuaauuugaaauuugaaaauauucaucuuuuggucuauggcauugauagcauucaccagugucaccugaaauuugaguuccugcucaaacuggaagucuuguauuuuuuuccugaagcacucuucaaggauccaacuaugguagcuuaaucauuacaucuagaaaaugacuuauggcuccuugugaaaauugcuucuuuguaugaaaauucugguacagcaugcaggcuauuguguucugggaauagcauagugaugaugugcguuauggagauaacaggacauuagguauacagaauggaauuaauauuuagaagugcaggaugccacucagauaacccuguggucaucccuaaguauuguguagcccucgguuaacauauggcacauggacagggaggagccuugggaaucauuagguucagugcccucauucuauacuuugaggaaacuuugacuuagagaaguuguucaggaucauuugcucaugucacucaacuacuuagagugauaaagccaaggggaaugccagaguuucauaacuuucaguccagggaaccuucgacuucaacauacuuuuucuucuguaacguagcaaaucagggguuucaaaauauuaugaauguuaagaaaaaauugguagauuuucuuauaguuuuaagagauaacugaaagagcauccuuuauaauaauaaauaugacagcauugguucuacagcacuuacuauaaucguauuuucaucccaauagucuagucuauacucuuuauuaauuauccacuauauacauaacagauagauuauuuuuauuaauuauccacuaugcacauaacagauagacccagauggacuuguaaaugaucuauggcuauauuuauuuuucuguagguagcauuacacauggaauuguuucaagugggaacaggggaagagaagaaagccaaagguucagauuuggcauagcucuuggagaagaugggcuugaauaaugagaagcacgcaggaugucauuugagaguuguggauggaaagagccuucuguucaggaggauugcaaugaggggaaauagaauucugagaucgguucuguguauuuccuccccuagaauggaggaaaggagacugggagcagaagagaugaugguaauuagaaaacagauguguguggcucagaugguuugaugggcaaaggccagugagaaucacugccgaguucugggaggcuuuggcgaugaucucaaaaugggaagcuugaaaugauuaaaacuguggaaaggaagagaaagauaaaaggaagauaaagguagauuuauuaugggacaagcccaaacaagaauaggacagccaagguguccaaaauaaaacugggaacgccuauggaguuggaacccaugucaucagcacaaauuacuggaacuuuguuuuuucuguuucuuuaaugaauauauuccacaaacaaggaaacacgguaaaaucuaguuuuaacuuuuaaggcguuuuccagauuauaucuugguagcaauauggacugaaauuaauuuaauagcuucagaagaaaauaucauuuauuggguuauaaccuaacuuuccccuuuuuauaagugaggaaacuggggcucaagggugugaagugacuggcuucuagcaccacaguguccuaggaacuuuaacaugaggauuugcugaguggauuuaaacugcucacaguccuauggacagugaggaacagaauugucccugaauucaggccuugcacagcccuggcugugacucuuucaaguguuaguuugauuaaccaugaaauggaguugcugaaaaaucaugaacugcaguuuuauucgucaagcaaagucauuucacagucaguauaauauucaugcuaagggucuaaugcuuuaacaacauucaguauaaauuucaguuaaccuacacauucaguuaaccagcacaccuguucucuaacuagccugggagagugugagcauacuuaugagguuaauuaugacugguaaaugugaguggagcucaucaacacacaaugagaccccaggaagacacaacagugcccuucgccccaacuccucuccaggaucacgcaggcaaccuucuccccagccuuaaucccucagaaggcuucaaggacccacucagccacuuaauacagaaagcugggaguccucugugacagcacuuccucaaagcugauggaguuggcagagggcccuggugagcuuuuuagagagagacuccugacucucauccuagacugugauucaguucgucuuagaguguggcccagaaaucugcauuuuuaaaaguucugugaggaauuugaauauacaguuauuugcgaaccacagcuuguacuauauuaaguaucauuuugcagagaauuaaaagcagcacugauguuaauucuuccaacauuaccaauccccagaagagcucuauagacucugggucucauagacuaugaaagucuugguccagaccacauuuacuuuuuaccuagaaagccuuccuucucuucuccccauuucaaaccagggcuaagcuauugaacuuguggaugucaucugguggugguuccugucgugcucaggaucuuggaaagauuucuguuuaucuggcacgcuccacacaggccugucaggcucuggggauuuguggcauuugcagaacuuacaaggcaggcagcauaaaaauauauaauucauagaaugaaagauuuuggaggccccuucacuuuuacaaauuggccauaaaauagaaaucacagacauaacauucauauaaccgcaguugccaagaaugaagaaucacuugggggagggagagggugcuugaggaguuucauguguacuucucuauagggcaccuaaagaaagagugagcauucaaacucucugugcaaaugauaauaggaacauuaaaguagaggauagaguucucggccugacaauugcaaguaucuguuaaggauaaugaagauuucgagauugauccuaagaggucuuuaaaagucuuuucacagugauugaguuuaucauuugagggcauuugcuuguccugauagacauuccaaauauacuuaggauuuuguauacauuuuacuauaacuuacugcuucuugguuuuuuccuuucccaguggaagcaguugacaauauuugaggcagcugucuacuuugaccgccugugauauaucaggggaaggagggaagggaaaaguauacauccugccaccuucuucuccaauuagcugcguugacacucugggcuuccauuagcuuucuagaaagaguccuuaggaaggagagagaggcuaaucugcuccugucaguuccacuuaagccuucuggggacuugagucauggcugaguaauggcugaugauacugguugugaucgccgacuguugaaaaacaguguauucaaugagguuggauacaugcaagacauaaaaaaggaaagaggaucucugucacagaagucaaacuaaaaauucucuucacuauuugauuuguauauuaaagaagugucaucuuaggagucaggagagccgagagcugggcuuucgugguuaugugucacucuagcuuugugaccuugaagaugccaaaugauauuucugggcuucaguuuacucauguaaaaauaguuguaauaucuacauaguguaaaggaaaauuucauccaaaucaaacacagauugggcuggagaugggggugauagagggugauaguuguggcuaggggguguugaauggaugaauuauucuaaauugcuucuggaccucaaacuccauuauguuaggaaucugugauccacggggaguauggggggcacacagagggaguuacuuggaugcuacuaaugauacuuaagccauuugauaauuuacacucuuagagaaaugcacagccagaguaaaagacaguuaugcuguuucauucuguauuguuaaacaaggaugaaaaggguuuacaugucacagaaccuaggacagggucagucccucccuccuuaaaaaucaguccuuuuuuuuuuuuuuuuuuuuuuuuuuuugccaucuuuccagaaagugcauuucaaauaaaaggugaugaacauuuuuaaagcagaccuucagaaacaaaucuaucuuauuuucuuuuuguuuauuuauuuuuauuuuuuugagacuaaguaucacucugucacccaggcugaagugcaauggcgcgaucucagcucacugcaaucucugccucucggcuucaagcgauucuccugccucagccuccugaguagcugggacuacaggcaccugccaccacuccuagcuaauuuuguauuuuuaguagagacaguguuucaccguguuggccaggcuggucucgaacuccugaccucaggugauccacccaccucagccucccaaaguggugggauuacagguaugagccaccaugccuggccaucagaaacaaaucuauaguucuaccaggaacaggaggaaucugcuucuuguuaacacuguauccaacaucuacacauugauuuagcugcuuaauucggcaaguuucaaugcauuacauagguucuuuuagaaaaugauuaaaaaccccacccuaaauuucagacagguuuacuuacguuugugguagugcauuaggugucuuuaaaacucacaaggcugauuccagaaauuuuagugaaaacacauuuccugcuuuuauguucauaucauguagguguguauugguauuuagagaaaugauagaaguaccgucacugugaggauguuaagcccuccuuuaucucaaguuauuaucguagacccagcugcagaaaugacacaggauguuuuguucuuauagacgcguucuuuuuaaauaacaaacuuucaaacuauuaguuggaagcuugccacaaacuaauaaaacaauuagaauuaacaucuuuuaaaaaaugaauuacccaauagccuaaagguaaauaacaucuuugguuauuaguaaaaagaaucagauagauacuaagccugcuacugugcugauuacccaaacaauucaggagaaauuaagugauuucaccuaaguuuucuagguaagugccucaguuauucacuuaaacuguccaagaggcaccuguacucuuguaauaaaguacuuaccuaugugguaacucccaucuucuaggucauuaauucagauguaacacauucuuccuugcuauuccguaaugugcuaugagacgggaaaaaaugcaccuaucccaauuguuggacaguuuguuucuauggaggaauuaaacucugaguuuauguuggcagcucugucguagccauaauuucauaccccagccugguuguaauggaaacuccaacuuauaaaugcuauuuguaccauuaaacuaaacaugaaaccuaauucaaccuuccugaucauaaccuuguagccaagaauguaauuuauuuuucugaauaucuggacuucuguaauuguugccaaugaacaggcuuuugaaguacucacugauuaaaccauaaguaacaaugaccuauuaaaaugaccaucuuuuuauuuucucugaugacuucaaauagcauuuggucagauaaagcagcuguauuugaagauucucuugguuucacauuuuagugaaauuguuguguuaauuaguguuaagcagcacauuaaauuccucagagcaguuagggcucauucagugucuguuuaggcucuuuauguacaaagcacauucuaggcacugugaggacacauaguagacuggcccucaagaaacaagguauuacucauaagaaaaaaauacauaauggaaaaauugcaccaaaauggcaugugacugguuguuaagugaaugauauagauauuauauuuuauuccagugacaacuagccuuuaagcuucaaauuuauuaaaugcuacccugcauacaaauauuucaggaaaauuaaauuaaccuauaauugcaaaggcaaaaauucaaaugaccuaccauaauauauuuauguuugcaguguauuuaugauuuucuacugugcuuuauuauuuaguuuugagcuuuuuaaaaugaccuucuguuaugaguaugugcugaaugaaggaauccuuugauuauugucaguuguugaucaaugcugagcauucaaaauggagaaauaucuuuauugcagauaaaaaugauuaaucauagaugcuuuucauaauagcuaugaaaaauauauaauaaaguagauaauaguauaaauaguauauaauauuauaucaaaauagauaaacaguaguauaucaagauaagaaguagauaauaguauauaaaaaucauuguccacuaggcaauuagaaaggaaaaagaaaggaaagacauucauauuggaaaggaagaaguaaaacuucucuguuugcacauagcaugaucuuauuauagaaaauccuaaagaauccacacaaaaaaacuauuggaauuaauaaaugaguucagcaagauuguggaauauaagaucaauauagaaaaaucaaucguauuuuuaccaaucaguccaaaaugaaacuaagagaagaauucuauuuauaaugacaucaaaaagaauaaauucaacaacagcaguauaaggcaugagcaaugaaaacaacaaaacaucaaagaaacgaauuaaaggagaacuaaauaaauaggaagacauccauguucauggauuggaagacaauauuguuaagguggcugucguaaucaaauuuaucuacagauucaaugcaguccuuaucauaaucucaacuacuuuuuugggcagauauuagcaagcugacccuaaaguucacauggaaaugcaaaggacacagaguagccaaaaacaaucuugaaaaggaagaacaaaguuggagggacuuacccuucccuucccaauuuaaaaacuuagaacaaagcuauaauaagacugugugguacugacaugaguauaaacauauagauuaagggaauagaauugagaauccagaaauaauaaugaccccaaauacacuuaugguuagugaauuuuugacaaggguacuaaacagcuaaguggggaaagaauagaaagaggagucuuuucaacaaauggugcugugacaauuggauauuugcaugcagaagaaugaaguuagacaacuaacucacaccacacacaaaaguaacuuaaaauggaucaaauaccuaaauguuagaaauaaagcuauaaaacucucaggaggaaacauaaauguauaucuuuacgaucuuagauuaggcaauaguuucuuagauaugacaccaaaaccaaaacaaccagagaaaauuuagauaaauuggacucagucaaaaugaaaaacuucugugcuucaaaggacaccauaaagaaaaugaaaagacaacuuacaggaugggagaaaauauuuguagauuauguauuugcaaauccagaauauauauauggaacucuuaaaaugcaauaauaaaaagacaauuuguaaauggaugauggauuugaauagacauuucuccaaagaaaauauacaaauggccaauaagcacaugaaaaaaugcucaacaucauuagucacagggaaaugcaaaucgaaaucacaacgagauaccacuucacagcaacgaggauggguauaauaaacaaccaaaaagacaguaacaggucaggcaugguggcucaugccuguaaucccagcacuuugggaggccgaggccagcagauugcuugagcucaggaguuugagaccagcuugggcaacauggugaaacccugucucuaccaaaaaaaaaaaaaauuacaaaaauuagccagucguggugugugccuguagucccagcuacucgggaagcuaaggugggaggaucgcaugagcccgggagacggagguuggugagcccaggaucaugccacugcacuccagccugggcagaagagugagacccugucuaaaaaaauaaaaaaauacauauauaucaauaacaaguguuggcaaggaugugcagaaauuggaacccucauauguuguugguaggaauauaaaauaguauagcuguauugaaaaugguuuagcaguccuucaaaaaauuaaaccuacgguuaccauaugauccagcaauuccacuccacuccugaccuguuacugucuucuugguuguuuauuauacccauccucauggcugugaagugguaucucauugcgauuuugauuugcauuucccugugacuaaugauguugagcauuuuuucaugugcuuguuggccauuuguauauuuucuuuggagaaauaucuauucaaauccaucauccauuuacaaauugucuuucuauuauugcauuuuaagaguucuggaauuccacuccacuucuugaucacucuguaaauuaaguuguucugauaaagcauaauagcaaaaaauauugucauuaaggaacauauuuauguauuuuguuuuuaaaaagaaacaaaacaaguuugauaaucaaucuuagagacugccugaaauuucaucagugcagagaguuaagaagaccaacauuucucuuguuauaucaugaagauaaauauaguuuaucacuucugaugaacugauauacauccuuuuuauuaaucugauuauaggccuuuuucacucagauuuauuauaugaaacaguuauuguucugaaauugagggaagaauccuaaguauuuccauacagacguuucauguuuguucucuugguuuuuuucccagguacuaccuuucccaagccaggugguguacaacaggguaggcaagugugggagccguacuguggucuugcuucugagaaucuugucggagaagcacggauuuaauuuggucacaucagacauucacaacaaaaccaggcuuacuaaaaaugaacaaguaaguugacuuugcacauuguuaaauuguguuuugcuucagcucauuuguguaacuagugggugccuuacaggucauccuucagacuccugaugagugaauaccagaguuuugauuucaugcuguauuuuugccagaguguggaaggaaauuuaaguuaaggguuccauaagaacucuauaaaccagggaauauccaugaagggauacuuccauuaggacugaugaaggacuguauguacuugcccuugucuaguuagcuaaaauuagcgauauauacaucucaaagagucauaccaccgagcuauaaauaaugcugacaucuucaccaucaaaaugagaagauuuuauuuuaauauucuucccucuucauuuucucaccaauguccaggaucuuuaugguuguauugguugaugggggacaugagcuuccugcuaugggaaacucagaggaucuuaggcuuugagagcagcauuuggaauguucagugguaggaaaagaaugaccccacuucacaggaacaauuuugcccuaguguagcugagcuguacaaguggacgugcugaugguaggaugggagugcuguccucuaccaagaagcuaugaagguuuacuuugcaaaccuguauagagguaagggcaacagucucugugggggugcuuugcuaauguagaaaagucagauagaguguucucauggucauuuuacagaguuggguuugucauccuggucucagaaacuggcuucuguccccuuacauacauaggaugagcagccacccaaugagugguaccugcauguugggaagaaacaaggaacauggcucacuaucagguugagaucaucauuauaaaaauuuccucaugccuguaaucccagcacuuugggagccugaggaucgagaucaaggccaggauugagacuauccuggccaacauggugaaacugcgucucuacuaaaaauacaaaaaaauuagcugggcaugguggcacgugccuguagucccagcuauucgggaggcggaggcaggagaaucacuugaacccagaaggcagagguugcagugagucaagauugcaccacugcacuccagccuggagacagagcgagacuuugucucaauaaauaaauaauaaauaaguaaauaaaaaaauaaauaaauaaauuuccauccauguccauuuucuuuggacauaaucuccagcuuugaaacauucagaaccucacaaacagagggaaucucauucuuaauuuaccaauugcguauuuccauuuuaucuugggggaaaguagaacuguuuuaagacaguaacauagccaaccauacuuguucuaaagccacuauguuuugugucuuuuauaauacagagaucaaauugcccacuccuuugcaaacuuccauuaaaaaaucacucaguaucaaguuuaaauagccauuaccagcacgaauaguuaaagaaucauuaccaaucagcaaaaaauauuuuaagguuauaccuuguagguuccauauuagggucuccaaagaaaagaaugaucuuugguggcauuuaaggauauugcauuuuauguauaagauuguacauacaguaggggcagguucucuuugauuaccuuacuugauugaagagcuaaugugauuaggcuggugaugccuuuuuaacugccugaaagaaaggaauuauaaauaaauacauuauugcaauuuuauuauaauuauuaaauuugguguucuuuugaaucuaacucuuauggccugcuuaucuaugggauuacacuuaaauauaauaucaucauacucaguucccagaugccucauaaaacacaguugcuagauuuuaguucccacugcaggagagacaacaaacuaccugcagagagcaggacaaaaguaacucaaggauuagacauugggauguucaggaauuguuagaagaaagaacacaaaguacaguauuuaaaugugccuugggauuuuauagagaucaaccuaguuuguuuccuaugaggagcaaacaugaaaaaguaaaauacacuuguaacuaugaauggaauaauuuagaauaaaaauuaacagcaauuuacuaaccauguauagauuguuagauccagaaaggguuaaagacaaagucuuccuucucuucuaaaauauaggcuagcucucaucuguuuggaaugguuggcuugucuggaagccagagaagagacuagacagucuuuuaagauucuuuccagcccugugauucugugauauauuuguacaacuucuagcauaaucuguguauuguguaguugaaacauuucugauuccuguggucaaagugaccuagaauauauuucauaacuucauuauuccagauuucuauuaaauuguaaggcaguuuuaaaaacgcauggcaaagguaaagauaagguagaaaaaacaaauauauaauuuuaaugugaaaacaaacauaauaacaguaacuauuaccucuccgcagccaucuggcucuggcaugcagagagagaagccaggaaauaaaaggacaagaaacccaguuugaaguucaacaacauuuagagaaacacuuuuuuuguccuuguauugcuuuuauuaaaguuucaacgugcauaaacagaaaaaauauuauuuuaauauauauucaagaaauaauuugugguaugaauagcuccuuuuuugguaauuuauuagaggaaugaagggggaaaugguuuagaagacuaguggaaauuguagucaguuguucucaccuauaaaugguagaauucugaaaauuuguucccauagaaucauuguccucuagaguuaauaacaauuccacuucaggugcaguaugacuuaaacaggcucuugugggcuggccugggacuuuauccaccguguagagaauuucuuuuaugagaaaaugugcuccaaguuucaaacuacugacuuacaaaugaacuuuggaauauuauccauuucuaagaccagauuaucuauuccauuucauucauacaaaaaggcaccucucugggccacagucaaauucacacaugcauugcucucuggaggguaguugugaucauacacacacacacacacacacacacacacacacacacacagagcuaaauuuuuuaaaucuauuaaauggaacaagacacugaagggauuauuaaaaaggaaagggagugugaagacaccaaauguuagaaugccuauaaaaaucccacuacaucuguccuuauaaaaauagaaauaccuuugaaguucauauuuugggaaauaucaccucaacagcagagcaugggcaauggcugcugggcaaguguuggacuuucgcacagcucaucaugcaaaccugugaugacaucauugcauuuaugcccuaaaacuagauuucaggucuuaagcuggcuuaaauuaucucuugaaaaauggagauuauauacagcuuugaaaaauagggaauuuuuuuccccagaagacauggcaugugauugccaaaaaaacacauaaccaucuuugguuaagaggugacaccaucuuucugagcauugcucuaaauacaagaaaggucagagugcugcagguguauuacaacuaugagaauccauaauuacuuucauucucuuuaaagaaaagcaaaaguuaccagcauauugagaaggcacauaauuuuacuauuucuauuucuguugaaacugaggauuacguguuggauacagcaccuacaaccugcauuguuuuucuucauuguuucauugaacuuuuuggaccuaaaaauauacuacugaguggguaugauucccuguuuuaugggugagacaccuaagacaaucagauuguaacuuuccaaauacauuguaaugacuaucaguggcucuuggccuugaaccuaggccuuccuuaauccaaaagccauucucaucaugcaguguuuaucuccucuagcuggauagcagaaucucagcagagccuuuuaaaaccuagaguugcaguggcccuucuccuggagauucugggguagagcccagaaaacuuuuucuuuaaugaagugucacaagagauuuuaugaugcagccaggguuaagaagcucugucgaaaucaucauaccagcauugcccuagguauguuccugagaauccuaguccucuaagacauugaaagaaaaaaaauauuaugguucaauaaauuugguaaauguugcgugccuugucccgaaugaaucaauucacgaugauuauucgcauuuugaagacuucgaaaauuaaaaacaaaacugcaaacaaacuguuugacuggauuucaccuagcguuuuugcagucuucauuguucaggggagucuuaaugaguguuugugacucauuugcauucugcagaacuccaguucauugucugugaaauacuaggcaaguccacauccucccaccaguuguaacaguaaaggcuacuauaucacuauaaacguaacaucuguucugacccuccaacagcuauucaaauuauuaaaaccuugaagaguuauauaaaggguggaggagagagagauccuaugcccaugugcccuagauagcuuuagcuuccuuaucaaaacacuauuuccuuacaauauuuuaaauuucccucuccuguugcucuugcccccugcaaguuucaagucugaaugguggcuagaaagcagugagacuuagggggaaaaaacccaacucaccuaaaaaaaucauguuaaguuuguaaaagucuacaggcuacagggaucccuaaggcaugguuaaucgggccucuguuuaaucaagaaggugggccaggcaugguggcucacgccuguaaucccagcacucugggaggccgaggcgguggaucaccugaggucaggaguucgagaccagccuggccaacauggugaaacccugucucuacuaaaaacacaaaaauuagaugggcgugguggugcacgccuguaaucccagcuacucaggaggcugagggaagagaaucacuugaacccaggaggcagagguugcagugagccgaaguugcacgacugcacuccagccugggcgacagagcaagacuccaucucaaaaaaaaaaaaaaaaaaaggccgggugcgguggcucauaccuguaaucucagcacuuugggaggcugaggcgggcggaucacgaggucaggagaucaagaccauccuggcuaacauggugaaacccugucucuacuaaacaaaauacaaaaaauuagccgggcgugguggcgggugccuguagucccaacuacuugggaggcugaggcaggauaauggccugaaccugggagguggagcuugcagugagccgagauugcgccacugcacucuagccugggcgacagagcgagacuccaucccaaaaaaaaaaaaaaaaaaaaaaaaaaaaaggugcacucauucauuuuuacagcagauuucucuguuuuuuguucauucacuuugaugaauauuuauugagaaccuaguauuaaugugcguauuaaaccccagacagcccacuagauauuagugcacccuauuucuaauccucgaggcaacauuguuaggaaagcauuauugccccauguuagaaggaggaauaaguguguacaggaaucugauuaaaauauaguguaaauuaagaauaaugugggagaauaagacuugaaagcaaacgggggucaaaucccgaacuuuaaaugcugggcuucggaguuggaacuuucuucuguagacagugggaagcuauuccauuuaugccugagguagcaauuuuuuuaaauuuuugcaaucagaccuuggcaaugaccuugagcaguaggauguaaauaacucccacaugcuuagcguuccaauaauggaacacuaggcauacauggguuaauaaaaaauuguucuuaaucacgauaggcaccaaaaucugcuggggagcguucucacaauauguguauucaggucccacugcaaaauacagagcuaaacuuguaaaggcagagccaaaguuauuuguauuuugcaggggaaaaacucccgaagagguccucacgcacagcccuagcaaggaaugauuucacaaaagccucugauuauuagaaaguuuuccuuuuauugaagugaauccuuuacuacgcuaggaaaaucccgcugucaccugagacucucucaaaccccugaagacuccaugcgucccugaagauuuaugaaguguugucuccucaugagccucucucuuuaucccaggaaccuuucucuggcuugacauguuuuggaaaagccucgcuuagaaugaccgucagaacuucccgacuuuauaggaguggggacaguguccacaggcaugagagugcuccaacuggaccuuagagucaaaccaaagagaggagccuggucccuuuccaugccacagggauuaguucacacagcccugcagacgucuagucuuggagcccuacacacagaaacugaguccgcuaauagaaacuugguggaaaaaaaaaaaagaaaaacaaggaagaagcagcaaggccugcaaaaauaaaauaaguuuuuccuuuccuuccaguugcagccaugagauuuucucuguaauugagacccaggcucuuugccuugaucaugucauugcucccccugguggacuucuucuucauugcaggcguguguugcgcugacugcuucccgcaggccauccugccuccugcuuacaagggcuaccccauacugugggaagagggaagggucaccggagccuccagccaucuucccaggcucugagguucaagggccaaggcucuuccugugagcuacuccuuauuuugcuuugauauguuaaaaacauguccuuucuguaaaaugcuuugcaaaauuguaagacgucuagguguucaugagugacacagaauucacuuaugaaccacguaggguuagauaccgccucugcugacaaauauuugccaagaagucaggagcaaagucugacuguguugguagaacugcagguaaagguuuucugcugcaccaucccagccagucagguugaaagcaaaagauuaggaauuacuuacugauaugcugugaucugauuuuuuucuuuuagguaucuuucauuacauaguuaucuuuuuuaguauuuaaaauuaauuuucuguucuuguuaggauauauacucaguuuucccaccuagaacuuuuaaaaaguauuaucucuggcauuuuaaagcuuuuauuuuuguauuauuucauaaugcuuuuccaucuguuagaacuuucuuucaaauuuucagcacaucacaagaaaagaagaaaauuuauauuccauaaaccuucuuuguucuccagacuuuugugcuaaccaaucuguuccuuccauuuugaaagguuauguauagaucaaaucucggugggaauggugaauagauugcagccaguaaauaaaaaacaggauuuaggguuuggaaagacuuggauuucaauccuggcuuuaccucuuguguggauaaggcuuuaagcaaccaaugcagccuuuugugccucaguuucuuaaccucuacaguagggauaauaauacuuauccauggcugggcacgguggcucacaccuguaauccuagcacuuuggcaggccaaggcggguggaucaccugaggucaggaguucaagaccagccugaccaacauggugaaacccugucucuacuaaaaauacaaaaauuagcugggcgugguggcaggcgccuauaaucccagcuacuggggaggcuggggcaggagaaucgcuugaaccugggagggggagguugcagugagccaagauugcgccacugcacuccagccugggcagcagagugagacuucgucucaaaauaauaauaauaauaauaauaauaauaauaauaauaauaauacuuauccguggguuucuuguccacugcacuccagccugggcagcagagacuuugucucaaaauaauaauaauaauaauaauaauaauaauaauaauaauauuacuuauucaugggguucuugugaggauuaaaugacaccauauguauaaagagcaccuuggugcacucagaaaaugggagucuguuugaugguguuauguccuggauguuauaaugguaagacuguuugccccaugugacaccaggauaaugaacauaugggucugucucagaaaggcuaaauucauagccugagugcuagauaauucugucuucaguuaacuauacauuucuugacuccaaaaaggauuucuaaagaugauagcuucauuucauaaauauuugugggguguauguucuguccaaguaccuugaguaggcuuucuaggggauaaagccugcccccaacccucacagaauuuacauuucagcucagacucgugcacaaacucaacuacaauguaauguagaaagugcauguccugaagaauuuucagaugcacugcuauggaaggucauguucaaaaccaagcccauuuccccccuuaucugcagccaaaucuuuuccucccccagcauugcccaucuccaugaauggauaccaucacguauuugguuguccuagccaggaaucugggaaggaagcucucuuggccacuugcccugccucccuuccauuggcagguagucaccuccuuaacccucccggaaccuccccuucugucuuacuuacauugacuuauuucagugguucucacacuuuugugccuuagcaucccuuggaaggcuuggcaaaacacagacugcuggcaccccuucccccagaguuccuucuaauucagaaggccuggggcggauccugagaauuugcauuucuaacaagucucgggugaugcugaugcugcaggucuggggaccacacugaaaaccacgaccucaguucaugccauugucauuugcuguugggauuauugcccagucuuccuggcugugcuucuguaucuaauccuuacccuucuucacauucuccacccuguccucagaucuggaaaaaagaauuuuuucuggcuguugaucacccacagaauaaaugucagaauuccugcugugaucugcagugcccuccauuaccugacucuuaccugauucucuagucucaccugcuacuuugcugaucccaucucggaucacugaacaccucuggcacacugaacuccugcaguuccuuggugccguaucauuuuauguucugccuuuuguaucugcucuucauuauuugcaaugccaugaaucccuuucuuuccuggcuaacuccucuaggcccuuccagacuacugagggaaaccucccuggggaagcauuaccucuccaucugaauguagagagaggugcuucacuuaucuaccaucuaccucauggugguuaucacaugauuguaccugccucuuaguccaccucacccacaagacucugacagcuuccuaacagcaagaaccaaauccaucaucucuauagccauaacccugagcaacauugccugauacagaggggagaucaaaggauguugaaugaaaagggcuauccagaaaggcuacuuggagggguagauauuuuagccagaggugaagagugguuaguauuuagacacacaaggaguagcagaagaacauucugaaagagggaacuuaaacuggagcuuggacuuggucaggcuuuagugugaggaaggaacaaggagggcucucauuuggcuggccacagcaugugugguccugagagccaguugagggaaauagcacagguggaauucacauggcucaacacaccauugaauuaugggaguccgggaaagagcuggaucaaaggugggaauaugccgagcaccaguaaccugaaccagacuguccagagauggaugaggcuggauaaagaguaaagaugggugaggauuaaguguguuuguggccaugguggaguuugagggcaccauuaggacauauuccacugucuucuucaugugucuucccacccaucuuauucguguuuuuaucuccagugccuaauaaguacucaaugaaugaugagugaauuuaugccauggaaucagacuaaaggccaggaguggucccgcaugagccagggagaggagagguggcucguuggugauuuuagguggugccauugucacccccugaugccucuccugcaaauaagauuuaggugaaggaacaggcaggcugcuggccauggggggaggaccaggcaagagaccucaagcaauggcagcaacgaguucagaauaugacugcuugucgccaaaaacaaggaaagucuuagaauuugugaagaucaaaccggcugagagcugaaauguacccucugccuucacugugcuaauacaauaaacacgagcauuaguaccuugauucuauguuuaaagauaacgucuagaaagaguuauacauugucacugcuaauccauuuuuuuccuccugaaauagacagcuuuaugacuauuaugacacuguucucaaaaucuaacuacuacuauucuuccauuaaauuuaacacauugacauguguuuagagaauauaauuuaauguggaauaugugaaagaaacguuuuuccuucugaccuguucuuccaguuuucuuguacaguacuagggggcuuucuuguaugacucuucugugugcagagaaauaucugaauaaaauaaccuagagauaaaaguguuaauggucuuuacauuaaacauacacacagucaagaguuauuuuuccaagcaggcacccucagagauaaauuaccuaugguuaugucuccaaaccaguaauuccauuaguaaaugcaucaaaaaucaaaaugaacaacgugaccacgcaggaaguuuuacuaccaaaaacaagcacuugcagguggugugucgaggauaaacaguagauaaagaggcaggauucaauuuccuuuuauacugagguuugaggacagacagaccauuauucacucauaccugccacugacuaacagaagcacaggguuuaugaacugcgagucauuuaccuuuaaaauucaauuucauuccuucaaucguugugagcuugaauaucuaauuacaagguuuauacacugagauccuaguguaauaaucuauaaagcguguacuaguuggaguuaauucauugaacaaauauuuaucgagcacuuauauaugugucagccccuguguuagacaugaaggaacaaggcagacuugggcuuucugucauguuugagacaaaccuggaguuccagacucuuauuuuauuguucuuguugcuacugcgguucacaugugaaugacugguuuuguuuccaguuuuucaacuugaacuauuucauaaaacaugaaauguugcacuucugacauucauccaaaguagcaagcugcaaugugcuuuuaaaaaauuccacaguguguucguuuugauggggccaaccagaaaaacuagggaaagagaaguucagaaaguuagggagucauaagaaugcuuggaauuucuaacagauuuuacuaaacauuuucuguaucaugacauguuccagaaggccauaaaaguuaguuuauacgaauauaaacuacuuuuugccuugcugauaacugcaaauaaauaauucagaugaccacccaccaaaacaccaagacauuuggggguuuauguguuuccuacagaauauuuuccuuauaaauuucauggucaaggagcacaagaaugaaguaguaccucauuuuauuccauuuuuaaauucugcagcaccuguuucaauauuuuuguauaucccaauaauaucauuuacagaauaagauaaugacuaaccuccuuccuugauuugacuuuaaaggaagggauagaaggcauucuuuuauuuacauuuuaguacagcaacacacugauuucuccagucaaaauuacuuaaucugucacguugcuuucaugguaacaaucaacuaaaugagacacaggacuaucaauuuggauagcacuguuuuauucgcuaaggagccuuauguaaaacuugauaaauguugcacuuauaccgcugguccacugggaauaagugggaauaaaaagagucggauauuggccaggcgcggaggcucacgcuuguaaucccagcacuuugggaggccgaggcgggcggaucacgaggucagaaguucgagaccacggugaaacccugucucuacuaaaaaauacaaaaaauuagccgggcgugguggcgggcgccuguagucccagcuacucagagaggcugaggcaggagaauggcgugaacccgggaggcggagcuugcagugaaccgagaucgagcuacugcacuccagccugggugacagagcgagacuccaucucaaaaaaaaaaaaaaaaaaaagagugggauacauaaccuuuaacuuaauauggcuugguaaauuagauccuauauaugcuaauuuuuacuuuuuuuaauagauggaacugauuaaaaauauaaguacugccgaacaacccuauuuauucacucgacauguucauuuccucaacuucucaagguaagacauuuuccaguuuaaugguucuuucauuuucuucuaaugaacaguuacuuuagaaaucuaccuuuauuuacaaggcagugcaauugcccuugaaaagacauuuuuaauccguuuauuuuugcuacggagggaucaaaauuugaaauauuugaacagaaacuucauuucuuccuagacuacugucuuaaaucuuauaaaaacuuggaauuauuuuuaaugagaagccauuugaccuaauagcucuuuuuuaaaaaggaaucagauuuuguauugaaacaaauaagaaggcaggagauggguauuuuagcauaaauauuuuauugcacauuuuuguacaauuugaaccugcacagaacucuagaaauaauuuagugcuagaguaaugaguauuuucuaggauccaaaguaccagccucugucugucuuuuuaauacaaucgugugccacaucacgacauuuuggucaaugacagaccucauauauacauuaauccauaagauuauaauaugguauuuuuaccauaucuuuucuauguuuagauacacaaaugauuauuauugugucacaguugccuccaguauucaguauagucacaugcuguccagguuuguagcccagaagcaacaggcuguacucuacagcauaguuacgcaguaggccgugccaucgagguuuguguauguacucuaugaugcuugcacaaccacgaaaucaccuaaugaugcauuucucagaauguaccccugacauuaagcaaugcgugacuguaaaccauuugauuuucuaagccucacguguuugaugcuggggagguauuuaaaauucugguuuuuguuuccagcagcuguggucuucugauaacaaugcaaaucuucaaauucagguuuuuagauucccuauuuguuaaauuacuagcuucagguucugaguguucucuuccccagucuuucauuagcauagguugauugucacugugccucacuccuuugcugauggcccucaguguuuugcucucccugugcuggcucaagucugcauacacagcugcuaucuaauagcugacagaucacuggauccagaggcagaucugcuggagaccagccugggaaccuccgggccucccuugucagcccucugacgggcacuucugucaucuuaacaugggguugacaguuccuugcagguccacacgagagcaccaaaggacccagggcagcaggcaacaucugcuaguuagugcugacccaguggcuccugcaggccaggcaccaagggagcugggucuggaggagcugcugcucugguccagggugccugacaacccaccuggcuggaagaagauuucagccauccaaggacuucccugcuaugcagcagguccugugcaaguuaagugcaaagaaugagauucaguaaagcaaguuauuaagcagagaaaaggagcugcugccuuaucuuuaaaagcaaguguucccugaaguuuccugggccuuccugauaaccagaguuccugggaugguaacaggacuccugcaaauuuuccacaguaauccagggccaggugcugggcagcuaggacuguguuuucaaccacauuuauaaaauggcuuguuacuggauuauccagggugugugcccugccucuuaauuccagaaggccacaugcauauuauuagacaugauuagauaacaaggcuuauuagcucuuucaggcauuguauuuuaugacuugcaaagagaaaagcgcugcuucccugauccuugcuguucuagcgcguuuccuucugagucaccccugacauccuuaaaccucauucaugaacacuucuugcuucauaggucaaaucuuuacaaccaaacagauugcaaugcaacaaauuuuaaauauuuaugucugaacaguguaaaacacaaauuagaagccauggccaguaucuuaauuggguuggcagaucacaguaugguggccauauucugugauggccucuaccaacaaacacguguacaggaguuuagucuucauuuaauucugaaaggaaaaaaaaugauaaaugccuuuuagaagauaccaugucuacagaaaacagugcuggccuggccgucaggaccucuggugucagaacuggccucccaacuggucaugauucucggcaagcuguucaaccucuugggggucucuguuuucuauuuuuccaucuguaaaacaaggacaguucucagucaucccuaccauauagggaugcucugaaccugugaaggaaaggccuucugagagaaggaugcuguauugguccguuuucaugcugcugauauccaagacugggaagaaaaauagguuuaauuggacuuacaguuccacguggcuggggaggccucagaaucauggcaggagucgaaaggcacuucuuacaugguggcggcaagagaaaugaggaagaugcaaaagcggaaaucccugauaaaaccaucauaucuugugagacuuauucgcuaccacgagaacaguaugggggaaaccaccccaugauucaaauuaucucccaucaggucccucccacaauacaugggaauuacagauguacaauucaagauaagauuuggguggggacacggagccaaaacauaucagaugcuguauacauucagaguggcaguuaaaaaggcaauucuguagacgucucaggcugagcccacugcccagcuccugacucgguuucuauggaaacaccuugaggacagggcugggcucugcuucuccucccucaguucuauuuuacucaauuaaacacaugucuauggauuaccuucucucuucuauacacuacaugagaacugggacuucugcagucaacauuaaauguuuuccuugccuuugggagacucuaaguucuucuuccauuaaaguguaacagauguaaggagaggguggucacagggcuuccccuagcggaggugggaagcaggaacuucccugugggaugaggacucugggaagguguuucuucggggaggugagggaugggucagcuuuagacaagugaagggggagagcauucccagcacagcgaccagcagaagagcagggccaagaggaacugaaagggaugcagugcaacccaggauggacaugacuggacuggaacagcagucaagaguuuuaagcagaaauaacaagagacugccugaccagcuuugcugcuuucaauaaaaagccagaacugacuccccaggagcaaccucuuccucucuucacacccacauaccagggccugggcccuuagcuaccagccuuccauaaaaaugaagagaaugaucaguugaacuuuaauauaugacaagauuaugauuguuccacucauagaacaugggacauuaaaaaaucagcuuuucauuguuuaagggaguagcuuuaucuaaggaaaauuucucugucaauaugcaauugacagagaaaaacaacuaagcuggaacuucuuaagaggccuuugacauuacuuuuuuuugagauggagucuuacucugucgcccaggcuggagugcagcggugcaaucucagcucacuguaaccucaguucaagcgauucuccugccucagccucccgaguagcuggaauuacaggcaugcaccaccacaccuggcuaauuuuucuauuuuuaguggagacaggguuucaccauguuggccaggcuggccucaaaacucauggccucaagugauuugcccaccucagccucccaagugcugggauuacaggcgugagccaccaugcaaagccaaggacauuaacauacuuuaaaaaauaacuuuuagauguauuuugacugauaaguuauaaagauaaugaagcugaucuuaagaaaccuacccuuauagcugcugacagaccuauugcuuguuucaggauaaugagguucccaugagaagaacugacacugcaaccuaauauuauuguugauauuuccaauccuccacacaucguuaacaugccgcacgguacuugcuggcaagcagacuguaaggaugaaagucaggccucccuccccacacuuuuuuugcacacaaauggucagaacuuuugaaggguaaggcauuauaccauagcuaauugcccuuucuuuuuuuauuccauuaaagauggcauuuuuaccuugaaauuuagacagucuugagucauguacaaugcgaucccgugagcacuugguguuucucuagcugaccuacuucguuuuuuuucaccuucuaggcuucuuguccuguuucuucuuuuuccuuuuuuagaguuagaaggaaccauaucuaguuuuauuaauccagagaugggaaguaauugguucagaccaucagguguuuugccucagggaagguuuccugcccggggacuuaugcacagcgagcucucagcagagaucucaggcuucaguggggauuccugacuugcacacuggguugcuguugcacacaguuguggaacucccuagaaauucaagccaggcaaauguuuuucaccuggacuaucuggagaauugaguuaaaacuaccuuggccuaaaaggugcuucucuuuguuaggauguuuaaguaggauuuuuaauauuugcauacuaugguuucagguaucuuuuuucaguuuucagaguuaacuuuaagaagcaguuucugaaaaagaucaacuuuccaacaucaacagcaucccuccaaaucuaucuuagauccacacacuagaaagccuugcaacagacuacaauucaaauuugucuguccccugcccccaauuuuguuuguuuucuaagcuuguauuuuuuggggggcguauaaauauuuuugcaaucuacaaugccccucacccuuccaaaugugcuuuugcagggaaacccuuaagaagcuuugccucagaacccgaugcugucaaaauaguccaaaugcauuaugagagacaccaauaugcuaaauaauuucaaaccaccacuucccuuauccuuuuuucacaucauucuuccuuucucugccaugacccccucaccuuccuuugcuuccauuucugucuucuccuguaucucagauggugguuccggugccaauaguaacuugcaaaaacaaacaaacagugugaaaauuagucaaucaccagaaaagcaguggggugugaugugcaagggggugcauuuuggacaccuuuucucuucccuacaagugaagucucaauuacugaugugaacaguguuucuucuaucaacuuuugugaacaaacucugcccucugauggcauuauuuaacaaaacaaaucagacuucgcuaauuccacaagucaauuugguuuucacaucuuauuuguaaauguugacuuuuuuauucuucuuagccaagugaccaauucaauucugugcccuucaaaucucuuaucuuuugacagacacugcaaacucugaagaaagcaccaaaguaaaaaucgguauuagcaguuaacaccgucucugccuccuuaaauacagcgcagaaguuccauuuacaagugcgaguuuucucuggguuuugccuuugugaacccuggcuggacucgucuuccuaaauuggcacuuucuuccucauguuucugcuuuucccucuauggggaguggaucucugccgcugcaugggccaccagcuguguuggcccaucagggaugaguauaaucuggacuuucccucauuuccugauuauuccuuacuguuuauuucaugccuugucaauucaucuuccucugugagugggagcccugacccaaauacccaccuccuuccccauuugucucagcuucucacagcaaauguuuccaucucuccugccuugggacagaccggagagcagagcacagcugucucuucugcuuguguuuugugauggauggugggcggaggggagucuaguccugggcagaggagauggaagugcccacugcagggggugugaggacagaagccagaccuccccaccaugcuggcccccacuggaccuucagggacucuuguuacugugacgggcuccagcaaagggcccuuuaacagccagcuuggcugggcgcagugacugacaccuguaaucccagcacuuugggaggccgaggcaggcggaucacuugaggucaggaguucgagaccagccuggccaacacggcgaaaccccaucucuacuaaaaauacaaaaauuagaugggcauggugaugggcgccuguaaucccaacuacuugggagacuguggcaggagaaucgcuugaacccaggaggcagauguugcaguaagccgagaucacgccauugcacuccagccugggcaacaagagcgaaacuccgucucaaaaauaaacagccagcucuaccccucuccgccucagccacuccucacucugcccccaaaagguccuguucuuuuccaugauggccuuucucucacuucaaacugucuuccucccucacugaucaagggucaaagcccugggccucuggccuaugguacuuuucacccuuuaauguagauaguggcacaaagauaaccucugcuuccaggccagaggcuaaaaaggagguaggcuuuuggcagaauggugguuaccagggguggggaaagcaggaaaagggauuuuuuuguugaaugggcagaguuuccauuugugaacgugaaaacguuuuggagacgggugauaaugaugacuucacaacaaugugaauguuuugauaccacugaauuguacacuugaaaaugaugaaaagggcaaauauauacauuuuacuagaauuucuuagaagaacaggauauacuuucaaaaacugauuccaaucacaguaaucucuacuauaauuggaguacaaaacagucuuaauucuccgggauaauucuggucuuaaguauugauuuaauaugugcaauaauuauuaccucaggaagaaugccuuucaaauuuugaugaaaauauaccuaagauuuuuacccuagugcuuuguguagcuguggaagaggugacuaauauuaucgauggguugauuaauugauugagguagcagugugggaccaaugcugaugaaaaugcucagaaugagguguucggaaaugccucucagagugagaaacaugcaguuaugcuuucuagaaaauuauucccugcugcagagcuucaucuucucaucaaaaaaaaugaguaaaaauuuaaaaaauacgacacaguggcagaguccaaaggaagcccagaggagugcuuacagagucggggaauaggaucugucaacaaaugucgaagaaauugguaaugccugcuauuuuaggaugacuuaaaagagagcuucaaagaugcaggaguaauuguggugacugaaggacaaaaggguauguuguugaacaaaaaacaaaauauggccugacucuucuacucucuaguguaugcacuacuuagaaccugugaucagccguagucaccacaauuuuuuagcgcuccauaaagaucaaauuagagcuuuagauuauaaaaugaagggaaauaagucuuaagauaaaagccaaaggaauguuugaaagaaacaacaaaaaguuaaaagaauuaaaauugaaguugaaaaggcuaagcauuguaaaagcauaggagaugcaaauccuuugugucaaaugguucaaacaaaaggaaaugugcauaaaaggaaaauguuaaauauuggcugaguauaagaaagacuuuucaacugauacaguggacuucacagggagguuguggaaucuucucucaaggcuuuuaaaaaucacuguaugggaugguaggguacaaaccauucucagccccaaaaugaaaucaugagugagcaaaagguucaggugacccagggacuuuauaaauaguagccagaaauucugaccagaguuuuaaauuacuuagaggagaaacugaugcugaaagaagauggaaugaggguagggaaauugcuucccuacucaggcacuaggacaugugcuaugcucuggucccugaugguagcauggugguauucuggccucuucuguauaacggacgugucaccccagauuuucccaauuuggcggaagcuguguguacagaggguuggcagccggcaaccauuauugccuucugcaaaggggaagauauauacaagacaccuguuugucauaguuagaaacuucuagagagagccuacuauauuaucugauacuugacaauacauucuuaagccaucuaaaacuuccauuuuggaaaauuauucuggaagucuugcauuggauugcaacgugcaaacaagagcaagucauccaugcucaucaagacuucccaguccuuacuucucucgccauugaucaaagauggcaguggugaggcugagagccaucuccugaugggaugcugugcauggauucacaugauugggcauuucugcuaacuagcacuagcagucauucuucacaugaacauaaaagaacaguugagguuuuuaaaagcaugaagcaauuuugagggucuaauuaggugcauauuugguaugcaagccuugucuuccuagucccuagcuuuauuacuuuaguugcuguuuaucauagauaugaaacccaauuuaauuuuaaaagggggauaaaucugggguguguacaguaguuagcuggugguuggcacagcuaacuccugggacuccaguuaguuguucauccaguuacaugaauguguauuucugagaacuaacaagauucgcauugcaaggcuaaucucacccaugagcaguguguguuccaaugugguaguauuuaagggcuccagggugucauucauauguccuggugccugaaauuccacuaucucagaguuguuccuuuggauucuucucucugaagauucuuuuuaaaaaugcagauaaaccaggaacaacauuauaugaauucauacacagaaaaggaugggggcuuguuauuacuuuccucugacaacagagccccaugauaugggaagaaacguuaacaacugagaggcacacacucagauguucauuucuucauuuggucaucauuuguugagcaccuacugugugccacacacugagcuagagcgugucguuccuggcugcaggaggcccacagucugaugggagaggcacacauuuccacacagugcaagagagagggcccagggcacagaggagggaggcauggacccuggguugggcauuaauugcugagggaugugaugugacuccaggcuggguuuugaaaggugaauggagucugccagcuggggagaggcaggagcgggguccugucaguuuguuuucucuuaguucuuucugaccccugacagaauguccaggcacauuccucagaaggucacgaggccauagggcuagagaacccugcaggccccucaggaggucaccagagcaugcccucugcccagagacuggggcacucuccccgaacuccucaaggcuacugcuuucaagcaguucaaagagaaaaagaaggaaucauuaagagaaauccagccaaucucaucacucugcuucgggaagaccuuguucuugggccaagauuuaguggauucaucuaauccuuucauggaaggaauuaaaauggaacaccuggcuauuugcuuuauuuuuaucugaagccacuugccaucacuugaggauaauuauguugaauuuuguuucauucuugauaucccacacaaaauuuccucaacuccagaaaucacuuuuccauaauuaagagcauagauucuagagccagauugccuggacccauauccuaguucagcuacaaguuaugaaccuuauuccugccucaguuuccccaaguguaaaugaggauaauuauuuuuucuacuccauugacguguuauggggcuucagcaagcugguuacaugagguauuuagaacaaggugaauagcgagugcucagugaagacuggcuguuauucacucccuuacugcagagcaccugacccggaacuguuugaauuacaauauagaggaagugccgucucacccagcaaggcagucagaaccuaccaaucaacugaaacauucaccgagggccaauugugucccuguggguucuguucuagccauuggaaauacuaaauccaauacagaguggcccccauccucaagaaaccuacagccuggugagaaaacuagacaccaucucuuccuuaacaugcacaauggugugguuuguaccgugcuauacuaugaaauguccucacagccccucaacagguaccuggaacagguaucauccuccccacuuccugcaugauaauaaaaugcuuaucaggaaacaccguuugcuuauuacgugucauuggcaccuuagcauaggaggucaucuuucaauaaguuaaccuagagggaaggggagauguugucuaaguaggcccuguuuucguccugcagugauggguuguaacgaacucaauguuuguguuagguuuggaggagaccagccugucuacaucaacaucauuagagaccccgucaaccgguucuuauccaacuauuuuuuccgucgcuuuggagacuggagaggggaacaaaaucacaugauccgcacccccagcaugaggcaggaggagcgcuaccugguaaguccugucgcaugcaaaaggcggucuccccacugccugaggagugggcccuccaccagggaagguucacucuucccuucccaggccuucuccuuggcgccuccauggagcguggcgcagagagggugcuuccgcaggaaggaggucuuggcgagagaaacugguuccgggugacccagauccuaaugaacauuuccucaaauuauuuucugauuuugcuuugcucaguugucuuuagugcuagguuuugggacccagagcguuaacagucuuuccuaaggaguccugacuagcacuguagugcuuaagaagaacaaagguguugggggggugucuguuagagggcggcagagccccuucucaucccucagcccauucaguucccaugaccacucugggagggggagguguuuucagaugaggacccugagauucuaaagguugugggauuugccacagucaccucucagguaagggcgcaacugcgaccgacuguuucggguuuccugccuucacagucuggguucuuuccaccacagcgcgauagaacccugucauugcaccaguaauuguuugcuuucucuggacuuguuuugggacccucagcuccauaagggauguuagucucgagcccaguaauuauuuccgcagcacagagguugguaacaaaaacggagggcggaguugcgcgucuuucuuucagcacuagaacgaaagguacauuucccaucccuguguugagaaacauguacugaggagcugacagccuggugcccaggaggcugaaauccuggucucugugucugagagagcccuugggguucacccggacccauccugggcuguugucgggcacaagcaggaaaguaggaaguguugaggaucagucagagguguuguucccaaagcuggaagaucgcccagagcugaggccacugcugaugugccgucagcagcagccuugccgcuggagaaaagcaccgaaucucagggccacggccaggacggcugcuuccucaucucauuuuaaaaacauaauggaaguggauguucagaggcugggagcauuuggggaugauguccccucagugucacguucauguuuucaaauccaugauuagaguagagaaaacugagauacagagaaguuagugucucagccagggccagacgacuacaccagacccacggcuuuccacucaccuucgguauuugaucaacuaccuaaggcuucagugaaauauuuugaugauuuuauuuuuauuuuuauuuucuuccuuugaugauauauuuuaaaaguggcuuuucccuuuuuuuuuuuuuuuuuuuuuaguuuuuauggcgaaacccuaaucuauuucuuuauagguuaugaggccgggcgcaguggcucacgccuguaaucccagcacuuugggaggccgaggcaggugcaucacuugaggccaggagaucgagaccagccuggccaacauggugaaaaccugucuuuauuaaaaauacaaaaauuagccgagcaugguggcgcaugccugugaucccagcgaauugggaggcugaggcaggagaauccuuugaauccgggaggcagagguugcagugagccaagaucgugcuacugcacuccagccuaggugccagaccgagacuccaucucaaaaaauaauaauaauaauaauuaaauaaaauaaaaaacuauagguuaugaauaugacuauauguuuuuuauuuggugagacguguauucagaguauagaaacacuacaagaauaaugucuucucuaauuaucuuuauuauuuguuuuggaucuugauuaauauaucuauaugcucuuuaaaaacagcauacauuccauuuaauccagacaauuuuuucauaguucugauucaauccucaugcuaagaaaguuagaaccaaaggacagcagaaaaugccaaaaaaccaacaauacagaaacacgucuuaugaacacuacucuucaaauauuaauguaagaguuaagaggaaugcucuagcuucuuccguucugucaagcuucuguugccauccuguaaaucauuucauauaaugcaguuuucacacacucacacaaauaauaagcugcaaucauuagagagaaagguggcaaaugugaggggaaaaaauuaugguuuggaguuuccauuuguucguuuuuguuuuuguuuugagacacagucuugcucuguugcccaggcuggagcgcaguggcaagaucucugcucacugcaaccuccaccuccgggguucaagcgauucuccugcuucagccuccccagcagcuaggacuacaggugcuucccaccacgccugguuaauuuuuguauuuuuaguagaggcggggguuucaccauguuggccaggcuggucucgaacuccugaccuaaaaugauccacccaccucagccucccaaagugcugagauuacaggugugagccaccgugcccagccugguuuggaguuuuuuuaaaaaggucauaaaauauugaaaguugguaguuggggcaaguguuauauuuuugaagagcugguaacugccuuuguuaugugacuugagagauuguagagagauuucccugccuggaauucugcccuuagaaauuuguaggggcuccuuuccaaauguaagcacuguguucgggaagggucuaugucagaugaggucaucagaucgauccuuggcaaggccccagcaggaaagcacugggcuccccaaagcagcacagcagaaacucgggggggcucagauucaagagaggagagccugguggugggggggagggguguccccuucaugaucugguuccagccugaccugguuagaaggcugucuucuuguucaaaggauaguuuguuuauuuggaagaagauggucuauugccuuuuuuuaauagcugaaacuuuuaauuccaucuccuuggucccauuagacccuugaaauaaaauugcccccuuucagaagagucuguccucauuuuggcaaaggcuggguagucaguuguuugacucaaaagaggguguuguuugugucucagcggggcgcaggcagcugugaggagcccacuguccccuccuugccggccaccccuccccucggaggcccuucccugcacaccgcaugcccacagggucuugguugcuggccugaaaugagucugcugauuuaccacgucauuccagaucucagugcucuaaagccccuugcuuuaucccauugccaaaauucgggcaguucugccccuggcccugagccucacagagcugcuuagcauacagcugggaguggccagugccugccuccaagccugcucugaggaugaaauaauaucaucuugugaggcagggugguuuggaagaaaauggaaaggguaaaggaauccuaggauuugcaggaaccccaaagaggaugaggacucucucauuuuacaggugugggaacgggccugggauucggggugggguaaagucccugccaggaggagaauccagaccuccugauuccacuucggugcuguuugcccacucagaccuuauguuccugaaggguaaagggagaagaggacugggccgagucccacgcuuuugaagcagaaucauuugauguaacaucgucucuccaucuuuacaaagacaucgcuguuacagcaauuuguuuucaaauauucaagcaucuuauagcuauaccuuauuuucugggaacaacuagcuuuucucaaacuuucuauuucuuuccaaacucuucuuccuuugcauuuccuggaaaaucauuuuuaaauaaauuagugcucgcauagaugcaaguucaacuucuagcagccauacugugaaaaggcaguugucuuaggcucauuucuuuuuguccagagcuggaagcuccccaguguggagguggcugccuccuuuuugggggugggaguccucugaacccaggcacacuuggacacaucccagcaccugagacucuaauccagcucauguccagccuccuuuauuuccaggguagggaaauaccuggcacacagaccauauuuaaugaaugguggaaagcuuuuucuaaugaagagcaacuguugucaucuccagaugagggagagcaucuuauuccugcugaagccacucccuuuuccagucuuggagcuuccaugaaaguggauuucuuaugcugucauuuucacccugcugguuacacaucaaguucucaaaaaugucaaauugggcugcugcccuaaccauuauugccacuucacuaggccauccuccauuugaagaauaggaagaaaagggagaaaaucuucccagagagaacacugccucugugacacuguuuauucggcuuggcuguaaaauguggaaaguaaugcauguuuaaaagaaaagauguguaauuuacagcuucuuaauucauaaagaauucagugaaucauguuggcccuguuggauucuggagaagucugaaaauuggccagagucagcaaagguuuuuagaaagcuaugcauuuuaaucuacuugaaaguuuuggacucugaauguccuuuaacuuugaaaguauacauaugaaauaccagcauguggaaauuuccacucugucccaaccagcugagacuguccuuugagcaaaagaaaccucaggcauugccucuauuucuaaggcauuguuuuucuuaaauaaauaaaaugaagaagggcuuuggauugucugcuuuuuaaguguuucaguaaauaucuauguuuuccaaauacgugacgguaagaaaguuacgcucuuggucuucaacuaguucaaauuuagcuuccaauuguaggcugagccaggggcccaagauaagguguauuuauauucccuucucagcugccuuagcugggugacuuggauuuagccucugugaaccuugcuugucucaucuguacaaugggaccauauuaccuacuuugccugcauuacaggguuguugggagagucuauugagcauucuacacagaagugcuuuggaagcuaaaacucuccaaaacacauuucaguauugaugcucccacccccuuggcuccguuacuggcuccacaugaccuaaaggggccauuuuuccuccagaccuggagcuccucugcucagggaguccauagaggcugcuguuuuccuggggcucaggacauacuggguccugaacccucaggucugcuucugcuguggucucaaauugccucacuagauuccuucccccgggaaccuguuucuaaggaaacuacuucucuuuguguucccaacagcuggagauguguuuugaucccagcccgcuggcauacauuugucuuguguuuauuuacuuggaaaccuaagcuccuguaggcccuggguuggaaagucauauacacgcgcacucucccucuccgaggaguaacgagaaaggcacgccagagccgaaugcuccgccaggcugaugcaagccauccaggagcauggaggaccaggaagccccagcuucagagauacgcugcgaaauacauuuguccuggguguaucuaaagcaggagucacaggugauuuuaggaccaaaggccacuucuggggguuagcaagaccugaggguaucccugggaguuucaggcaaacagaaaacaagaugggugaaggagggggcaagggaggagaggagggaccaacaaagggauuuuggagcuagaauagaaugcuacccccugccaccugugcuaccaccaaacggcagccauguguguaguguguagcagguuagcaugcuuugccucauguuaggguguccgcccucacagccucuccuggcguagguaugagcacuccucauuccccucuuaugaaccaggauggcgaucccagagaggcugagugguggugaagaucaaaccacaaauaaggggaacuugcaugaggcuaccuuaguuacaaggggcuuacgagucacccagguuaccucuguaucaggagccacggggcaggagaacugugggaaugaagacaaaaggauugcaggccagugaaggcuaggaaacgaaugccaggcagagccaggccccaugggaagcacaugaaccacagcacagcuaagccacacggaaaccagaaguuguugagaccuagagccacuuccagcacccaagugucagugcccaggcugcccagggguucucaguucucuucagccaucuucaaagacaccaacgguggguugagccccucuuaugcuucacaccucuccuucuaccaucucauuucucuagcccagcuggaaagggcucuccacuuuuaaggacuuaugucauuagauugggcucaccccgauaauccggcauaguguccccucucaaggucuguaaccguacucacauuugcagaguccuuuuugccauacaagguaacauauucacaggucccagggauuaggauagggacaccuucgacguccauuauuuugccuaccacagugucaucaaggauaacuuagcaggggggagaggggacuguggaggggacaugggugugacaggcauucugacacuuggcuaugccacuuauaagugcucaccacugugcauucuacuaugcaguggcaccaaaccauggcuuuccuggcccuagucugcaaaacuaaguggccagucauacauuuuuuuuuuucuucuacuagugacucauccaccaauccauccgucauucguucauucacucaauaaacauugauuuaguacuuucuguguaguaggagcuauuguaggaacuggaaauaaaauguugagcuaaaauggacacugucaguccucauggagcucacagacugccagggagacaggcauucaucccaaaaccauacagauguaugugaaauaguggcugcaucacauccuacauguaggauguaggcugcauccuacaaugcagagacauggcgcuguccaggcauugaauggggcaguuggcaagucuggaagucagagaaguguugguugagcuauaucugaagggaaagaggagaaggaagaacacccaggcauagggcacauacaaagcccuguggcagaagggaacacagcacggaggaagaaccagggaagcugcagcagggcgagcugaggaagaaaggaaagagcugggugcagugaugugggcaggcagguggugggccccacagagccucccagaccaucuuaaagaucccuggggaggcacuaaaggacuuaaagcaaaagaggcauguuuacaggacauccugaaucuuuuacauuuugugggaggaaucacuuuggcuacaacauacagaguacagaagggcuucaagucgauguggauagaccagcuagauagaucagaggcuacugcagugauccaagugcaagauaaaccaaggaggaaguuuuuaugggacaucaaccaugugcaaagagcagcuccagguggggucaggggcagcaaugagggagcaauuacaaagacauugaagacucauugcugugcuuccaguugcuugccgccuaguuagcaacagaagacccaaacuugaaaagcuuaauaccaagaaggagauauuaauaauagcucagugcagccauauaggacuugucauuggcugggauguguuaaauuagcaaucugaaaauugcggggaggaacgaaaucagcaagaguugggguuguugggagcggcuucccagaaaaggagaggcggacagaggagaggugggugcugucuuuagggguagaagaagaugcagcagaaguaaggcucuggggacagcaggaggggacuguuccaagugaagugacacuuuagaaaguguguaaaagccugagagcaagaggcucacucuggugaaccgccuauuuggcaggagcggagggcuuagggaggugaggagcuuggguacaguaaaguguuucuccagaugucccaguugugggggaagcaacgcugcucugauggcugccaaggcagguuugccugaccugcugucuccaugcaaggucccaucaggagcacgcaccgcaagggccgccagagcacagccaggugcauccgccggccaccugucagcugagcucaucugcugugagccccgccccucgcugugagucagcggagcugcugcagcugugucccgccgcuggcgcucagcgcugcaccccuacuggggcagguggcuaacauuuauuaaggcggugguucucagccuuggccacuuguggaggcuuuaaaaacuacugauuccugggucccacacccgaaaguucugguuuaauaggucuagggugcagccugggcuuugggauuuuuuuuuuuuuuaagcuucagaagugaggccaauguguagcugagguugagaacuacugaggaauuaacaacguauccguuccugacuguauuagcaggagcuguuuucacugagagaagcacccccugaaugccuuauggaagcuuaccuucuuauccucugcccauuuggaaaaaccugcauuugccuucuuccccuuagacauuuuuauuuguuaggcuuuucauuggcauaugcaaauaaaugucauuaaagagguuugaugauauagugcaauauuauguguuguauuuaugaauauucuauaaaugucuuaagucagacuuucuucuaaaguugaaguaaauaauauuucuuauccagaaaccaaggugugcauuauaguauacauuucagaucucacuuuaggaagccaugcuuuaaacaguaaaacagaaugagcacuuugaugaauaaaauauuuuagcaucuggacaucuuuuuauuuagguugacgaggcacuuggaguccauugccaucucuucaaagagacaugugacauucuuuaaaugcaggccaauucauacaaagacauguaaaugcuaaauuaaaagaugugggugaguagaacuacauuuuaaaugcagucaggaaauguucucugaaugcagucagaggucuugcuauugaaagaagcgaugggaugaaguuuuauauaaaguaaaaaacuaauggcuccauuuaacuuuguuaacauuuugaauuuuauaccccacacuuauuuuugcagaaguuggcaugccucuauaguuguccucaauugcuuugccauuuguaauauuuuuuucccuacccagcuguuuuacauacacaguauaaauuccccaaaggcugaaugaucuccaaacguguucuucaaaauauuuugcaaagucugaagacaggaaaaguaaguguaaaacaucuaagagauuuguuggaaucucagcuugaauucuaauugcgaguacuuaugaaaaugucaauauuaacaugaaauagcuggcaguuuuucuaauaaauguaaauugaauuagauaguguguaauuggaaaaauacuugcuucacucaggcuucucaaaacaagacucaggauuuguuagcugcggcagccuugcccucuaauggcuggaaguugaaggacaggacuaaaauacuuuugacuauaaggaggauggaaacuaagaagagggaaugucugaccauuugucaccauauugagggcuucuucccaaagcauggggcaugaugucgauguuagcaugagcuuauuauuaaaaggagguggguagguggggagccaaggccaugcuaaguaucuuggagcuucagaauaagcuuggauagaaacagguauuauagaugccuaaucuccugaaaugcaguugaaaguucaaacuugccuuauaauauuaaaaaaaaaaauacccgaacaaguuauacaauaaauaaucuagccuggacauugugauggucugguuuauagucauugagauuugcuaagcacauguaacaaacaacguuuguucccuuuucugauugaccaaugaguguuucagacagaguagaaaugauaccaguagaagugguuuggcagaaauuucauaagaaguuugauuucaucccauguucuuucugggaaagcagccaggaauaaauggaacagguggggucuuaacuggcuacaaaaucacacagccucuagaacaaaccgcuuuuucucugauccuaaacccaugcagauauucacaguugaaugaaagaauuuuaaccaaagcuuacucaauuucaugacaagcaaagcuuuuaaaacaccgaucugcaagaagccccagccgccuaauggguaaggcauuggcuccuaaaaaauggcucugcauuucauauuacaaaguaaaaacacaauggaauuguaucaacauucagcuaaaaguuugcauaugcaucucccuuugcauuagaggugaaauaacacugguuugacuuuuauaguaagacugcugucccguuacccucugcagagcauuauucacucacuuccggguuuuguaauuaaccacuuggauaagacuuguagaaagagucagcagauguauaagacaaaguuaucaaguucaacaacuaaaaaggaaacuuugaugauaaaugucagguauaaucgauggcauucuaugucuuaucacuauuaauaaaaacccugugagauuaagacaaggguccuaaaccaaggcaauaaaauuagccgagaccagucuugaugaccgcucaucuuuauuucucuugguaacuauuacucagguauuucuuuuuuacauucucauacauugcuuuuuaaacccuucaaauuauuucaugucuguaagucuuauguuuugaacuaaaauguaacuugauaauagaauaucaucuugucucucaguaccugucacagcucccuguuaaacacccaauaacagaugcgaggauguguggagcuccaacgauguuugccucuuuucccuacuugcacgugcaauuucaacauauucugaacaccuguaaugugccagauacugucaaccugucuccaguucaucuucuuccaauccaugaucaaaguguccaguguguaucugacuuugucauugucuugcuuaaaacacuccuaugucuuucugaucuuuaaauguaauauuagcuaucaucauuauaauaauaauauuauuauuugaucaaagagccucacaacugcaugugaauuuacaguuaucucaauaaaauuucaguuagaaaaaaagcaucaugcaccaauagagaaaagauagguuuaugaauaaauaguguaggaaaaauuagaccguuaaggaacccaacauacaucaaauaaauucagauggauuaaaaagguaaaaugugagaaaucagaaggauguguaucugagccacggaggcugugaguugucuauccuguggaaggagacaugacugagcuagaggauggcaaagcauauaggcaauggaagaaaucacaaaagaaaugaauuuuagauuugucuuuagauaauuuaacaguuuauuucacaaaaaggcauuauaggcaacauuaacaggcaaaucgaauggagacaauauuuacaaauaugacaaagaauuuauucuuaaagauauuaagauauaagaagucuuauaaaucaguaaaaaaaagacuaauuccccauugaaaaauuacaaguaaaauuccggauaaucuaaaaaaugcucagccucaucuauaauuuuugaacugcaaauuaaagcaauaugucacuuuuaagguauuaaacuggcagagacuucagaaauuauaaguagugguaugcucauaaauguuuaauaaccaccucuggcgggggugggggguuguuuuguaacuuugccaauuucuguggugucaauacuucucaccauggugauuucaaacuacgaacaugacaucacugaauacagcagaguuaagagaugggcauuugccucuuauaagcuguuacuaucuggcuccagcacauuuccaauucauacucugcugucaaggguacaucagaauggacauguccauguauuucugguaucaggauuccgggagcgugguccaucuugugcaucauucaauuccuccgcccuucaccugcacaccaugucaucauacguuuuuaucuuugccaggcugagagaugagaaauuaugugucaguaggauaaguugcauuucucucguuaugagugaaguugagcaucuucucacauguuuaagaggcauuuguauuuuccuuucucaucuuaucauugcccauuuugcuaacauucugaucucuagaaacuuuucagaaaauuacagaaauuugcccacuauuuuugauauaaauugcaaguauuguuuuccuaguuaguaaucucuuuuaacuuucuuugugauguuuuuuacaugcagaauuuuauuucuuuguggucaaauuuaucaaccuuuuucuuuuuauggcuucugaguuuuguguuauacucagaaggaucuuauuaacucugaaacuauaaaaaauauucuccauggugucuucuagaguuuuguuguuauucauguuaaauuaaaaucuuuaauacuucugaaauuuauucuggugucagguauaacauaucaauguaguuucuuuuuuuuccagauggcuaacaaacuaucccauuuauacaauaauuuguguuuuccucauuaaaguaucaccuuuauuauaugagaaauucuugguuuuagagggaucuguuuuuucuuuuggcuuuuauuuuguuccauuaauguguaucuuuauauacagaacacuauucuauauauuuauauauauacacacuguuguaaccuauuguauaauuacauaauacauaguuuuauuauguaauaugcaauaguauaauuauauaauauagagugacuauuuauauauacauuuuauuaucuggcaggguccagucuuuccucuuuacucagcuuuuuccccaauuguccuaggucuuugucuuuguucauuuuuccuuaggaacuuuaaaaucagcuuguucagggucgggcgugguggcucacgccuguaaucccggcacuuugggaggccagggcgggcggaucaugaggucaggagaucgagcccauccuggcuaacauggugaaaccccgucucuacuaaagauacaaaaaaauuagccggacgagguggcgggugccaguagucccagcuacucgggaggcugaggcaggagaauggugugaacucgggagguggagcuugcagugagccaagaucgcgccacuguacuccagccuggaugacagagugagaaucugucucaaaaaaaaaaaaaaaaaaaagaaaagaaaaucagcuuguucagccguccgcuacccccaccccacauucauacccagaauacccuguguguuggguuuacuuugagcuuuagauuaagguagggaggauugacgucuguauguggagucuuauuauuugagaauguauuuugccuuuccauuugcucagaacuucuguuauaucucuccagaguuuuaaaguuuucuucauuuagaucuugcacauuucuuaaguugauuucuagauauuugguuuguuguuguuguaauuuuacauauuauuacuguuacuaauuucuauauauuaccuuuaacucagucaccuuaguaagugaauucuauguuugucaagaaauuuucacagauuauuuucaguuuaccagauaaaauuauauccccaggugauaauuuuaucuuucuuuuuucuaguuuuuauaacucuuauccauuuguuuuuguuguaucucuagaacaguguuaaauauaauguugauaaaaaugacccagcaaucccauuacuggguauauacccaaaggauuauacaucacauacauuuuauaguauauagucuuuacauaggcuguaaagacacaugcacauguguguuuauugcagcauuguuuauaauagcaaagacuuggaacuaacccaaaugcccaucagugacagacuagauaaagaaaauguggcacauauauaccguggaauacuaugcagccauaaaaaagaaugaguucauguccuuugcagggacauggaugaagcuggaaaccaucauccucagcaaacuaacacaagaacagaaaaccaaacaccgcauguucucacucauaagugggaguugaacaaugagaacacauggacacagggaggggaacaucacacaccggggccugucagggguuggggggaaaggggagggagagcauuaggacaaauaccuaauacaugcggggcuuaaaaccuagaugacagguugauaguugcagcaaaccaccaugggacguguauaccuguguaacaaaccugcacguucagcauauguauuccagaacuuaagguaaaaauuuuuuuaaaaaaaaauugguuucucauagaagucagauaauugaaguaaaaguuaaauugcuaauugccaaauuucgcucauuucuacuuuuauucuacuagaguaugaugucuaggauccagauccuuugggauuucaucucagggagaauauaagcagcaucagucucaacaacuaguaauagaaaaaccuaaggaaaaagacaaagauuaucauauuaacaccccucggccccgcaugcaccuguaaccuacguguccuuuuugauaacccaccacuuccagaguggcuucauugucaaccaccugugucaccagaguaaauucaaguguguccuuucuugagguuucuggacuggauguugucuuguguccuuucccaugggugugguuucccuggcagucaguuccucagugaccacauuuaacaaauuguaauaaaugcagacuagaaccauaauucacaguuuugcaauacaaaggaaagaugaaaaacaacuggaggcuuaaaguccugugagauacccauuuuaccuugcuuuaauuacggcagcagauguaaauuugauuugccccaagccuagguggucuuuggcuagggcucauucaccucugacacagagaccccacaucucccugacuucuguugaagaaguacugggaaggucuuugaauggacccugagcacacuugacauuggaaaagggagaaaucuuugacuaagacccuguacuuugagcaguuuucaguccauccauucagcuacaaauguggaagcaaauaugccaagguccuugaaaagaauguugaugcuugauugcacgauguuucccuuuaaaguuuuggccuugagaacuucaaagugaugacacuguucuuccugccaugcccgcucuuagcucuguguggucaguaagcagcgacucuuauuuuucuuuuauuuuuggaaacuaaguuggagugagggcauaaacccccucacuugaauuguuuuggcuuaagauguaucugagauuuuaacuuuguuauuuccagcugcuucccucauuaaauuuaggucauuaauuucauaaaucagcauaugccuuuuacuuuuaugugcaaagcccagguguuaaagcucgaguaacucuuuguuuggaaugguggguuucguaucuggcccaucccaaaugggcuuauugugccucacaauauuucuuuccuucccuaaguccuuugguccuucaucuuuaucaaggacucacagucucucuuggguauccgauaagaguuuguacggucaguuucguacaucuugccuaaucuauuuuuguccaauaugauugcuuguuacuuaaaacuuuggaauaaccuacauauaucaccuauauaccaugcuccugauuuuuuaaaaagaguuauuuccuuaaucuagucaguccaaucagcagugaaauucuuuuuauuuuuuucuuagaaugucucucagauguccccaucuucucuccacggcugcugccaacaccacagucuuuaacuuuuuucaacucucccauaccuccuaacugcucuccucaaauuccagacauucucccucucuuucagcuuuugcauagugcugccagauuagccucccaaagcagcacuucacaucauaucguuuaauuucuugcuuaagaagcuuggugacuuuugcccacuguggugaauucuacaggccuuucucugucuuucaaggcucuuaacaaucuggaccuauccugccagcccugacauauugcuuucccaaauaaacgcuaauccaaccaagcuucugacaucaucuuucagaaaaagcucauccucaucucuauucuuguccuuaugcugauaaccuaaguugaaaggccuuuuuugucuuuuucuucuuuuuuugagacaggaucuuccucuguugccuagguuggagugcagugguugggaucucagcucgcugcagccucuaccucccagguucaaaccauccuccucccucagucucccaaguagcugggacuacaggcacaagccaccacgccugacuaauuuuuguaauuuuuuuuuuguagaaaugaggucucacuguguuacccaggcuggucucaaacuccuaagcucaagugauccucccaccuaggccucccaaagugcugggauuaaaggcaugagucaccacaccuggccggaaagaccaccuuugucuuuuuucucuccaccuccuauccaucguucaaauucucaucugcagucucucaugaucccagccuuugagauguucucccuuuucuagaauuccaguugcccaugugcuuuacaccauuucuuuuuccugaagucacacuauauuccagguacuguuuagcacuagaauccucaacuuaauccucacaaugaucuuaugaaaaggugugacugugaucuuauuuuagaguugagaauccugaugcucagagagguuaaguaacuugccuacagugaagccgccuccauuaagugauaaaaccaggaugcucacccaggcagacaggcuucagaaaccuuguucuuaaccacuaugccaaacugcuucuuuuuguccuaugugacacugucauugauuccuuaguccuucccagccugacugucagcuccugaagggcaggugccaucuucacugcuuuauuuacaucccauugccuccguggagcuuauugcauaggaaggucuuagaauuugcugcauguggguagggaacuuuccugucuuuuucaccuguacuucuucagcaccuaaacacacacacagggucugacacauaauaagagcucaaaaauuauuagcucaguaaaugacuaagugcauacauauuugauuuauucacaguuugaaaaauauaugaucacaucagugcauccuuugcauauuuuucauucauauaaaugugcauaucuguauuuccugugcaagcaucuccggugccucugggucacugcuguugauuaagcuggacacgucuuucuaggccauaaaauggaugugucuuuaucuguuugugcugcuguaacaaaauaccugacacuggguaauuuauaaagaaaagaaauuucuuucucacaguucuggagacugcuaaguccaagaucaaagugccagcagguucaguugucuggugagggcuucugucugcuucuaagaugguucuucuggaggagaagcaugcuaugucuucacacugaaaaaggcagaagggcaagcgagugaacucccuccaucaagccuuuuuuguuuuuuuuuuuugagauggagucuuacacugucacccaggcuagaaugccauggugcaauuuuggcucacugcaaccucugcauccuggguucaagugauucuccugccucagcccuccaaguagguggggcuacaggcgugcaccaccacaccuggcuaauuuuuuuauuuuuaguagagucgggguugcuccauguuggccaggcuggucucgaacacuugaccucaaaugauccgcccaacucggccucccaaagugcugggauuacuggcaugaaccacugcacccaaccugucaagcccuuuuguaaggccaccuagucccauucacaagggaagagaucccauggcccuucaccucuuaaaggcccaccuccuaauacuaugacauuggcaacaccugaguucuggagugaccacauugaaaccauaguaggaugcuuuguauccucagcaaaguuaauuguugcuuguucaaucuuacaguuucuacccagggcacagagggucucagaguacaucacuccauuauagcugaugaaauuaagcuacaccaguuuacucaaacuaauacguuauuaucaaaaagaagcacuucuguuaugcuuagcagccuuaacagugcuuuuaaacuugagguuuaugagcacuugcuuuuagauacuaaucauuacagguaaguaaaauguugucauuaguccaacaaaucuucagaauuuaauuuucaaaaagguuuccuuuuccugggaaagcucuucuaaacuggggcaagauauuauuuguuucauucccuguaccuaaaacuacuugggccucccuuuuuaauccaguauugauuuaaauguuuuugauaaaagacaccucauuuaauucucucuaaaugugauuagagaaagucagguuucugcagagcacagucuguauuuaauuuauuugcaaagccauauugagcacugagaauuuuaagauucagucaaaauaaauaauuuuacauuacggcaucaguuaacaccaaguuuucaaagggcuuuucgcuuuaaaaaacucaaaacaccucauuaagucaaccgucuuccaagaaugugcuauucaccaagauagccuuauuagucccuuuuugcaagugacaaagcuguggcaagaaacaauuaaacaucuuaccagcggcucuuggaauggagucuuacuggguaggcccuugaccugugagccuaccgucauuggcacaguagaauaggaggcuaggaacaaggcaggaaugaaaacaaucagaagcaagaagccaaauggaagaacaggauucgucaucaaggucuuuuaacaugggaucccauggaguugauaaaaggaaaaaaaaaucauaccucaauuagucauaauauuucaaggcagaaaagaaacauagagguuaucucaucucagccagucauuugaguuguuacggcuggagcaggaggguuggaaaugucacacagaguuaacuccugcuaucaugcugccagcaaaggcugagcccuaugggguguuuaccaggaaaagcgaauguaggaaauaaaaugucaagaagaaauuugugaaguacaagaaugucugaaaagagcguauguuaaguucugaaacaaaaugauaaaacucagaagugacagcuguuaccuaaacuuuuccaauguguuguucaccaaucuacuucugaagacagccuagugcaaccucauuccuuguccagaaaaggaggacguagucuucaaggugaccaaaucaccauaggagacccuaucaccaccacccccacaucacacaguguacacaugcauguguacaaacacacgauaacaucgaugccaguggcugaaauuugacuuguucuuuuuuuaaaaaauuaaacuguucuuccuggguuuuuuccuuuaacuauaaauaaacccggugggucuggcauuuuguuaccaacaucuuuucaggaaccuacccaucugcaacugauuauuauauacaucaugugcauaaauguuuagacuacuuauauucagauauggucaauuccuucauucuuccuuucaacaaaugcacagcaccuacucuguagccagcccuuuagcagauguugagaaugcacuaaugaaaaacacagaugugguucuagcccucccagaguauauaaucuaucagggaaaacagacauuaaacaaguauugggagagaugaucaggcugugggaacaauacgugcauaggucaagggucccaaguacugcaagaaucucauauggaugagaacaggggugugauaugaaagcuggagaggugggcaauagaucaaucaucaaagcccuuaaaaagauauucuaaauauuugaagcuuuaugcuaaagacaauaaaaaguccuagacaucaugacaugauaggauuugcauuuauuuauuuauuuuuaauuaauuuguuuuuuagagacgggaucucacucugucuugcaggcuggagugcaguggcacaaucauagcucacugcagccucaaaccccugggcucaagcaauccucccaccucagccugccaaguagcucgggcuauaggugugcacuacccuagcgaauggggccuugcuguguuucccaggcugguccugacuccuggccuugagccaucuuucugccuuggccucccagagugcugggauuacaggcaugagccacugcacucagccaagauuuucauuuagaaaaucuugcaaggggaggauguuuggaguagagcaaaauaaacuauuuugguuugaaauaggauugucaugguacaugagaccaagaggaauggauaaagacaugucuauguaauaagaucaacaauuguuucaugaguaauuggcuauggagcuaaaggaugaagaggcguucaggaugauucuagguuucuaguuggaguaagcugaugcaagguacugcugaggguagggaauaacgggacggaugugcaggaaaaauaaauucugcuuuggauaugcugaguuucaggugcuugcaguacauaugaauggagacacccagcaggcagaaaagugggcugugcugaauauguggaauuggaaguuaucaguauccaaagagaggguaaucaaucuacuaaaauauucugugaagguugagaucaugucuggaacaauguuggugcucaguaauuaucugcugaaguuguugaauuagagccauggggugcguaucagggaugaggauaaaagagcccagagucacccauuuuuuagcaccaacugaggacuuugaagcaaaacaacaacaacaacaacaacaaaaacugaacaagagucccaggaagaguacaauauagaggugugguggugucagagaaucagaggaaaaaaguucugagagguucaugacugucagaagcuucaaggaagaauaucuaaaaugagaauagaaaacguaaccauuagauuucuacuaaucuuggcaagagcaguuuccauuuagugacaaggguagaagcaagauggauaugcagauggggcaagaaagauguggaaaaaaugaagauagugguggggaagucuggucugcauuggccuggugaggcaugcagagguaugcgugggauugucacguucucuuucaggaucacuuaccaaaggaagagguagguccucagaaccuaaagcgcaaggagauuccacauuacucuucucuuaaaaaacaaauacuauugagcacauaccauauacacaaccuaaagggcuucuucaagaugcagauaccaagaugagauuggaugugcaagagauuuauugggggaaaugccugugaagggaaaaggaggcaggaagagccaucaaacccauaguagaucugauuccuauaaagaacaggggaaggacuauuggguaaggagagccucagaacacaguguaguuuuaagaaaguuucagucaggccaaggggaaguugucagccaaagucauucaucagaggaguccuguguguugcaggaaugggccugccuuagacaacuugucacacuagucacugccugauauuagccuacgggaagcaugcccuuggcacaaaugaggugauaaaaucgaacaaagcagcugggaccauugguuacuuacucuuccagcaaugggagagauucauggcugccacauauguaauaucucauuuaauucuuacagcaucccccuaagauugguauuauuauaccuguuuugcagaugagaugccaaggauuacagagguuaaguaacuugccucaguucauaccacuaguaaguaauagagccuggauuucagcuagugguauguuagagcuggcucagacuaaucgagucaauuuuuuauuuuuaggaauugcgcuagucaguugacacaaagacaguagcuugaaaauuuggccauauaggaguauuuacagcauggaaaucugcauaugcuacacaucaguccuuuguuuguuugcuuguuucugaaaagaugguuguuaggcauuugccgguacaccacugauuugaagccaggucaucugaugcuacagcugacucuccaaccucuaugcuacagacaauuggcuucaugauucccugacacauuucugaugcaaaaaauuccugaaaccacccuccuccucggaaucccuguggagagcuugccaugcccuguauuuugcuuuucccugaauugccgucaucaucauuuuuaugucucccuaccuggauagaaaguuccucaaggacagagagugcaaucacuuuaugcucccugucuuugcaguguccugcacaccacacugcucaguaacuauucacuguugaaggugaugcugauugauauacaucaucacccuacuggugauuaaggauugguaacaucuacaaaauaauacaaaagauugugcuucauacagauguaucuuucugaaucuuacauuuuauaauggcagacacuauuggaaaaauguguuuuaaccucaagaugaccauuuaagagaacugugacauccauuacagcccagggaucugguugaugugcuuccugcccacucccacccacaaaccaggagauacauuaauuacuugccucccuggccacucucaguuuauugggaaauuguuuauccucccagcuugucuagaaaauaaaauaugcaugcugcuuggaagcagggagguaugcagaagcuuccagaucuccagacucuucucucacugcgucuuggggccugagagcuuagcucugcaaagaacaacccaggaagggucaggauggacagggcacugcagucucugcaccaaguggugugcccuacauggcccugagacuucagaagacucgggucuuaggcucacugcagacuguguaacgugaauaacaaaaaaaaaauuucuacugcacaugaguaagcugcagaagacuuugugccuugaagcuuccuuccagaugaaaaagcgggucucucaugaaaagaacgcuugccuucaagaaaagcucuuuaaaaucuuuugacauggcaaaagaaucuguaacuugccacuuguacaucacuuccaaaaauguuucuuccuucuuaauuuauuuuaaaaauuuuguuucaggacccaccgugugacaggcacauuuuccaccauuugggaaacaucauugaauagaaugagaauuccuacugccaugacacuaacacugcagugacauccguagcgccaaaacucuugaucuucuucaucaugugcuuucauucaucagacguguauucguucagccaaacagacaugagcaucuacuuuaugccaagcucaguggugagggcuacagcuucaaaaacagaauauggacuaugcucucgaggaauugucuaaggagagaggcacacacagcuaggguucuaacaucagagcuuuaucuaggagcaccaccagagguguggggagcucgugucugugaggcuuccuggaggagguguuaccucaguugagucuugcaggaugaguacaagguccaagcagagaggguguaauuugaaauagcuugauacagaggaggaacuaaaggcagugaagggugcugggguauaaaguuugaggcaggagguagcaagaacugaaacuugacauugaacaguuaggcagagccugcaucaugcaucaauuaccugguuuacucccuuuauucaaaaaacaggcugggugcgguggcucaugccuguaaguccagcacuuugggaggucaaagcgggugaaucacuugaggccaggaguuugagaccagccuggcuaacaugacgaaacccugacucuacuaaaaauacaaaagguagcccagcaugguggcgugugccuguagucccagcuacucaggaggcugaggcacaagaauugcuugaacuugggagguggagguugcaguuagccaagaucacauuacuggacuccagccugggugacagagaaagacccugucucaaaaaaaaaaaaaaaaaaaagcaaaaaacaacaauagcaacaccuauaaccacaauuaacuuucuuucuuguguucuccgaaagauuggcaggaaggcagaugaggauguuucccuggucucuaaucugaagcuguagauuccuacaacauguaauacugucccacccuccccaccucuucccaaccaaaugccaauccacuccgcuucaucauuuccaaguccacccuucaaaguagacuucgccuauucccaaggaugcaguuccaucucuccuucuccuccuuguccucugcuccuguuaauucacugauccacugggcagaaacuccaagucugucacucucucccacccuuauuccaaugcuccugugccaacaaggagugacccaagcagugagcuuuacagccagcaccugcuccuucuggaauggcccuucucagaaaugcaggaaccucagcaguccuuccucagccaauaagaaugagauaauagagguucaaaggcuuugaaaacacaagaggcacauaauucaguguuuuuguuauuaucauuugaggccucuagacuucugaagaagcuacuucuggucugugagaacuucaugaagguggaauuacuugacuucaguaaaggcccccccccaccccccgcaaaugaaaaccuugauuaaaaaguuuaaaaauucaaaaggaauggugaagauagggaaggacugagaaugaauuauuaagagguuggaaauuucagagccuuccuuuuugaagaagcuggcugaguuccaaaagaaauccaaguccugaauuucuauuacuucuaacaaacugcauuagcauguuaccaacacuuauaaacugacuuaaaagaagacuagggcauuaaauuaaaaaguaagccaugagacuauuaccaaaauaaaaggaaagcaagagggauuugccuuuguccuuguucagagaaacugaaaacaaacuuggauugcauuaacagaaguaucuguucuaccaacugcaaaagugccaaaggagaucauauagguccccaacucugucaugaguccuuccaggugaacagagaccuuguuaaauuaaggcaaucacauucagccucccaagaagggagccuauaaaacugagaagccaaagcuaauccaguccuuucccauucuaauuaaagaggcugaagggcuugucucaccuaacacugucucaucuucaugccacuuccucaaauaaaggagucagugagaaguuaccaauucacaugguaaauaacaaacucuccugaguuuuuuggauaaucaaaugaguuuuccuuuguucauuccaucccuccccauuuggaauuuagauggaagaaugucuaagucgaugaaaauccaacuaaagaaacauuggccucuuuguggaggaaucucacauuuaaguacaaaaaaaauuaagcguuuaggggaagaaaguucaaagacuuuugcuuccuuuguucuuuuaaauauuuuauuuggaguucggcauuacagucaggacaaccuacaguaagaaaaccaggcuuucguauaaaaguuacugaaaggugcuauacaccaacauacuuuuauaucuaccauauuuuuauauucuuuauaucuuucauuuuaaaauauuuauuugguguggcagguuuaugguagcuuuuuaucguccucuuuuugcuuggccauauuuuauauaauaaacaggaacugguuuuauaauagaaguauuugaagacaaagaauaagauuugaugccaugagaucuuucuuucuuuuaaauccaaauaguuaagcagaucaaccuaugaagagcgagaagccaaaggagauguuucaugauaagguaacuagaugguauuuuuccauuagcugcuugaccucuuuaacgugacaccaguguguuuuccuggauaaaauuacaaucccagauauucagacguucagauucauauuuuccaucuuagcccacgaaagcuuuacuuuggggauuuugcagaaaauucuggcuuguguuucagucauuugccuuuucucuguggaagccagcaggaaacaguagcagauccugacaauccccagacgucccagggaaagugcaaagaggcucggcauuaauugauuaagagguucuuucaaagcgcaacuucucucuaaaacuacucacuuuaaaucaugagacuagcugcaaacugcaauauuuauaagagacauaaauauugaagaacacagugacacucuccuaggagcaggaacuagaaguggaaagagcaguguuccacguagacucaguaagacuuggaagcugaucguaucuauucauucacucaagaaaauauuggcuaagcgucuccugugggcuggcacucuccuaagcccuggaacaggagugaacaagggagacaaagccccaccugucauggagcugacauccuagugaggugaggcagguaguaaacagacagauaauuaauauauaucagguggugaccgaaagcuaagaaaaauaagaggacaaugaguaacugcggaugcuauuuaugucaagaaucaaaaguuuguucugaggcagguguucucuauaugggguccacagauccccacaaaaaguucauggguaaauuacagaggaucucugaaugauaguggcaaaaaauacaucauaguuuuaccaacuuaaaguuugcaaauguucguuuuugaauguaggcaacaaacaguggcaauauuaacaguaccugucaugccaccaauagaacucauaaauuuuuuuuaauuuuuauuuuuauuauuauacuuuaaguucuaggguacaugugcacaaugugcagguuuguuacauauguauacaugugccauguuggugugcugcacccguuaacucaucauuuacauuagguauaucuccuaaugcuaucccuccccccuccccccaccccacgacaggccccggugugugauguuccccacccuguguccaaguguucucauuguucaauucccaccuauagaauucauagauauuuuauaucaacuguuacuggagaugucucaaucauucauacuaacauaauucuuggaucaaugucaugguagauauuagacccauugagaaaucuugucauucaauacauugaacaagcauauauguuacuuaucacaacuuuguaguauuuugauaaauaauucaauggauuaggucuccuuuauaauccuguuuauuauauacauuuaagcauauugcccugaaaagugaauccuuagacuacaucaaacugcuaggaggucaguagcagaagugcuuuaugcaaacuucccauacuucuucacacaauauuaaaaauaugaguacucagggguugacguuuagaacaauaaauaauuuuuacugcuccaucaagaacauccuuaagauaaacugguguuuuuauugucguaaguaugguggugaagaauaccaugaccuguggaacaguuugguccaccgucugcauucuugugaaugagccaccuguuuaugaucauagccuugcuccauccacacaaaugucaacaccaucaacaggcaaagaacaccuuaggauucuuaugaaaaccaguugguucuuguggaccccuuaaagaguuuuagagucccgaggccgaucgcgguggcucacgccuguaaucccagcacuuugagaggccgaggcgggcagaucacgaggucaggagaucgagaccauccuggccaacacggugaaaccccgucucuacuaaaaauacaaaaaaaauuagccgggcguugaggcaggagaauggggugaacccgaggggcggagcuugcagugagccgagaucgcgccacugcacuccagccugggcgagagagugagauuacgucucaaaacaaaaaacaaaaaacaaaaacaguuuuagaguccugccgggggucuguggaccucacuuugagaaccacugugcuagauuaaauggcaaauacagauuccuuuaagcauuuggaccacccagaggacucuauuugcaugaaaacuugguugugguuguaguuuugcuguccaacucucugaaauugaaguuuuaaccaagcguuuaagguagaauuuuaaaaaucucaguagaaaauaaucuucuguugacuuuucuucauggccccagagaccuagcaugagaauacaggucaggaaauacauuuuacagcaggagcauauggauggccccugcucaaggaaagaaauaaccaauacuugagggaaucuuaaccucuuuugugucaugaaccucuuuagcagucuagugaagucuacagaccucuucucagaauguuuuuaaaugcauaucauaaaauacuuaggauuacaaagaaaacaaauuauacugaaauacauuucuauccacagaccccuuugggcggcucagcauucaaggcuaauaaccacuugcuuccuucaaucccaacuggcaaggaggagcaccaaaggaggugacauuuguuucuuagugcauuuguuucuaggucaguuaacaucuuaaaugcccaaauucugaaugucaguaaguucgauuucuacaucuaaacaaggccagggcaagaaaguggaauaagaagaaugaguuucuccugagccuuccaucagaccuaguggcacaggucaucagcuaaauacacaaucuuccuaaaggagggugacccugggcugggggccaggaagaucuugggcaccaucugcauaauagucuaguaccguugagaauucuccagugggaguuuccaaaaguuugguuacucuuuuugaaaaaaaaaaauuguuuuauauugaaacuuuauuuuucucuguuuuuuaaaccaaacuagcauccuuagacuuauuauacuuggagaaacugucuagaacuuagugcuaaaaguuaaggauaaaagaauuuagagacuugugugacuuacuaaaggauaaaaccaauaacaagcugauacuguuuguauauuuguccccacccaaaucucauuuugaauuguaauccccaguauuggagguggggccuggugggaagugaucagaucauugacgcaaauuuuucaugaaugguuuagcagcgacuccuuggugcugaccucaugauagugagugaguucucaggagaucuggccauuuaaaaguguguggccccuccuccccugagccucacuugcuccugcuuuugccaugugauguggcugcucccacuucaccuucugccaugauuggaagcuugcugaggccucccuagaagcugagcagaugccagcaccaugcuuccugcacagccugcagaucacugggucaguuaaaccucuuuuccuuauaaauuacccagucuugaauauuucuuuccuuuuuuuuuuuuuuuuuuuuuuuuuuuuguugagacagaaucucacucugucacccaggcuggaaugcaguggcaugaucuuggcucacugcaaccucugccucccaaguucaagcgauucuugugccucagccucccaacaaccugggacuacaggcaugcaccagcacgcuggcuaauuuuuuuuguauuuuugguagagacaagguuuugccauguuggccaagcugaucucgaacuucuggccucaagugauccacuugccucagccucccaaaaugcugggauuacaggugugagccacugugccuggccucagauauuuauagcaaugcaagagugggcuaguaaacaaccccauaguaaaaguuucuacauucuugguggaaugguuauaaauuaaugaaaaacaauuuauucacuuuaauaggagaaaauguugguucugauaguggaaaacugcugauaauccaaagagccucucuguuuaaucuuagaauuaaugaaaguauucuagcaucauggucuccucugauuguguuuuuugggggacuaauauugaagugaguucuuauucucugauucaaggguaaggaggucaguuggucacuugaaacuauuccaagacugggaagacaaccugugauuuuaaauuugccacaaauaauccaccaggcggauauucaccucuucgcuagucaagaguuucacuguggucuuuacaguccuacuuuguuuccucauaaaggaaagcacacucucuaagaccccacagcuuuucuuucugucccccccaccaggcucuuuuccuuuuucccguuuuccuugcccugcucacugcaguuucucuuucagggccaagaugaauccucaaguccuugcauuuccaggaccacuucauccaauguugcugaacccuucauagcccuuaaucuauagauucaaaacucaaagugccuguucaccccuuaccucugcagaaugcuaucuuguagucuguaaagcauuuucacauauuuuuucuuuaauccccauagccauccuguaaaagaauuuguccuauccuuaucuugugugugugugugugagacagagucucacucugucgcacaagcuggagugcaguggggcgaucucggcucacugcaaccuccgccucccggguucaagcuauucucguaccucagcuucccaaguagcuggaauuauaggcacgcaccaccacacuuggcuaauuuuuguauuuuuagcagaguugggguuuugccauuggccaggcuggucucgaacuccuggccucaagugauccgcccgccucggccucccaaagugcugggauuccaggcaugagccgcugcgcccagccucgguccuguucuuauuuuagagguaagaaaccugaugcucaaaaagauggagugcuucacccauugugacucagcagcuagcacagaagcaagacccaaacccagaucaucugauggcuaagccaggguuuucuucucuauuucacagauaucuucuguguucuagucgcauuacaaacucuacuuguuccuuaucuacuagcauuauucuugccagaaacauaguacagcagguuauaaaaucuuauuuugaaguggcuaugacuaaagacaguggggcauaaaccaguuaccugugggucacaugugacuugccgacguguuuuguuucauauauggguuuuguuguuguuuguaguaccaacauuuaagaauugagagaucucacacaaagauccaaauucaaauuucuagcuucucuugacaggugagaauauugggcaacccugggacaaauuuuguguggcagagacuggcuggagcugaacagcaucugcccccuggagacagggcgugugcauuccuaguuugcccugcguuucuccaccccucaguaucugcaggcacagggcccuauucaugcauucacaugaccuggcaggcaccugugggcauugguaauugcugucccagcucuggagccuguauucagcagggggugggggcagaguggggacagacugcacacaacacggugcccagcagauguugggaacccaguaagagcagcguugaaggaugcuacauucacugaguguuauaccuugaguguugaaagugcugagaucgccauagagaauugauucuuccacucucuggcuuugaaaacuguucaugauaagaaagaggaagagaaagagccccuccuaaauauuauauguuuaaucagguuuguuaugguuaucguuguuucugagacaggaucucacucugucaccaggcuggagugcaguggcaugaucuuggcucacugcagccucugccucccagguucaagugauucuccucccucagccucccaaguagcugggacuacaggcacuugccaccaugcccagcuaauuuuuguauuuuuaguaaagaugggguuuugccauguuggccaagcuggucuugaacuccugaccucaggugaucugccugccccggcuucccaaagugcugggauuacaggcacaagccaccacaccugcccuguuuaaucaguuuuucaccaggaagacugcuuuuccuccuacagacucuuucucuugugugucuaaaugauaaauauaguucuacauuuacccuguggaauugaucucuucaucaucagaguaauuaacauauuuuaacuugaguguauauuugcuuuucuuuggcuuugguucucaacuugaggaaagauagaucugggaaauucuguuuuaguaguucuucauuucaguacuuauguguguagaaguuauucuagugacuugaauuuuuuguguguuuauacagccuuggucugauucauggguaguuaaccuaaaaaggggagggaauaucaauaagagaaaggaaagaguaauaagagaaaaaaaugcuauuauaacacagccuuuauuuuuuauguuuuuaauuagaauuuuuauuuuagauucagguuguauauguggagguuuguugcaaggguguauugcauguguuugagcuucuguugaucuuggcaccagauaaugaacauaguacccaguaggaaggcuugcagccuuugcugucucccucccugcuuuuggaguccccgugucuguucucaucuucagaggauaugaacugggguuuauguugguucacuaaauguauauauccuaagauguaccugcauauaauaaaaauagggaacauucuauaagaaagcugugagagaaaucucaaauaccagcauaauaaaggggcuugauuucguagcuuuuuuucuuggauuccauguagucauguuuuauuuuagaagagaaagaauccaggaagcaggaccaaugaaagggucagaaaugagaucucuaagcaaacuuaggauggaaaauuauaaaggucugaggauucauaaagaaccugacccacugaaaacacaguccaagaagcuuuagagugagacagauggaaaaugaaugagugaaugaauggaugaaugaaaaaaugaauuagaaaaagggaaaaugaaggcaggaaaaaauugagcuuccuuacagaauguucucuaauauuuuuauuauaugcagguacaucuuaggauauauacauuuagugaaccaacauaaaccccaguucauauccucugaagaugagaacagacacuggggaacacacuauacuaauagucauuuauuuuuucugggauuuuuuuguuugcuuuuuauaacauuauggaaaauuuuaaauacucacaaaagagaauaguccagugaagcuccauuucacagacaauucuuagucacucaugauacuaggaucuugagaaaccgaaguucccuguuaauuuaaaauaauuauuuuauuuagguucagcaucucuuuauugaacuuauuacgaguccuuaaugaccuucuaagucaggaucauggagcacagaaaggagaagcugugggcuggccuaaaaaauaauccacaaacaugcuguuuauacccuggauaaccagagguugaaagugugacuuuugugguuuguuuugcguucuuaagccaaaacuauuagacuauugcaugugaaagaaaacgaaauucugaaccucuucagcuaagaaggcaaaaucaucaaaauucugaggcuaagacaguuucuguggcuuuucaaaacuuguguggcccaaaggggccauaaauaacuuuuaugguauaaaucccuuaaagaacauucuugguuucucaggaauuccugccauucuuacagucacaaagcuucauuuuggcugggaagauguuugagcuugaguuuucuguucaguacugccuccaggaaguacuaaacuguggagacguggacuaugcugugggcuucuuauaacaggugaaaugaacagauuugaggugaaugauucuuuugucuccaccucauaauucaacuuuucaccaaaaucugccguauuccuucugaucucuggccuacguuuuauaaacaccuuuuccuucugguauuacaugcagagcacaaaaaaguuaaaauauauuuccaugauuauuuuaagcuugagaauagcaaaauuguagcccccauaggaugcacuggcagugcauucauauaauaucacacugccccuccuagagaaaacucacaauggugaucucuccauuuucuguguggcuaaguagcggguagggaugcgggcccauccauaaacccgaccuccugcuuauuuuaagaguuucaucagcaucucaagaugagucaauauuagaaggauagauagucccauugacuguaugcuucagaauauaaucagcgcagccccuuauaggccgaggcugcugccauguaugugcuggucugaaugcagcaagcagcauagcacugcagcccagguggcuggugcaugccugguuaaccaaggcagcacuugcagcacucacagcagucagccaguggcagagauccagccauguggcuccuucugggcuguagagaugagaaucacagacaaccaagaugcaaaaucccgaagucauuauuccucugaguggagcccgcaucuggaaugcaccuuuuccagcagggaguaguuuauaggucauauaaugucauuucagucaugcagauaucuagcaagaaaaaguaucaacaaugauauaucuuuaucuauaugaacacuuaaguacuuuuuguucaaaauuuaaugguacuuguauucuggacuuuacuggugaaauuuuuaugauguuguuuauugaaaaacaguaguaucaucugaaaucuuucauuagacacccagacuuccauggugauuugcuaggcauagcauaauucaaauaaaaauuucauuaucuucaaagaccacuuuuagaaacuauaauagaacaccuaucuggcacuggguggauaccguaauacagagaagcaaaucuucuagguuagaauauaauucugauacagaauauguagaacaaagauuauaacuuuuuauauucauggcauacuucaaauauuggaacuuuuggcaacaugcaacacuaauaauagacucaaagcaacaccauuaagacaaacucacugcuaugauguaacagugucucacagggucuguaagaagaacccucaggaauaaugcuguuugaugucugacuuaaacugugcauuguccuuuacccucugacauauagagcaaaaaugauuacguuucucuaaacaugugaccuugcuuuggcacagacuugacaucuuacucaacuucuuuccucuaacuuugcaaguuucacuccuuacaucccagguuauccaugccucuacacucagcauuuccucugauagaccuuccuguagcaaagaagcaugaauagcccauacagggcucccaaucaagaugguauacugaguucacacucucuugaccccaaauauauuguaaugauugauagaauauaaaaagaggaaauccaaaggauuuaccagcuuuauuauaaaauaagaacauccucaugcauggaggaauuccugaguggugagcaaugaugaauccacaggccagcugggcucugguccagaauccaguaguggcagccagaaauaggacaaggucaaggagacuagaaguguccuggccaacaagagggccagaccaggcucagugcuuuaaaccaaggcauggggugagaagccacacuuccccucacuuuccaaguaaaggaaguuaaacguagcaacugcucaucuucugccuggaacuaugcccuuauaagaggcuagagauauacagagguggaaaaacaaaaccacaaacucacaaguaagaagugaaccaaacuauuugcuccuuuguaagcaaauguguaauauucucauugcucucauaagaugggaaguaaaacuaagaccugauucuggacucaggacccgggaguccggaugguagaagccacaaaaccacuagaauaagacagagggugagaaggaggaagaaagagagacagggagaggagagaggcagcagagagaggaagaagacggagacagauuaugaaucuccuacccaaaaugagccuacagaccauacauucuaaggaacauggaaaaaaaauccaauaccaagaaaggcaggcagcaaaaucuaguacuggaauaugaauacacuccagauggcuuuaaggaacaaccugacaaagucuuuaaaauaagugugccuaggauguuugaaaagacaaaagaaugaauagcuuccauuuaaaaagagcagaaaauuguaagagagacaugaaacaaggacaugaggauaucuuuaaaauaauuaaguaaaaugaaaaauaugguuauugaaguaaaaauuuaauagauaaguucuaagcuaaauaaaguuaaagagaauauuaauugauuuagaaaauagucaagaggaauucaccaagaauggaauucagaaacagauagacagauagagcaguuaagagacauggaaaaaauauuguaaaguuucaacaggcaucugauaggagauccagaaaaaagagaauagaaaaauguuagggaagaaauauuugaagcaauuaaaggacaaaauauuccaaaauuggagaugauucuuuuuuuuuuuuuuuuugagacagagucuugcucugucacccaggcuggggugcaguggcaugaucucgacucacugcaagcucuaccucccagguucaugccauucuccugcgucagccuccugaguagcugggacugcaggcaccuaccaccacgccuggcuaauuuuuuuguauuuuuaguagagucaggguuuuaccauguuagccaggaugguccugaucuccugaccucggaucugcccaccuuggccucccaaagugcugggauuauaggcauaagccaccgcgccuggccuggagaugugauccuucauacuaaaaguacacugggaguacugaacagauuaaacaaauuuaaauauucacacaaguauuuuagagugaaacugaagauaucaaggaaaaggaagcaaagcagaugaccaaugaaggaaucauaguuaggcucauagcagacuucuugucagcaacaauagauaucagaugacaguacaguaauaucuucaaaguguugagauaaaaaaauugugaaccuggaauuuuauacccagcuaaacaaucauuccacuggccuuuuucagacacagagaguuuccuacuuacugaguucauuaaaagcauuauuaaaagaugaauuaugggggaaauuaagguacaagggcauaaaaagcaacagugaacagagcuguugaguaaaacaauguuaguaaaaugaguugaauauuaaguguuaaaaguuguuuguauguuaaaaaaagauuacaauuaggcaacuuuaaaaaggugagugguguuuaauggauaaaguugcuaaaauucaucuccgauuuggaggaauauaagaaaaccaaauuacuucaugcuuuauuagaaaaaauuuaaucaaguuugaauguuaaaaaaaauuuaaugacuuuuccauuuacuuaucuuucucaucaucuauuuacaaaugaauuuuuaaaauucuuugcccuuccucagacucucucaguaaugaaaguaucuuaagcuccuuuguuauuuuuauuuucuuaaauuguaagagucauccauguguuugaaaaaaaaucuuacaauguuaaaaaaaaaauguaaggguaaaauguaauccuuagauucuaaagcaguagaggacagggaagggauauuauuaaaaacucuauuaaaccaacagaagacaugaaaagaaaaaagaugcaggaaaaaaagaauagcaaauuuuaaaaaacgcaauguaaggugcagaaauuaaguauuuuaaucucacuaaaaguaaaugauuaaauuaauuuauuaaaaauagaaagguucauuuacuaaaaguagaggcugaaaauaaugagacuggagagaguuaccaguuaaaaacuaaauaaauuuaguguaggaauaauaacaugauacauuuuuauuuuuacuuuuuauguauuuauuuauuuauuuuuugagauggugucucacucugucacccaggcuggagugcaguggcgcaaucucagcucacugcaaccuccgccucccggguucaagcaauucuccugucucagccucucgaguagcugggacuacaggcacagaccaccacgcccagcuaauuuuuguauuuuuacuagaggugggguuucaccauauuagucaggcuggucucgaacuccugaccucagguaauccaccugccucagcaucccaaagugcugggauuacaggcgugagccacugcgccuggccguaugacacauuuuaauauaaggcaaaggcauuaauuuuaaaaaaucauaaaaauaaugagaacuaccaagaagauauucuauauaaguauuagcauaguuacauauuauaaacuacaaauaaaggaaaaucaauccaguuauucauuggucgcuuaaagccagagugcuuacugugaugccuuauguacaguagaugccuuaauucauaauguaauuaaagaaucuuggcauucauugguuggagauuccaguuugaauuguugaaacacaaugagugaaucauuuugaacuacccuaaauuaagaaucucugaaauaaaauugcaguagaccauaucguggcaugauagaacuauggccaauggaacuaugccuuuauacaaggccuuuaaacuguauuagaauaguaugguugaaaacuuaaaguuagaaucccaaaugaaguuuaccuugcauuucauuucuaaucaauggcauuaaagauaauaauagcucucucccaccccuuuuuccucaguauucaacuaaccacuggauucaguccuuauaauuuaugauuauguaaaauuuaugccccaaaauuuuugccaaaauauuuuaacgucauuuugauguccaauuugguaaaaaacaaaacaaaaaaaaaaaacauuaaggcaccuaguaguuuuauaaauaauucccaauggggcuaaccucugcugaaagacauucuuugugcuaagguuucugacaucauagacagaaggaaaaugauuguuagccaaaaacacuauaauggugagaauuagugacugauaauguauuccacuuuuaccuucgaaaauguuuguacaaaacuggguugggcccagugguuuugcacuaaaaucuguagacuuuuauucgccuaauaaaaugaccacauaaccuggcaaaauucugcguauuuggcagcucuuccugccccggaggcuggaagagcauugaaucugcagguguggcuuuuagaagguucagagaguggaauuagggaagccagcccagcaccccaccugugugccuuccugagggccaggcuggcguccccagcauuuaauagacgugcagggccucuauucauucccaauagauaaugacaaccaaaauaaucaaggaauugacacgcuuugcuggaaaugccugauaaugacauuauagaccgaauuacagcaacuuaaauuucuuucuagcaaaugaugccauguuuuuuaaaagauacuuuuggcacuuagaaaauagaucauaguauuuaaugcuauugaauauaguauuuaauguauuuaauauaauauugaauauaguauuuaauagaacauaguauuuaaugcuauuguacacacgaaaaaccuacucuuccccuuguuaacuuggaugagguagcucccucuuuucuuugaagguaaagugggcagaggaauagaauugucaacagcuggacugcagaagggagaggaagaagaaaaagguuuucucacauuuuuguuuuuuccacaaggugcucuuuaaucuugggagccagcagucaugacccaguuauugagaucagacuuccuggaccugcuuauauagagaaguggggagcaguguaagagccggauguccacacugaggcagacagaacagagagugguagugggcaaguugaagcagcaaugacaugaugaagggcccauggugccccaggaaggggccccaaauccaggaguagguaacauaaaaguucacgcuaauaaccggaccuggugacuggcuugauauucacaagcaagacucuauuccacuggagguaguaccuagugaaagcaaaucagaccacacucuuauagaaucuagaugaaccaggaguacugagcaagcuuguaagacagaggcucagauacaggcagcaaaacauggcuucaguuaagaaauggagaaccaggugggcccgaaucucagaaacaaggaagaaguacaaugggcagaacuagggcacaggaauagggucaugcuagcugaucacgugccuuuugugugugugagagagacagagugucacucuguugcccaggccggaaugcaguggugcgaucacagcucacugcagccuugaccuccagggucaagugauccucccauuucaaccuccugaguagcugggacuacaguaggcaugaaccacuauaccuccagcugauuuuuuuuuuuuaacuuuuuuguagagacaacuuuuuguugcccaggcuggugaucagaugucuugagucucagcaugcuggccuagagcaaugauucucagaucuagaaccuuuguaucaaaugaagccuuacagagaacccaauauguaaacccaggcgaagcagagcucuucuggcuuggguagggcaggaggucuuggagcccugcccauccagcaccuccccaacagacccucuguguauguugacguuuccuuuuacugggaacuccuuacaucccucucuucuggguccaggaucagccauagaauuggagaggguugagcggcccuggcuguagaggaaagaagacuccagaagcuggagaagaauucgggaucugacaggaaguucaaggugaccucugggagccuucugagaagaaaaagggcaugcaaccucagcagugucucucugccucucaccaaauugacagugggcccgaacuuugcucauuuaaugagauagaauuaguaaagucuccaguguacuuuucauuccuuccacaagcuuuuaccgaauaaaaugauugguacucaguaaagguuagucccuuccuucuucucucccucccucucuccaccaccauuagaccucauuucuuaaaggacugauuuccacuaaaaugcaaguauuucuuggaagcacauugagcuugauaacuuauuuauuuauucuucugugugcauuaauuuaugaacucauuuccaccagacaccuagcugagagccauguuugauggaugggaaucagagaagaaagccagagagagccccagaugacugagggaugaaaggcccucaagagacuggggaaaggcaguaaugacaagguucacacuaacacaaucacacccaggacagcggcagauuugaagagggagcagugcagaccugaggguggcugaagaggguugccucaaggaggguccccacuguggccaaagagguccuuguaacuaacugaaaacaauuggacaggaccaccaccugcaguccacucacagugggcguuucuugcacucauccuauaccauauuuuaugaauuuuauuuuaaguuccaggauaccugugcaggacaugcaguuuuguuacauagggaaacaugugccauggugguuugcugcacccaucaacccaucaccuagguauuaagcccaacaugcauuagcuauuuaucuugaugcucucccucccccaaccccacugacacgccccaguauguguuccccucccuauguccauguguucucauuguucagcucccacuuauaagugagaacauguaguguuugguuuucuguuccuguguuaauuuguuaguuugcuguuaggauaguggcuuccagcuuuauccaugucccugcaaaggacaugaucuuguuccuuuuuauggcuguauaguauuccaugguauauauguaccauauuuucuuuauccagucuaucaccaaugggcauuugggcugauucuguguccuugcuauuaugaauagugcugcagugaacauuugcaugcauauaucuuuauaguaaaaugauuuaucuuccuuugaguauauacccaguaaugggauugcugggucaaaugguauuucugguuguagaucuuugaggaaucaccacacugucuuccacaaugguugaacuaauuuacauucccaccaacagugcaaaauguuccuauuucuccacagccucgccagcaacuguuguuucuugacuuuuuaauaaucgccauucugacuggugugagaugguauaucauugugguuuuuauuucuaugccauaaauauugaacugaucuuccauuuugcauuuuucccacuuuccauaaccacagagucaacaucgucucugucuugguauguuaugcucauuuauuaucuucugucuguaguugacagguuuuucugaaugauuuuaggaacuucaaguuccaguagagagaaugaaugaaugacuucucuuaacuggacuucuaucacaaaaucauggcuaacuucaugcauucaacuacuguuuuuuaaacauuccaaaaagugaucaagacgucauuccaggcaagcuuuuuuuuuuuuuuuuuuuuuugagauggagucucacucuguugcccaggcuggagugcagugguguggucuuggcucacuguaaccuccaccucccagguucaagcgauucuccugccucagccuccugaguagcugggauuacaggugcacaccaccacacccgaccaauuuuuuuuuuuuuuuuuuugagauggagucucauucuuuugcccaggcuggagugcaguggugcaaucucggcucacugcaagcucugccuucuggguucacaccauucuccugccucagccuccugaguagcugggacuacaggcgcccgcuaccacacccagcuaauuuuuuguauuuuuuuuuuuuuuuuuuaguagagacgggguuucaccauggucucgaucuccugaccucaugauccgcccgucucggccucccaaagugcugggauuacaggcgugagccaccgcgccuggccuuuuuuuuguauuuuuaguagagacgggguuucaccauguuggccagacuagucuugaacuccugaccucaggugauccaccugccucggccucccaaaaugcugggauuacaggcgugagccaccgcgcccgaccuccaggcaaacauuuaagacaggggguuuuuuuuuggcuguaagaaagagaugccaaucugucccuacuccuaaggagcaaaggagccugaaaaaccaagaggccaguugcuuccucuugcugucuuacauuuuuguauuucauuuuucuuucuaaggugcagugagagcccagaucuauuuguuuagucuguuucuucccauguugcucauacucacaaauuucuauuuaaacuugccuccuggcuucuuuaagagauaaacuguugcugcaguacgguuaggguaaggaaauuaccuuacuuaacagcugguaagucaccagcuguugcugcugguuauggugccuugcugugcaguccgugagcuaacuuauuuagugagagauuuuccugccaauuugcuauaaccuugagggagaaaaacugaaaucucccacagaggcaggaauuuauuuugcaaaaaaugaggcauuuuuaauauuuguagacauuuuaacaugugaaaauguugcauuaauguuugagucaaaagauaagauuccauuuugaaguuacagggauuugcaaucaguauuucuaaggucuuagauguuugccauuaaguuuuccuuugcauugauuuuauuuccguuucuccaucuguacaugauucaugguguaugugcuugagguggguggaacucgcccuuguuggacaauuuucagcauaagaaggcaagugggcagcacuuaauucucuccuaacccuuaagaugauaauaaggacauguuaaagggugagacacgcaacagugagcagaaaaacaagguugaaacccuuguaccugggagaaggcauacaauguugguaacugauaaaguugggccaggaagccacagucuagagugcauuuggaggagaaaauacagcggaauaagacuccagguuuauuuggaaaugccagggacgauggauaaagcaagaggcugacagcagaaggaugaacuggagaugucuauauggaagagaagcccuuuauuucaucccuaccugggaaagcccagcacccagcagccgucuauugggugaaaaauugauucauucccaaaguauuugaauguuuccugagaaaagaccucccaaccuggccauuaaauaaucaccagcaggauggugcagcccacugguuauaaacgcuaccaaugucagcacagcucuccaucaguuuuuccugacucaucauuaaauaugaauggacaagaaaacauccauagcuauuugaagaaagacugcaccuuaaaagacaggggcuaaaauaagcaaauggaaacaauaauccuaagggagacaaauuucaggaaaaagaauaaagcuuuaagagggagcuuuacuuaguuuccucagagagauuggagaaaauguugcauccauacauagagcaggaugcuguaagaagaaaaucagcaugcaucaagaaagaacgcuuagacauuaaaauaugauugucaugaucaaaaauucaguggaaggacauggaagaucaaaaaaucucuuagaagagcaaaaagacagaguaagaaaagaugaaagaguaacgauuauaaaagaucauucaaguuucaaaagccaauuggaaaacuagaauuaaagaaugcagaaaaugaaggagagaagauuauuuaaacacauacacacacacacagaaaccaauaucuuaagccugaaagacaugaguccccagauuaaaagggccugcuaaguguucagcacaaugcuaggucuaccaugugagauuucagaaaaucaggguuagagagagaaauguuaaagagcacacaaucuucucugauguuaaaacacacacacacacacacacacauagacagacacacaucaccugcaaguuauugagaacauuauuagcaacaaauuccuuguaagcuagaaaacagcaaagcaaaaaguuacuugaggaauuacuucagcaaaacgagggaguaaaacaagcaagucagacauagaauccagcuaaaugggauucuuaaccucugagggacacaacugagaggcagagaggcauagaacaagagacaguugcuuucauuauaccuuuugucuuuuuuuuuuuugacauguacauauuacuuugacaaacauuuuugaauuuuuuucaauagcacauauacaucaaauaagauuuuaagaccaaaauagaaaaaggggaaaauccuuuauucuaccaucuuagauccaaucauuuaaauuuuuuuaaauuuauuuucuucccaucuaucuuuaaaauauaaguuuuuuuaaaaaaaaaacuaggguuguagucauauuauauauauauaauuuuaucccgacuuucucagauaagcauuuuuccuauaguuacauauucuuuguaaacauuuuaaaugacugcaguuauuuacaaugacauguacuacaaguucccuaaucucuauaacugaauuggaauguaacuaugauaaauauuuuguuauagaaauagaagcaaccaguuugucuguuagccaguuugacuccaucaggauguguuauuuuuauuugguuaggcuccacguguuuuccagacucucugugagaccauuguaguugugggcuccacaucucugaaaagcaucaaaaccccuugaaccucaaagaccgcgguuccuuguuugagugacacuguguuaaccagaagaagugcagggauauuucugggggagaggcacuacagcuuccacaggguccugcccacaggcaucucaaaugcuuaguaaacuuugcuguaguucauugaaaagagccuaccaaaaaucuaaugaaaacugagcuggauacuagauuggucuucaucuuauaauggaacauuucagcauaaaacugugacuauuucggccggguccaguggcucaugccuguagucucagcacuuugggaggcugaggcgggcagaucacgaggucaggaguucaagaccagccugaccaacauggugaaaaccuaucucuacuaaaaauacaaaaauuagccggguguggugacacgugccuguaaucccaacuacucaggaggcugaggcaggagaaucgcuuaaucugggaggcagagguugcagugagccgagaucgcgccucugcacugcagccugggagacagagcaagacuccgucucaaccaaaaaaaaaaaaaaaaaaaaaaaacugugacuauuuauuugucuuuaguucaaugcaauagaaacuggaaacucacacucuuggaauccaaaugaaugacuucaaaaaauguuuggucucuuguguccguaaguguuucaguuucagaauuuaagagcuccacuggacuagcgcucccaaugaguuaaggauauucgcuaaaauaaauguagauaugccgccauaaaaaugaaugagauccugucauuugcaaugacguggaggucauguugaauggaacuggaggucauuauguuaaaugaaauaagucagguacagaaagacaaauuuugcaaguucucauuuauuugugggagcuaaaaauuaagauaauugaacucauggagauagaguagaagauugguugccagagacuggaaaggguaauggcaguggcggggagaaguggggaggauuaagggguacaaaaacauaguuggacagaauuaauaagaccuaguauuugcuagcacaacagugugacucuggucaaaaauaauuuaauuguccauuuuaaaauaauuaaaaguauauaauuggauuguuuguaauacaaagaauaaauguuugaggugauagauaacccccaaaaaagcauguaugcugacaauuccaaagacauuucuauuuuugggggaggccaaggaggguggauccccugaggucaggaguucgagaccagccuggcuaacauggcaaaacgcugucucuacuaaaaauacaaaaacuagccggguguggguggcaugugccuguaguuccagcuacucaggaggcugaggcaggagaauugcuugaaccugggaggcagagguuacagcgagccgagaucgugccacugcacuccagccugggcgacagagcgagacuucaucucaaaaaacaaacaaacaaaaaggcauuuccacuuuuauuuucccaauaauuuuaaagccaguuuguuuauuaaggauuuacuuaacucauaugaaaaagaaacgaaauaauuaaaguaaaguuggcauuaugucucacuuauccagaaauucuuuaucugccauccugccaucagacacauagccauaaacucagaaguaguguaaaggaccagaaagccacuacgguagaugccacagauauuaaauauccaacaucgcaagcugugcuuacaacagggagagcaacgugcuucucugccugaugcugaugcuuccuggauggcuguauugagaauuccgaaggacacuucccaucucaacuagagugugucaucagugauucaugcuagacaugagcauggaaugggagaaugaugguaucuggccaucugccacuuuccaauccauuaagccucacuaaaaagucuuguuugacuccucugguucuggcucagauuuuuuuacaagguuggaaaaaagccuuuuacaaggaagaguguaugaggcaauaaaaguuaacuuagaccacauccauuccauuuaacccauuaaacuuguacucugauuaccgugguccacuuaugggucaaggauuuggguacugccucaauggugaaugacagucauuuuucucucucccacuucuaacacagccagcguaagaaaccguccuuuuccauaauauccauauuuuuagcgugugaagacuggcuccaaaaaucaauuuuaaguccacauugaaaaagagcuuuuuauaucaucguguuacauugcgucaugugcagaguaagaugagcuauaagaaguccaaaguuccacagugguauauuuugcauaauaccguuuguguuuccauuaaauuguauuguuguuuugacugacauagcacauuacauguuucuguauuuuucuuccucucuguuuucucugugaguuagccagagucacuauuuaaaaaaaaaaaaaaaaaaacuaucagaaucaccaggaaugguguuuuugaauauaagauuaaguaaaaaggaaugaaaugcugaagguauaauaaagauggcauaaucuuaacaggugaguggcagguaaaguaacugguauaaaugauuucuaaucuuagcaaagggucuaugaggcaaguauuauuguccucauuuuaccagaugaagaaguugagcuuuugagaagugaacauuugccaaagacuccacaacucacaagagguacagccaagauuugaacugagguuugucugauaccaaccuuggugguuuucucucucugccguucaugaaaggugaaaaaguuuaaaugauaaaugcagaguaaaagccuuguauuaacucguaaguuuugguaucuaagaaauuacagccuuuucuagaucuugagauuauaaaacuauucuuaaaaguugguuauugucaggcgcaguggcucacgccuguaaucccagcacuuugggaggucaaggaagguggaucaccugaggucaggaguucgaguuugccgcuacuaaaaauacaaaaaauuagccgggcauggugguggcugccuguaaucccaacuacucgggaggcugaggcagaaaaaucauuugaacccaggaggcagaggcugcagugagccaaaauugcgucauugcacuccagccugggcaacaagagcgaaacucugucucaaaaaaaaaagagaaaaaaaaaguugguaccagguacguccaucugcaguuucaucgacugagauuauguagcugagagaaacugaggcucagagauggcacgauuuagcugaggacacccagcuaauuaaucuuggagcuaauuaaucuuggagcugagaccagcacccaaaucuccuuuuccucauucagggaacuuugcauauggccucuuaaggauucugcuauugaaagcagccagaaauccugucuuugaaagccaugggccauauggacaaaacugauccauguuucaagcauggagcuguguaaaaacaccaauaagucuuuuuucaguucaguggcuuucagacaaggugcugucuuauaaaaggauaaguaaaauaugaaucgucucuaaauucaccuuuugugauaaaauuaacuccaccugggaauuucuuccuuccacccuuucuaaaauuaaaacugaaauccaagagaggaagcaguugucuaguucuugauguacagagaaauaaaagagcaguuuuaugucucaggcagaagcagacgagaggccugugggccuggcagugcagagugaggagaaggaggcagggcugugaaaauucgcugacagggagggaguaggagguguccaggccuccagcgcagugucucaucucuagagcaagcccucaugugggugaagcaagugccgauacacagaggagccccugcaaggugggugggaagguuauuucaggaugccaggagcacucaggccagcuuggaaguccuuucaugggcaccaugaggaagucuguccacuucuaaaagaauucuggccacucccaauguugggagcagaucuagccuaagaacuagaacuagguuagagugccaggucccagcugauggaugagguuccagacagaccccacuccuggagacauuuggguuccagccaacagggaagagaguaugcgauguggcaccugagcccugucccagggaccccaucugccagauguggcuggcagugaauggccagcauggaaggaagcccaugguccuaucugucuccuuuuccuggacccaagugagcgcuagcccagguggacuggaguauguuaacucuccccgccagaaaccugggccugcuauugagacuaggugaggagggagguggcaagggagaggaagagcaaaggcaugagaugaauuaccuaauacacagacagcucaugaagagugaccauccucucagagucaccagaguuucuuucaaaugcagauuccuggcccugcauaucaaaugcccuggaagucuggccagggaaaucacaguuuguaucaggugccccauuguuaucccuguugcacugucaauaggaguccuccaaggagagcaaggaagugcagacuggggcaccucuggaggcugcacacagggaggagagguggaaggaagagcugcuggcugagaagcugcugucaucauccugugggggugaagagggggugugggaguaagggugagagaggccucaggaaggacucucuggaacuggaggcagugacuggaguuuccucugagaccagccggcccuuuagacucaaaagaugagagucacccaucaccauccaucugguggaaacauuacaggagcaaguggauaaaagacgauuuugcuguaagaucagaacggaaaaagacgagcccacaaagaaaaucuagagggaggaaagcauaugguuuuuaaaauaguacaguuuagaauacauugcaacacaaauggauuaauuuuuguacaguguuggcaaugaaaaggauucucauaguuaucuggaaugcuuacucagagagaugaucucauuucccuaauaaugcaaaaucuugagcagcguggggucuuauguuaagacccaaugauaaaaagggcuagacuuggcagggaagggcacugcaggggugcccauggugugugccaagacucaggaaccagaggagcaagucguagaucaggugcuggcaagcaggcuggcuuggcuaaagucaucaaugcagugacaaucuuaaacaaaaguuugaaauccauauuaaauguuuuuuuuucuuuuuuaaaaaagcaaucuuacccuagaagcacuacauggaaggaaaaaaugaaguugcguaaucauuuagaaaauauaugugcugagagaacuuuaguauuaaaaggugauuguaaaacaaugcaggauaauaaaucuuagaccaaagauaaaucaugaacaccagggcaaccaaaugguccuaggagacugaaaggcauccgucagaacaggccacuguaagugcagcucauuggucucauuuaguuucccaggaggcugaaauguugcucacugaaggucucgguucugcuaagaguggacuggguaggaggugccaggagcaguuuccugcaggccccugguccucaggcugccaggcagcagcauccccauuuauugugguuguggccaagcaguuggcagcuccaugccuggggcuucucagcucauuucugcuuccucuggaucuuccgguccagucaucuuuauuuauauccuccuauagcaucaccauagauggguugugaugaaugccguucaucaaccuaaugggcucaaauggaacucuuugaaaucccccaggaugcgucuuggucuaagaaaagaauuguuaacugcacuuuuaaaacuaggaauuuaugucuuccuauaaauugaccucgugagguuauuuguggauuccaauagggaaguggccuucuuaggccccagugccuccuccgcccuccccucaccagccagcugaugcccucugucuacuccuaugagcccgggguugcugaggacaaaacccuggcagggucagcaaauggaagaggugucugcuuccuuucuugcucuggagcagugugccuugucucucuccuucugccauuuauucacucacucauucaguaucuauugcacuccugcuuuaguccaggcagggugcugagcacuggagaugcagugaacagucugugcucugagggaccuacaaccuaaacaaauaagcacacaaguacuugcucaagggcagcucuggagaagcagcaggugccaugagagccucuguaggaggcucuggcggucucugaugcccugcuccuccuguuaaugcaggacucuggggggcugacugcguaugugacaguucuuuggauguuccccaucacuuuacuccguccuucuuugugaaaucucgaccucagcagaugaacacuguccuggccagaaucacccuaggcucugcuucucacccagcuccuggcccccucccuguugccacugcugcagagggaggccaccaggguuauugggucccucggacuaaaggcucagguuccaaggggaggccaacuaccagaggacacccucaaaugugagcagggcagggggcucagagcauccucaaggcaaagcacaggcacccgcccgcacaagcuuugguuuguuucacaguguguaaaucucuguacaguuuucucacaauaaauguaagaugcagccgggcacaguggcucacgccuguaaucccagcucuuugggaggccgaggcgggcggaucaugaggucaggagauggagacuaucguggcuaacacggugaaaccccaucucuacuaaaaauacaaaaaauuagccgggugugguggcgggcaccuguagucccagcuacucgggaggcugaggcaggagaauggcgugaacccgggagguggagcuuccagugagccgagaucacgccacugcaguccagccugggggacagcaagacucugucucaaaaaaaaaaacaaaaaaaguaagaugcguacauuguaauaaaagcuaacacuucaaaaaaggaauaaggaaaaauucaguauauucucaucuuccuuuaugccaaccaccagaaaaaacugcuuucaaucgugugcugugucuccuuccagauccuuuuguguuuauguaaacauguugauuuuuauauuguccuacauguuuauauuguccuguagucuauacuuucauucacuugaaaauuuauccaagacuuuucaggauagcacacacagauccuucucauuuuuuccagguauccaguauuucagugugugaauguaccauaauuucucuuaaaaccaaucccccguucgugaacauguaaauucugccauauuuuguuguaauaaauaaacucauugcagcaaugaauauccauauauacacacacacacacacacacacacacacacacacacacaucugucagugucaaacucuucuuagaaagguauuucaggucuagugucuugcauuuuaauggguuuucauacacaaugagaugcucuuaaucacccucaccacauggcuggacagacauaugcaccccccuauucacuucucauauguuccucccuggaaacugcaccuccgccucucaugguaaacucaagugcuugaguacucucaauuguguuuuuugcagauucuguuuauuuccguugaauuuguuauuguaauuguguaauuuacuuaauuggcauauaaacugaagaaguaugaggggauuauuguuuuuaagaaaaagcauaaauuauauuucucucauucccaauuugaacuaaaaaaauuguuacuagcuaaacacccacaccuaaacaccuacacccacacauguauaucagauacaguagcuucuaccgacucauaauuucaucaaccauauuugggaguuguguccagucuuaaucugccuugccaguauagucucuggaaaaacauccuacagcuguuugguuuauuuguagauugaguuaucuuuucuccuuagaaauaccugagaaugaggcaugucuuauuuagaaucucuaauaugaucuaccuugauaaaaguugguuuugagcccuucugcuuacccccaccaagccauuucaagcucugguaacgcccucagaaacaccauguccaaccucauauaagagaaauggaaaaccuggacgucacaacuguugccuuugaaagugagagggugucuguauauaaacauccugcuacuuuuuaagcuaauauaguguuagaagugauuuuacagcuccucuaaaauuugcaaacucuuaugagacuauuguagguacuuaguuguuggaugcauggauacacagagaagcccuaaauucaugcaacaaacauuuauuaauugccaacuguauaccuacuaauuggcuggcaacugguggcgccaccacgaagcacaguggguaccacuguucucccaaggccugugaccaaacuuaagacucggagccaccaggaagugcagagaugcaguuuacucaacagagcaugcacucucuaaaauggcccagcccugugugugccuggccaguggagcaggaugcugggaggcaaaaaauaaguuuucucaugaaaucugugaauucucuucaucuucucaaggcgugccuguguaauucaaucaugaauuuuacuuaaacuguguggcauuugauagagccuugcagagacuacaagacaucugacugcuguauuuucucuucuaggauaucaaugaguguauucuugaaaacuaucccgagugcuccaaccccagguuauuuuacaucauuccguacuuuuguggacagcaucccagaugcagguaagggcuaaagcagggucauggcaugcacguacgcacaacaagggcaagaaccccaccagccugguacucggugggaaucuuuuguaucccuagucucucaaccuucuggaauucaguuccuguuuacuauuaaucuuucaagauaauauuugagacuccaaauguccuauaaauaaugaaauuuaaaaaucagggucuguagaggccucaggagaccaccauauaaagcuuuguaacuggaaccaaacccuuguuuauaccuaaaacauacuugucacuacucaucccauguuguuugucuuucucuuuggauaaaaugacaaaaugucacauaaaaugugaucgugaagaccaggagcgaacacccagccugcuccuguacagugacugacuuaaccaacaaccugcccucguagcaugugucacugggucugagacacuggaagcccacaccucaaucccauaguggauauacuuaguaggcagagaagaaaguguuuuauaaugaucaccugucaaccuuacuugaaggcacaaccuucuuuagagagugacuuacucagauagucaggacccccagggugugaucugcccagguccugcaucagcaccccuguauacuuguuaagaacccccacccaaucauagucucguguguagcagccuccccagaugcuucuggcguagcuauaguugaaaucuacugugcuagacaaaugucauagccuggagaagaaauggcagcaacaaugaagcauuauauuugcuugguaggaaaucaaccccugcuaucagaagugacauuauuccccaaaggaaacauuaacuagaggguccuuguguuucugaaaaggccaaaggagaacugcuacuucuacaccggcaacgcauucauuguaccuuuuugcuuaugcuaugauuucugcuucguuuuuaggcguauuguuguuauuccugucuuguuucauuugccauaacaaaagaguuugcuuauaguccaaauuauagaacuaggaguguugguuuuugacuucaccauaagcccccugaguccagguggccucuccccugcccccgacccuugccucaauaacaaauaccuccugguuaacauuuagugcuucagguauugggaagauuuggggcuggaugacucacuugcugaucacagugaauaucuuuauaacaggaaacaugauuugaacucccuaaaguauuuuuuaaaucguguaguauuuuucagauuuuugaauuuucuaaucuuggagaggugacucaugacaccacaccuugauacacacacaaugauuuuuauaacucuuucaucauaucaccuugcacagucuuuacaacaaugcuuugaacuagguaagggugauuuuuaccauuuuucaaaagagaacccuggcuugcccaauucccccaaaugauaaaugacagccaggccuggagccccacucccgggcuuuucucacucgccuuagugucaguucagagagcuggccuacaaaucagcucucugauuuuuacaaauuaggcuguuuuccuucugcaaucuagacaaacaaaauaaaacaaaacaaaaauccaaagauuccucuuuaacucuuccaaagaauaagaugauuaauaggcaugaccugacagcucuuuugaguucuacauaaauacuaugucgguaaguuucauauuucaaaacuccuaaauucauuuaauugguucaguuugguccuccuauuaaaaaaccauucuacucaccccuugauuaguauuuguuagaaccuaacugcuugugccugcauucauucguccacaauacuuaggcagggccucugaauucaaggcccugggcuuggcaugaagcauggaugaaagugacagagaaggaauggugagcagggcaggacaccaguuggaaggacugggaaggcccuggauggggcuacaucugggcugguccuugagggaaacaggauuuggacuuaugcaagugaaggugggagguagaggggguaaacucucagcaucuugcugcauuucaaauaugaaugucugauuuuaaauaaauuuuuauauccauaaagggagccuggugaaugggcccuugagagagcaaagcugaacgugaaugaaaacuuccugcucguggggauucuugaagaguuggaagaugugcugcuguuacuggaaagauuuuuaccucauuacuucaagggcgugcucaguaucuacaaagacccagguaacuucauuuguaagcaagcucuucuccaugagaggucuguguccagggcuacucaccuugaaaaggccucaggaaauaaaggagugaaaugaucucuucugaugacaaagggcaguuaguucccugggcuugcaaaggaaaguuagaaccaggagcugcagaugccaaaaucuugagcuucauguucagacauaaaagcaccauguuccaaaggcuuaauggcuccauuucucccuauggaaacugaaauuggcaacauucuccaucagccuugucuugagcauguugcuggaaacugaaacuggcaacauuuuccaucagccuugucuugagcauguuguugggguggguacaaaugaauccgugugugugcaccuggacuccauugauggaaacaugcgugaguaugaaagagccauccuugugaugaauucucucuggcccaacuuccauuugauaaaagcacucuaguguaucaaauccugacaguggaauagauagagcagcaaauugaaaauacaauuaugauuuuauccuaacaaaccgagugguccccaaauagcagcaagaaauagaauguggcaaagcaauuacaagggcugccugugguaucaucguaaguauaauuacuuucagaaauccaucauuuauuuuuucauugucauuuuauccaaagagaaagacaaacaacguuguuuguuuuuuccuauucuccuuaaucuacugcugugacaacaagccuugaauacacauucagugaucuguuuauuguucuguuuuguuguccugagauggaagaaggcauucugcccuguagaaauaagcagcagauaggcccggugcgguggcucaugccuauaaucccagcauuuugggaggccgaggcagguggaucaccugacgucaggaguucgagaccagccuggccaacacggagaaacccugucucuacuaaaaauacaacaauuagccagguguguuggugggagccuguaauuccagcuacucgggaggcugaggcaggagaaucgcuugaaccugggagguggagguugcagugagccaagaucgcgccacugcacuccagccuaggcgacaagagcgaaacuucaucucaaaaaaaagaaagaaagaaagaaggaagcagcagaugaaagcuccccaaaugcagucugcugccucacauuccacaggguucccgaaccccaccugcaucacugguaggucccaaggcccagggaaacuggucuuugcccagagagcccuggaucccguugcacaaggucaagguggcccuaccaccaucagggacuugcugaaggaagguggauaguugguggaggcugccuuagccucccagcucucauuagaguucaaaucccauuuaccugagugggguugugaaacuaggauuuccuuugucuuuucaacaacaagccauuuaaagaguuuauagaauuuuaauguaaagaguuugaugugacugauuuuuauuucuagaagacaacauaaacuccguucuuugugcaaggagaggucuuauccuaaauuagacuccuuugaagaagaaagguuuauguuaaucauuuucuccuuuuggcuuuaucuuguucuauggugugugugugugugugugugugugugugugugugugugugugugugugguguggugugguguguggugugugugugucuaauacacagucugagauaaagggcaaacuaaauccuggugacacauaagaugaacacucuccauaaaagauauuauggcuuccaacuuuguuacugucugcucagucauuugcucugagagagaucagcugcuauggaugaagagagguucacauagugaggaacugagaccucagaccaagagccacgugugugagccaucuugggagcagcuacuaugaccccagucaagccuucagauaacugcagccccaaccaacauguuaauggcugucucaugagagaucccaagccaggaccacccaacuaagcuaccccugaauuucugacccucagagccaguguacgaaauaaauguauguguuuuuauuuuauuaauauuguuuauuuuaaugagcacucucuugucccagcauuugggaggaggagccaacgugagaguccucuuccaguuacaucaccauccauccugaggucuggaacacacaccauucacaggaugcaaaacccagcacagggguuguggaccugagaaccuagaugaggguauuuuuaucuucaugcuuuugaauacagauaaaccaccuauaaaaagcuuagcccagaggacccacuuaguggcucuugucgugguauaucauauugacuuccuauuuucuccauuuaaauaugugucuucucagaaauuaugggccuuuauuccgugaucugaaaguucguuaauucaaggagaaaagauuucugaaaaccaaguuacuauuaacucuuuuaccuucagccaugaucuuuccaccuauaaauuaaagauuauuuuucccucagaguuuggcauaguaaauaucucaaagagaauaaaggacaucugguuuuccuguguagugggaugaaagguuuccauaagccaggccacuuggccaguccacgugguccagcuggacuagcgguuaaaacagugaaacacuucuauacggccuucagggugcaccugccagccuggcugcccguccuuguuacccccgccuuuuccaacagugauguaacggaaggacuaauucauggcacaagagggaucuucaggaccccgggccagugucacacucagugacuguucugaguucaguucuugaguggagcugguugucaaauacuuuaaauaucacccuagcauaacucucucagcugccacacauuauaugcccaauaaaaugaaccuuugaguuguugcuucaguaacuucuacuguguuuuguguucucuugggcaucuucuugugauauguuucuaugguaacauugaagaccaagcuaguccacaguuccucuaucccaacaaguuuccguguccccugaggcagaggacaagagaucaacacacacuccuggccaguuucucaauauauuuuagccucagggaagacuuagcacccauauuguuuucucaucaccacaacugaguuggugucaaguagguuaaagaaagaauagcugcaaguuucuaguuacuucaccaucucaucuuuguauuuuuagucuaaguucaugucuuagggcauacuaaaaucauuacucuuucccuuuauugaagaguuugauaacugaguagauuagagaacagagagaagaaaagcuaaaaucuaagauacugauuuaagggaucuagugacccuuaacucauuguagauuaacuaaccaucugaagagcugaauuaagaugcaaaaacaccacuggccauuuuucuuugguguuuguccuguuauugaaaaacaaaaacaaaaaaaaaaauaggaguuugcugacuucugguaacuccucucuagcaauacuaaaaauauguauaccagucucauuacagaagaaaaaacacuaauagcaaugacucuuuggagagcuaguaaaaaucguaaugucuguuagucauauggguugucacuuauuucagauugaaaugauauucauugauucuuucaaaucaauacuaccugucccaauaacucaccauuuagacagguuaauaaccuuucucaauaacagcguaacugucuuuucuucuguuccuuucuuguagaaauauaugcugacaucaaguaaauuugucuccuaccaaaaauauuggagaaacuuagccuuuagaacuuuuuuuaaacagucauuuuauguuaauauuugcauuuuauggagacagaauagaguaucucagaagcuuaggauaguaaguacuugagaugaaauaaaaauuagaguuuuagcaagauggauaaccaagagaauaugcuugguauuucuuccagccggugcgcagcugcugauauuaggacaaguacuguggagugggcauucagaaaacacugcucaauccugaccaugaguuugaauuagggagcaccaaggccccagcagguuuacucgguagaagcaaccucacugguugaacauauacauaauuauuacauaugaucacauaugucaucuuauacauaauuauuuuuuauugauuaauccuuauuauguuuguuuauuacuuaucaccuuuuaaaaaugagaaacugaggccagguauagugacuugcaccuguaauccuaccauuuugggaagccaaggcagacagaucacuugaggcuaggaguuugagacuagccugagcaacauagcaaaagcucgucucuacuaaaaauacaaaaaaaaaaguccaggcgugguggcucacaccuguaaucccagcacuuugggaggccaagguggguggaucacgaggucaggaguucaagaccagccuggccaacauagugaaaccccaucucuacuaaaaauacaaaaaaucaacugggcaugguggcaggugccuguaaucccagcuacucuggaggcugagacaggagaauugcuugaaccugggaggcagagguugcagugagcagagauugcaccacugcacuccagccuaggugacagugugagacuccaucuaaaaaaaaaaaaaaaaaaaacaggccugauggcaugugccuguggucccagcuacugggcaggcugaagugggaggaucaccugagccuuggggaggucgaggcugcagugagcuaugaugaucgcacccauugcacucuagccuaggugacagagcaagaccuuguuucaaaaauaaaauaaaaguaaaaaugagaaacugaagccagcccagagaaguugagagaaugauccauagucauccacaaaaauguguaaguaaggggcaagacucacauauuucugagcagugaauauuaauguauuucugaacacuuuuucuccuuaacucuuaaagacaugcugugagccaucaguauuuuucuagucauaauuuuuaggagcuaaaaucucaguggugguaagggccaaaauaaauaagcacaugaaagacaaggaacaugugaauauguguaauaggaacagucauaugagcaucccucuauaaacccuugacuuggcaaauaaccgagcuguucugguucaauagcgccaccuagcauccagacauagaacucuaugaccuaauauuaacccauuaccuucucccuuccuagcgacuugaaaacucauguguccaauccuuuuacuuuguguuuuaaauacuuuccaugacuagcacuacauuaguauucauuuucaacacguuuccauuacaaauguaaacacuggagccacaguagggaauuuacuagacuuuugugggcugccuuaagaauauggucaccaacuauuacaaaggaaaaauauguaacaaauuccaaacgagugacuuaaauccuaacuuugaggauuuaaguucauuuauaagcuaagugcuuuguuuggaauauuuauacuuaaauaguuuuauaaacaaucacagaguacacauuuaaauauuaugcuuuuuuuuuuuacuaugcaugaaugauaaauuagaccucccauuagaaggaugguagugugcucacugauuucauugacguugcaguuuucaauuuugaggauauuugcuagaaaaugauaacaaauauguagaagaaaacuuuuaaauacuaugcuacagaaauaauucaaauuuuaauccaucaauaaaaauaucagccugaguucuauacuaaauaauaaaagcuuggccuauuuauaauaaagaacaguuauucuuuaaggaaaggacauugaguugggaguuaggaggaacuucuaguucuuugucugccaugggucugcccauaugaccaggggcaaauccaguuuucaaguggauggucuuuaagaucuuauuauucuaauaccaguguaucauguagaauguuuuaaggcugcuuguucugucuuuuguuacuuagcacaauuauggggugcuuuuacccccucaaaaauauuccuaggcaguccccauugccuuaguaauccucaaguuuaguuguggggguggucuccaccucuucguguccucuaggacaggaugaaauccuagcuggagaguuccuccuucagaauguguucuucccuggagcugcugaugcucaagugaucaagacaggggucccaacuccaacucucuggucacaauuuccaucccucucucuucauaacacacacacacacaccuguggagaagacaguaugucauaaugcagucaaaugcucuaccacugaguuauccccccaucuuuuuuuuuuuuuuuuugagacagaguuucacuuuuguuguccaggcuggaaugcaauggcacgaucucggcucacugcaaccucugccuccuggguucaggccauucuccugccucagcuucccaagcagcugggauuacaggcucccacuaccaugcccagcuaauuuuuguauuuuugguagagacgggauuucaccauguucaucaggcuggucuugaacuccugaccucaggugagccaccugccucggccuccgaaagugcugggauuacuggcgugauccaccgcgcccggccuaguaugucauaaugauuagagcacaggcucugagauagauagcccgcaugcuagacccccuccuccacuuaacugcauaaccagaggcaagguauagccccucuaagccucaguuuccccaucuggauaagaugcauaaauaaucuuauguacuucauagguucuugugagucuugcaugaucaauccauguagaguccuuagcccagccuuacuauauggugaguguucaguaauuagccugcccaccaagcccaucacaggagagacagggcugucccugagagaaacuggacuggagguucucuuuguaacuucuaggugaaagaaagaggaaaaaauuggaaggaacaaaugaaggaaaugauuauccuugaccuguuucaccaguuacagcugauacauuacaaggaaaucucaugccuuuaagaaacaauauuucuguauuacugacuugggcagagaggaacgaacaauuauauuccagucaauagccuguuccagaaacaauugcaaggaauaaguuaaguggaaauauuacuacagugacaugcuaaggggcuggaagacacacauaauccaaguuaaugagguuuuuaugccugaacucuuaccagaaauauuagggagcuaagacuuuucacuaaaugaaacccacuguugagacguuauuggggccaacuacccuuaacuuaugcugaauauugaauuuugcugacuguuauauuccauguuauuuaauagacauagaaugauaauagaguuuuuuuaaguaagauuccuaagauucagcucuugaaaaacuguuuuccaugugcagaauuacguacuucagaacacuaaauuaaugaauuaauaaccuuuguccagcagguggcgaugucucuccauuuucucaagaaagugcacuagguucccuaauagacuuugcucugcagacgggaguuuacauaacgcuugaacacagauguacaauuauguccaauuugaggccuaaaaaugagauuuuuggauaugaaaaggauuccaaguccaauugauugcaguaguucaaacugcacuuuaugaaagccaguggagacuaggggaagaggguggaguuuugcaaucaaauaaguuuaugugaguuaaaaguauauacauguauaucuaaauuauauauaaaguauauguaauauauaauguauauauuguacguuauauauuauauauaaauuauauguaauauauaauguauauauuguauguuauauauuauauauaaaauauauacauuauauuguauacauuauauuauauuauauuauauauacauuauauauuauauauauaauguauauauaauauauaauguauauauuauauagauacaccacuaacucuggcuuuaguuuuaaaaacuaacauuuuagaaagccugaauuaaacaaauucucucuuucauuuuuaauuuccauuuuuauuuuccacuucuauugcuucugugcugcagcaaaacucaaaaauauucuggaaacucccaaguauacaaugaugguuaggaggaauucagauuagcuauuuuuagaaggcaauuaaguuguuuuuaaaaacucaguuuucauugaugaaaacaggacuccaauuugcuauugguucauuuaccaucgauauucucuauaaagauuuuuuuuucaccagccaugucccaggcucagauccuaauaaugucagcacuggaucuuguguguguguguguguguguguguguguguguguguguguguggugugugcaccuacccauguucaaacaacuagacuccuuauuauauagcacucauacaugaugcaaucaucuuaagaucacaaaaucaguaaguuucuaagucauaauuacuuguauaacaauaugcaguuauaaaacacuuucauauagaugaucucauuugauucuuacacaaauccccugaaguugaggaagacaauuuuuuuuucucauuuucuaaacaaggaaaccaaggcucaaagaggcugaacaacuugcucacagucucgccaaguccuaagggacagcacugacauucacgcuucuguccccaggcccaucacaaaacauaaaucugugauuccucuaaaacucuucuuuauauuuaaucauuaauucagaaguuagugaguacuaagcauucauaguauguauugccauuaaaggcaagagcuuaaaaauaaaaucuaggcugggcacuguggcuuauaccuguaaccccagcaccuugggaggccaaggcaggaggaucacuugagccuaggaauucaagaccagccugagcaacagcaagauccuguuucuaccaaaaaaaaaaaauuaaaauuaaauauauaguuuaucucuguccaacguaucugucuguucacuaagaaacaugaguuuaggaaucaucauagaugauuguuuuuaaaaacucaauuaucauugaugaaaacaggacuucaauuugcuauugguucauuuaccaucgauauucucuauaaagauuuuuuuuuucagcagccaugucccaggcucagauccuaauaaugucagcacuggaucuuguguguguguuaccuuaacacacacacaagauguguuaucuuaagccaguguguuaucuuaagccaguacgaggcaauacacacagaaaaaaauaauuuugagaauagaucuguuugacaacaccugacgucuuuccaguggggguugcggggacguagggaauagcagugcaaggucuuuaagauagugucuaaaaaucuaagcugggcugggcaugcuggcucaugccuguaaucucaacauuuuguuaagccaaggcagguggaucacaaggucaggaguucgagaccagccuggccaacauggugaaaccccaucucuacuaaaaauacaaaaauuagccaggcauggcaacacaugccuguaaucccagcuacucaggaggcugaggcaggagaauugccugaacccggaagguggagguugcagugagcugagaucgagccauugcacucuagccugggccacagagcaagacucaucucaaaaaaaaaaaaaaaaaagucuaagcugaaggcauauaacugguucagcuguagcuacugggcaaauaguucauuaaaaaugaacacauaauguaaaccccuuuaacuucuaaacacuugugauuuuuuuuagugaacauuuuucugaggggaacuguauaaccacaggcugauaacaucauucaguuuacagaaacaucaccaauucacaagaauucagccucuaggcuuguuuaauuuacuuuaugaaagcuuaaauugcagcauaauauaugugcguuuggccuauuucaacuauuacucuuuguuuuauuggaaaacauguuuuacucuugcuuacugauuuguucuugcguugggaucaucucuccuccaggagaaagcauuuccaauuuuauuaugaaagauuaacaggaaaauagaacuuccuucacagacauugauguucuaggaauaacuuuacaaaaauauuucucuucucugaaaacuaauauuuaaauagguguaaucugaaacuaccagaaaaauucaacaaacaccuccagcaaauaaauagcugagugucugugaugucccuuuccuggggaagggcaguauaaagaugaaaaucuugucuagcuggaaggccgucacuaacagggcuggggcgcauaacccuguggagacauuugugcccggccuuaaagggugcguaggaguuugccaaguggacguggaaggaggcauuuuaauaagaggaaaauaacaugauuggaagcguggaggugagaaagcauagaagcacucagagugaggagagcuggggcuugggccagcccacgucagccccugccugcggacccagccucuuggagccaggcucacucacccugccuuuaagacggcccuaccagaggcaggagaaggauccgcagccucagcuuucuguggcgcaaccuggcacugagucacucauaccaaucucagcgccaguggccaagccgcugcugccggagggccugugucacccuccccccguuucccugcccucuucccauccuaccaccacccaagcucccuggcuuccuaacaguguggcagggauccucccaggcccccauccuccuccagccugaguucuuccucccugcugucuucccagucuuccccacuaagaucccaccacccuucagacccgggcucacaccagcuccugcuggccccaugugccucgcaccgaauacaggaggucgcacacugcauccccagacaccaaguacugcccugcuugaccaccuauguuccccugggcccaccagcauggacucuccuucuguuaccagucacugccugauccaggcaugagcugccugugucccccgacaucauccuccuggcaccauccucugcucuuccuggccuucuucacugggagccuucgggaucaucccuccagaucaaguucuuccagccccaccucccucccacccugugcacccagggaaauucaucucuucugggucccaaccuuggccucgggagagccccagaugccccccucugugucuaccccaguuacucaguguggucagacuuggggguuguacaguuuucugucucaugauucauuuccccaggcaaaaagcuggcuaauaauaucugggugugcgggggagguaccaguguguuucuguguuuggaggugaauuuuuuucuacuuuagaauuuaaucacuucuacuuugagcaguuuuuagcugagcugacaguaauaugcucugcauugaguauuuguaggggguggaauuagucaccacaaauuucaauuuuuggacuuuccugauaacgccacaaagcugaaaggcuucuaaagcuugagcaaagauuggaaacuugaccccagggguugaugguugaucuuuauaaaaacgaccuuguggucaguuuguucuuuuaugcuuaaauugucaaggucccuguccaccccaggaauuaauguggugauguggaaagagcacuagacaaaggauuucaaaacugucuuugggcccuuggcucguggccuuagcucucugacauucuuugcuuauaaaauguacccccugccggggcgaaguacaauccuuacccauuuugcaugacucaacauuuuauaauggaagcuucuauuuuugucuggcuaaaucuuuuucaaauaaaaauauuucuuggucuguauauuuuucaugucucagacauuuuuaucaauacauaauguccuagcuuuucacaucuugcaaauggcacagaauugugaaagaauacagcaaaaagcuagaaauauaccuguguauauaacauugcuggggauuuuuaugugugguuucuuguggguucuaguaagcacguucauuucauuaccuacaaacgcauagaaaaauccaacauaaucccacacugaugagaagaagagaggguuguuugucaggugggguaguuucacuugacuugaaggucucaccccgccccucgucuuuaccauagcauacgcuucuagaugcuucugcugcauugucaaccagacucuaccagaacuguuuuucaaaacauguguuccuaggauuuuaccucccugcauuuuuugcuauaucuauuaaguaaugcauguauauaauuaaaaaucaaauaguccuauaagauguauaaugaaaaccagcaguuuccuauuccaacccucccaaagaugaagucugauguugcagagccaaucacuuucagcgcagcuagauguuucuucggauaaucaccgcgcuaucuguaacuaguaugcacaggcugcuguuucuugauuuacuggggucaugaucucauucucuuauuccauuaccuuuacuucuacuuccuugcuccucuccaucuuccuaagauggucauacccacauuugagaugcaugguccugcugacguugcugugacuauauacauuuuguuggcugcugaucagaguaguacaucaugauuuuguuucauuucuugcacaacuuaauuguuuuuccuggaauuauuuauugccuucauuuauuugccuagauuuauuuguaccuaucaaaaauuucguaugugccaaaauuuucguaugugccauuagaucugccgcauucaguauuacuuuugguauuauuuaaauauuaauuaccagauaaguaugucaguuccaucccaaccugcccucccuucccgcagaggcccucuccucuuuccacccagagcucuuuaagcuccaucgcagccugcccucccuucccccagaggcccucuccucuuuccacccagagcucuuuaagcucuaucccagccugcccucccuucccccagaggcccucuccucuuuccaccaagaaagcuccugcuccuaguauaucuggguucauuacucuaaacacagcuuuacugcagcuucccuuuacuauguuucucaguuggguccaguuuucuuaaucucggggaugcuauuucuugauuuaauaacucauuuuacuucaagauguuccuaaguugccuccucaugaaaggugcaugggagggaaauuuuuuuugagucauugaaggucugaaaagcucaguauucuacucuaacuugauggcuaguuugguucucauauucaugcucauucucucucucucucucucucucucucucucucucucucucucucucucucucucucucucuccuuggauugucucuuuauuccuuuuaugaaauuuuacaauaugacucgguaugugugcuaaauauuuaguggauacuuucaggcuuaaaacuccugucuucuauuucugggaauucuuaacauuuuguuucuuugaugauuuuaccaccauguucugcuucuuuucuggaaugcuuuuaguggucagauacuugaaccucuagauucauccuuucuaugcgcuucgcuguuuuuuccucccucaauugccaucuuuugaacauuuuuucucuggaagaguuccucaauuuguauuccagccacucuguugaaucuucucuuuuucagccuuucuuucuucuuuuuauauaacaucuuguucuuguuagugaauggaugcaauauuaccuuaaaagucuaaaaauuauagacauugguuuaagcguuuucauuuauuccccgcuuuaucucuauuugcuccagauuccuuuguacuguuuugguugguuugggcucucuuuuucagucugaaggcuuuccucuggugacacuugucugucuuucguuuuaagagugaggcacuaaagagcuaauugcagccggacaugguggcucacaccuggaaucccagcacuuugggaagccaagguggguggaucucuugagcucaggaguucaagaccagccuggacaacauggugaaaccugucucuacaaaaaaaaaauacaaaaauuagcuggguguggggguguacagucauagucccagcuauuugagaggcugaggugggaggaucgcuugagccccagaggcagagguugcaggguugcugugagccaagauugugccacugcgcuucagccugggugacagaguaagaccccaucuuuaaaaaaaaaaagcgaagaaaagcuaauuguaagugcugugcaaugaaggaggcucauugaccaguggaccucgcuugaggauaaucaaauagcaauagagguuuugcuggaaaaauauuuguuagugauuguaguuuuuuucucucuggaguuuguccaguuuucccacggaaaaauuauccaaacaucugcuuuggggaugggagaugaagugugguaggagaguggagcaugcaugcaacugguugcuggugugggaacaggcgcugaagguucucacugaaugcaccaguuuccccagugcugggauuuuagcccauaccucuccuucccacuccucuggguuagcaaaucgguauggagccucugcccaaacuaucuggagacugauccuaagauugccugccccuggcuguggagggaacuggggucccagcugcuucauaccuagacugccagccucagacccagcucucccgucggggacacccagugguacuccaucucugacucucagcugggugagcugacacucccgagccaugucccuuuucgucagcacuucagacucucuucgucugcuuugccuaaucggaugcgugccuccaaccgcauuucaucuuccagaaauugguggaggccugccuuccacugauaauccuucuccagcauuuuauccaucuuuuaauaaaaugccaucuuuaauaaaauuaucauuccuucacugucauuuuagagaaguuuuucaaaggacaggcauugaaggcauguaaucagcccacuacauuuaacugggaauguucuaacuaccugaacuuuaagauucugcugccagcuuuguguuuaccguucuuagcuagaucugucacacacauaucuuuuaugcaguaucuguguagccaugaugugaaucaaacuaccguagcacugccuucagcaucuguaucuugggauuauaguacugguaaaauuucaaaagcaaaacuaacaaaaacaagauccuuuaacgguaauugauuaauuaaucccuuuuggguuuuuacuggaugacauuaccaugaugaagcuccacacuuaauacuaugauuuuaaaauuaccuagaagacaaaucagggcuguacuggagguuucuugugggaggaaauguaaauuauaagaacugauaaaaacagacuccugugaucagaggcagagcguaugaccauuuaaagguaucauuccacauaaccugguggaaaaggacaucuucguuuccugugcuguuaggugucaguuugggggaaacguguuccccagguuaugcacagauggcggcacaggcauggagugggggagugaaggccucggggggugagcacagccagucugcucauagacagaaggaaaagcagccaucgugaaggcucgucugccgcagcugcuccgguagcaggagcagcagcucauauaacaaauguuucaugacgaaugcaaacaaaagccagcuccgaaauuccagccauguuauguccaagccaguucaaaaucguauaaccacuccauuugaguuuuuuccccucucuaaauacauuccauaugagccguggugucaggguugcugggaucgccugcguucacucagaaaacuguuguuaaagcccagacugaagggaaagucaaucagugggaaaacaaacucaaagaaaacacggaggcccaggugugggggaggggguuuuccccagccaggcaggaccccuggaaugaggcuggaggcuggcgaacacucuuccagcacagaaggaagaguguucuugccugggagcaggaauguguucaguggggccccugugccugcggcggccuggccacagccaagcaccgcgacucaaagugugguccacggaccggugccaguccgcaagcugcuugcuaccagcccgugacgagauaagggcagaaauuaagaagcagcauuuggaagcuuugaugggaauuuuacguggcuguggucauuuuucugacaauuuauuuuuaucgucauuuacaaaagugucaaucugaaauggauuagguagggaaaacaauccgagguuauuggagaagcacugccguagauuuuccucccagcgugggcugccugggucagcaagguagaaggccagccagugggcaagaccacuccuaaggcaucuggggccuccgaggcgccaugauucuuccauaggguuuggccuucuuggcuucaaagcucaaacaugugcugccccauagcaauggccagacgcccaaaccuaaagagagagaaacucugucuuccuaaaacugguuccuuuuugacccaaaaccuuuaaaaguggcaauuugcauuuggauagcgcuuuuacaguuagcaaaguaccuuagacuuacauugguucacuuguucacaucucuguuagguaguguugugaauccccuaacguuacccaagaauugagaccccuuccccugcaaaauauguugaaguccuaauccccuauaucugugaaugagaccuuauuuggaaguagagacuuugcagauguaaucaaguuaagaugaggucauacuagauuaggguggacccuaaauccaaugacuugugcccuuaaaaggagagagagacugaggcucaaggaugaaggccagugaagauggaggcagagacuggagugaugcugucacaagccagggagcaccaagaauuugcagccaccccuggaaacuagaagaggaggaaggauucuccccucgagggaaacacaacucuuccaacccaucaauucuaguuuucaaaacuaugagagaauaaacuucuguugucuuaagcuaccugguuuguggcaacuuguuaucauaggaaacuaaugcaguuagaaguccucuuccuccccauuuccaggggaagaccuggaggguccguucgcauucaaaaucugcccacguucaaagcagcugugaggagcaaaccuuggauuaggacaaagagccuucaaagaugaacacuguccucuggauugccuuucuuuguuguagaaaggaauuggggggaaaaagaugucuaauauuuggggaaagcuuuauaagugauuuuacagugaugcaaugaaauauagugaggcgguuggaguuuuaguuugaagaauguuaauauauuggaaaacagaaaaacaaugaaaaaucugacacaauauuuauauuuauauuauacaauauuuuuauguauuuguuguauacacacacacacaauaugcuuagcagaacaaacuagaagggaaaauaccaagagaacugcaguuguuaguuguggugguuucugcaugguuuuaguuucuccuguagacuuuccuguguucucugccuuuccuguaacacacgugcauuacagagagccacauguauuagggaccaucccuguccagacacuaugcgcugugauguauauacauauuucuuuuucuuuucauuuguuuuuugagauggaguuucacucuuguugcccaggguggaguacagugacacgaucuugacucaccgcaaccuucgccucucagguucaagagauucuccugccucagccuccugaguagcuggguuuacaggcaugcaccaccacgcccagcuaauuuuguguuuuuaggagagacgggguuucuccauguuggucaggcuggucucaaacucccgaccuuaggugauccacccgccucagccucccaaagugcugggauuauacauguguauuucuaauagucacagcggcacggcaaguuagauauuagcauugcuauucuacaaaggacaaaacacagccagacagucuaaggaccauacucagggucucauagcuggugcaaggcagagucugucuggcuccaaacccugugggcuucccaccacgcuuuguagcuuuuucuauuuuugugaucaaacaaaaaaaaggacgacagugagaagggccacaacugagcagcgaggaaacugucgcuguggccccuuaagggagggcuugcuugugcucuguccucugucauuugcacgaaguggaggaguccucuuuuuuuuggcaguuaacucuacaggggcuucuugaagacaggggccaugacccgucacuuccaucaaaagucgugacuggcucuccuucucccauccuucucuccuuucugaccuccugccuggcagaguuuucagaacagcauguaaagcaugguuacucaccgagcgugucugggacaaauaccuggacaugccuaccugggucacuggguggccuguuccuccaccacccccagaucugaaggcugguuaggcauaaagauaaaaauugccacuguucucuuuuucauacaguccugagcucuuccaacucaaacaacucaaaccuuggcgguaacaaaguuaaguauuuaauagcuuuuuaaauaaaguacugaaacuaguuugauuccauuuguauaucacagugucacccuagcauuuuaauuuucacuugucucauucuuucuuucuaguauuuugaucugauuuuuaccuguauuauuuguauuuuuuccugcaaaaugccuguagauacuagcagguaagcauuguaaaaauaaaauuguaggccgggcgcagugacucaccccuguaaucucaacaguuugggaggccgggcgggcggaucacgagggcaggaguucaagaccagccuggccaacaugguaaaacaccgucucuacuaaaaauacaaaaaugagccaggcaugguggugcaugccuguaaucccagcuacucgggaggcugaggcaggauuaucacuugaacccaggaggcggagguugcagugagucgagaccaugccauuguacuccagccugggcaacaaaagugaaacuccuucucaauuaauuaguuaauuaauuaaaauaaaauuguauuuuguauguagucagucagugaaagaccugcgauucagugcauucuccagcauguggucccccuaagcacaggugccaacaaacugaacuccacggcguggcuuuguaagggcucagaaacauccagguaaagacucccaaggccucuccuuacugguuucuguuuccaugaucugaaugcauuuucucagccaucuuacuaaguugucauaguagagacaggcacucuuugccccagugaauggauugcgugacauccuccuccuugcugugagauacagccugugcauccccguaagacccuggguggaccucuguuauacagaaacauugcccuuuuaaauaaaaccuaaagaaaguccauguuucccaggucggccuugaaaaagaaauuuccugagggagaggcagcugggccauuuauuuaacaaacacuagugauggugcacuuacugugggccagacagcaucaugagggcuuuauggauauugaugcauuuaauaguccugaucucugugcugacuuccuccuugccugggaccucuugcuagccacugcuggcugccugugauccacuccaggaggaguuggaaccugcuggcucacuagugggcaaagaacaccuccucuuggaccuccagcccagcgagcuaucgcugcaacauccugcaggagagcagagggcaaaggcaugagauaggagcacaaaugcagugaggccaguaagugugacuggccuguugagguucauagccaaggaagagaccuggagcugggauguucuaccuuuuguccccuuguccaugccccuugcucuucuggagggaaccccucuccuccaggguagccccugcacaccaggccuucaguuuagucauggagauccuuuccacagugacacagaguguuggugacaaucucuggucauggugaaaugcgccgcuguucagaugccucuucaucgcuuguucucucccacaacuggagaccaugaccagaacaaagagaguuucucuucugcauccugcuacuccaucuuccuggacagauucccccgcuacaugccugccuccaggccuccauucccacacccuagaccacccucuccaugcugaccacccuuggcaccagaaccguccucuccuaaaacucgacuguccuguggcccacuccccgaggacccuaauagaucauucuagaacaaagaucuagaaugaucuagaauacaauauauugacagcugacaauaacacaauuuguccuucccaggggaauuucuaauaaugagaauagugaucacagaaauacuagaacaguacuuuccacguaguggguguacaguaaaaauguauugaauuaauacugaaugcauguacugugauaaacauuuuaugugggcuaccuaauguaauuaucagaauaauccagugacuuaggcacuuuuauuauucccauuuuacagaugaggaaacugaaguuuguauaugacgucacuauuuuauggggaggcuccuuagaaaaaaaaaucauuuuaggcacuuuuuacuauacauguacugauaauuauuuuaaagagcuuuuuuuguaggaaguauguucuuuuauucaucuaaauuuggugcacuaaaaauacaggugaugugaugugaacuguuggccauuuaagcagguucauuaucucacaucuuuggcccuuccugccauuccucucauuagcagugugggcagaggguuaaaucuuggcugccgugggauauggugagaaacccuauuuguggguagcuugcccugguccacacugcaccaggaccuggacccaggcauagcacugcgccacccugccacccgugguccagcagggcccugaggcaggucacuccacuucaaaggaaggagucauucaugguggauguccaggcguggccugugcuacuaagagugagggcuuuuugcaaaagagcagauuuucaguaguacuuuuccuccuccccacaaacuaugccguuccuacaacacuaaguguggcccacagcagaaguucuuaaccugaaguccaccacaugguuuucagggaauuuuuauuugauuugauauauauuuuuuccuaaaugugagauggggucucauuguguugcccaggcuugucucaaacuccuggacucacgugcuccucuuuccuuggucucccaaagugcuaggauuauagacaugagccaccacaccuggccuuucagggaaucuuucagcugcuccaucaccauccuuuucuuucuuucuuucuuucuuucuuucuuucuuucuuucuuucuuucuuucuuucuuucuuucuuuuucuuucuuucuuucuuucuuuccuucuuuccuucuuuccuucuuucuuucuuucuuucuuuuucuuucucuuguuucuuuucauucuuucuuucuuuuuucuggagacagggucucacucuguuacccaggcuagagugugguggcaugaucucggcucacugcagccucaaccucuugggaccaaauucuguccuccugccucagccucccaaguagcuaggaccacagguuugugccgccauacccacuuauuuuguuuauuuuuuauagaggugaggucucacugugcugcccaggcugaucucaaacucuuggguucaagcauuccacccaccuugaccucccaaaguguuagcauaacaggugugaaccacgacaccuggcugccauccaguuuaucagaaaaaaauuucauauuccugcuuuuuuucugggaagcaaagaauuuucagauuuucacaggcauccgcauccccuagaacagugagcauuccagucuguguggaaggccagugcuguggccuccuuuucugagggcuggcccuaccacgggagaggaagcacucuggugggagccuugauguggacaggcgucaucugacggagagccaccaggaggagccacuggcugcugucagucgggagaacuggcccgaggcccugaggccggccaucuuguucagagccaggauguggcgcuggcacuccaaauggugaccaagccuuuuguuuaugcggguugacuucuggcucugccaugcuucuauauuuccacauuauaacauaggauauuguuugccuaaguauaauagggcaugugcguugguuccuggcaucagccauggaagauuagcuuacuuucaccaacucagaaucagucccaguggccaucacaaaagaccacacaacucccagagugucuauaaguagauacaaaaccacauguguuauuagucuugaucuuagaccauauuauuauuagcuuugcuuugguugaaagugggccccaucauauuguuaaaauagaguuucacagccuuuaagugacuaggguacaucacuuuuaagauguuuuuccaaaagaaaauguuaaaucccaaauacauuuuuggcugaauaguugguuuuaaugguucagagucaaaaacuguaacuuaauuccuaguaaaacuugaaucaauuucaugaggguuuugcuaaacauuucccucuguucagccugagacuucuaccaguucuuaaaucucaagcaauauuagcauauucuuuuaaaaugucaauguuuuuucauuucaaaaaaaaacucuugucagugucugacuucuguugacauacaguagcuuauuuguggccuccauuaugguauugugguuaaagucucccauuuccccucacucucuuuuucccuaguaucagugaggaaacacaaugucaaaugacagucugaacaacuggaucuguacugcuggcuucaaccucaaauguaguucgcugccuuucuacauuuugcuuuugagggggaugacggucggugggaauguuauucagauaucagcauccguaggcugaacuuaauaugaagugugaguggugcccgcucugccucauucggccaugggguuuauuggggaaauggcgucugcugcaugccuguggcuccagcuuaauaccaccagagacaagaaugcugggcgcagcugaaaggcaguaacccaucuggagagcuccuaaaaaggauccaaguuugcuuaauaaugugcucaguagucuaauguuuugggcacaaauagcaaaaagcucuuccaauaacacgugcuuuggauaucagauuaaucuggggcaggaaacacuugcaaaguggaauccacccaagagaaaaaggccaauaugccagcaucaaaggcuuaguguuuuguuuugcuuuacaaagugagcacauagugagcacacauugcugaaacaaucaaugucucaacuguaugccaaauucuguaaguugauaaguaccauuuuuuuuauuagggguguaacuaauagagcacugcuuuuauaaucuaguccuacuuucagauucagagagauuuaggcauucugaaguuaagucccagggcagggucuuuacucaaaguguggauguguggacaggcuuucuggcuauaagcaguagcauuagcuauuuggggcucagaaacccgugcauuugaaauuugucauuuuuugugaaacuggguuuuuauuuugagaguugcuccuguguuccuuauuuuuccaugaguucaccuucaugguauacuaaacuucauuuuuacuuaagaugcaaugcuacauagaaauaaggaaaagggauuuauuugguccacaaacucaauuuauuguauuagguuggugcaaaaguaauugugguuuuugucaugaaaaguaagggcaaacauauuuuugagcccagaugaugugcccaacccugcuagucacacaaagaacagagaggacauggauggcgcucaccaggaaguguguguggguacccugcggaucucuaggcacaggcuuaguaacaauucucuuguccaccacagggaggugacuggaaggugccaggaagccccaaaugauucuaguucacuauugcccucucauauacagaacaucucucuccugcaguugaaagacugagcuuaaagccagcaaaaaucucugagaaggagaggugggguuuuaagagcaaggcaacccccuucuaguucuccauuuucuuuaaucaucuauguaggauuuuguguuuuauuuauuuaaagggaugcagauuacuccacagugccacaauuuugccagucacccaagucuggaagcuugaaguccuuucaauuauaccuuaaaaaaagccaucucccagaauaucugcuuagaaauguucuagauauuuucccagcucaccauagagcugggaaaccaucacagaagccagauugcugaaugccaggcaugugacugucaacaacuauuguuuucuggaggccacagucaagaaguauucaauagaaaauuggaaagagauuuucccuucaaauccauacacagcuuuaaugcacuuagaacauaccugugccuggaguauaucgugcaucccuguuuauggagccuagagucuuauuuggugaacaaaauguaagcaagaauggcuucaguccuauccuggaaguuuaacaaaagcaagcucagaggcuucuuucuguugggaauaugcaggucacacacaauuaguguuauaaguuggucccaaaaccagucuacuggccagggguagggccaccacugccuguuagcaggccaaggaguuggcugaucuuuggguuccuguuucacuucagcuuguucuggaucaucugcuaggaagcuaaaagcugcucuuuaacaagaaggcaucuucuaucugugaaguuuucuucuccuuuccugagaugugaaaaugguauaguacauaggucaaucauggucuuugcagucaguagacauggguuugaaucccagcucuaauucuuaccagcuguuuaacugucggcaaucuccuuaaccucucugaaugucuguuucuucauccgaaagcagagaauggugaccucacaaagcuguuuugaggauuaauggagauaaugugcccgugcaccgauguacaguuuccaaggcacuuuucuaaucaucucauuugauucuuccguuuccgucugcaauagggcaggguuuucaagugcucaacuuagucaaguuuuugaguuugaaaggagagaccaacacaauuguuccaaagucucucaugaugcagauuccagcauucccuggugugaucccuugugaaguguggcaugaggacucuacuggcuucagcuuuucugguggcaguagaauugcccaucuagugccuacugaucugaguggacuugacuucuuggccgugucucuguuuggaguuaaagaggaacgauuuuccuugugcauuauuuugaaaaucaccuuugaagucacuaguuagaguuguuuucaaaugcaaaugucgaggucacaugaaguugagugaccacauccuguggcacauucccacuugcucuucuaguuuauuuuuaauacagaccaagaguaaaaauauauacacaccccauuucagaugcaaauugaagccagacuuuguuucuacauaucugugaaauggaguaagcuaacuaaugggaaaaaagauuaugccuaauacuuagacauaguuugcuaguaguugcuaaugucaaaauaacauugaguuuuuaggaaaaauuaaggaauguguacagaaugaugcugcaauuauagucuuuaugucuuuaaugaaauagauuuaggauuucauuagaaauccaauagaaguaggauuuuccacacuaaggcucauuagucagagucaaggaaacacauuuucauaaucauuuauggagcauuucaaaauuuaaaaguccuuuuggcucucugaaaucuaaucuuauguguucucccaccccuuggccauuuugggauacuuaaaugaggucagaguuuuucauuaacaguucaagcccuugugagaaauucuagcccagaauuucuacuugaaaugugagcaccaaacuuuacuuugggaacaacaacaaccaaagaaaugcaaaccaagaggacagaccauguucaugcaugaaaauauggaauaucacaaaaaugccauuuuccucacaugagcauauaauuuaaaguauuuuuuuuuagcuuaaagugauucucaagcucaucuggaaaaaauaaacaagugacauggccagugaucuuuuuuuaaaguaaugagaggagauuugcccaacaagauucaaaaauacuagaaagcucuuggguuuaaaauaaugguguaaaagcacaagcucagauagacaagucagugaaacaguaacagaaacaguugcuaaugcaaaagguaaugugcucucugguaaagaucauuaaaaagaaagaauaaauaaagguguaaauuaguuagcuaaauguuuagggaaaaaauagucuccuuauaucaugggccuuaauaaauuccagauggucuaaagaguucauuuuuuuuuuaaugaaaauaugaaaggaauagaggaaaauauaguugacuguuuuuuggggggaugggguuuugcuaaggauuuacuaagcauaaaagcaguaaaacacauauuuauacaaggagaaaguaaagggcuggcaugguggcucaugcauguaauccuagcacuuuaggaggccgaggcaaguggaucacuugaggucaggaguucgagaccagccugaccaaaaccccaucuauacuaaaaaauacaaaaaucagcugggugugguggcggaugccuguaaucccagcuacucaggacgcugaggcaggagaaucgcuugaaccuggggggcagagguuguagugagccgagauggggccacugcauuccagccugggcaauagagugagacugucuccaaaaaaaaaaaaaagagagagagagacacaguaaagaauaaauauguuuaauugaaacuuuaagcauguuuaaaacauacuuaaguuggcaaaauauuugcaacaaugauaucauaugauuauauuuuaccaaaacaugaagcauuuuuuacaaauccauaagaaaaucacuaacagaaaacaauggagaaagagaaauacaaguuaccaacaaauacacuaagaaauaagcccaaccacauucauaaucuaagaagugcauauuaaaaugagaccauauuuucuaugaaauuauuauugucuguuaugugaacaaacacugagcagucguggaguccccgaugaugaggaugaagagaaauggcgccucaggagacuccuagagggagagcacauuguuaaccccugggguaaagagcaaguuagugauacaucuuaaaagccuucaaaaugcccauagcugcagaacugauagaaaaauccuguaccuugauugugguaguaggggcauagguauauauagcugucaaaacucaucaaauuguauauuaaaauugauguguuaauuaaauguaagugauucuuugauuucuuggugaggaaauaauguuuacaaucuuugacccauuucaaugcuagaaaaaaaaaucauacagguacauaaaaacuauuauaaggauguuccucacaggauaguuuaccauugcacaauaaaaagacaacuguaaaaauagaagaauagcuaaauacauuuugauauaccaaaaacaguuaaaugacauagcugauugcuugaaauaugaugugacaugaaguaaaggagaaaagaauaguaaaucguauuuacaauaugauaccaguuuuacuagaaaaacuacgugagcacaggaaaugauuaaauugaaaugcucagaauguugauguuguuagucauaucuuuggguggugggauuauuaguaauuuauuuucuucauuucccaacuguuagauaguaagcauguagcauuuuaaauuaugggaaaagcaugaauuuuaggaaaauaauugaauguucagauaaaaauuauauggaagcagaaggagagcccacuggcuuacuguggaauugcugggagcacacagaauuuuuaucccucucucuuccguguucuuuuccugcacccgcagcaacacugaugaaaauggggcaaguaaagaacaucauucucgagggggcagcacaguugugugcacacaaaauccuggguuccacuuuuugucccuuuaccagccccucucucuaagauaucuaaccucuuuuuggcaacuguccuuuggauuucaucaguucaccuggcaaauucuagccaguaguuuuuuaaaaacucaccuugucucucucucucucucucucucucacacacacacacacacacacacacacacacacacguggcccuuucuuguauacagaagcuauaaaauguguguagauuucuagcccugaaauacuaaaguucuauaauucuguacuuaacucuuuaauaaucuugacauuuuaucuaccauaugaacuacgguacaaacaccauuaagggcaggacuuggcuuuccaggccugaaugcagguauuuaaaauaauugaauuacaagaagguagcucauagaucuuuuccauugcagcauaacugucuugaaucugaaaacacauugucugucuuaacucugcaguagcugacacacccuccuccucacaagucacuguaguaguaagauuaaauauuauaaugaugguuuagcaaaucggauggggacucaucagcuauuuucauaucaagaacugagguugaaauaugcauccuuuauuuguuuuucauugagugauuacagauggcaccuaauaaagucuucaugcugugauaucuugaagccauugauuuauguuugguaaguguggacacaccaacucuagucaaccucccucccauuacauaccacaaggaauguuaaaaugacauuugccuauuugcuuuuucuagugacugaugaggauccuuucugagagguaaacaccagcauuauugaggagugaaguuuaggcuugauauuuuucaauaaaguauauuccucauuauacuuuauccuccaaaauaaaaugacaaaaauaaaacuuuggacuuuucuuuggauacauauuagccaaaaccaucaugccccugguaaauauaaauugauucugaguuuuuagaaaauaaaucacgaauuguacaaaaacauugagagucagaagauguuagaauacuggauguggaggugaauuggugugccuuuucuuccauuugauuuggacuauggugugacugacuauuuuagcaucucuuccuaauucuuuccuuuguugaaaguguuguaaaggcccacaugccaaggcuaauuguggggccagagccagggagacugcugggcaggugguuaucuaggcagggauggcaguugggcagaaggcacaagcaauacaagcucugggaacaucagguggcuucagucuagagacacagaucagguaacccagggaaagaugguggaguugaggaauaaugcuaagagugagggccacagaccagcaucgaccagaagccuccacggugaaauauggauuccaugagcuuggacucagcagccaagaaaagucucauuuaauagucauugcgaucucaauuucacagccauaucgauggagaaacaucugugcucaagaggagagaauuccacaacagcuuacagccacacacuggucaucccugugaaagaugcagcugaccagacaugauguagaaagucaggcaggcccucugaaccccaugggcgccucugccaagugguggcgagcauucuggaaaaaguggaaaggccaauacagagaagugacgggccugcaaaugguccugauuuuucuaacaccaauucaggggcaucauugggucuuuugacccaagaucuuaaguggauccucugugcauuucauuacuuaguuaaauagcaugucauuccguaagaaagcaaaccugaauugguuuugccuaaacuacauagcccaggaaauugagcagaggauugaauggcacaguuccugaucucagcaggcuaugguuuccccuuuguaucuccacuuuguaucugacugcauuuucucuuugcccuaaaccauccagcuauugcaguggcgaugggggggugucugacaaaacuuuacuuuucuuccuuuuuuauuaaaguguuucagaugcugcagucaugaaugauuuuugaauguuuauuauuuaccuaauacaggcaagaagauauaguagaagauaaaaaaugaauagaaaagagauaguacuacccaaauggaacucuauuagggaggggaaaauaugugaaacauccaaaauauauuuuugacauuuuuacagaauuaaauaauuauagauuauacgguauucaugaucaagaagugcuuuggaauuuuaugcaccuaaugaauguauagguggggaaaguugaucuauaaaugcacauguauacuguaagggauaugaaucuuuacuuucacugaaccaccagaccuuaaaauuuuauaggagcagagcaucucaaagucuugaugucuguaauuucauaaaguaucauuaacacauuaaguuucaacuaaauugaaauuaauuguuucauuuggggagauuagcauuuuucuauuucaguggcagaauacugauguuucaagggaauauauuuugaggauaacagucauaauauuaauaguuguuguuauuauauuuaacacucauugggagcuucuugugucucaggaaucuuguuaaguccuuuagauguacuauuucauuuaauccuaagaacaacccugugaggaagauacuauuauuauguccauuguacagauaaggaaaccaccaacuuagagaugauucauaacgcuucuauguuacugagcuggucgcuagcagcacucaagugauugaacauucaacccaggcccaggugacuugcaaccccgugcucguaagcucuuaacuggucucucucucucucucucucucugaaaagggcaaaaucuaaaacaugauuaucugagggagaugggguagcuagaaaaguaggauucuaugaaauguuauucugcugaauucucaagaacacaguguuucuggaaagcuuagugguucuguugaggugauguucauugauauucuaaauguguuacuuuguuuuauuuuuuuguuggugggggaagacuuuacuaguuggaauuacuaaaaucgcuuuaauaaagugcuugcaaagacucaaucugguuaacaguaaagccauuuguuucagucaugucagcaacuuugguuuucauaaggguuuuaaugaaucggagaguggaauuuaagaaagcaaacaauccaaggaauacuccuuauuuuucuaaaauagcaaagcaaaaaugggaacccuuuccaguuuaguuacagcaaguaucuauuggaguuuuagaaauucuuagaguacaucauuuaucauauagaacaaaacuugauuaaugaacacuuuuuaaaagucuuuuuaggguccuauuauuauuuuaguuguuuagauauaaaaauauuuuaugacauauucacuguuaaauuuauagugaauugacauucagugacauuuguuuuuaaaguuguuuauugaaauauguagucuaccagaaauaaguacgguuaccaacuacugaaaucaauuuaauaguaauuuggucuuguuagucuguuaaaaagaauuauuggccuucagauauuuccacaaagcccuuuguuacucaugaaucccaucaagaugcuaugaauaaagacugugaauaucaauaaguuugaaaacauuccaugcucauguucagggucauauuuuucccugucuucuauguuccucuuuguggcuauaaacccaaacuuauguguuguguguuuuuucuaugacaauuauggauaugacuuauuuacuauaugcucuaugagguauaaccuaaugucaacugacuucaacuauguuugccauacuuccaaaaaaauagccacucauguaucugucugaucaggaggugaaccgauggugcuguaugaaauugagaacuaauuaucucauaaacauucuaaguggauauaaggaauuaugugcucaguugcaaccacuaauuuaucgaagcaccgggucuaaauaccucagggaaugcacagaagccugaugguugaaaagccuucaaagcauucucucagcuaaaaaguacaagaauuggggcucauaucuagugccuuuuuggacaguuggucacagaagcuuagaaacauuggcacaaguauugucagguggagccuggccgugaccucugugaaauggcugucaugagcuuggcagggugggaauaauggcucuccugccaccaucugucaccccuguccaagacaccagcacaauuugagagcagcugugguucccuacccuauucucaccccauccccccaugcccagcagcucccucccugggacuuuggaccucgugggaaaaaaauggagaaggagggaaagaaaaguacuugaggguuuuguaaauguucagaaagggaggggggugcgguagaauuaaaucuacccaaagaagagccaaagagcuuucacuugcuuucccuucuagccaaccaguaaccaguaggccuucauuuuauugucacauguaaaacucaagaagugaugaguaaguagcauucaauuagaauuuaaucuuuuuugguagaaaugguguaaaaguuuucaaugaggauaugcugauuccugguugcauguuccacagccuuugauguucaaccacaucaucuugcacuuauagcuaaaaggugucagacaccuaacauugucuuagcaaucuucugugguuccagauacugugugcaucuuacaggcuggaguugggggacaccgaugcuuaaugggaaaacuaaugacuuuauacagaucuuauaaaacucugcuauugucggggggcaggcauuuaguagauuaaguuuguaaucuaagagaggaaacugggcaggaaagacaagagugaggugaagcaccaccguggaccagaaaaaggcuugaaauuagaagccuuuggcaaaagugugaaacuuugccacuuuacauuguucagugggucagaaauugucaaagauuuucuuuuuucuccaaagagaaaugacgaggaaggagagacauuuuuuauuuguucuggguguuuguuuauuguuuguuuuggacaaggucucacucuguugcccagacuggaguacaguggugcagucacagcucacugcagccuagaccuccccggcucaagcaaucugaaagagagacauuucaaaauugaaccuaagacucaugguuuaucgcaugagaacccacagcucucacagaaacucaagaaaugucuuagugaggggacucaauccuuuacacuucgagcugaaaggacggcagucagcccagccaggagguuaccucagcauagaccaaguaaauaaaucauuugguagaagccauuugagaguaaagguuacuagaaagucauaaaucaaccagcaagucgauguaugguuuugcuagaauguaggagcaauuagaaauuuuuagaaauauuucuuuaacugugcgugacuugaggaagaggacuaugaccuaacuaaccaguuacuauuauuauaucaaaaugagauuuuaaaaaauacaguauggauuuaaugccgguucacuuauucaguuuuaugcaguuaaguuguuguuuuuagaacauuaugaaauuucauuucaugccccaauaaaacuaaacuaaaauggaauggguuacagcuuuuccauuuguugacuuuucucuuucaaacaucuuugauuuuccauucauugaacacacuuuuuaagaaugcuuugaaugucauucaaguuacccguuucuccuguccccucccccaccugucucuaaugcaguuuccaaagugaaccaauccuaacggaaccuaaugauaccuuugagcacguuucuuaguaacacuagcaccucuuucuuaccugcuucuaauucacauaauggccuuucuagcauuggcugauuguuucuuuuucauuuccccuuuaucacucccacccaugucuuaucaaaggggaaggcuggugguuaauggucagugcauugcaccacaauuucaugcuugugcugcaucaaaagucuaaccugacaaucagucccuucucuuccaucugacaucagaagcuucugcaguuucucacagccauuggccaugaaaguucagcucaagaagucaucgcaacuaccuucauuuauagccuguuguugaccuaaaaccuaaugcaugucagugcucuucucuguuucuucucucaugucagaaaaauuaaaauguuuuaauuuuuuucccaggcugcauuugcaaguuuuaauaugucuauaacauuuuuauaguauaucaguauccauaucaaacauuuaacucuguuacucugcuuuucuuuucuuuucuuuuuuuuuuuuuuuuuuuuuuuuuugaaauggggucucgcuaugucgcugcagugcgguggcguuagcucacugcaaccucugccucccggguucaagcgacucucagccuccugaguggcugggauuacaggcaugcaccaccaugcccagcuaauuuuugcauuuuuaguggacacgagguuuugccauguuggccaagcuggucucaaauuccugaccucaagugauccaccaccuuggccucucaaagugcugggauuacaggccuaagccaccgcacccggccuaccccugcuuuucaaagucauagccaugauacccagggauuuuucccucacaugguccuggugucuacugacauuagcuuaucaauuucaaacuuuccuuaagcaaaacaaaugggccuccuauacaaaugggaagguugcaguuucaucucauuuuuucuuagaguuuugccugguuaaagcaauuuggauguuuuuagauauucacacugucuuauuuagugugcaguugcaaaucugauuuuuaacagggagagaaggaagagguagggcuguuaauuugcauuccccuaagacugaguacuaccagugggcuacagguugcccagauaaaguacauuuaauuuuaaaguaacauugcaaacucucccaguagaauugacagcauccuuggaacuucauuucacacuuuccugacuugggaaugguuauuuugaguagcaccuccuauuaaccuaacuucuuaaugccuggacagaagguuaaauaucucacuuaucuacauguucggccuccaugaacagcugcuucauucacagcccuucaaggguuuaucaaaauuuccccauguuuaacauuccagagagaacauccagguuguuggcucuugagacucaccauugguucacucacugaggcugaugauugugacuaauauaaucuuaaaacaaaaaaugcaauaggauacauucuguuaaagaaaaugcauuuugaauuaacuauaaaaauacaaaguucugugauagcccuaucugaguacccaguucauagaauccaaaaaugagaaaagauuucgucuccgugauuguagucaucaugugguguaauuugcuaagaauuucaagugcacuaaauguuuuacgagcaaccauacucccauauuaagggcacugcuguacuccuuuacauucucagagucaggagaugcaggauuuucaaaaggcccugugcauuuugaaacuuuagcaagguaggugauagauugauuucauguaacaauaaaauaaaugucuuaaaguuucaggaucucugacaauagaagauaagugguaucuuagaguuggcagaauugaagaccuuaucagcuauaagaagaaaaguuacugcucaauaucugaagcugccauugaccuuagggaaacaagcaaaaaggcacaugaucgcuuaugaacaaggaugugcaucugauauuauugagucauagaaacagaaaacccaaucaucuaacaguagcagaugguuauaugaccuuuaaggcaucuauaaaauggagcauauaaaaacacauugcaaaauguaauugguaauaauuaaagauauaggagaaauggucaugguuaguuaaauuuuaaagaugauaaaacuaaauaaacaauauagcacagauguguuuuacaaugaauaggcauaaauaagaaaaagacuagaaggaaauguacuacuacaguaauaacuguggcuugauuaaaaguuauuuuauauucuuguuuuccuaaguuuccuaaaaacuuuacuauguauuugcauauguguauauguacauauagguaaguauauacauauaucugcacaucauguauacauguacauaguauguuuauauggguacaucacaaucagaaaaauaaauguuuauguuuuaaauuauuuuucuccaagaaauaagguuuaaagcucaaagcuuauaaacuucccaagggcuuucugaugauccuguguggaucuagauaguagcuugaucuguacgaaaccccagagaagaaaaaguaauagaccaacaugaaaaaaugagacaaagaacuguccuguggucauaucaccaucuguggagugcccagagugacggugucagcaacuggcuuuaacaucaucagggcuagauguagguaaugaagugugauuucaggagagggccuccucccugccaaaggaggagcauguguguguguguguguguguguguguguguguguguguguguaugugcgcgcgcgugugucuguguguaagagagggagagagagaaguacccuaggccugcaaaugccacacagacuaugaggaguagagaaaaagaauccuguccauaaagcaaaagcagagcuuaugaaauugucagauaccaaaagaauuuagaacugcugcaauaguauuucucuugaucuucuuuauccagaugaaaaaccaguuugaucaggauauccuuaucagucacugggucuggccuucauaauacgauuucaaauaaaguaacaaacguaauaaaaacacauuucucaauacuuauaucaaauuaaaaguauauuuuaagaaagagauacauuuuguugauaaagacauaguaauucucccaauaaguuuuuuuuagaaguagauauuuuuaaacagaaauaucugcuucaauuguuguugugaaaauaaauccuucuuuuauugccauccucauauauaagccgguauuuuagugguaaaaacugugcugaggaaaacacacacguagcacauacuuucaaacaaauuuuaccguagcacauacuuucaaacaaauauguauuuaccguagcacauacuuucaaacaaauaugucagcuuuuuaauggucugggccaugaugccgaacuuggggagaaaagaaacauagcaacuugcccuucauucgguaaauacaggcagcagggaaagccaggaagccagagcugcugacuuaggggggugguuguggagggaacugaagccaccccaggacucauuacccucagcgugugugucugggccaggaggaguugagcuuggccaucuccuccagcccugucauguucaagucuaggcauuaggaucugagggugagguugggaggcucccacaucaacagaagcugggaugcugaucagcaacucaugaaccgaaaccucuacaagugucgggcccuuccggugauuuguugcacauuaaguuuguccggcaggguguucaccuggcucugcagaaggacacgaaagguggacaucugcggccaucaaugccaccuccuugugaucccccuuucucucccuccuguggugccccacugugaggagcauccuucccauccgcagugaaacagagaucuccagauugcccaggaaguuguuggaaggauugcacauuugcuucucccuuuauuguguacuccuucuagaagaaagagccuguguuuuuagcuuuuauuuuauuuuauuucucuuauuuccuggaaucaagcauugagcuuagucggugcucaguacagcauugaugacuaagcaaaaagaauccaggcaagaaaauaacuaacuaccaccaccgcccacccccgcuagcaauuucagcagauucugagcauaaguaguguggaguugaaucccccaggcaauaaccuagaagccccaggcaauaaccuagaagcccguccaacagcugcccucaucuccaauuccaugggguuaggacccgccuccgugauguuucugaaaaugcauuccuccuccgggcugauuuccauuccacaggggcccagugcccuggucuuggugggcccucagcgaccuaccccacacagaccaauacuuucucuuccugguuccuuuuacuguguucccugcuuccaaaaauccaagcaaagugugugcauuagaaacccuucauucucuuucaucaaaggaaccuagcgguuucugcauuuuuaaacaacaagaaaguaaaucaugaacuuuuacuuggcuacauagaucaaagauucucuugaagguccaagugaucucaaauuauuuuuaauuauuuauauuuccagaucugaauaaaagacugcaaaacacaccccaaaaguuuucuguuuacuuuaucaacccucagcaccaaggcagccaugaagugcuuuuuguucuuuucucccuucauggccauaccaccaggaagguggucuuaacaugccaucgaucauaucugaguggcaaauguagcgcuggcccggccagcccagcacauaucgcugugagccgcagugacacacauucauuuccgcuggaggcagcccuagggaguccggcggcccugcagcuguauuucaucucuuugaacuguauggccuccccuauaauucaggaaaugaguuuacucuaucugugacaagcaucauguucacacaguuuugggagcggccagcguggugcagggcuguaugggaauggagguggcaggcguuugccaacccuggggaguacaccgacgguacuuccucucccacugccgagugcuccacuugaccgugacuuucggcacaccuguugccugagaaagugugcuuuauccccgugugcugggaaucucuggcuguaaucuaaccugagaugaguaagucaguuucuuagacagggcgcuucuuaaaacagcaaggccucucaguugaucaccacucagcuccccugaagcuguagaacuggugccugucuuuuguccaugcuuauuuuuuuucgcugguaaacuuuggccccucuuuugguuguuauuaaacuaguauuuguuuggugcacauaaucucugcuggaccagguuaaaacaagugcagauuguuaagggaagagggcucuggucagcgcggagugugcauacacucggaucaaggaaaggaaugccagagccagcccagcaucaaaauacacugcaaguugguggugagcuuuuguuauuuugcguaugguuaaccaucucggaggucauaaagcgaggccucuguccuccggugcagcagcuggguuuauacaguauuuccagauuguuuauucuggcccagagccagggcuacaucguuuuuccauuaugcauguuugacagaugaagagaggugggaagugggacucccaggaacaggucugugauuuccuuucuauuuacauuaaagggacuuuuaggaguacugaagauuaugaaccaguucaaacauaugucaaugcagcagagguagagaagcugcuauguuugcaaaaaauguucagaucuugggcaguaaaacaaaaucaaagcaaaaucuugggcagugagcacaucgugcuugucacugcccagucuugcaugcagacagguuacuggcgagugauauuuaucauucacauccagaaguuaagcuaguguuuguuuggcagggcauugggaggagccccugaguuggcaaaccagaaucugugugcaauccacugacauaugcauuucaugcagaugggugugccuggugccgggcagagauguguuuccaaggucccaguagaacuuuuucccugcagccuuuucccugagccaccagcuuucuguggauacucccaaaagcccgggcuaaguucuuccaccaggaaguguucaagacugaccaaagagccacaguucacauuguauccacagcaaaguccuuggcacauaggucaaauggaugugauugaaugacuguuuuccuucuaaauaaaacacuuucauuuugcuaauggagaaacaucacuaaaaaguaccaaaagugauggcaaauuaaguaacugaccagcauucauacagcaaagucaggucacacaaauaaaugucuuuuuacccaacaguguuugaaucuucaguuaauggcugggguaaauaucacacccagcacaaauucauuagcugcaagacgguggcuucuacauagcuauuuguguuuguggugaaccuuccuuaucauggcaugucuuaagcuuggcuaaguauuugcaagcguucugucaccauaacauaauguucuucaacagaguggcuaagaaaagcaaauaccacuaccucuccagaacaaccugugauccaaaccuucucugucagccuacuauccagaaauucaauuuccagaaauggaaaguuugcucaggaaggacccucaacuaaggaaggaauuuagcuaaaaagugaaguaugcauagucaacacugaaaguugcccuuuggguuaauccagucuugcagauggauuuaaaauacagguuucaaaucaacaaacauuuauggagggugguuaggugccaggcauggagcuggacacuggggaacuaaaaaugaaaaagacacagucccuuucagugugaaaacauuuuugcuggcuugcaaguuuuucaccagauccucccagacuuaccaaagcauuccccucaucuuagaacacucaagcccuucuuuucaauggauucccugaaugccagaauacacacagggcaaggagaagugggugguuauagauuuccacucaauuuggaaauuaacagccugugguguagcaaaaaggugcaaggcugagaaucagaaagcccacuuuccagugcuuggacugaaauguccuggcuguacagccuugagcuggucuugugaccucuggggcccuugguaucuguaaguaaaauggguacugggaagauugagcaagguagugaggggcgaugugaaagcgcauuaauccacagagcccuaugaaaaugagagggaugugcuucucugcaggacuuguaugagaaguugcacuguucgggcuacuauuuguaaaguuuuaauaauacagaaagcagcccccuccuggccucaugccagguuuuauucucuaccaacauuggguggccaacuacagauuuuuaugucacugggggccagcuguuagaagaaucuccacucaggaccguaacuacucuguagugucccugccacucccuccccagggacagcgcagagccuggaagucuaucccccuguggcccugacucuauggcugauuggacaugucuauaaagaaaaaacaaucucuauuguguucuuuaaauagaaagcucaaaguuuguuuuuuuacuuuguuuucccucuucugaacacuucauagcucaaaaccagugccuauuuugaggaaauuuucaauaguuaucauaaaauuaacuaagggaauuauuugaccaaucccuaaagguaauaagaaaaaacuuuuuaaaaaaauaucaaaaacauccugaagccacagcuucuuuuugccaaaaaguauugaugaauuaaaguagagaggcagaaaaaugugccuugccagcacuauuggucccaaaaggcaaccaaaccacaaaguuaaacacugaaauguacagaccccagccagaugggaggguagacugcuucucgcuaaggacccagcauuugugggucuccuaggaauuucugugaaacuccuucagauacugccuuugugcccagcugucugucuccaucucacagacacagccaagccuuccuugaaucugacagcacccucguccuucugaugguuucuuuuguucccucaagaagccuguacagaggagaacuguguuuccccaggugcugagcuguggaaauacaaagauaaaugggguaucgcuuuuguccugaucacucaguauaaaaagccucuuuggaagaacagcuaaaugaaaccugguggagauguuaagaauaaaaucuagagaaaauuuuuuaggagguggauagugccucagaggccuccuaaaaguuuuccaucucuugauugaaacacacacagaaucuauacucucagacgugcacacacagcacauacggcaaaucuucaugaucuuguaguaaguaugaaagacccaacuccaugcagaguauuuaagauaagcccaauaagccuggucucccuggugaggauuucugaccaaacagaagaaauguugacuccagcaaaugaaucagagugagaugcccucucugcccccauggugacaagccuugugagcaggcaucucccuuagacugugagcuccauccacucgucagcaauguggagaguuaagaaccugggcucauuagucagacuuccccacacccaacuucgggcuucaccacuuaccagcugugugagccugcacaaacuucuaaauuccaaugccacagcuuuaaauggugauaauaagagaccucuacagcacugggagcuuuauaaggauuaaauguguguuuagauaucuuacaauucuuggcacagagaaagcucucaaagugccaacugaugaugaugaugauggugaugaugaugaugccccauucacugcaacaauuccugugcguggugcagaauagcuauucaacaaaucuuugcagaaagagggaaggaagaugauauugggcacaccagugaggccuaauugaagccuugauuuugacgagaagcacuuacucucuagguuuaugaaagccugaauuuuagaaucuuuaaagcagaagcauaaaacucgacuuucuauaacagccagucagguaacauaaaagaaugaaccggcauuuagagucugaggcaaacuggaaagcccuggccucuuucacgggggcagucacacuuggcuccagaagaauguagccgcccuuugagaaaagccagaaauccagcuuuccaugugaaauagaccaagccuuacaacaacugaauccauuucuaaaaaaaaaaaaauaccccacgggccaaacaacacauugccugccaguccgaucuugggcugccuuuuugccacccugucuuaaagggaggagcucuguauucgucucuuucuuuuaaaauguuuaucagugggcacaagagacaugagccccuugaaguuacucucaguuccugcuaggaucagagaacgcucauggagugaggucuucacuucuucaugguuaauccgacaguaugugcucaccuaacgagggcuucuucccuucccaaggaaugcuacuaauaaguauagauuuuuaaagcauaauuguuuuguggcugaaauaacaacaauuauuugaaaaaaaauccuaacaacuuccucuagagcugcuauuauggcagucuggagagaggcugauuccauaguccauguagcuuuguuuuguuuggauggaaagucuggcauuuuacaaaaauguggaaaacuuagcaauggaaugacuuuuccauagcaccgauuaucguacagcaagacacacauccauaugucuuugaaaugagauuuuuaagaauucucugcuuauuauacaagacaaaccaccucuggucuuuccauaugaaggugauaguuuucuacaggcucaugaaagcugcccugguuauggugcaguacuuaaaguuagggaaaaaucucaacauagauggggacccagauucaaauucguuuuuucacuuaccagccagcuaugugaccuuggguaaguuucuauuucuccaucugcaaaagaggggucaugauauucaccucacaggguuauugagaauaucaaauaaaauaauguauaugaugauccaaacucauaauggguguuccccaucaauauugguugaaucugagucucuguuucuccuggcacaaaauagcacuccuguuucugaccgcgacauaacccucuggcaaugucauuaaccuuauuaaauuuggcagcucuguggaaaacgaaggucaaaaaagcugucauuguuuauauaaacuguucauuuuguuguucacagugcuaugaggacuaaaggauagaggguuggaugcugccacccagggaguaaccagggagaagggaagaggcuggaacagagccugaggaggacuggucuuuauaagacaggcugggaaagaggagggcguagagaagauggaaagggagugaucagagagaggugagggugccaggaaaacacuguugcagaugcagggguuucaaaauggaguguguggcccacagugugauggggucaugcugugaggcgcccucugagcuaccaacaaggaagcgagaguaacugaauggaguacagaaggaacagaaagcagguuuuggugaguucagucacguacguaagcugaaaauguuacaacaaauguagacagcucuucaggaaguugggcugugauggggaggagagagaaaagaugaaagagggagggugcaugagacaaggguuuuuucaagaagggaagugaguuuugauggcaaggagccaguugagagggagagguugacaaugaagaagaggggguggaugagggagagaaggaaacuccaaggaggcaggguggguagacaaaugaagcaagaauuggauauuaaugcaaaacuagagcuuggggaaacauuagaucccauaagaaucugccaaaccagcugauacugacccucauguuuagacgggggauuuagggagggauuaagaagaguaaggaagacugaaguaacugaaauacacgagacaaucuguuguuauuggagggguaacaggaaaagcuucuccuccacccucugaagcuuacuugaaaaugaacuuacaauaggcagauuaacaggaaaaaaaggaauaaaauuuauuaauaugcaugaaacugagcaugguagcucacuccuguagucccaaauacucaggagguugaggggaggaucgcuugagcccaggaguuugaggcugcagugagccaccacugcacucuagccugggcaacagagcaagacccuaccucuuaaaaauaaaaugcuacacaggagaaaaucacaggagagugguuaccucauaacccagggagguccagcuuuuuucuauaccuuucuucauagggaaaggggaaauggagguuaaauguggcaauuuugaagaguaguaaaugauauuuaaggggaaugaaugggcccaaugcucagacaauggaagguaaauaauucucuuugggaacugaaugggacccaagaacaggcaauaguuugggacaacguucaucugagcucugagugugguguuuaaucuucagucccuuccucugugacaugaguuuugaucuucucugauuaaugaaauuuuaggggaggugacugaaggcaauuuuguuccucuuuggcagguccaauuucuagguagauaagggaacuucagagaacagcuucauccaggauguacuggucuccaauggccuucaauuugaaauaucgccauaccaaguugccauauuuggcggucacccucccuggauccuuaacuauucaagaaaggaucuuuuaaagcucuugccuuguagccaaacaugaaaaagucccccuucccucuugucuuaaaagucuguccucucuguggaguguucuagcaaacauagggcugggccuccucauguucugacuagcacuaucaaauagccaaagcacuuuugucaggcugguaaggugacaugcaauuaaaauuugguuggaaaggcuaccugggaucuuaucaaauaucaaucuuauuaaagaccucucauuacuguauaaaaguuggauaagauaugucaauguagggggcucugagugaaaucauaagagccaguacuuuccagucauagagucgauggagugcacugggauuuuagaugcugguuaucaccagaagucugucguuuuccgaacaugguaaauacuaggucaauuucugccugggauagaauguuuccuacuggaaacacaaaauuacaaguuuaaucuaaauaaaccaccaggacgcaguuuuaccucucagguggaacucugcaaauagugguuguuggggugguuuucaucacugacucugaguauuggacccagagaugaucgugcccaauuuuuuuuuaaucggcccuuuucuccucccaaacuauaaagccauuagccauucccuccaaaacaccugccaguuuccugugagaucgguuguuaaguuugggugccucagucagcaggaggaguaguaggcucuaggccuggacauugaccauuaugcucuaccacacugugaagaaaggugugagaagcaguaauagcccucucaccuguccacaccaagaaacaacacagcaaaagcacagcagcugauugucaugaggagccuccuaccucugccacuuucuggcugcaugaccuugaaugaguuauagccuuggccucaguuuccucauguauaaaauggcucuuccaucaagggguuauugugaggauuaaguaugauuguguguacaagugcuuagcucagugcuugcuacacauuaguucccauuaacuguagcuguuacuauaaaaauauaccacaaagcauuaggcucagccaggacugucaccaucucgcaccauaucaguuaacuaaucgugcaaauauguccugguucuuuucacuuguacuugaaggacacaauaucacauuuuauugauguauaauauuuuacauauuuaugggauauguaugauauuuuuuuccaugcauagaaugugcaaugaucaaaucaggguguuuaggguauccaucaccuugaguauuuaucauuucuauguguuaggaacauuugaauuuuuuuuucuagcuacuuugaaacauacaauacauuguugcuaacuauagucacccuacucugcuauggagcaugagaacuuacaucuucuauauaacuguacauuuguacccauuaaccaaccucucuucagcccgcucuccaacccagacauccuucccagccucugguauguaucauccuacucccuccuuguggucaacuucuuuagcucccauauaugagugaaaauacacgaucuuugucuuucugugccuagauuauuucauuuaacaugaugaccuccaguuccauccauguugaugcaaaugacaugauuucuuucuuuuuuauggccaaauaguauuccauuguguauaauaccacauuuucuucauucauucauugauggacacagguugauuccauaucuuuaccacugcgaauauuacuacaguaaacacgugagcaugcaagugcagguaucccuuugauauguugauuucauuuccuuuggauagauacauaguagaaggguugcuggaucaugguaguucuauuuuuaguuuuuugagaacucuccauacuguuuaccauaguggcuguucuaauuggcauucccaccaacaguguauaagaguucccuuuucuccacauccucaccagcaucuguuauuuauuggcuuuuaauaauagcuauucuaacuggaguaagaugauagcucauugugguuuugauuugcauuuccuugaugauuagcauguugaguuuuuucauauaccucuuggccauuuguaugucuuauuuugagaaaugucuauucggaaggauauaaugucacuuuugacagaguuauuuaccugcucugcccauccaccaacucccccauccuaaccauagaggaaggcauucagggaagagaguuuuauugucaugaacuaggaguaaccuuauggcaguugacccagucaccuaaucguaaucaaagaaagaaauguauaaacccauuaugcuguaacuuuaaagaauauucccaaaguuuuucuggccugaaauuaauaaccauuuauauagcaaaucaacucaauccauuauauagaccaacauuuugcaagugauugaagacuaguaaaaugugauugguauuucucagauaguuuuguagucaagguauuuauaugauuacacuugcuguccauuguuuuuaggaaauuacuguuucaaccuuacgacaaagagcuuugaggcugugaaauagaacagauuuccaaauuacuucuuuacaaggaucuaggcucccuuuugcuuauccccuuggauccuuugccagguugggccaaauaauuuaaguaaugaauuuauuuuaaaucacaggagucuuacuuuuuuguguaucagauaacaaaacccuacacaauguauagugcucuaagaggaagggauugaaggaggcuuucaaugagagaauuauuuuuccucugccucucaauguuugacuuaaaacucuuuauuucuugucugucuuucauaagauuuuuuagcucuguuuuaaaaaacaaaaaggaacaccuaagaccugugaacaaugacccgccccagauuagcuagaguucauaucuucagagaagacagauauuauaaaauguucuguuaggaacccauuucagaagagucuaugccaaguuauuuaacagaaauucuagaguguucaauguguguuauguuuuuaauuucaaugaagaccauguuaucuauuuacaaggaucuaggcuccccugugcaaaggacccaaccuggcaaaggacuuucaaaagagucaguuugaaaaguaauacccuuauucaaugaggcuguuggccacauagagaauuuauuuauuuuuuauuuuaauuaauaccuaaugggguacaugagauguuuugauacaggcaugcaaugcauaauaaucucaucauggagaaugggguauccauccccucaagcauuuauccuuugcauuacaaacaauccaguuaugcucuuuuaguuauuuuauuauuauuauuauuaauuuuagacagagucucgcucugucgccaggcuggagugcaguggcgcaaucucagcucacugcaaccucugccucccggguucaagcaauucuccugccucaggcucccgaguagcugggacuacaggugcaugccaccacgcccagcuaauuuguguauuuuuaguagagacaggguuucaccauguuggccuggauggucucgaucucuuggccucgugauccaccugccucguccucccaaagugcugggauuacaggcaugagccaccauacccggcucuuuuaguuauuuuuaaauguacaauuaaauuauuauuggcuauagucacccuguugugcuaucaaauaauaggucuuauucauuuuucaauuuuuuuuguaccuaugaaccauccccaccuguccccaaucccccacuacccuucuuagccucuacauagagaauuuuucaaauuccuucuuuagaauugcuacugaaggcuucagaagguaccucaaauauccuaaaaauugggaagucuauguccuuucagaugagucugauuuuggaaauagccauuuggaacuguauuuaguaaauuauauaccuauucaaauuuguugacaaaaauuuuagucaaaagcaagauuauaaaagaaaaugugagggcaaaucuucaugaccuuggauuuggcaauggcuucuuuaauaugacaccaaaagacaggcaauaagaagaaaacagauaaaauggucuccauuacaauuaaaaacuucuauaugucaaccuuggauuuggcaauuuuuuuuaaugugacaccaaaagucaggcaauaugagaaaaauggauaaaauagucuucauuaaaauuaaaaacuuuuaugcaucaaagaacacuaucaacagagugaaaagacagccuguggaauggaagaaaauauuuguaaauuauauaccugauauaugugcagauuaucuaaaauauguaaauaacuccuucaacucaacaauaaaaacaaacaaaagcaaacaaaaaaaaaccccacuucaaaaaugggcaaaggacuugaauagacauuucucuaaagaagauauacaaacaaacagcauuuguuggacacaugcuugucaaaaagcacaugaaaaggucauuagaaauuagggaaaccauuagcaucagcaucacuacaggagucauuagggaaaugcaaaucaaaaccacagugagauaccacuccacacuuacugggauggcuacaauuuuaaaaagggaggaaaauaacaaucguaggagagaauucgaagaaauuggaaccuucacacauugcugguaggaauguaaaauggugcaaacacuguggaaaauaauuuggcaguucuucaaaacauuaaacuuagaauuaccgcaugacccagcaauucugcuccuaggcauauacccaaaauaaguggaaacagggacucagauacuagaaugcaaauguucauuauaauaagcaaaagauggaaacaacccaagugucucuccaaggaugaaaggauaaacaaauugcguucuaucuauacaauggaauguuauucaaccuuaaaaggaaugaaguucugggccaggcaugguggcucacaccuguaauaccagcacuuugggaggccgaggcagguggaucaccugaggucgggaauucgagaccagccugaccaacauggagaaaccccaucucuacuaaaaauacaaaauuagccaggcaugguggugcaugccuguaaucucagcuacucaggaggcugaggcaggagaaucacuugaacccgggagguagagguuguagugagccaagauugcgccauugcacuccagccuggacaacaagagcaaaacuccaucucaaaaaaaaaaaaaaaggaaugaagcucugauacacacuacaacauggaagaaccuugaaaacaugcuuagugaaauaagcuagacaaaaaaaggacaaauauuguaugauuccaccuacaugaaguacugagaauaggcaaauucauaaagauagaacauggauuagagguucuaucuaaucgaugggguaaguagggugggguaaggaaaggaaaggaauugggaguuauuguuuaauggauaucaaguuuuuguauagacucaugaaaggauuuuuaaaacaguggugaugguugcacaacacuguaaauauaauuaaugccacugaaguguacacuuaaaaauaguuaaaauuguacacucuauauauaacauuuucaugcuauucagcaaugaauauaaaauauauuuuguuauuaagcauuaguauaaaauuaagcauauuuuaguuguauauauuuuaccacaauaaaaaauuuaaaauuuacaaggguuaaaauuauauuuagacugggugcaguggcucgugccauaaucccagcacuuugggaugccaaggcagaaggaucucuugaugccgagaccagucuggguacauggugagaaccugucucuacaaaaaauaaaaauaaauuuuaaaaauuuguaaauuauacuuaagaaaucuggcagcccuuccuuuccuuuucuggacaaaugcauuguugaaauaguaaaauggaaauggauuuuguaucaaauuaaacuuuaugucaauauuuuaaaacuuacaaaacaagauuauuagaaagugguuagacagcucuuccaugccuccuucugaggguaaagcccuuuucugguguaucaagaaauaaaagagggaaaauggauagauucugcuguucaaaagaauguagaacucagaguuaacaauugaauuugguccaaucgcaugguucacaucugaugaaaggaaauuugauagcuugugcuucgucaacucauguugacauuaacaccuagaguugguaaguguuuccaaauauugucaggaacccuucuucucuucuaauacuuggauaugcaguugcuuccuuaggugcuaccagaguuguacagguaauguggguccucgccgggaucccuucuaagcuacugcaaaugauggcucaugugcgaccccgguucucuuccagagcacaggaagcuuggaaacaugacugugacggugaagaagacuguccccucuccugaggcugugcagauccucuaccagcggaugagauacgaguacgaguuuuaccacuacgucaaagagcaguuccaccugcugaagcgcaaguuuggacuuaagucucacgucagcaagcccccccugaggccacacuucuuuaucccaacuccacuggaaaccgaggagccaaucgacgaugaagaacaggaugaugaaaaguggcuggaagauauuuauaagaggugaugugacuguguugccucuauggcuuuaucucccuuuuccagaaaguucuuuguuuggggaaguaaaauccuuaagggacuaaauuaaugcuugggugcauuaaaaagaacaaaacauucccacauguuggggucauugggagaugcccgguuuugcggguuuuauuuguuuaauuuuauucuguguuuucucuuggcucuuugggucuuucccggguacacuagauggcuccaucccaaggcaucuugucauaaaacagcuuucccccaccccauaucaugggaaaagggggagaaauauagccccuagccuaauaacuuaucauuuguaaaaugacuuauaaaaauauuaccucaaugguaggagacauccagacuuguauauuucaguggaaauacaaaaccacuucagagaccaggguaucuccucuggaaggaucuaagagaagguaagacagauuaggacaucgaaaaggaggauggagccaggugccauggcuugagccuauaauccgaggcugaggugggaggaucacuugagcccaggaguuugagguugcagugagcugugaucacaccacugcacuccagccugggugacagagugagacucugucucaauuaauuuuuuuuuuuuaaaggaggaggaucuccauggguaagugguuucuacccgcauggguagaguucugccucugguccuucucagggggcacuuucaccaagagcaguguaauuaucucugaaagagcaagucagcuugugccgcauccccaaccaauccacagccuggaguaccuuucaaggucaaagugcauggccagcuccauugagacauuccauuucaaagcaccgugcugacagauaucaaaguacucuagcagggaaaauaauuuguuugcuguguaaggaagaauguagacaagacagauaaaucugaaggucauguggcaucagggaaagggcauggcugugucuuuugcacccaauaugaaacaucuucucccaacacugcuuuaauggaaguucuaggaaccaauuuagcucaggcauuugacuccuacagcagaaguucugagccugaccacagaugguguguaaucuaucaaacacaccccuggccaaguuggguccuauaggaccugguacuauguacuauuguaacuucuaguucccuaagagguaccuguuuucaguaaaaagggguccugaguucugugcagguggaagagcuacccgagaacuaccugaguucugugcagguagagucccauuucuuaugggaccugugugcuccugagaacucuuacuugagacaucaaaaagaagcagcaagagcuucugggacagagacugcuuggccagcuuuguaaguaaguggcugccuccaaugugaugugaguacauguugggcagucucacuguccuaagguaugucuucuuuccaccucccacugccccuccccugccaccuaucaaugaugccuugguucagucauuagaaaucuguugcuuugaguucugaaauauuuucaccuuaaaaaaaaugcugaaaauacacauucuccugggaagacgauaaacagcuagcuaagaagccgagguucagugguggcagcaggaaggacacugccacaaauuuugucuauuucauauuuguccccuagagccagcccuagcaaaugugugaguugggaguaguuaauaguaaauaagacucugacuuuacacaagcuacacauuuuauacuuuucauaaaccacaaagucucucuagaauuuuuucugccuucacuaaaauuggacuguagccaagauauaaagcaagucauuuggaaccugccgagugagcacugaagcuacuuuaucaugagauguguguuaagaaggcugcagcccacaggaguccagggaaggcggggaccacagaggcacagaguccagcacuuggccgcucaugggccuucuuucugccucagaggacgggggcagagaagugaugaagggaaauguucuuagaggaggaaauauccuuuguccuguucagagagaccagggcccuaccauuaggcauacuuucagaagcaaccuggagaacagcuaucaaucauauucaaaaccaguacaagaacugcugccugguacccugugagucauuucuaugaaauuccauauaaagaaugaugauaaguuuacacacugugcaaucucacaaucugaaaauaaaguugaguuggcuguguuuucucugcucuugucagaacauugggacaauuggucguucaaaaacauucauccucuuacugcaaguuuaucuggguacuuuuaccuguguguucaaaggcauuucuuuucagcagugaucauuauaacuucacaaaaaaagaugcugacggauuuacuuacagggccuuaauguuauuuugucccagccaacacccucuagguccuaaaagucaagguacuucaguuuauuuggcaaacaugacaacauuuuuuuuggcccugggcccaacaguuuguacuucaugaaacauauuguacauuuuacauaguuuaauuuaaaaaauaccuuuuaagcuaguugaucuuugacugucuuauuuauuauaaccuuucagcacauuccaagguuuuaguuacucaggaaggaguuaauuaaaaugauuuuauuuuggucugauggauguuuuuuaaaaggaaaauuauuauuaugaaccuucagccuacuuucuugagugccguaaaagugcuuguaaaucuuuuuuuuuuuuuaagaagaaagaaaaaaaugguguuugacguugauggaaauucaaaaauauauauggaacugaaacauuaacuuagcuaaaauaaaagcaaucuguguuuga

SEQ ID NO: 192121 - RNA, 17072 nt, Homo sapiens
agcaaagccgucccagcuggcuuugggguaaugcuggccuuaguuaugcugagcgaugcagcccuccugaggucauucggaacgcccgggagaguggccacucccgccccagagggggaaggguggccgguuuccaaguccgacuuggucaggugaccgcggcgcggcauacucagcggcagagacggaagaacagcgcucccgaggccgcgggagccugcagagaggacagccggccugcgccgggacaugcggccccaggagcuccccaggcucgcguucccguugcugcuguugcuguugcugcugcugccgccgccgccgugcccugcccacagcgccacgcgcuucgaccccaccugggagucccuggacgcccgccagcugcccgcgugguuugaccaggccaaguucggcaucuucauccacuggggaguguuuuccgugcccagcuucgguagcgagugguucuggugagugcgcucccuuuugucucgucugccgcgcuuuuguccccacccgcagccuccagccaccacccagcgggccugguucgccgccuggugcugccugcacccucgucgguuucaccucccacugcguuacccgcguuucgcacuuccgggugucgaauaugugguuuccugccuaagugcuucugcuggaugaacagggaauuuuucuuccgugugacuguaagaguuuucagauacuccugacuccucagcuucuucauaguugcgcauauuaagcuguaguuaugacacuacaacaucgagcuacuacagacauucaucaguuugugcaggggcaucacacgagcggugacucaggcacaauggccuaugguugcucugcugcuaccugccaauuuacagucguucugccaugaaguuaugguuaaaacauagucaugaguaugugaaacgacuguucauugaacaccauuggcuacuuaauguuaacauguuacccauguguggcucuaggaacuuuuuaaagagguucuagaaugguacucuuaacacaacccaguuaucauacugccguaugaaaggugcuacacaaaaaucugugcguuagauuuuaccuugagaucuaugugaaaaugugcauguaauuucuuaaacuguugcacaugucuuuucugacuaaaugcuacaaguauuaaguccuucaaaacagaaauauuuugugugcauauauagaaacauacacauaauauauucuuuuuuuuuuuuuuuugagacauagucucauucugucacccaggcuggagugcaguggcaccaucucggcucacugcaaccuucgccgcccggguucaaacgauucucgcgccuuagccuccugaguagcugggacuacaggcgcacgccaccaugccuggccaauuuuuuuguauuuuuuaguagaaacgggguuuugccauguuagccaggcuggucuugaacuccugaccucaggugauccgcgguggcucauaccuguaauuccaggacuuugggacacauaauauauucuuaaguaaaagaacggaaucauuaaacaguauuuauuugaaucaacuauauacuacauaaauaguauacauccaaauuaacauacuauauuuaguagacacaauacagaguaugaacuauauauuauauuaacauuacauaguauacaugguaccaugcucuacucuagggguagaaaaauuacaccuccauucuguuagggucucugcuggguccaagaauuaaauugacauugugugacuaaauuauguggggagacuuaaauaauaaauuuuagcaaguucuguacaguauucuacuucuugucuuugaagcuuaggauguugccuuuccuucuaguacagagugccuuucauacuggaauuucaucuucucuccuaagaaacagcacaaagggcaaagugcucuucaugcaccugcuauuuuucgaguuucuuuaccuuuaaaaaugugccaaaauagcauauuuuaacccuuucaugacaaagaaauugacuaccugcaaccaguaaccuuucuuauugguaggucaauugauguaaaaaauaaaacuggauaagcuauggagaauuauucauauuuuaaauaauucaccuucuaaaacagagacucuuuauucuuaugccaaaacauagcuacuucaaaaagauguuacaaaucuuuauuugcauguuuugggcuguaaggaaucuugagcuuguuuuggaaauauuuuagauuagugugguacauaauuaacaacuuucuucccccuaaauuguaucuuauauuaucauuuuguucaaccaugaagauuagguaaagauauauuggugccaaagaggauuugacauuuuugacugagacuaguacuaugccaaaauaaaacagcuaguuuugagucauuuuauucuuugcuaugaauaacuucauuuucuacagauaaacccaugguuauuuugaccuagaauaauaaagauacuucucauacuaaacaaaauagagaacagauuccugaugaucugaaaaugcauuaacccuguggaagauucuuuaauuaccugugauuucccuuuguauccucugcuccucacucucaauuugacuuucggggaaucaacaguauagaugaguauaugugacuguuuuaaaugucuauuaaaaaccaaauauaaaugauagaccuuuaccauaaaugccucuuuucaucucucagcaugaaauucaagucuagacuguaggggacagugcagguucaaauuagaugaugcuaggagaaauuccuuauucuuguucaacuuucugaaugucccaguuucucuuuugcaguucaauuuaaaauguaaugcccguagucccagauacucaggagggugaggugggacgaucgcuugagcccaggaguucaaggcuguggugugguaugaucaugacacugcacuccaaacuggguaauggagcaagacccugucucaaccaaucaauuaaucaauaauaaauaaauaaauaauaaaaaugcuucaaggauuuuaaacccaacuaaaagguauaaugauaggggcuuguuaucucacauaacaggaaauuuagaguagucgguucauugaugaaaucaaagacacgggcucuuucuuucauccucagccuggggacuugucccuucauggucacaggauggcagccaggcaccauaacuucacacaacccugcccaaaggcaggaaggccagugucucuuuucauuaggagggaaaccauuuccacaguccccaaaguuggcuuucccucaaguucccuuggccagcauggaucucacaucccugucgcagcuguaguggaagcugggaaauuacguaaauacgacuuuugggcaggcaaacagcaugccugccgcauaguaugcccuucaauuauuucuucuuagcagagucuccugaucgucuugggaaauauagugcugauuauggauuugcuuauccuguagaaauacucauaugaaaggaauggugauagaaaaagcaggaggugggucaaaaauggggguugcaucuauuucaugaggauaguuacugcuguguuuaucuaaaauguguagaugugcuuuuccucaugaagucuugcuuacgcaguuuagggucaauauaccauugcuuagaaugaaugcguauagcaaguaauuguugaagguugaguccauuuauuaaaauaacagcaucuuuuuaauuuuacuuuugccucccuuucuguccugugccuccaaaguguucucuacuacugaauauaauagaugcauauuauguuuuaggcauguagucuuccuuuuagaagcccuaaucacuuauguuacaagggacaauguguaaagacauauacuacauguugugauuuaaaagugaagaauuaaaagagaauggggcuggacacggugacucaugccuguaauccuaacacuucgggagacugaagcaggaagaucgcuugagcccaggaguuuaagaccagccugggcaacauauggaaaccacaucucuacaaagaaaaaaaaaauagccaggugugguggcacgugccugugguccuagcuacucaggaggcuaaggcgagaggauugcuugagcacaggaggucaagguugcagugaaccaugauuccauuacugcauuccaaccugagugacagagugagacccugucuuaaaaaaaagagagaauggguagcugaguugccuagaaugcucuaguuuaugagcugaguggauaucacagggggauagguggaaaaugagaggggguuuaguuugcauaagcuaucuuuaaagccaagucaaacuaauggggaagugagaaagagaaucuggguccuaucugugugagggguaaaugguaaggggagcuggagcaguucuuuuaaauauguguguaugugcuguuuaugcacucuuuccuuuccuccccuuaggugguauuggcaaaaggaaaagauaccgaaguauguggaauuuaugaaagauaauuacccuccuaguuucaaauaugaagauuuuggaccacuauuuacagcaaaauuuuuuaaugccaaccagugggcagauauuuuucaggccucuggugccaaauacauugucuuaacuuccaaacaucaugaagguaagucaauccagccuauggaaauugcugacaaugguuaagaaaugaaaaguuguucuuuuggaagaaaaaacuaaagcaaggucuaauuuucucuucggagcaaccauaaguggugacuggcacuugcuuaugacuuagggacugcacauucaacccaaauugagagauguuaggaauacagaaaggaucauacccgccacguaacagaggaaagauggucacguuuugucacauguauuuugaacaauauuuccaagauuuacuuaaagcuguuuguugaagggaguguggguugcaagucaaaguucaucuuggaauugcacucuuuccuuccccuucucuguaaugcauccugugaaugcaucauggggauuauacugcuauagucuugcaucauuacgacacaccuggcugcacuuuuagccaacucuuagcuggccaaauggugcaaauaguggaugaacugauagugaugaaagugaugaaagugacccagaucaccuggagggaaaaggauuguggaacuguaaugguuuccagaaaaaucagaggugguagaagaauaucuaaacccccacacauuuaaaauccauucuauuuuaauagaauggauuccacccauuaccacuccaguauuuguaaggccagggaagcauuaacaaauuguuuuuguuccaacggcuuguucauucauuaguuucuuuugcaugaucaucuuugccuugguauaaaaaaauuugcacuggauguggucgcucaugucuguaaucccaaaauuuugggaggccgaggaaggaggaucauuugagcccagggguucaagaccagccugggcaacauagugagacccugucucuacaaaaacaaacaaacaaacaaaaacuaaaaaauuagcguagugguaugucucuguagucccagcuacuugggaggcuuagguuggaggacugcuugaggcugcagugagcggagauaggcuuacuacacuccagucuagguggcggagggagauccugucucaaaaaaaaaaaaaaaaaaaaacgggaaacuuugccuuauuguuuucuccagggaugggaugggaauaggagaggagaaccaacacaaaaaaucuggaaugaucauaggauauuuuucccuuuggccacauucugguagcuucaugauuuucuccuguagauauuuauccugcugagaugaaugucuaucaaguguauuugcuugagaacaugcugauuuccugaugucuaggaacuuucccaagcuguauggcacaaaacauuacauagugaguuuauuuaauaaaaauuguuaaucaaacugugaggagagaugauguagcccacauguauacauuuucugggacccauguugucagauguuuucauugcucauggaaaaugcauacuaagcucaggaaggaacgucgcaguguaagcuuaugguggugauauucaaaugaagacucaagugguuuuaguacugucugacauuagggccugucaaguugaguaacuuugaguaugacuuuagauaucaacacugcucugaagcuuaccacagaaaugauaggaacaagagugagcuguuuuaaaaagcuuauuaaaaugaaucuaaggcuaggugcaguggcucacaucuauaauuccaacacuuugggaggccaaggaaggaggauugcuugaggccaggaguuugagacuggccuaggcagcaaagugagacccugucucugaaaaaauagacaaaauuagcugggcgugguggaguacacaccuguaguccuagcuacuugguaggcugaggugggagcaucacuugagcccaggaggucgaggaugcagugagcgaaguucgcaccacugaacuccagccugggugacagagccagaaccugucucaaaaaaaaaaaaaaaaaaaaaaaaaucgaaaguaugagucauucuuagacuuguucuaauuuaccaagaguaaaauguuucaccaaauguaccuuauaaaugucuauucucaaagauucuuuuagauuuuaguggaauaguaacaauguauuuaagucucuaggcacugaugaaauuuuugaggcuuucauauuuauuauguuuuaaguauuucaguuuauauaucucuucuaacauuuuuauauggaacaaucaguaaucuaaauacaaauuccucuuaaaaacgaaccacuucuaaguguuuguauaaagguauacauuguuuuucuuaucuauguaguugguagacuauucacuuuuggguaauuuuauuaaagaggaacauccaagcuuaugauuuuauaguaggaugagauuacacguggugaguauauuuuaaaguauagaacuauugggaauaguagggguuuuuuuuugccccucugguuaaauaaauaaucaggcuaaaagagauuugcuauacguggaucaccaguguucuaagaaucacacuauaauaaaauaaacaauccuaaaacuaagcaguagacuucaagcuuugguuuagaagacacuaagaaucuugcaggagugcaucucaggaucuucauaauaaauagugguagucaucauuuagcaugguacauguauauguucccaucuuaguugugagcugcuauuguugauuguuuauaccuugugcuagcaguuggcuggagacauagcagggagcacugcagacaugaugcaaucccuuaaggaccuuaaaaucuaagagggaaaauacuggagauagaucagaccguacagugauauacccugaaaguugcuuuuaaaaaccugucucaccuuguuuaaauucucacuucucauauaaaagcacaauauaugcuaugaaaaaauggccauaaaacagucauuuguaggagcagguauuuauauaucgcauguacuaugugauuuguuugggcauuuguguggguugaaauuuacuaaaauaaaguugacaugcuuacaaggguuuucacuauaauuuucuaggcuuuaccuugugggggucagaauauucguggaacuggaaugccauagaugaggggcccaagagggacauugucaaggaacuugagguagccauuaggaacagaacugaccugcguuuuggacuguacuauucccuuuuugaaugguuucauccgcucuuccuugaggaugaauccaguucauuccauaagcggcaauuuccaguuucuaagacauugccagagcucuaugaguuagugaacaacuaucagccugagguucuguggucggauggugacggaggagcaccggaucaauacuggaacagcacaggcuucuuggccugguuauauaaugaaagguguguaugcuaugagauugcugcaguuacccuccauauuccuaauauauuucuaacauuuuaauuccuucaccucuugaaauauuucauuuuaagucauuggugguauggggggagaaaaucauuguaaauaauacuuauuagauauaucacuauuuacucaacauaaucaaggguaaauaaaucaggaguaaaauccaacucaauggucugauuuugagaucagacuaaaaaucacaggaucaagaacuuugaagguguuaauuuuguggguccccccuuuuucucuccuacccugguccuuuauggccucuauucugggacaacucuguuucuucaucacuauuucugacuauuugcuucugaaucccgcagacugcuucuuuuuauccucuuaccuuuuggucaucuuugcugcccagccaaugucacccuuguuugucuccucuuuuccuucaucgcagccuuuucacuuucuccaguuuuuuccuauugcuuccugguauguucaaggcugcccuauuagaacagggaguucugauuaaacuccuccauuaggcuuaaacuauauggaccaaauuugcauguacacuagaaagcacuggguauugugcuacgaagucaggcaaccuucugcuugcacuuccugggcccacaaagggcacaaauacaaauauucugaagaacucuugauacuuaaaacagcaguguguccagguacuccuuccaagggaaaaaacugggagccaucacuucaauuugugacucaaaacuguucccucuauguggcguguauuucccucuuaaauaugccaccugcuaugauaagcaauauuguggggauauuucacaugauaucaacagucaaauuuucugagauuuuucaauauuaggcacaaugguaagagaaaaagaaaggcuagacuacauguaugagaucauugaaucauugaaaagaaaagugucuuggguauaaauucaguuuuggcuaccauuuacaauauggaagggagcuuaaaauauucauauaauacucuuaugagugcuauaugugcuggguaccaggcuaauguuuuacauaacuuauuuuuguucuaaucauagaugaggaaauucauuauucagaggagucagguaauuugcucuaggucugggagcuagaaagugacaaagccagaacuccaaucaacucaggucuguuugacuucaaaaccaugggcuuuccacuguacuaugccauggucccuuuucagaauuguauuucaauuacaugucuuuucagugacauuucuuuuuguauaaaaagcuuauaccuuuuguuuuaaaaaauuguauguuucauuucagcccaguucggggcacaguagucaccaaugaucguuggggagcugguagcaucuguaagcaugguggcuucuauaccugcagugaucguuauaacccaggacaucuuuugccacauaaaugggaaaacugcaugacaauagacaaacuguccuggggcuauaggagggaagcuggaaucucugacuaucuuacaauugaagaauuggugaagguacagugaaaugucugguggcuauuaacauaauauucuuaauaguguggucauguaggaauuauuucuucuauggcucaauggccuauaaauauaggacauuguucuauccuguguuuguucuucuaggcagugacuauauauacauguauaaauauauaaaugcaacauauuagcacauuaaagauggaauuauuuuauuuaucuaaaaacauuauucuuaauuuuuuagcaacuuguagagacaguuucauguggaggaaaucuuuugaugaauauugggcccacacuagauggcaccauuucuguaguuuuugaggagcgacugaggcaaaugggguccuggcuaaaagucaauggagaagcuauuuaugaaacccauaccuggcgaucccagaaugacacugucaccccagaugugugguaagucauucuuguuaccaaguacucuuuuauaaaggaagagauuuaaaauuuaucagacauauaaagaagaguaggauaaaaagagaaauuggaugaauuccuacauauacaaagcacuuuccaaacuuugcuuacucuaauauaaagagaaggggaagaauuugcauguuuugaaacauuuauuguuuaucagauugagcuuacaucauuucuagguaucucccaguaguggacaaauuuuggcugaaaguacucagcucuuagaaaaauuguaagcuguucagaccaaugaaaaaugcugaaugguuagucuaaaacggagauuacuguuuaaccaguucgguaaauucugacuuuugcagauguugcaucccaugaaauuagcaaacaagagguacccaauggcagagaaaauguuagauuaaaaaugaaucaaaauagggaggguucagggaagaugcuucucucugagcuugaggagguucugugugucaaugaguacccgaaucagacuccacaaauaugacaguuucugauaugguuucuuaacauauauaaaauaagaugaguauuggugaaguucuaaaaauucgcuuucaguugccaccugaguacugucugaucaaauaggaaccgaaagauuagacuaauuguucuucaaucuacuugacuuaugacuuaaaacauuaacaacccauugaauaaaauggaguaaggcaaucuggacagagcaaauaauuguggaauuuuaaaauguugaucugggagaagccauaaugagaacucaauaccaaucucucaugugacagagaauaguagaaaucugguuuuggaauuugcuucuuacuuuugaauacuuacauuugaauaugaggguaucugaucugggacuucacaaucauuaaccauuauucuauuguguuuauuucaagaaauaaacauaaaagcuaaauauuuaauguggcuuauaaaacugugagucuggcuccuaccaacuucccugccacugagugguccugcucucccuccucaccauaggagccuucuucccccaggguucaucaugcccaccuucuugcagucaccuacagacucccaggucaacccuuaaaauccuuugagagagcccuggcuugcugucccuguccccagaacuacucuucacauaauucuuagagauuuaaauuuuuauucacaguucuaauuaccugcaccuccugucuucuaggggucuuguccgcuugaccuuuguuaccuguuccuuugcauuaucaauauacaaggucauauugguaaugcaaagucgaacuucuuacucaacacuuccacuuggaugcauagcaucuuagaccuguacguccacaacugaagcccugaguuuuaaauuuuugcuguagacuagcuccacccacggucuucuccaucucaguuaauggcagcuuuauccuuuaggugguugucaggccaaaaaccuugguguccuuaacuucccuuucuuuuauaaacauacuuuagacuuugcauuaccaauaacugaaccccuuccacggcuccaguuugaaggauucugccaucuaccuaccacuucuuauauuuuggcucacucugcauggcacuucggcuuccaaagggaucuauaauccagugaucauacuaucuuuuaauccuaucaucuuuucucugucuuuuuccuuauccgggacagauucuguggcccaucacuguaacuaaucuauugcauacacccaacuccugaacccuugcucccucugccauacucacuugacggaacaucaacuuuaaauacagaucuacuuauuccaugccugcuucuggacagcuaacuguuaacuauggaaacacacacacacacacacgcacccagacacauacaauguaaaauuaucucacuuuuggcuuuaaggucaacccuuguguccugaucccauugcaaaucauccacccaaggauuguuauagcaauucuccccuuuaacucaauuucacuugcauuucuagugaucuucccauuucucuccuuuccuuuguaguaaaacgucuugaaaggauuguuuucacuugcuaucucuaauuccuugcuacaguuuuucucuugaacccccucuggucgagcuuccacccccacacuccagaauugcucuucucaaggcccacaauaacaucugccuugccaguuccagugaugaguccccagugcucauuuucuuaacuuacuggcagugucugccucaguuuaucacugucucuccugguguuugucguaccuuuuggcucuuccuucuuaguuaguuccuuugcugauuucaucucauuuuuccaaccucuaaaucuugaagugcccugagguuuagucuuuggacuuccauucuucucuaucuuuuuuugagugcacuggugcgaucuuggcucacggcaaccuccaccucccagguucaagugauucuccugccucagccuccugaguagcugggauuacagguguccgccaccaagccuggcuaauuuuuuuguauuuuuaguagagaugggguuucaccauguuuggccaggcuggucucgaacuccugaccucaggugacccgcuugccuuggccucccaaagugcugggauuacaggcgugagccacugcguuuaucuuaaugucccaggugaucuuauccauuuucauggcuuuaaaugccauauugaugaucuccacauuucuauuuccagugcagaccucuuuccgaacuccagccucaauaacuuccuacucagcauuuccacuuagaugcauagcaucuuagaccuguacauccaaaacugaaauccugaguuuuaaaauuuugcuaucaacuagcuccacccauggucuuucccaucucaguuaacggcagcuucauccuuuaggugguugucaagcccaaaaccuugaagcccuuaguuuccccuucuuuuauagucacagccaacccauuagcagauaucauccucugcaucuuugaaauauauucagaaucuguccacuucuuauccucucuguggcaacccucauccuuuuaguuuccauugucucgccccugccuggauuauuucaguagcuucuuaauaggucucuauuucuacccuuuaaccuauucaccacaaagcaaucagaguauacuuuuaaauaauaaugccacucccauggucacauuucuccaauggcuuccagucucagagagaaggccaggucccauagaugcuuacaagggccuauaaaaucuggcuccuaucgccucucugaucuuaucugccaucacccucccccacuuccucuccuucaggcacucugccuugcuagugcaucaacaggcagagcacacucuugcacuggggcuccugcacuugucauucugucuggaagguuuuccccagacgcucccguggugcucuuauggcgcucccaugguucucuuccaugccaccucuaagaagucuucccugacuauucuguuuaaaauaacacucccaggccccuccuuuccuaccuagcaugcccuguccuucuaaccuggcuuguuuucuccauagcauuuaaucaacaccugacauauuuguugauucuaauuucuuccacuagaauguaagccccaugaggacaaggacuuuguucaauguuguauauagcucuaaaacagugucuagcauuuuaagauuucaauaaguauuucuugaguaauugaaugaauaaaugaaugaaauccacuuuuuuuuuuguccacagcauacuucccuuaccuucuucuuugcucccauucauccuuuaagucucagauuaaauguuauguuccuggagaggcuucuuucugauguucuaaucuaaagagauccuuuuguuauaaucucucaauuuccuuuucuuucauggugcuuaucagaacucacacuuucauauuauuugugugauuguuuagugucugcuuuccccacucuagucuaagcuccauaagaacaaggacuauguguguuuuguuuuuuauuguaacucuaacacugagcacaguacuaggcacagaauugacacaugcauaucuugucuuguugaaugaaugaaugaauauaaaaauuugaauaauacaugaaaagccaugaagcucuugcauccuguccccuuagaucaucucccuccccuuuucagcuccaugagagcagucugaugaagaggaaugcuagcucaggaaaaucuuugucuuccaagaacuuccuuuuggucuugggggaggaagguguuuuuuuauaccaccaugaggcuauuuuuccuucccuucuauuaguggugacauuguggaaguaucuguaaaauaauuccagauuguuccugauccauaaauagugagaaacaugggauguaacuugcuacuaugcucuuuauuuuuuucuuuuaaccagguacacauccaagccuaaagaaaaauuagucuaugccauuuuucuuaaauggcccacaucaggacagcuguuccuuggccaucccaaagcuauucugggggcaacagagguaagagggaauuuuaccuuauuccuuuaaauugcugauuagaacaucuugaugcaaacauuaacuuuuaaggggagccuuauaacuguuucacuuauacuucauaaaaggaauuguaaaugagcuccagccaagcauuguggcucacacuguaauuccagcacuuugggaggcuaaggcaggaggaugucuugaggccagaaguuugagacuagccugggcaacauagcaagaccccugucuacaaaaauuuuuuuuaaaguuagcugagcaugguggcacgcaccuguaguccuaguuacucaggaggcugaggcaggaggauugcuugagcccaguaggucaagacuacaguaagcuaugacugcaccacuucagccugucucugaaaaaauaaaauaaaauauaauaaaauaaaaugaauuucaccaaugacaguguuuggucaaaaucuuugaaacuuuuuguuucccagaaaacuaagcugauaaaacagcugcaguaucucuaugcauaucacuguaaaauagacauuauucuucacagucauuuuacguuguucaaguucacugcaugcauccaaaaugauucuucucauaaaacuagaauucggaugcuuucccugacaccccaccccagaacauaucugaauacaagaugucaugacucuacuauuuuauguuuauaaaacauuuuggagaaaguuagagauuaaucuaacuguugaaaccaccagaucuggcauugaguucauucugauauauuuuauaacuuauuuuuuuaaauaaauuaucccuuuggaggugaacuguccauauggggguucuccuugcaucacuuuucugcauuucauuucuaauacaugugguugaugaggcagaaagaagaugaguucaaaucuaauguuuaauuacagcuuaguagcccagguaugauacugauuauguuuuuauuuuaucuauguucuuuuuggugccaauuaacauuauuauuuaaaagcucaugggcuuuguuuucauauugauccaccugagaagcaaaguuuuugguucaaaauaacccuagaauauguagggaacuuauuugaauuugcuuaguauaguaagacuaagaauauaaaacaauuacaguaauaauugaucaaauuuauguauuauugauuaguggagguuauuagaaaaucugggggaggaacgcugaguagauacuugggcagacucugguuucagagccacuuucugcuccugauccucucuuuagcuuuuucuccacucugagacuccauucagucuugaaaauucuccuuccccaaccccugcacacuucuauuucccucuugagaguaaaauagaagcaagaauauagaggcaagauacauacacucaauuggaugaagagugauugugaaucacuaaauaaagguaaaaaugaaccucuugucuacaauuuuguuugaacuacuaaucacuccuucccaauagaaagugggugagauaaagagauaaauuuggagacauuugcauguauguuuuuaauuucaggugaaacuacugggccauggacagccacuuaacuggauuucuuuggagcaaaauggcauuaugguagaacugccacagcuaaccauucaucagaugccguguaaauggggcugggcucuagcccugacuaaugugaucuaaagugcagcagaguggcugaugcugcaaguuaugucuaaggcuaggaacuaucaggugucuauaauuguagcacauggagaaagcaaauguaaaacuggauaagaaaauuauuuuggcaguucagcccuuucccuuuuucccacuaaauuuuuucuuaaauuacccauguaaccauuuuaacucuccagugcacuuugccauuaaagucucuucacauugauuuguuuccaugugugacucagaggugagaauuuuuucacauuauaguagcaaggaauuggugguauuauggaccgaacugaaaauuuuauguugaagccauaucccccaugauuauauaguuaugcaucacuuaauauggggauauuuucugggaaaugcauugcuagucaauuuuuuuuugugccaacaucauagaguguauuuacaaaauccuagauggcauagccuacuacacaccuaauguguaugguauagacuguugcuccuaggcuacagacauauacagcauguuacugaauacuguaggcaauaguaacagugguauuuguauaucgaaacauauggaaacauagagaagguacaguaaaaauacuguaaaauaaauggugcaccuguauagggcacuuaccacgaauggagcuuacaggacuggaaguugcucugggugagucagugagugaaugugaaggccuaggacauuauugaacacugccagacuuuauaaauacuguaugcuuaggcuacacuacauuuauaaaaaaaaguuuuucuuucuucaauuauaaauuaacauaaguguacuguaacuuuacaaacguuuuaauuuuuaaaaccuuuuuggcucuuuuguaauaacacuuagcuuaaaacauaaacucauugugcaaaugua

SEQ ID NO: 192122 - RNA, 17072 nt, Homo sapiens
uacauuugcacaaugaguuuauguuuuaagcuaaguguuauuacaaaagagccaaaaagguuuuaaaaauuaaaacguuuguaaaguuacaguacacuuauguuaauuuauaauugaagaaagaaaaacuuuuuuuuauaaauguaguguagccuaagcauacaguauuuauaaagucuggcaguguucaauaauguccuaggccuucacauucacucacugacucacccagagcaacuuccaguccuguaagcuccauucgugguaagugcccuauacaggugcaccauuuauuuuacaguauuuuuacuguaccuucucuauguuuccauauguuucgauauacaaauaccacuguuacuauugccuacaguauucaguaacaugcuguauaugucuguagccuaggagcaacagucuauaccauacacauuagguguguaguaggcuaugccaucuaggauuuuguaaauacacucuaugauguuggcacaaaaaaaaauugacuagcaaugcauuucccagaaaauauccccauauuaagugaugcauaacuauauaaucaugggggauauggcuucaacauaaaauuuucaguucgguccauaauaccaccaauuccuugcuacuauaaugugaaaaaauucucaccucugagucacacauggaaacaaaucaaugugaagagacuuuaauggcaaagugcacuggagaguuaaaaugguuacauggguaauuuaagaaaaaauuuagugggaaaaagggaaagggcugaacugccaaaauaauuuucuuauccaguuuuacauuugcuuucuccaugugcuacaauuauagacaccugauaguuccuagccuuagacauaacuugcagcaucagccacucugcugcacuuuagaucacauuagucagggcuagagcccagccccauuuacacggcaucugaugaaugguuagcuguggcaguucuaccauaaugccauuuugcuccaaagaaauccaguuaaguggcuguccauggcccaguaguuucaccugaaauuaaaaacauacaugcaaaugucuccaaauuuaucucuuuaucucacccacuuucuauugggaaggagugauuaguaguucaaacaaaauuguagacaagagguucauuuuuaccuuuauuuagugauucacaaucacucuucauccaauugaguguauguaucuugccucuauauucuugcuucuauuuuacucucaagagggaaauagaagugugcagggguuggggaaggagaauuuucaagacugaauggagucucagaguggagaaaaagcuaaagagaggaucaggagcagaaaguggcucugaaaccagagucugcccaaguaucuacucagcguuccucccccagauuuucuaauaaccuccacuaaucaauaauacauaaauuugaucaauuauuacuguaauuguuuuauauucuuagucuuacuauacuaagcaaauucaaauaaguucccuacauauucuaggguuauuuugaaccaaaaacuuugcuucucagguggaucaauaugaaaacaaagcccaugagcuuuuaaauaauaauguuaauuggcaccaaaaagaacauagauaaaauaaaaacauaaucaguaucauaccugggcuacuaagcuguaauuaaacauuagauuugaacucaucuucuuucugccucaucaaccacauguauuagaaaugaaaugcagaaaagugaugcaaggagaacccccauauggacaguucaccuccaaagggauaauuuauuuaaaaaaauaaguuauaaaauauaucagaaugaacucaaugccagaucuggugguuucaacaguuagauuaaucucuaacuuucuccaaaauguuuuauaaacauaaaauaguagagucaugacaucuuguauucagauauguucugggguggggugucagggaaagcauccgaauucuaguuuuaugagaagaaucauuuuggaugcaugcagugaacuugaacaacguaaaaugacugugaagaauaaugucuauuuuacagugauaugcauagagauacugcagcuguuuuaucagcuuaguuuucugggaaacaaaaaguuucaaagauuuugaccaaacacugucauuggugaaauucauuuuauuuuauuauauuuuauuuuauuuuuucagagacaggcugaaguggugcagucauagcuuacuguagucuugaccuacugggcucaagcaauccuccugccucagccuccugaguaacuaggacuacaggugcgugccaccaugcucagcuaacuuuaaaaaaaauuuuuguagacaggggucuugcuauguugcccaggcuagucucaaacuucuggccucaagacauccuccugccuuagccucccaaagugcuggaauuacagugugagccacaaugcuuggcuggagcucauuuacaauuccuuuuaugaaguauaagugaaacaguuauaaggcuccccuuaaaaguuaauguuugcaucaagauguucuaaucagcaauuuaaaggaauaagguaaaauucccucuuaccucuguugcccccagaauagcuuugggauggccaaggaacagcuguccugaugugggccauuuaagaaaaauggcauagacuaauuuuucuuuaggcuuggauguguaccugguuaaaagaaaaaaauaaagagcauaguagcaaguuacaucccauguuucucacuauuuauggaucaggaacaaucuggaauuauuuuacagauacuuccacaaugucaccacuaauagaagggaaggaaaaauagccucauggugguauaaaaaaacaccuuccucccccaagaccaaaaggaaguucuuggaagacaaagauuuuccugagcuagcauuccucuucaucagacugcucucauggagcugaaaaggggagggagaugaucuaaggggacaggaugcaagagcuucauggcuuuucauguauuauucaaauuuuuauauucauucauucauucaacaagacaagauaugcaugugucaauucugugccuaguacugugcucaguguuagaguuacaauaaaaaacaaaacacacauaguccuuguucuuauggagcuuagacuagaguggggaaagcagacacuaaacaaucacacaaauaauaugaaagugugaguucugauaagcaccaugaaagaaaaggaaauugagagauuauaacaaaaggaucucuuuagauuagaacaucagaaagaagccucuccaggaacauaacauuuaaucugagacuuaaaggaugaaugggagcaaagaagaagguaagggaaguaugcuguggacaaaaaaaaaaguggauuucauucauuuauucauucaauuacucaagaaauacuuauugaaaucuuaaaaugcuagacacuguuuuagagcuauauacaacauugaacaaaguccuuguccucauggggcuuacauucuaguggaagaaauuagaaucaacaaauaugucagguguugauuaaaugcuauggagaaaacaagccagguuagaaggacagggcaugcuagguaggaaaggaggggccugggaguguuauuuuaaacagaauagucagggaagacuucuuagagguggcauggaagagaaccaugggagcgccauaagagcaccacgggagcgucuggggaaaaccuuccagacagaaugacaagugcaggagccccagugcaagagugugcucugccuguugaugcacuagcaaggcagagugccugaaggagaggaagugggggagggugauggcagauaagaucagagaggcgauaggagccagauuuuauaggcccuuguaagcaucuaugggaccuggccuucucucugagacuggaagccauuggagaaaugugaccaugggaguggcauuauuauuuaaaaguauacucugauugcuuuguggugaauagguuaaaggguagaaauagagaccuauuaagaagcuacugaaauaauccaggcaggggcgagacaauggaaacuaaaaggaugaggguugccacagagaggauaagaaguggacagauucugaauauauuucaaagaugcagaggaugauaucugcuaauggguuggcugugacuauaaaagaaggggaaacuaagggcuucaagguuuugggcuugacaaccaccuaaaggaugaagcugccguuaacugagaugggaaagaccauggguggagcuaguugauagcaaaauuuuaaaacucaggauuucaguuuuggauguacaggucuaagaugcuaugcaucuaaguggaaaugcugaguaggaaguuauugaggcuggaguucggaaagaggucugcacuggaaauagaaauguggagaucaucaauauggcauuuaaagccaugaaaauggauaagaucaccugggacauuaagauaaacgcaguggcucacgccuguaaucccagcacuuugggaggccaaggcaagcgggucaccugaggucaggaguucgagaccagccuggccaaacauggugaaaccccaucucuacuaaaaauacaaaaaaauuagccaggcuugguggcggacaccuguaaucccagcuacucaggaggcugaggcaggagaaucacuugaaccugggagguggagguugccgugagccaagaucgcaccagugcacucaaaaaaagauagagaagaauggaaguccaaagacuaaaccucagggcacuucaagauuuagagguuggaaaaaugagaugaaaucagcaaaggaacuaacuaagaaggaagagccaaaagguacgacaaacaccaggagagacagugauaaacugaggcagacacugccaguaaguuaagaaaaugagcacuggggacucaucacuggaacuggcaaggcagauguuauugugggccuugagaagagcaauucuggaguguggggguggaagcucgaccagaggggguucaagagaaaaacuguagcaaggaauuagagauagcaagugaaaacaauccuuucaagacguuuuacuacaaaggaaaggagagaaaugggaagaucacuagaaaugcaagugaaauugaguuaaaggggagaauugcuauaacaauccuuggguggaugauuugcaaugggaucaggacacaaggguugaccuuaaagccaaaagugagauaauuuuacauuguaugugucugggugcguguguguguguguguguuuccauaguuaacaguuagcuguccagaagcaggcauggaauaaguagaucuguauuuaaaguugauguuccgucaagugaguauggcagagggagcaaggguucaggaguuggguguaugcaauagauuaguuacagugaugggccacagaaucugucccggauaaggaaaaagacagagaaaagaugauaggauuaaaagauaguaugaucacuggauuauagaucccuuuggaagccgaagugccaugcagagugagccaaaauauaagaagugguagguagauggcagaauccuucaaacuggagccguggaagggguucaguuauugguaaugcaaagucuaaaguauguuuauaaaagaaagggaaguuaaggacaccaagguuuuuggccugacaaccaccuaaaggauaaagcugccauuaacugagauggagaagaccguggguggagcuagucuacagcaaaaauuuaaaacucagggcuucaguuguggacguacaggucuaagaugcuaugcauccaaguggaaguguugaguaagaaguucgacuuugcauuaccaauaugaccuuguauauugauaaugcaaaggaacagguaacaaaggucaagcggacaagaccccuagaagacaggaggugcagguaauuagaacugugaauaaaaauuuaaaucucuaagaauuaugugaagaguaguucuggggacagggacagcaagccagggcucucucaaaggauuuuaaggguugaccugggagucuguaggugacugcaagaaggugggcaugaugaacccugggggaagaaggcuccuauggugaggagggagagcaggaccacucaguggcagggaaguugguaggagccagacucacaguuuuauaagccacauuaaauauuuagcuuuuauguuuauuucuugaaauaaacacaauagaauaaugguuaaugauugugaagucccagaucagauacccucauauucaaauguaaguauucaaaaguaagaagcaaauuccaaaaccagauuucuacuauucucugucacaugagagauugguauugaguucucauuauggcuucucccagaucaacauuuuaaaauuccacaauuauuugcucuguccagauugccuuacuccauuuuauucaauggguuguuaauguuuuaagucauaagucaaguagauugaagaacaauuagucuaaucuuucgguuccuauuugaucagacaguacucagguggcaacugaaagcgaauuuuuagaacuucaccaauacucaucuuauuuuauauauguuaagaaaccauaucagaaacugucauauuuguggagucugauucggguacucauugacacacagaaccuccucaagcucagagagaagcaucuucccugaacccucccuauuuugauucauuuuuaaucuaacauuuucucugccauuggguaccucuuguuugcuaauuucaugggaugcaacaucugcaaaagucagaauuuaccgaacugguuaaacaguaaucuccguuuuagacuaaccauucagcauuuuucauuggucugaacagcuuacaauuuuucuaagagcugaguacuuucagccaaaauuuguccacuacugggagauaccuagaaaugauguaagcucaaucugauaaacaauaaauguuucaaaacaugcaaauucuuccccuucucuuuauauuagaguaagcaaaguuuggaaagugcuuuguauauguaggaauucauccaauuucucuuuuuauccuacucuucuuuauaugucugauaaauuuuaaaucucuuccuuuauaaaagaguacuugguaacaagaaugacuuaccacacaucuggggugacagugucauucugggaucgccagguauggguuucauaaauagcuucuccauugacuuuuagccaggaccccauuugccucagucgcuccucaaaaacuacagaaauggugccaucuagugugggcccaauauucaucaaaagauuuccuccacaugaaacugucucuacaaguugcuaaaaaauuaagaauaauguuuuuagauaaauaaaauaauuccaucuuuaaugugcuaauauguugcauuuauauauuuauacauguauauauagucacugccuagaagaacaaacacaggauagaacaauguccuauauuuauaggccauugagccauagaagaaauaauuccuacaugaccacacuauuaagaauauuauguuaauagccaccagacauuucacuguaccuucaccaauucuucaauuguaagauagucagagauuccagcuucccuccuauagccccaggacaguuugucuauugucaugcaguuuucccauuuauguggcaaaagauguccuggguuauaacgaucacugcagguauagaagccaccaugcuuacagaugcuaccagcuccccaacgaucauuggugacuacugugccccgaacugggcugaaaugaaacauacaauuuuuuaaaacaaaagguauaagcuuuuuauacaaaaagaaaugucacugaaaagacauguaauugaaauacaauucugaaaagggaccauggcauaguacaguggaaagcccaugguuuugaagucaaacagaccugaguugauuggaguucuggcuuugucacuuucuagcucccagaccuagagcaaauuaccugacuccucugaauaaugaauuuccucaucuaugauuagaacaaaaauaaguuauguaaaacauuagccugguacccagcacauauagcacucauaagaguauuauaugaauauuuuaagcucccuuccauauuguaaaugguagccaaaacugaauuuauacccaagacacuuuucuuuucaaugauucaaugaucucauacauguagucuagccuuucuuuuucucuuaccauugugccuaauauugaaaaaucucagaaaauuugacuguugauaucaugugaaauauccccacaauauugcuuaucauagcagguggcauauuuaagagggaaauacacgccacauagagggaacaguuuugagucacaaauugaagugauggcucccaguuuuuucccuuggaaggaguaccuggacacacugcuguuuuaaguaucaagaguucuucagaauauuuguauuugugcccuuugugggcccaggaagugcaagcagaagguugccugacuucguagcacaauacccagugcuuucuaguguacaugcaaauuugguccauauaguuuaagccuaauggaggaguuuaaucagaacucccuguucuaauagggcagccuugaacauaccaggaagcaauaggaaaaaacuggagaaagugaaaaggcugcgaugaaggaaaagaggagacaaacaagggugacauuggcugggcagcaaagaugaccaaaagguaagaggauaaaaagaagcagucugcgggauucagaagcaaauagucagaaauagugaugaagaaacagaguugucccagaauagaggccauaaaggaccaggguaggagagaaaaaggggggacccacaaaauuaacaccuucaaaguucuugauccugugauuuuuagucugaucucaaaaucagaccauugaguuggauuuuacuccugauuuauuuacccuugauuauguugaguaaauagugauauaucuaauaaguauuauuuacaaugauuuucuccccccauaccaccaaugacuuaaaaugaaauauuucaagaggugaaggaauuaaaauguuagaaauauauuaggaauauggaggguaacugcagcaaucucauagcauacacaccuuucauuauauaaccaggccaagaagccugugcuguuccaguauugauccggugcuccuccgucaccauccgaccacagaaccucaggcugauaguuguucacuaacucauagagcucuggcaaugucuuagaaacuggaaauugccgcuuauggaaugaacuggauucauccucaaggaagagcggaugaaaccauucaaaaagggaauaguacaguccaaaacgcaggucaguucuguuccuaauggcuaccucaaguuccuugacaaugucccucuugggccccucaucuauggcauuccaguuccacgaauauucugacccccacaagguaaagccuagaaaauuauagugaaaacccuuguaagcaugucaacuuuauuuuaguaaauuucaacccacacaaaugcccaaacaaaucacauaguacaugcgauauauaaauaccugcuccuacaaaugacuguuuuauggccauuuuuucauagcauauauugugcuuuuauaugagaagugagaauuuaaacaaggugagacagguuuuuaaaagcaacuuucaggguauaucacuguacggucugaucuaucuccaguauuuucccucuuagauuuuaagguccuuaagggauugcaucaugucugcagugcucccugcuaugucuccagccaacugcuagcacaagguauaaacaaucaacaauagcagcucacaacuaagaugggaacauauacauguaccaugcuaaaugaugacuaccacuauuuauuaugaagauccugagaugcacuccugcaagauucuuagugucuucuaaaccaaagcuugaagucuacugcuuaguuuuaggauuguuuauuuuauuauagugugauucuuagaacacuggugauccacguauagcaaaucucuuuuagccugauuauuuauuuaaccagaggggcaaaaaaaaaccccuacuauucccaauaguucuauacuuuaaaauauacucaccacguguaaucucauccuacuauaaaaucauaagcuuggauguuccucuuuaauaaaauuacccaaaagugaauagucuaccaacuacauagauaagaaaaacaauguauaccuuuauacaaacacuuagaagugguucguuuuuaagaggaauuuguauuuagauuacugauuguuccauauaaaaauguuagaagagauauauaaacugaaauacuuaaaacauaauaaauaugaaagccucaaaaauuucaucagugccuagagacuuaaauacauuguuacuauuccacuaaaaucuaaaagaaucuuugagaauagacauuuauaagguacauuuggugaaacauuuuacucuugguaaauuagaacaagucuaagaaugacucauacuuucgauuuuuuuuuuuuuuuuuuuuuuuuugagacagguucuggcucugucacccaggcuggaguucaguggugcgaacuucgcucacugcauccucgaccuccugggcucaagugaugcucccaccucagccuaccaaguagcuaggacuacagguguguacuccaccacgcccagcuaauuuugucuauuuuuucagagacagggucucacuuugcugccuaggccagucucaaacuccuggccucaagcaauccuccuuccuuggccucccaaaguguuggaauuauagaugugagccacugcaccuagccuuagauucauuuuaauaagcuuuuuaaaacagcucacucuuguuccuaucauuucugugguaagcuucagagcaguguugauaucuaaagucauacucaaaguuacucaacuugacaggcccuaaugucagacaguacuaaaaccacuugagucuucauuugaauaucaccaccauaagcuuacacugcgacguuccuuccugagcuuaguaugcauuuuccaugagcaaugaaaacaucugacaacaugggucccagaaaauguauacaugugggcuacaucaucucuccucacaguuugauuaacaauuuuuauuaaauaaacucacuauguaauguuuugugccauacagcuugggaaaguuccuagacaucaggaaaucagcauguucucaagcaaauacacuugauagacauucaucucagcaggauaaauaucuacaggagaaaaucaugaagcuaccagaauguggccaaagggaaaaauauccuaugaucauuccagauuuuuuguguugguucuccucuccuauucccaucccaucccuggagaaaacaauaaggcaaaguuucccguuuuuuuuuuuuuuuuuuuuugagacaggaucucccuccgccaccuagacuggaguguaguaagccuaucuccgcucacugcagccucaagcaguccuccaaccuaagccucccaaguagcugggacuacagagacauaccacuacgcuaauuuuuuaguuuuuguuuguuuguuuguuuuuguagagacagggucucacuauguugcccaggcuggucuugaaccccugggcucaaaugauccuccuuccucggccucccaaaauuuugggauuacagacaugagcgaccacauccagugcaaauuuuuuuauaccaaggcaaagaugaucaugcaaaagaaacuaaugaaugaacaagccguuggaacaaaaacaauuuguuaaugcuucccuggccuuacaaauacuggagugguaauggguggaauccauucuauuaaaauagaauggauuuuaaauguguggggguuuagauauucuucuaccaccucugauuuuucuggaaaccauuacaguuccacaauccuuuucccuccaggugaucugggucacuuucaucacuuucaucacuaucaguucauccacuauuugcaccauuuggccagcuaagaguuggcuaaaagugcagccaggugugucguaaugaugcaagacuauagcaguauaauccccaugaugcauucacaggaugcauuacagagaaggggaaggaaagagugcaauuccaagaugaacuuugacuugcaacccacacucccuucaacaaacagcuuuaaguaaaucuuggaaauauuguucaaaauacaugugacaaaacgugaccaucuuuccucuguuacguggcggguaugauccuuucuguauuccuaacaucucucaauuuggguugaaugugcagucccuaagucauaagcaagugccagucaccacuuaugguugcuccgaagagaaaauuagaccuugcuuuaguuuuuucuuccaaaagaacaacuuuucauuucuuaaccauugucagcaauuuccauaggcuggauugacuuaccuucaugauguuuggaaguuaagacaauguauuuggcaccagaggccugaaaaauaucugcccacugguuggcauuaaaaaauuuugcuguaaauagugguccaaaaucuucauauuugaaacuaggaggguaauuaucuuucauaaauuccacauacuucgguaucuuuuccuuuugccaauaccaccuaaggggaggaaaggaaagagugcauaaacagcacauacacacauauuuaaaagaacugcuccagcuccccuuaccauuuaccccucacacagauaggacccagauucucuuucucacuuccccauuaguuugacuuggcuuuaaagauagcuuaugcaaacuaaacccccucucauuuuccaccuaucccccugugauauccacucagcucauaaacuagagcauucuaggcaacucagcuacccauucucucuuuuuuuuaagacagggucucacucugucacucagguuggaaugcaguaauggaaucaugguucacugcaaccuugaccuccugugcucaagcaauccucucgccuuagccuccugaguagcuaggaccacaggcacgugccaccacaccuggcuauuuuuuuuuucuuuguagagaugugguuuccauauguugcccaggcuggucuuaaacuccugggcucaagcgaucuuccugcuucagucucccgaaguguuaggauuacaggcaugagucaccguguccagccccauucucuuuuaauucuucacuuuuaaaucacaacauguaguauaugucuuuacacauugucccuuguaacauaagugauuagggcuucuaaaaggaagacuacaugccuaaaacauaauaugcaucuauuauauucaguaguagagaacacuuuggaggcacaggacagaaagggaggcaaaaguaaaauuaaaaagaugcuguuauuuuaauaaauggacucaaccuucaacaauuacuugcuauacgcauucauucuaagcaaugguauauugacccuaaacugcguaagcaagacuucaugaggaaaagcacaucuacacauuuuagauaaacacagcaguaacuauccucaugaaauagaugcaacccccauuuuugacccaccuccugcuuuuucuaucaccauuccuuucauaugaguauuucuacaggauaagcaaauccauaaucagcacuauauuucccaagacgaucaggagacucugcuaagaagaaauaauugaagggcauacuaugcggcaggcaugcuguuugccugcccaaaagucguauuuacguaauuucccagcuuccacuacagcugcgacagggaugugagauccaugcuggccaagggaacuugagggaaagccaacuuuggggacuguggaaaugguuucccuccuaaugaaaagagacacuggccuuccugccuuugggcaggguugugugaaguuauggugccuggcugccauccugugaccaugaagggacaaguccccaggcugaggaugaaagaaagagcccgugucuuugauuucaucaaugaaccgacuacucuaaauuuccuguuaugugagauaacaagccccuaucauuauaccuuuuaguuggguuuaaaauccuugaagcauuuuuauuauuuauuuauuuauuauugauuaauugauugguugagacagggucuugcuccauuacccaguuuggagugcagugucaugaucauaccacaccacagccuugaacuccugggcucaagcgaucgucccaccucacccuccugaguaucugggacuacgggcauuacauuuuaaauugaacugcaaaagagaaacugggacauucagaaaguugaacaagaauaaggaauuucuccuagcaucaucuaauuugaaccugcacuguccccuacagucuagacuugaauuucaugcugagagaugaaaagaggcauuuaugguaaaggucuaucauuuauauuugguuuuuaauagacauuuaaaacagucacauauacucaucuauacuguugauuccccgaaagucaaauugagagugaggagcagaggauacaaagggaaaucacagguaauuaaagaaucuuccacaggguuaaugcauuuucagaucaucaggaaucuguucucuauuuuguuuaguaugagaaguaucuuuauuauucuaggucaaaauaaccauggguuuaucuguagaaaaugaaguuauucauagcaaagaauaaaaugacucaaaacuagcuguuuuauuuuggcauaguacuagucucagucaaaaaugucaaauccucuuuggcaccaauauaucuuuaccuaaucuucaugguugaacaaaaugauaauauaagauacaauuuagggggaagaaaguuguuaauuauguaccacacuaaucuaaaauauuuccaaaacaagcucaagauuccuuacagcccaaaacaugcaaauaaagauuuguaacaucuuuuugaaguagcuauguuuuggcauaagaauaaagagucucuguuuuagaaggugaauuauuuaaaauaugaauaauucuccauagcuuauccaguuuuauuuuuuacaucaauugaccuaccaauaagaaagguuacugguugcagguagucaauuucuuugucaugaaaggguuaaaauaugcuauuuuggcacauuuuuaaagguaaagaaacucgaaaaauagcaggugcaugaagagcacuuugcccuuugugcuguuucuuaggagagaagaugaaauuccaguaugaaaggcacucuguacuagaaggaaaggcaacauccuaagcuucaaagacaagaaguagaauacuguacagaacuugcuaaaauuuauuauuuaagucuccccacauaauuuagucacacaaugucaauuuaauucuuggacccagcagagacccuaacagaauggagguguaauuuuucuaccccuagaguagagcaugguaccauguauacuauguaauguuaauauaauauauaguucauacucuguauugugucuacuaaauauaguauguuaauuuggauguauacuauuuauguaguauauaguugauucaaauaaauacuguuuaaugauuccguucuuuuacuuaagaauauauuaugugucccaaaguccuggaauuacagguaugagccaccgcggaucaccugaggucaggaguucaagaccagccuggcuaacauggcaaaaccccguuucuacuaaaaaauacaaaaaaauuggccaggcaugguggcgugcgccuguagucccagcuacucaggaggcuaaggcgcgagaaucguuugaacccgggcggcgaagguugcagugagccgagauggugccacugcacuccagccugggugacagaaugagacuaugucucaaaaaaaaaaaaaaaagaauauauuauguguauguuucuauauaugcacacaaaauauuucuguuuugaaggacuuaauacuuguagcauuuagucagaaaagacaugugcaacaguuuaagaaauuacaugcacauuuucacauagaucucaagguaaaaucuaacgcacagauuuuuguguagcaccuuucauacggcaguaugauaacuggguuguguuaagaguaccauucuagaaccucuuuaaaaaguuccuagagccacacauggguaacauguuaacauuaaguagccaaugguguucaaugaacagucguuucacauacucaugacuauguuuuaaccauaacuucauggcagaacgacuguaaauuggcagguagcagcagagcaaccauaggccauugugccugagucaccgcucgugugaugccccugcacaaacugaugaaugucuguaguagcucgauguuguagugucauaacuacagcuuaauaugcgcaacuaugaagaagcugaggagucaggaguaucugaaaacucuuacagucacacggaagaaaaauucccuguucauccagcagaagcacuuaggcaggaaaccacauauucgacacccggaagugcgaaacgcggguaacgcagugggaggugaaaccgacgagggugcaggcagcaccaggcggcgaaccaggcccgcugggugguggcuggaggcugcggguggggacaaaagcgcggcagacgagacaaaagggagcgcacucaccagaaccacucgcuaccgaagcugggcacggaaaacacuccccaguggaugaagaugccgaacuuggccuggucaaaccacgcgggcagcuggcgggcguccagggacucccagguggggucgaagcgcguggcgcugugggcagggcacggcggcggcggcagcagcagcaacagcaacagcagcaacgggaacgcgagccuggggagcuccuggggccgcaugucccggcgcaggccggcuguccucucugcaggcucccgcggccucgggagcgcuguucuuccgucucugccgcugaguaugccgcgccgcggucaccugaccaagucggacuuggaaaccggccacccuucccccucuggggcgggaguggccacucucccgggcguuccgaaugaccucaggagggcugcaucgcucagcauaacuaaggccagcauuaccccaaagccagcugggacggcuuugcu

SEQ ID NO: 192123 - RNA, 73676 nt, Homo sapiens
gaguucggaguagagauggccgcgcuugcaccgcugcccccgcuccccgcacaguucaagagcauacagcaucaucugaggacggcucaggagcaugacaagcgagacccugugguggcuuauuacugugagucuuuccgaguggccgcgcccuuucuuucccaguugcauuuuagggcccacacaccucccugagguucuuggggcaugccccgccccccucgcuuuaaaccugagcuuugaccucgagccuacccagggaacucccuggguucccacccccuggcaguaggaaucccaaaacaccaugguguccacugcuucuccuaucuugugcuuaaaugcuccaguacugacuacacaggcucuugaacuguggaauauaaucuuccaagguuuucucuguguguguacacacaagagcuucuugucucaaauaggaauccugaaaauaaauugaguuagguuuaaaacgaaggugaguguccgaaagaaggagugauguggauaaaaggacgauagacuaguugaaaacauaguaauaagugaauauuauuuaugacagcaugcaagcccaaucagaaacucauuugguuaaauggggaguaucugcuacuaaauaagcaguugaauuugaccuuuccccacccagcugcucucuccuaccaugcagaauuuuuaguuuugacuucuuugaauaauacccgcuguugagaccuuugaaagcaguauuuucacuuugaguguuauacguugaauuuacaguuugauuaaaaaaaauauagguuaacucugcucaaacuuguagugaguaaagggagugccaguaauucuguguuaacuuuauuuuguauucuguacucuuaacuuuacugcaaauaaaacaaguaacuggacaauuauaauucugaaaaggauauuuagaguugagaaguuggauauaaugcguccauuguuguguauauuguaagguuagcuaaaaucuggucacuguuaucucugccauacuccaaauguacccuguuucucaaaugugcaaggccuuuucagaccuaccaucuuccacucucuuggaaugugcaccuuuuucuugcacuuggcaaacucaugauucaagaucuaacccaaaugucaccacuucugugggcagcaaauugauuauucucugugcauuacuucauuuuguucaaauuuuacagcaucauuuuuauuauacuuguucuucaguuuccucaagcaggguccauauucauucaguauguguucauugagcuaccuuuguaucaagcauuaguaggcgcugugacuacauuugcugcauuuuuggagcuuacauacaauggagguagagaguuucaacaauauagagucuaucauacauagaguauuaaaagcuuaugaagacaaauagagcaaggaaaaggaauaagaguaucaggaguagugguggcagggagugcagaugggauuucaguuucauaguggucaggaacacuucacugaauugacauuuggggaaauaaaagagugaaaggcauaccuugcaccaucugggaaagaguauucuccauagagguuauaaaagucccgaaguagaggcuugcuggaaggaggaguaaguagacuauugugacuggaguggauggggcuugggagugaugggauaaggucaaagaaucucucaucccuaaaggaaauuccuguucccgaucccuguaucauguaucuuugugacaaaccagggacaccuuacucacugucguccuuucccucuagauuuuucuaaaccuaauccaguuuccuuuauuuaaaaauauaacauaaacucucaccauaucauucccuaaaguugcagcucugcuuuuccagccuuauagguaaguuugaaauaguuguccauaaguuagcuuuacgccuuuaucuuguagagccuuucagcccaugcagucugguuuucaugcccaguauuucacugaaacugcucucaucaggcuuaugaagaaauauuuuuauugcucaggugacacuuaacaauuuuaguuaugaaacauguacauauaaaagcauauguaaugugcagacaguuuaaggaauaauaaaaugaacacuaauaugccuaucacauuugauguuauuaaacuuuuuaauuuuugacaaucuggugggugugaaaugguggugucucauuggagcgaaaucugcaauucucugagucuuaaugagguuuagcaucuuuucauauguuaauuaaccauuugugauucgguuuugaaauacuuguuuauugcuuuugcccauuuaucugucacagucuugucuuaauaauguuagauguuaauccuuuguuauauguguuguaaauaucuucucccauuucaguuugauuuuucacucugaagaccuuugauguucagaaguucuuaauuuaaaaauguuaucaaucauuguaugaaucucuuaggacuuaaccuucugauuuuauaggcuuucauuucuuuucguguauuuguuugggacuuuggcuuucuacaucuguagauggguguuuuuaaucaauuuuggaaaauuuucucuacuauuauuuguucaaauauugcuuauauuucuauucucucauaaaaguuugauuagacauguuuugcacuucucccauuuaacuuccuugucucuugauucugucauuuuuuuuuaucucuuugucuuucugugcugcauucuguguaauuucuugagguuuaucuucaccucccuauauuuuauuguuuaacccuuuuauugaauuucuacuuuaauuuuuuauuuuaguguucucuuuugguuuucauauuggccuggccauuucugauaguuucuuguuacugauauuuuuaaccacucuauuucugugaacacuuuaaauauauggauuuauguuugcuguuugauaacauuguagcugcuauauuugugggccugauucugcuuuucaacagaacacugcucuuggugacuucuuuccuuacaauugugggcuagucaugcuagaccagcgcucuccaaacuggaguaggcaaauaauuccaaaggaaucaauuuuccaauucuugacuuccauguuuuccuuccaaaaacuguucuuaacaaagcuccuguggucaggguagcaaaguaguauauaauaugcugcuuaucuuuuccuacauccuguucacaauuguccuucucccacuuuaaugaagaacggcauacucucacgcauccugagugcuuuuauguuguauugccuugaaagagaagguggaaaauccuccaggguguccagacaaaagagacaauucaaauuacccauguuagugaagccuccauuaauuaaggcauuggauagaccuuccuaucuuuccuggucuuacauugaagaaaaccagccagagcaaaaaauaaaccuucauucgggaguucaagaccagccugaccaacaugaagaaacccugucuguacuaaaaauacaaaauuagcugggugugguggcgcaugccuguaauccuagcuacuugggaggcugaggcaggagaaucacuugaaccugggaggcagaagucgcaguaagcugagaucgugccauugcacuccagccugggcagcaagagcgaaacuccaucuccaaaaaaaaaaaaaaagcuaagcaugaaagguuccaaaagagcauucuaauuugaggggaaggagguagaacuuuguauaagggggaugcagggagucaccuggaauuguauaugggggaugcagggagucaccuggaguuugucucuuuucaggaacaguuggucaguggaucuccgaagagggaggaguuauucugcgauauuagcagccauuguuaggucaucuuggauuuuaucaagagguugaggaggaacaguuuggggccaaggucaugagcaagaugaugugaggaagauuagcuguagggacagggauguggagggaccacagugggaaaucucagucuuucagagucucuuacauuuauacauguaucuguuaaggguaaugccuuauguuaaaaccgguccuguguugcaguauucugaauucucaaaaugauaaaaauuuucaugagaugaccuuacugccucauucuguauucauuauuaaagaauaccaaucuuggguugagagcaaaaccaagaacaaaggagaaauacugaagaugagaguaccuuguuucauccaaacaagcuccugcaaggcucugcagcuuauugcuauuuuauaauuagaauuuagaaauaaaauggggacaugaguugacauuccaacuggaauauuguauuucucugaaaaaguaacucuuacuuggcugauuaguuugguguuagcaacuggcauugccauuaaacagugugguagacauucucuuuaaacuaaaugagcuaaaaucuucggcucugagguuuuuuguuuuguuuuguucuucuggaaguacauuuaaaacagcuuggccgagcacgguggcucaugccuguaaucccagcacuuugggaggcugaggcaggcagaucacccgaggucaggaguucaagaucagccuggccaauauggugaaaccccaucucuacuaaaaauacagaaauuagcuggaugugguggcaggugccuguaaucccagcuacuggggaggcugaggcaggagaauugcuugaaccuggagguggagguugcagugagcugagaucgugcaauugcacuccaaccuggggaacaggagcaagacuucgucucaaaaaaauaauaagaaaaagaagaagaagaagaaaauaaaacagcugaugagauugaaccuuauuuguuauuacuauuuuuuuuuuuucacugagggauguuggaacaaguauuucaaguuuucccaauccuuucugcauccuacaauaaauaagaaggcucugauugaaagaagaugaugaaucuuuauaauaucuuuuugcauacaucacaggaauugagaaaaugaguaaugaugggguaacaaauccuuuuuaauuuuuaaacaaauuuuaaagugggccuaauuuaauugucagcuuagaauuuauuuaaaauauuugaugauaggugguuauaugguuuuuagccuguaacucagaaauaauuuaaagaauuuggugauuuugcuguguaacaugggaaaaacugggauuuggggggauuguuuuuugugaauuuaauuuauaaaaauaaaaaauaacaacagaaccccaauagucuacucuuccucauuauggcaauaaauaauauuaauacauaaauauuugauuuaauucauaacaauguaaaauuucuguuaaaaaaguacuuuuuguauuuuaaaaugugauaaauaucaaguugcuaugauaguuuaguuucaaagauacaacuuuuagaugucaauauuugauguaguauagaaaucacauuuuuuauaccuguuuaaccuucucaugaaaagguguagacaucaacauaaaaacauguuaagggauacauuucuauaaucuuagagcauauaauaauuuuauaaauuccuagagcagggaaacuuuuuuuugugagaaaaaaauucaagaguauuuugcuaaacuacuugcugauucauaaaagcuccaugggcuaugugcuacccucugccaggaauccuucugcauuccuauuaauuugacuaacuuacugacucagugcagauuuuacuucuuacagauuauuuuucaugaccucuuaaagaugaucuagaaauuguucuugugugccccucaucacauguguuauaauauaaacaucuguuuaucuuucaaucuugauucuccuggaggacagggauuaucuuuuucuuuuuuuaccaccugacacauaaauggaauuuacaaauucuuaaugaaugccuccucucuaaauauuacuaauaguccacuaaaauguaaacucuaugagaacaagaaguaugucgugugaugaucauugaauguccaccuccuaauauaguaucuaagacauguuagauaaccuguaaaacuuaucugucgauugaguaaacaaacuauacaguaauucauagcuuuuuuuuuuaauguucuaccacaaaucaaugacaaaauagaauggaaacaauccuaguacucuaacucauuaccuuacuauguuuauaaugaauuuuagauugagucauaggucauauuaucauaugauuuacaccuugugcccuauccuuucuaguauuuauaucauuuccaaaaaugauucacuucuggccuuaaugggaauuuucuaguguuuuaucacuuuuuaaaauuaccuuaauauuccuacauuucgaaguugguuggucuuuuguuuucuuuuuaaaucaggaaugaauguugaaauaauguauaucaaauuacuuuuggccgucuauggaaaugcuaauaggcuuauuguuuauguguuugaacuuuuuaauguaaguagcagcaaaauaguaaauucucucauauuugaaacaucccuccauuucuggaaagaaucccauuaguuuuugcauuuucuuuuaauuaaacuuuuucuuuugaaauaguuguagguccaugugcagcacauguaguuguaagaaauauuacagagagauucuguguacccuuuacccaaugucccccaaugauaauaucuugcaaaacuauaauaauguaccauaaccagaauauuggcauugguacaauucacugguuuauucaggcuuugucaguuuuacauguauuuguguguguguguguauauuuaguucuaaacagcuuugucagguguacauuccuguacccauuaccauagucaagauagagaauaauuaagaauuccccuuguugcccuuuuauuaauauaaccugccuucuccuuuucgcuaccucacccccauccccugguagccaguaacuuguuguccauuucuaaaguuuuaucauuuaaaauguucuauuaaaugaaaucauauauaagcuuuugggauuggcuuuuuucauuuggcauaaucucuggagauuuauccaaguuuauuccuuuuuuaaugcucaguagaauuucacccuauguguauacuacaguguaacaguuuaaucauugaagacauuuaaguguuuuaaauuugugacaauuaugaauaaagugaauauaaucacguauaguuuuugugugacccuaguuuccauuucccugggauaaaugcccacaaauucaguugcuagaucauaugguaauugcauguuuaguuuuauaagaagcugucaaacuguuuugcagagcaucuguaccauuuuacacucuuauuggcaacacaugaauaagugauagaguuucucuucauucucaccagcauuuugugucacuauuuuuaauuagucauucuuaauagguacagugauaucucauugugguuuuaguuuuuauuucccugauagcuaauacaguugaaaaccuuuucaugugcuuauuuaccauauggguaucaucuucaguaaaaugucuucauguuuuugcucauuauuuuugaguuugagaguucuuaauauauuauaguuacguuaucauuuugagauuuuuaguaacagcguuacucugguuucuuagauauuguugagaaaauuacuccuuuuccucaaaugugaguuggauuaaaaacgcaagcagauuuaccgcuuucuuuagauuuaaaaaaaucauugauacagcagaacuuugugcuuuuuuauauuucucaauuucuuccauuagaaaaauauuuuccucuugagccauucuugauauaguaguuuucuagaauaucuuucauuucuacuguauuuugaaauuuauuagcuagaguuaagcauucauccuaguuaguaauaaauguaaauuaaaguggaauaacaauuuuugacuguaaaaauaugacucaguacaaaugaguacgcguucagauccuugcugacauggcugugugauugguacaaaguuuggaaagcauuuuggcaaaauguagaguaucuaauucaguaauuccaguuuggggaaacguguucaggaaauaacuauacauuuaguaagaccuuuaugcagaauuuccugaaugauuauuuauacauuuaugauaagcucaaaauaaccuaaaauauauaucauuauggaaaugguuaaguaaauuauguuauauccacugcauagaaaguaauguaauuguuuaaacauuacaaagcaucuuuuauaacgugagggaagguuuauaugaaaguguggaauacggaauuauuauacaugcaguuccauaugucuaucugaagaaaucuuugucuucagugaccccucaugauuugaguucugaaucaccuuuuguaguuuuaaucaaauuaauuucauuuuguuacuagaacauuaggcacuugguugucuccaagccuuuuaacauucuacuuuaucugccuugacaccucuucucuuccccaccacacucacuagauuuuuauccuuuggguacuagcuugaaagucacuuucucugggaggccuuuucuuaagucuccuaguuuuaagguguuucuuuuuguucuuuaugccuugguguagcuuuaccguaauugcuuuuucauuugcuugucuuucuucuagacuguaaacugaggaaggcuuacacugugcuaccaguuuuuauucauuuacucugccugguagugcuaggccacuagagauauuuacauaauaaagaacaggugcucaaaaaguguuagccaaauugaccugaauuuuaaggcaguuguggucccuagagggaaguauggccauacaguugucaccuaauaaggcagacaacuagcauuccuguagcugauuggcauuuuaacagugcuuucuuucaggaugucugccucacagucuuucugguccuucuguuacuaagugauagaaccaagacucgaauaaacaaagucagauuaaaaaaaacgguugaaugaaaaauuguugguaguagcuaguaauuagagaaccaguuauugagugagccacagaguaacugaggggaaagggacuaguacaauccauggcaaaagaaaaaggcaaaaaagccagugaaaaaaucucggagauuccccuaaguggagaguggaaaaugaaggagaugcuuucuguuaauaguaugucucugagcuccaucucuuuauuuuucuuuaaugaagccggaaaauauuugaaucuuuacuaaaagugggcacuguuagauaaauauuuugauucugccagguuuggugcuguagauaaagcuaaacucagaacuuuccccuuccuuuuucaguuugccgugaguaaauguauaaaauuucaaguuucaauuuuuaaagcuuccucuagggggugacauuguaaaguuaauaaacuuccaguuaaaguauacacacagucucaagagucuucauuuguugauaucaucaucagaaaauuaaauacaguauaguuguucaggaagcuguaaguauauauaaaguuauuucaguucugagauguuacaggacauaccaguagaaaauguuaauuuaguguaaaugcuaaauaacaauggauuucuuuauugauagaugguaaacuacauggauauuagcauuaacaaucacuugcuuaugccuguacuccuagcacuuugggaggcccaggugggcagaucacgaggucagaaguucaagaccagccuggccaauauggugaaacccugucuacuaaaaauacaaaaauuagccgggcgugguagcguuuaccuguagucccagcuacucaggaggcugaggcagaagaaucgcuugaacccaggaggcagagguggcagugagccgagauugcgccacugcacuccagccuggugacagagcgagacuccgucucaaaaaaaugauaauaauaauaacuugccucuuacuauuuuuuguuggguuaaucacauagaaauuggauuuuaaauucauucagacaaguuuaacuaaaccaauaaagagaagcaguuccuuucagucuuugcugguuccugaaugauagacuagagucuauagucuuauugcuugauuacuuacuuuuuuuuauuaauaagcuuucucaggguacuuuacuguagcauugacaauaaacacacagaauguuggacuacugauuuauccauuagccuuccauuccucuuaaguuuguuuuugugaacauauaugcaaacaugaguuuuauuuuguaaaaauuauuucuuuccuuuuugaguaaugucaacucauuuuacaucucuuuagaaaaaaccguaaaguugaaggggcuguggagucagauaacagauucuuaacuuucauuucuuuuuuggcauucauacagguuuaagcaucuuugauaagguuugucuucuaugacaauuauauuugguuguucaaaguggaagcuuauauacucuugaacagucaagguauauauauaguagauuucaauaacuaugcuugauauaaguuccuacuuucacugaaauucuucauugggcuguuacauuuacauuuuuuauguuuuuuuauauuuauuuuucuguggcuugucagauuuuuauguuuuuacuauuuuggguuuuuuuuuuuuaaccucaauuuauuauuguuucuacuuggugacccuuaacaagucuuggaggagcaauucuuuguugucagggcugcccaguaccuuucaggauauugcuguuuuaaaugguaauaguacccccagacauugcauuuuaaaauagaaguuaaaaaaaaaaaagccuccacacuuuuguagcucccccgagaggcaguauaauugaaaaucuaaauaccuaucaguauggaaaguuuauauuauguaacuguuaaagauauauggaguuacauuuauuacaaaagcugccauagcccacagcauaauguaaaaaugaagggugcaaacaaauuacauguugcaauguauauaacauuugugguuauauauaauuuuauauguguauaugaagagagacaucuugcuggaugcaggguaagacucuggagccacacugccugagucaaauccuaaccuaucguuuauggccugcaugaccuuaugaguuucagguuuuuuauuaacauacucaggauaauaauaagaucaacuucacaaaauuuuuugguggauuaaucaauuuuucuauuuuuaugugacuaaaugaauacaugauccauggcgauuacucguuugauauuaguuauuaucaaguuauuauuauuccaguucagugggaucuuaucaauaguauauugcuggaucuuauguuuuuauccauuauaacaaccucuaccuuuuaauugcaauguuuaaaacauuuauaauuaauguaaugaguauguuuggguuuaagucuugcuauugguuuucuaugucucauuuguuguuuguuucuucuuucuccuuuuucugccuuuuugauaaucgaaguucuuuuagaauucugucauaccuccacugugaaguuacuagauauuccucuuuuauuuuuuuagugguugcucuagaaugcuuaccauagcuuaucauagucuacugucucauaauauaccaccuaauauuuaaggaaagaucuuuacugucuuuuccccucucauauccuuugccuauaguugucauacguuguacuuauacguauaccauaaaccuuauauauuuuuuaacuauucucuuuuaaagaaauuuauaaaauguaaaaauaaaaauuuuuauauuuugcgacauaaauaucauuuucaguacucaucaagauccaaguuuuaaaucugguauugguugggcaugguggcucaugccuguaaucucagcacuuugggaggccgagguggguagaucacaugagcucaggaguuggagaccagccuaggcaacauggugaaacccugucucuaccaaaaauacaauaagaaauuacccagacauggugucccgcaccuguagucucagcuacuugggaggcugagguggaagaaccaucugcgcccaggaaguggagguugcagugagcugagauugugccacugcacuccaaccugggcaacagaacgagaccccaucucaaaaauuauauaaacuacuuuggguaguuuauauugcaauguuccagaguuuacuaaucuuuucuuuuuuggugucuauacuauuaauccuguccacugaauuuuucauuucagguauuauuauuauuauuauuauuauuauuauuauuauuauuauuauuauuauuuugagacaaagucuugcucuguugccaggcuggaaugcagugaugcaaucucagcucacugcaacuucugccuccuggguucaagcaauuuuccugccgcagccucccuaguagcugggacuacaggugccugccaccacacccagcuaauuuuuuguauuuuuaguagagacaggguuucaccguguuggccaggauggucucgaucuccugaucucaugauccacccaccucggccucccaaagugcugggauuacaggcaugagccaccgugcccggccgauauauauuuuaccucuagaaguuucauuuggauucguuuguguauauuccauuucuccuuucuauucaugguuuucuuuaaaugcuuucuauaguucucuaguauguuaaugucacuaucuucuguuuuuauuauuuugucauuguuugaucucauacuguuggcuuauauuuuuucuucuuauggaucacauuuuccuaucuguuggccucuuuaguaauuuuugacuggcaguagggcauugugaauuuuacauucuugaaugucuggaguuugucaucuuucuuugaagggauucaaucuggccaacaaguaauuuggaguucaguuugauucuuuuguguauuguuuuuuuguuuauuuuuagcuuuucaggguaggucuaaaguagccuuugcucuagggagaguuuaacaccgcuacaaaaguaugcccaucuuggauucucuacugaauacccaggguaacauauagaacucuucacucucucugguuggagcuugaaugcguucuaacccugugugugcauugggaacauucaacuuauugaacagguuuuguucauucuuuggccuugaggagcuucccccugcacaccauauguuaguauucagcugagucuccagguuacccuucuucagauuucuggguuuuuuccugcauagcucccuuuucuuuagaccucugccccuuaauguacaacugccucagucucccugaauucacuccaguguguuuuuucaacucaagaggacuguuuucugcuugggacuccucuuccugggccuuaguuuggcgugugccuccgggcagaaugcugggcugaucauuggugccaccucauuuguuuccuuucuccagguaucauggucuuccucuaucucuguugucugaaaacuuguuacauauauuuuguucagauuuuuucuguuuacagugggaugauaaccauaguuacuucaucaaggccagaaguagaaucuguguucucauuuuaauaaucaaaucaucacuuaguguucgccaugugucagcacaauaauaucagaaucccagugauuaucuuuuuauucuuuggacaaugaaaaagccagauauucuuacccuauacuuugauuuucauuacaucauuuaauaggaagucaggaguggcuuuuucuuaaaauuguuguuacgacaggaguuccaaaaguauuuauuuaacgaagggaugagugaaguaaguauucuuuauuagcaggcauucauucaugcuuccuuccuuccccccccccccuuuuuuugggucaaauagugugccuaaauuauuuaauuuggaaaguaguuagauauguuuuguacaaaaacuguauaauaaucuuugacacagaaaucccuucacaaaggauaauacuaaccauauagaaaagaucugcaauauauuuaggaauagaauaacauucaguucuauuuuuuggaauaaaauuugcuuuuguguaucaauauguauucuauugagugccacauuuuuuaaccuaucaaagccucacuccucacaguugcuuuuauaucuuuuugcguguguuuuuaucaugcguauuucauaguuuuauguucuuauggauaagcaaggauguguuagaauguuaauguucaaauucuaaggaacuuuggauuacauauaccuucagaauuaguaaauguuuguuuucuaaaugucucacauuaaauuaaauucaaguuggaaaguauuuaauccuuuugcaaauaugccucauuacucaucaucaaauaauauuuauucauaaagauaaacacauuuccuugaugaaauaaaucaaauauauuuucuuauagaugauuuuagcuaaauguuuauuuguucuguuuuuguagguauuuuccauguuagacauuaauuuuucaucguauugcugcugcuagaaugaauugcuugucucagaguucuuuaugaaagagauccuuuuuucaucccuguggcaaaaagauguuuuaguguacuuaaacugaguuuucuuaagugaauucaaggaauuuuccuuuuuauuaauaguagaaaauguaucuuaugguaaauuuuuuguacuuaagaauucuuugcaauguaagauauuuagaaauauaaaagccaggccaauuuuuguccuaaaucuuuuaaugcugagaggauccaauucuucaauuaaagauauuaccauauaauaauguccuuguaauugcaaagacuacauaugcacacaaacuaagaaaaaaaugaauguaggccaggcuaauuaaacuauauuauaauuacacuguguuuaacuauuaguuaucuggauuagguuaacuucuaaaggacaagaagugaauauuuuguuuauauuuguaugugcugcguuaauuaucugcauguuugcuuaaugguuacauccugagauggcugucacuaaagccaagggcagucuuaggaaucaaccuuauuucucuacugucuagguuguucccuauauuucuucccaaaauugaucuaucaaguagcuaacucugcuccaugaaugguaggccucacauaguguucacuacuaugguuaaaaagagagaaagaccuguggggagaugacacugucgguaccauccuucaaauuauuauuuuaucauauuggccaguguacauuuagaucaugaauaauuaccugauguguauguaugauuggguaaguugguugucuucgagauuaaaguguguuugaaauagucauuugggauguugggaaagcaaguaucaagcccauuugagacugauaauuacgauauuuguaaugaugacaaucugucgucaguuucugcugcuuggaugcagauauagagaaagaagauaguuggguuuauguaugaguaugcuuuugccagagggauguaauaaaaaauuuagagguagaaggagauaguaaaauaaaguucuuaaaauguaacaucaaagcuaguugcagagggaaguuaaaggggagaagacugaucauaaugaagaaguaguaagaagccagggaacuggaaaccuguaguaaugugcauaguugaauguuggaagaagaggagauuauguuuagagagugggcgcuugauguauugauuuuggcaguaguuugagguggcaguuuaauuauagaauggccacugagugaaagagagcacauaaaauuguuggaggucaggggucaauaagaauugagaacaugggcuguguuuacauuugaauucaauuuacuugcuuauugcagaaaauccaaaauaacaauggcuaaguaaaguaaggauuuacucuuucauguaaagaaagucugauguuggcaguacccuauguuaguacaccaauuccauuaagucaucagggaccccagcugauugcaguucaaauuuaccagccagcacacuuccaagguugcuuuguagcccaagauagguacuagggcuucagucaucuaguauuuauauucuagguaguagggaggaaaaaagggagagggucugcaagaucuuucccugcugucauucccccuuuuauggagacauugcaacagucuuuccuaacuauuucugggaauauaauauuagucuugguuacauggccauauuuugcuuuggagaauacugggaaauguacucuuuuggcuagguauguuacaacuccuuaguaauaauauagcagcuugccaguccuaaagagguaugugagaaauuuuuuuuuuuaaguuacuaaagaagacugcaaauacaaugauuucuucaagugacaacugcuuuuaguuaagacagagaaggagaaggaaucagaaaauguagaggaguaugcugaugaaaagcagugguuccacgagauuuugguagaaggcauggggguguggggaagaggcaugggcuagguuggggcaagaaaacauaguucauaauugagaggagugaggaugccauaaagcagcaagucucaaccuuuugaucaccuauccauaugaguuagaaaaaacauugaauacaaaucugcaauauguuauguaaauuauuuaugaauuacauuuacauauugauguacuaauacuguauuauaagagauauauaaaauagaaauuuuuaaagaauuagauaaaauaucaauauaaaugcuaauauuuuauuuuccauacucuagccaauuguuuugccaaucccugggaucauaugggacucaaaggccuagcuagcuucaguauagcauaggguguuggcucucuuaggggaauaugagccaccuggcauggagcugauccuacuuucugcuagaagcauccucuuaaaaauaagagaaaagauaccuaauauucuuugggaaauuuuggcaauacaguaagauacaguaagcuuaaauuugaggaggaaagagcauauuaagauuuauagauauuaccuuguaaggagauaacauuugaucugagaucaaauuagcaucccuuuguaugucaaagugaucuucagugcuaguuagugugcagugaaagcaaagugcacuacgcugguagugcaguauaucucgguuacacuuuuggaacucuuuuuuuuuucuccuuaauaccuagauggaucgaauucuuaaaauugauaugugguuaugaauacauuauuaaauuaaacuucaagcucuguaauaugagauagcccucaaagccuaagcacuaaaaagcaguuccucuggacaaaaccauuaaaauuaaaaacacacagauaugauaaauagguaacuguuucguguguauauuaauuuuuaaagagaauuuuugacaugugaccauaauugaauugguaauucugagaguaacagauauucaacuuuguuauaaagcucuaguaaauuaaacaacgguagacccauagaauaacacagcaggguaggcaguauacagaguugggcccuauuaucccauggaaacuuaauauauuauaaugaaugauaaaaaugacauuuaaaucaguaggacagaaugagcuauucuuucauucauguguuugucuauucagaaaauguuuaucaagggccaaccacuguccuagaugccagggauacaucagcaaaccaaauagacuaauaucccugucaucauggaguguaaauucuaguuaggguacagacagguuaaauacauagaagauucccuuuggugggggaacguuauaucucuacuucauacaguauaaagaauuguuacaagucaauuuguuuaaaagcaaaccaauuugacagaagauuauuuuauuuugauagcuauccuuaauucauaaaggagaauauggagcuauucaguaaauaucuaacaguuuuuuagugguuaggaaaauauaaaaucaaacagaguguuuuuagucuucagauugauaggaauguaaguuuaauaaguuuuuugugaguuuaggcaaaaugagugcuuguauauguugcggauacaaugguguauugauacuuuuguuuuggggggcagcguaaccguaggucucaaaaugaaacaggcacagagacuaugacccaagaaucucaccucuugguuccccugggaacucucuugcauuaugccuaaggagguauuuugcaauucaggaguuuuacuaucaaucuucauucaaaaacuucguugcauuuuguuguugcauuugugcacaacaguuguaaugaaaauuugagagcuaccuaaaugugcuuuuguuagcaugaugcauucaugcuguagaacauuagcacugacacagaucucuaggacauauuguugaauguaagggguaaauuacagacauuguauguaaacaucagugguaacagcaguuaccacuagaacuguucacaguucuuaucacugggaaagcuacugaaauuguggugacagcuauuuagguuuagccuuaucucaguuguuuuuauuaacuuuuuaaagagaagguauauuuauucaaagagagaguauauguaaaauuacuauagcaauucuuucuauaaaccucaguucaagucucauuucccacuaucccagcccauuuugaauauuuugucaguaucacuuauuuggcacuuggcaggugcucuuguacauaugguuguuugcugugugcucugucuuaccaauuaaauuauaggugccuuugacagcuuaggacauaccuaguccucuuuuuuuuuuuuuuuaacauaauaccaaaagagaaggccuuauuugauaaaaaaauuuaucaugaaugucuugcauucuuuggauaauauuuuugugcuuuuuagguuuauaacuuccauaguaaaucaguuuuauuucuaaauuuacuugaauuuuuaauuauuuauuagcaauuauauuuuaaacacucauaaacauggauguuuaaaaaugaaauuguucaaauuaucuuacuuuucuuucuaggucguuuauacgcaaugcagacuggaaugaagaucgauaguaaaacuccugaaugucgcaaauuuuuaucaaaguuaauggaucaguuagaagcuguaaguuaaccacugaucauuuauuuucugguuaugguuaaaauaccauuuuauucauuugcgugucuguguugucauuuuaguucuuucccuuggcaacaaucaaacaaagccauuauaccugaggaaaaacuaguaauaauuuauuuucauuuauuugcuguauacuuccagagagguuaugaguguuaauuaaaguauguucaaguaucuuugcauaugccaucauaucuuguuccacauuauuauagauggccuuuggcuccuccuuuuauaggugaaaaaccccuccuuuuuuuuuuuuuaaguugagacagggucucacucugucacccaggcuggagugcauugcaguggcgugaucucucggcuugcugcaacccccaccucccagguucaagcaauucucuuacaucagccucccacguagcuaggacuacaggcacacgcuaaacgcgcccggcuaguuuuuuuguauauuuugguagagauggaguuugaccauguuggccaggccugucugaaacuccugaccucaaguuauacacucaccucagccucccaaagugcugggauuacaggcaugagccaccaugcccagccgugaaaaacccuuucuaaccuucccuugcagucacguggaugauuaauuugggaaucuuaauauuucuuauaauaaugaaauaaugggcuguguauuuagugaaaggaacaaugaaggaaaugaugccaauuacuuauccuuucuuccucccucucuggggucccagggcaagauauucuuaugguuuaggcauccuucccuccuagcaggaaugucguaggugacuaauuagucaccuucuugaaccuaauauaacgucacagaucacuguagagguacuuuuggagaagugccuauuggauuggaugucagugcauaaagaaggcagugccaaccuuaguagucacacuuaguaaugaggacucuguccuguaacuccuggacccagccauaccugguuucucuuuuaacaaagucaggguacacucauuaauucaucuccuccaagacuguuacauuaauagucgugacuuacuuuuuauuugcuuauuuagauauccaaccucaggagaauuagaaaccuauucuaucaguuguauuauuuugcuuagagaaaauuuagacaaauaaaaaccaaaaugaaaacacacuagucagcccagagcuuuuuauuguuuucauuguuuuuauguauuguuaggagguuaugauucaaacaagacuuaugcgaagacagaacuuccuaccuaguuguauaaagcagccaugggcaguaguguucucucucacuugguguggcugucuggcuuacugacuccugucgucugcuacuguuaacuacccaaaaucagccucauggcagcacugaggaaauucagcuguucuggagccuaucuggccuugcauuucuacagcugcuucuauggauacaagauaaauuugaguacucucuuucuagggaauggguugggguagaagggagaauguuucucacacauagcaguauauuuguaaaauccaacucuagcauuuuguauaguauaaugucucuuuauuaacuucacuguauagcaguaguagcucagauaauaguucuuggguaagacaaaauucaaacguuuucugaaguguaaaaucacauuuauaaagggacucaucaggaauuuaucacuaucugcauuaaaugacagguaagauaaauguauuccaugguaagggcacacugugguguuuguauuacaguuuuaaaacuucaaguauauuauguuuuugcugucagguauuuucugaugaagaugagaugaaguggccuacucucacuaaaauuguucuacaaugaaaucugccuuuacaaaugauuuugcaguuuggauacacaaauuacuguuaucuguggggauuuuuuuuuucuuuuuucuguucuuguucaggauaaacauagauaaaauuuccuuaaauuucagcauuaaaucuuuucuggaccauaaguuauucuguuuaauuaugaaaguauuuacuuugcugauuuuaugaaaaauccuggggcuucuuuuaauuuaauuuuuuacuuuauaacaucuuugaaaaaagcaguuuuuaauuaacuaguuugaugcucagaucugauacuccagagaguuauuuuauuccuguauuguagucugaguaaaaauuaggaacuuuuuuuaaaugcuuuaaauuauugugucuauagaaaagggcuaaaaauuuacagauagaaguugcauugauugcagguauauauuugucuaauuuuuaaaagcuuccauaauuugauucugaguuugucaucuuauaccuuacuuugaauuagaucuuuuuuguuuuucacacuaugugcucugagagauaucauuauuauuauuauuauuauuauuauuauuauuauuauuauuuugagacagagucucgcucauucgcccaggcuggagugcaguggcgcgaucucagcccacugcaagcuccuccucccagguucaugccauucuccugccucagccucccgaguagcugggacuacagcugcccgccaccaugcccagcuaauuucuuuuuguauuuuuaguagagacgggguuucacuguguuagccagaauggucucgaucuccugaccucgugauccacccgccucagccucucaaaguacugggauuacgagugugaaccacugugcccggccgagagauauuauuuuacgacaugaugaaccuucuagucuuauuuuuuuuagauuugacagaaauugaaaugggaauaaauuaaaauuuuaaguuauauaugccuagaaauuauuuucuaauucuauuuuuaggguaacuuauaguuuggguaauaaaacaugauuuugaaauauuugaugcuuccuucacauggauaauuggauauauuauccuuuuaugcuugguuauuuugauuguuagagcuaaauuauauuuucaguuuaucauaaguguguuucuucaaaguuguaagcauuggauuuuguuuuaaaugcauugggcugaggcauagcagcucuuuuugcaagauuucauugaugacaucuuuuauugaaaugaauguaaaauaauuuacuuaaaaugauuauuagaauuguuuguaauuaagucaacacuucugagaguccaaaaucauaagcuauguaucugauuuuauuuuagcuaaagaagcaguugggugauaaugaagcuauuacucaagaaauagugggcugugcccauuuggagaauuaugcuuugaaaauguuuuuguaugcagacaaugaagaucgugcuggacgauuucacaaguaaguaaagagaaaaauaaaaauuauuuuauuaauuuuguaacuguauaaccaaaauuaacuaguuuucucuggaacacuuucuaaccugcugauugauuuagguuuuuuuagaaaaaaauuaucaaaccucacggugauuuuagauuacaaauucgggccuuucucuuauaagaaaauggcugaaagaagaaauacccagggcagauuuauuuacuuaguaaauaugcucuacuuagcuauuuuuuaacauuuaguaaaaucugaguugauuuuagccaaaaucacagccccgccugaugauuuugauuuugaagguacccaccccaaucaauucaaaugauuuaucaguauaauauuuacauuuaaagaaauacauuaugguuugauauggagucagauaauacuauaauuacauuuuucuaaagucaaaaacauacaaaaaaucuugacguagcgcauuuacuuguaaugugagucuuguuacuuucucauaguaacagauuagaaaaccauuuuuguuauuuucuugaaaucuaauuuuauuuaaaacaugaauuucagagugcuuuuauaaagauaggaauuuuuuuucuuauagcuaaaugacaaaacuacauuuuaauguguuucauauuuaaacuagaccgcucucuuuucucuuccagaaacaugaucaaguccuucuauacugcaagucuuuugauagaugucauaacaguauuuggagaacucacugaugaagugaguguacauucuuuauugucuuauuagcugaagaucaguaauguuucuguuuaucaauauuguuauugcauuguuuauuuacagcagaaugucugucagaaauuaaugcaagcaaaaaauguaauuuugcauuuuuuauuagccauuuuuaaaaaguaaauuauuuccaauaauauauuuuaauuuuguacuaaguucuuuauuuuuauuuuuguauuuguuuuuugagacaggauauugcucuguugcccaggcuggagugcaguggugugaucucagcucacugcagccucagccugcccgggcucaagcaauucuccugccucagccuccugaguaucugggacuacaggcacaaggcaccauagcuggcuaauuuuguauuuuuuuguagagacaugguuuuaccaagcuggugucgaacucuugagcucaagcaaucuugccugccucagccucccaaagugcuggaauuacaggugugaaccccauugcaccuggccuguaauaaguucuuuaaauccagcauguauuuuacacuucagcauaugugugacuacuguauuggacagcacagguuuagaguuugaucuuacuaaguauuaacauauuacuaauccuguauguuguuaaguuuuuacacuguaauuuguugaacauacuugagguagaaucauuuuuuuuuuugagauggaauuuugcucuuguugcccaggcuggagugcaauggcacagucuugguucacugcaaccuccgccucccagguucaagcgauucuccugccucagucucccuaguagcugggauuacaggcggaugccacgacacccagcuaauuuuuguauuuuuacuagagacaggguuucaccauguuggucaggcugguuuugaacuccugaccucagguaauccgcccaccuuggccucccaaagugcugggauuacaggcaugagccaacacacugggacuggagguagaaucuuuuuaugacuuuuuuucuguuuaauuucuagucagcauuauuguuaaugguuuguuucccuuguaaaaugcauauaagacuuaauauuuuauaacauacuuccuguucauucuaucuauuugauucccauaaugauuuaccauaagguaagcaaagcacauaaccuuuguauacaugggcaaauggggcuaaaugacaaauuuacuacuuuaaguucaguaucauuuucaccauaacaggcuuuaccauucauguggagaauuuauuuucugagagggaauauauuaaucuagaaaaaggaagaguuauaaaugagauugauacauauguguuauaugagugauuugaacacuaugggcaauguuuuuuuugugauuaaacuuuuuuuucaaaaugaugaguagcucuuaguaaagucccaaacaaaacagaguacaaucacuguauaaggcauuuuuguaaaagauuguauagcaaaacugcaaaaaguuauuuuuuguuuauauucaaaaugaaguuacucucuaagcuugaugaguauaagcagggguuuugccagcaugaaaguuguacaggacauuucaaaguugugacaaaugaaggacuuuucuuuuuuugugagacugagucucucgcucugucaccaggcuggagugcaguggcacaaucuuggcucacugcaaccucuaccuccuggguucaagugauuccccugccucagccucccaaguagcugggccuacaggugugcaccaccacaccuggcuaauuuuuuguauuuuagcagagaugggguuucacuguguuggccaggaugaucucaaucuccugaccucgugauccaccugccucggccucccaaagugcugggauuacaggcaugagcuaccaaguccagccaggacauuuuuuuuguaaugugacugucccuuuaauuucaaaacauggagcaauuuuggcccuugccugcacacugccaguagcauuucccaguaauugagcuaacuagaagccaccugagauauuucaaaacagcccuacccuaggguauggggcaaugcccauuuagagccacugcucucagauauuuuauacucuuauacagagucauauaaaggagaacugauacccggagugugaaaaccugaacuauuacucaauggguauuaccuuuuuauauucugauggccuuauggauccaccuuuuuaacucccuuuuaccucaucuccuguuauuaaugauccaaauuuucuuuucuucucuguuuuacuagugugaggcacuaugcuaaauacuuggggauacagagguaauauaaacaugacaugauggaaagcuuugagugguucaguagaacuuuggagaguaccagguaggugaagaagaauagugagaauucagauuagaagaguaagucauaagccaggucagacagaugauggaagaccuacaaucuucaguuuguauuuuugaguaaagaacuaugccuuggggugcuuuguauaauaggagccuguacaaugaacugaagugagggagaacuacaaaaccauuugacaaaaaaaaaaaagaaaaaaaaacugguugaugauuaacuaugggccuuaguugagagguggaaaacuguacaugaugaguuguuuuugguuugagaaacaauaauauauugaaacuuagacuuuaaaauuugaggugcaaguaugacagccaaaaaggaauuaccagaagccucuuggaaauaaauaagcaaaagacagcaaaguagaggggacaauucaaguuauaagauuagacaaacccuucagguaaguggauuguuuugaaugagagagaugacuaaauaaauacccuugguaaacacuuauuuuugcaguguaagaggaagaaguuaauaaacacauucguagaugugaauggaaauucaagauaccagaagagaggaucaugauaaggcaaaguaacagaucagaaugccacaugguuuauugugcucugggccuacaggcgugcgccaccaugccuggcuaauuuuuuguauuuuaguagagacgggguuucacuguguuggccaggauggucuugaucuccugaucucgugaucugcccucuccuaguucuuauuuggggaagcuaccuuccccuauguauuuuagaagcaagcacauaauccuuuaaaguuauaacugcuaacaauggugaauccagccaacagguaaaguaauagucauaggaaaaagaacaaaauuuccagaacucuuaagugaguaauagguucucuucacuuaaggaauauguaacacuuccacauacauaagcuacauuaauuuaucuguauuucaggagaauaaucuagguuuacuuuuagcuaccauuaaugaagaaccaucuuccuuaauuuuuugaacauaguaacuagggcaaaacuguaaaugaggccagugagaaggcuucaugugagauuggggugaugggaugggauuuguuuagauauuaggguuacuaaagaguaaggguaaagggauuuuuuuacccccuaucucacuacccaaccugcucccuaagccccuuugccuugcacuggugcuagaauaaaguagcgucuuuguugguggauaaaggauuccagauaguuggaggggucuggaaugggaucccacacacagucccaccuggaucacugcuuaguggagcuguaggagcgggacugccaccacccagaccuaccugaaugguagagccacuggcagcuugcacccugagccuggaaaaggugcagcuuucaacuccaaccugugggagcagccacaggggcuguacccugcaaagccauaggggcagagcugcccaaggccaccacuuguaccaguguucccuggaugcuggucauggagucaaggauuauuuugaaacucugaaguuuaaugucuacuauguugguuuuuggacuuguguggggccuaucgugccuuuuuuugggcaguuucucccuuuuagaauggggaugcuuacccaaugccuguaccaccauucuuucuuagaaauaaauaacuugcuuuuaaucuuacaggcucacagguggaaggaaugugccuugauucuuagaugagauuuuggacuuuugaguugaugcugcaaugaguuaaaucuuuaggagacuauugggaagggauaauuauauuuugcaaugugaaaaggacaugagauuugagggggcgggagcagagguggaauuguauaguuuggauguuugucccugccaaaacucauguuaaaaugugauccucaguguuggaggugaggccuggugggaggaguggucauggggauggaucuuuuaugaauggcuuggugcccuccccaugguaauaagugaguuuuugcccuguuauuucacgugagaaguggugguuuaaaagagccuggcgucucucuugcugccucuccugccuugcgacacgcuggcuuccuuuugccuuccaucaugaguaagagcauccugggccucaccagaagccaagcagaugcugggcccaggcuuaugcagccugcggaaugugaaggcucuuuucuguauaaauuagccaacaucagguauuccuuuauagcagugaaaacagacuaauacaagauguaaacaaccugaauaaccgaagccuucugugugauaucuguacaugaugauuugggauauucuaauuaaguuauuuuuacuuaaaauuccaucccuuuucaaaaaggccacugguucacaagaugaauuaugcaauuuacauaacuaauucaucuuauuuugagcuuuuuuucccugcaguucguucuucugucauugaagaaccuacaggaacuucuuauuuccuaacacugcaaguccaagcuccucugucagauuuucagguuuucugucaugcuccguacucugcuugcugcccuauuugccaguccuacuuuguagaccaggcugcucacugucuucucauuuuucaccuuuggaaauguguuuuuagccggcuuugccuaaguuuuaucuucucuucaggucucaccuauauuauucuaguccuuacaugaauuucuccauucucucagcucucccccaccuguauuuagaguucuaacuuuauaaauguauugacuucauuuuuguguauuguauuuuugaauaaauuauauugcaaguacuugaagagggggcuuugucuucuugauuaguuucugcuugaaaaguugcuauaguguuucauuuuuuaaccuguagauggaaaaaugccuuacacuuguuuauauauaacuuauuuuauuucauaacuuuucuaaaauguaauagaucucauuuacucaaugauaauuuucuuggucauuucuugauuuuuuuuuccuuuuaauuucaugucauuacucacuuguauaaaacuaaagucuauuuucuuuaguccuucaacauuuuuguuuuuuuauuuuuuaauauuuugucugccacuauucuauuucucaguuaucuuaucucuauuuuagguauauguauuuagcucuuuuaacugugccuuauuaucauuccaucacaacauuuuaauuaaauuugcuguuauguaagcuucuagcucuguuguuacauaaacuguaguucucuuggaaucagugcccaguuuuaguuauagagucaacauaaauauuuucuuuuucugcuauagcaucuuguauaaucuguuuguggccaauauuauugauaggcuuccuuucauuguauuuuagauucauuucacuacuagcaguguuugaggaacagauaacauuuuacuauuuuucauucauaaucuuugguuaagauuaauacugccaaguuagguagaacaugaaaauuacaggugaaagauaaugcuauucuuauauauggaguuuuugcuauuugagggaaugagaugaauauguuuucugcccucguugagcuuauguucuaaccuggaaagagaaacagaauaacucuaaugauacaugauguauuaaugaaauguagggaagguaugcauuggcaguaccuaacauuagccuggcacuaugcuuagacaccuuguuucaucuuucacaacucugaauuauagugagaaaacugagggucagaaaaauauaaagugcuuggccccagauacauagcccaggacaauauuucucaaacucucugugauaaagguucagccuuuuuuuuuuuuuuuaaauuuucaauucuuugcagaugauuuuguaaaauacaaaugcaaguaauaaaugaauuacaaaagagaaaauuuaaaaaggcauacagauagauauacagcauaauuugcuauguguguuucaaauauuucuaaauccaguuucaguauuauguugucacaaacucguaagcaguuuugcagaccagcaguguuucugggaccacauuuugauuggcacagaucuagaucuuuuuuggauccuguuaugguccuccuggcuugaaaaacagggcugcacauuuacugaggcaauaaggcacaugaauagcuggcugugagaagguggucuguuuaaggguauccguguguacuggaacguuucaaagugagcaacaucuuauuauuagccuagaaaaccaugguaaagcagagauauuuuccaacuacaaaagcauuuauuccuuacauacaccauacuuuagguuuucauguucuuacuguauccugaaagucucauucuuagcaauuaucauaguagauaaauaugagaguagaguuaugucuaauuacaguagaaauuccaugugucuuguacucacuuguaugauaauugccaagaacaaugucuuacaccuaauugaugaguuguaaaugaaugaaauauuuuuucauacaguauuaguauaaaguaauuaagagugcaggcauugggccuccaaauucugucacuccauaacugcaugacuuuggguaaguuaacuuauguaagccuguuucaacauacguaagaugaugaaaauuguaauaccuguuuugucaaguugucauggagaucaagugaggaaauauauguaaagccuuuagcaaagugccuagcauguaagugcuuuaaaaaaauuggcucuugcagauucuagcaguaguaaggaguauagcuugagaaggccgauuaggaagccuuuaugaacuaggguaaaagauuaaaaacuugaguuuucagaaaggagaucagagaguaggguuacguuaaaaaaaaauaugcuaaaugugcuuuuucuguuggaagguaauuuuuuuacacacaaaaaaaucaguucguguaguccauucuaaguacuaaauguguauucauugcuaguuuuagccuguaaccugagucugaagcauauagcucuaucauauaauaauguuuaaaccauguuuuaauaauauuuuacugggcuguauuuagagagguugucagcaaauacauaaaauuuuucauggaaacuauccuaaacugauguggcuuauauauuuacuuuguauuuagaugagcuuauucacgggcauuaauguauuauugcuacuguauuugggagucuaacauguacauuuggaguuccaaaaggaguacaaagaaaacgaguacaaaaagauaucugaagaaauaaugaccacagauuuuccaaauugaguaaaaaagcagcuacagauucaagaagcacaguggacaauuagguuaauauaaaggaaaucacaccuagaaacauuguagucaaaccacugaagucuagugauggaagagaaaaucuugaaaaagcagccuugagaaaauguguuacacacaggguaacaguguugugagggauagcugacuucucauuuuuuaaaaaauuggaggcuggaggauaauaaaaugacauauuuaaagggcugaaagaaaaaaaauaaaacaaaugaacaaaaacccugucaacucagaauucuauauacagcaaagcugugcuucaaaaaaugaagguuuuaaaaaaacauuuuuaggcaaguuaauucauugcuagcaggucugcacuaaagauccaaagaacuaaagaacagcuaaaaugaaggaaguuuuucaggcagaaggaaaaggauaccaaguaggaauuugauuuacaggaaggaaugaacaacacuggacacaguaauguagguaaauguaaaagacuauauauuuuuaauuucuuuaaaagauacaugacuauauuuguaaaaauuauuuuaacuguacauauauauauuuggcaaacucuaaagaaggcagagaaggggaagagaaggaaacauaaacaggugggaccaaugcaaaacacauagcaaauuuuagaccuaaauacagcuauguuguuacauaccauaauuguaaauggacuaacacccaaauuuuauaguagagguuuucagacuagauuuuuuuuuaaaagcaagccuuaacuguauacuguuucuaagagauacuguucaaauacaaauauaaauauuuugaaaaugaaaauauggaaaaagaugcuuaaugcagauacuaaguaaauagaaucucaaguggccauagauaaaauaggcuuugaguagauguguuacuagaaauaaaaggggccauuuuauaauaaugggucaguucaucaagaagacaauacaguuacaaaugucugugcaccuaauaauaaaacuuucaaacuauaugaaacaaaaaucaacaaaaaaagaaaaauaaggaaaaacucauaaucauaauuggaaauuuuaacacccccauuagucaucgauagaauaauuuuuuuaaaucaauaaaauaacacgaauaacgaguggccacauaaauuguugucuagaaugugaaaaaccaagcgcuuucauacauugcuugauggagauguuagauguuauauccacuuuaggaaaagaguuggucauuuuuuuuuuaaugcuaaacauacucccuuuuacccagcaauuccuauucugguuuuuauccaagaaaaauaaaaacauauguccugaaaaagacuuguugaggagugcuuaugggaaguuuauucauaauagcccaaagcuagaaacaacccugauguccaccaacaggggcacugguaaacacauugggguauuagauacaaaaaggaacugacugcugauauaaccuacaacauggaugaaucuaguagacauuaugcugagcaaaaaaagagccggaaguauacaaacuauaugauucccuucauauacauauguguguacaugcgcgcacaccaaaggaaguugaucugggaagggauauaaauagaaguaugguuuacccagguauauuaaucuguuugucacaauauuaaauugugcacugaagauguaugcaucucaaaguauguucguuuuacugcagaaguugaauguugaacuauuuuauugauagguuugguuuaucuuaguauggguugacaguucuaaaccugcuuauucuauauucuaagagugaccaaaugauuaaauauauugagggagacaguuuucucacuuuuggggaauuuaguuacaauguggaaugagagaagacuagauuguguugugcuguuagguuggaauuguuguaaucuuaauucaugcuuuuaaauauauuacacuagaugaauagaucuauuuauauagguauaauauguauacuauaguuuguguaucuguauacucugcuaggagcaaugaugcagcaguagcagugagcacacagugagcaucccuagugccugauuuucuguucuaauuuuauucugcauaaggaaccaggacuuucguaaaaagugcuuaaucuagggcuaaguccaggaaggcuacagauaaggccagaccuucuugugacagaaaggaggaaaguguuaucauaaucauaggacccagaagccgacuugaaaggguucccauuguccaagccagggacaguuugagcauaaaaauaagaaugauaguaauggaugauaacucauugaauaaauuaagaaucuguauagguccagacugauacauaugaagaaauaaauaaaugaauaaauaauagaagagcagagaaggcucuuugucauaguauucuaacuauaaauauacaaauagugauaaaauuaaauuauuagugggcuuuaaaaguaguagguggaaaguuugauaaaaagaaguauauuuacaugucucugaauaucuuaccaaauugcuuauugauaucagaggaaaauaguaauucaauaaugagaaaacuuguaacacaccucuuuaggccaagucauuaaaccuaacaccacuaauauugggacagcucacgucaugugcauccuaauaagaugaucugaaaaagacaaacaucgcuucagugauaaugcuuccaaaaacguauaacccgaacguaaucaugaggagacaucagacaaaucaauagacauuuuacagcuugguugguauuuuuuaaaaagucaaggucaagaaacacuaaucaugcuccuuagauuagaucugggccuggggggaaaauaacuacaaaggacgugauugggacaauugacaaaauuuauugggacuguggaucagacuguguaacuauuaaauuuuccgauuuuugagauuguccuagauuuuggaaagugcaaugaaaggguaaggggacaccgugucuucaauuuacucuuaaaugguacagaaaaaaaaaaaaaaaaauauauauauauauauauauauacacacacacacacagacacacuuuuuuuuuuuuugauacggagucucgcucuguugcccaggguggagugcaguggcgcgaucucaccucucugcaagcuccgcuucccggguucaugccauucuccugccucagccuccugaguagcugggacuacagguggcugcuaccaugcccagcuaauuuuuuguauuuuuaguagagaugggguuucacuguguuagccaggauggucucaaucuccugaccucgugauccgccuuccucggccuccugaagugcugggauuacaggcauaagccaccgugccaggccugacacacacacuuuuuauauuuuauauauauauauauauauguauauguacuuuuuauacauuuauauguagaaauaaauugauaaaaauuaaauaguuggagaaucugaguagaagauaugugagaguauguugugcuauuuuuaaaacuuucuguaaauuugaugaaaacuauauuuuuuuuucaaaaaauaauuaacauugguuucuuuucuuaccccaguagauuaaguauuaaacaguuaccgaccuuaccuuguuuggaaaucuuuuguuuacuuggaacauauauuccaauguuaugauauuuuaaaaauagaggaguuauauuuaagucuuuguguauuaaguuauaguuaugauuugggggguauaguuuuacucucccuuuuaaaaacuuguuugcugaaauuauaguugcuuugaaaaauauaaaaggauuaaaauguugaaugaauaucaggaaauacauguaaucugugacuauaaauauuucagugucugaguaauuuugauaauaaauuuguuuaauauguuuuucaagcauuucucauuauaccacaucucaguguucugggaguuauguggaagucuuguuuauauaauaacuugggagguugagggacuaagaguauaaauguauuugugauguugccacaaaguuagagauuauuaaucccauuuuuaucacugucuacuuugaaaaucuuaugaaagcuguggauucucaugcuaauguguauugcauuuuugcauguaauuuggaggguguuccaggaagaggcaagagagagugcuacauuuuugagacuacaguacaagcuaccuauucuuguucaagaaauaacaaggagaacaauguggcagaauccagaaugagaaggagugauaggauaggagaugagaaugagggugguggggggaggauucaaacagagaauuuauaaaauuugacuuguauuuuuaaaguauuguucccuucuguaauggacaagaguggaaaaggcaaacucauuaguauguuauuaaauaaucaagguaaaagauaaugcuugcuaggaccagaguuugccaaagaggacauguugaguagugguuggauucuggauauauuuugaauguagagcugacaaaauuuuaacaguuucauuggcagaguguaaaagauacagagaacucaaaaaugacuccaaggguuggaccugacaacuauaagauuuuuaaccauuguggccauuuauagaguuggugggggaaaaucaggaguugguuuugaacuuggaggagcuuaucaaacauacaggacaaauauggaauuggauguauacuuauacaagauccuaagguucagagaagucugaacagaagauauaaauuuggaaguuggcagcaaauacaccucaugguauuuaagggugguacauuuaaagccauuagacugcgugagaucaucaaguguagaaagaagagacaaggaauccaagagcugaagccugagguacuccugacacugggacaugaaaaaggacaaguauaaaaggacugaaggagcgcgcagcaagggagaaggaaaacccggaggucuugauaaccaggaaagcaaguguaagggggggcaucaaggaauggggugggaaauaaucaccuguucaugcugauaggcgucaaggaagauggcauguaagccuugaauuuagguggcaaaaaucacaauuacuuucacaccaaccuaauagcaauauagaaguaaucuguaaccuugacaaaagcuguugcagugacugguggagauuaaaaacuugccuaggauggguucaauauaaaaucaaagaggaagaauuagagacagcugguguaaaacuuugucuuucaaggugacuuuuugguaugcuaauggagaauaauuuauaucaaauuuuucauagcucuagccaggaauuuauuauuacacucuugugagucuuacagguccuaaguuugaaaaucccuccucccgccuaugguugcuguugucuaaccagucaugcuucaguguagcaagugauuuaaaaauuaaaugaaaauucaugcuaauucuuaaguggccaaaauuugcaguugucagugauucucaucaaucuaauaacaaaacaggaacuuagaggccaaggacaaaaguaaaaguucuuuuugcaguuccugucucuuagaaaggauguuuaaucagccaaaaggaguuaaugaauuucaaaaauacaucuugaaaauuuccuuuuaaaauauuguuuaguauccagcauccuuuacauccuuuauuuuaaagaaaacaacauugaaaagugaauuaguggaauuacaacugccggaaauuucugcuaaauaguauaugcagcaguuuguaggaauagggauguuuuggaaacaggaugaaauaaaaauuaaauacguugcuuuacuaaacugagcccuuuucaacuuaguuucuuaaauuucacauacuaaugcagaaacucaaauugguuuaaacuucucuacacugcucaugcuuagauauuaggacugaaagaaccuucuaaagucauuacaacuuuucuacuaagucuuuagacaggauuaaauuauuucagauagaagaaaauuuagccuaauuuuaaagacccucaaagaaggcaguuuaaacuuuccuuagcaauuucuucauuuacuuguaaaauaguuuucuucguaacuaccaaaagguacauucugcauugauaaacauuaaguagcugaucuuuaaggcuuauuuucuguuauuucaucuauuuuaaucugaguugcaaauugcagcgugguaauuguaguuuaccaagauagaccugaaugaguggcuaacuuuacuacuaaaacaguaugaccuucaguaaauuacuuuacuuuuguaaugacauuucuucaucucuaaaaugauaagauuauagaaucccaagaaagaaggaugaagaaauagggacuucagauaagacacgugucacauuuagggaugucaguuauugcgugguuucacauuagacucuaaaacucaugcuugacucauucaucucauguauccccagcacuuagcauaguaccugacuugaguaaauaauaaauaacuugacuuacuggaaaugagggugcuucauagggaguaaacauuugcacuuagccuuggaggaaaagagacugggcagaaaggaaaccauguuagauaagagagaauagcauaagaagagaaugcagguaagacaggaauccaaucuugauugagggaaauggaaauaagacugaguguccacaauguagagggccuugaaugccagauuaaacuguauuuacauugagccagucuuauaaugucucaaagccuuagugugaguaaaaugugaccugccuaaauuucgagguuuugaugaagaccaaguagaggaaaauguguggaaaugcuuuauaaccuguagaaugcuauaaagaugucaguccaagacuuuaaucuugucuuggauuuaucuuacguauccaacuagcauuuaauauguaucuucuauccauggcauauugguuuauuuaucuuuauucuccaaguauuuccuuauuucuaucuuugcuuguacuuuuccuucucuccagaaucuuguuauugcuuccauuuuuucacaucuuacccaucuugcauggccaaacuaaaguaucauuuccuuuaccuuauucuguuuuuucuuuauucucugaacuguuccauguacuuacuauaggaaacagguuuaauacuuccuacuaaguguuuuuauaguaacaguucuuuguauuuuaauuucauaucgauagccagaugaguagcucccuaaggguggaaauaauguauugacuuauuuuauauaucccauauugcuaauuaaaggucuuaauuaacagcaaacuuuuacagagccuaaaaguauguugagguuaacuauacauaccuuauguuuuuccccaaagagggaaaguuuaaaaauuuaggguaauuaauuaccuucauuaguuuucauugcuggagcauagguuaauaauaaacauuuuaaaagaaugucauuuugcagauacugaauucaagugaacauagagacucaaaucugauacuaauccagcauuuguagcccuucaauucuaauugcucaggauuuugaaaaauuaaaaauaaucuggaaaagucagugcuuuagcacauauucuuugcucugaaaaaaugaaaaaggaagaaaaaggugaaccacaggauauugcuguuucuguaggccuaaaacacuggaaauuucaagucauucuaucuaacuguaucauaaacguaacagaacuuccuaaauccaauagccacuuacauaccacagaaauaaugaucucuuguacuaccacagaaauuucaguuagaaucaguuaagcuuucauacauuggagauauguauacuuccugagcaacuacugcauacuggucacaaagccaagugcuugguauaaacaacagauagacucugcuuuuaaugagcuuauauuguaagguauguggguguuuugagggucugggaggacacuuugucagcauccuuauauaauuauaaacuaugauaaauguuguuuuaaaaaaagauguaagauuaccggagagucugaccuuugauugggaacaucaggaaaaccuuucugaggaaguggcauuugaucuggcauaugaggaaugagcugaguagggguggguuagcugggugaggaagaaaaaagacaauaggcaaacagguuguaugggccauggcauguguaguaacagaaaaaaaugcauagcuggguaguagucagugaaugggauagggacauugagaagagguuggacaaucaagaaccagguagaguagacccuuguauccaaaguuagaguuuauuuugcauuuuaaaugaaaagauugacacgaauggauuuauauuuuagaaagaucacuguacucagagcacuagaugaggaaggugugguaggggcuagggcaagaauagaaguugggacaaauuagggggcuauuucagugaaaauggggagaugaagaccaaucaagguauguuucaaaaggaaaaucaacuggauucuuggugaauuagguaagggaguggggggagaggcaaaguauagagagagcuguuaaaaaugacuccucccauuuacuugagagugaaguucccagaggaaaggagaggugguagggggaucaaaagaacaguuuuaauuuuaauuguaugugagacauccaaguggugaugucacauagucggguauuugucaaagcagauucuggcuagauucauaaauuuaagaauaauaaauuuaucaauaguauuuaaagcuaugggaaggcauaugaagagguuaaaaaaaaaagcuagauggcaggaucaugauguuuguaugaaucugguaggugguguaauggcuuaagacagccccacugugagauaauaaauggcaacugauaugauguaugaacuugagauggaggagagggagaaugaaugaacauacauuaucugaagggaacugccucuauucauucagcucagauaauuauuacuaaauaaaucugggcccagauauuucauuuuuaaaagagaaguuagaaauuuggcuuuuauguaacuuuucccauauuuggauauauaaaacauaauucauauuuaaaauucuauaugaguuauuauugauugcgcccacuauuuugcacucuguccuaggacagaguauuuaaaauuacuugaaggucagcuagaggauuaggagccaaaggagguuagagagaaaccaagagaauagagugucacaaaaacuagagauagagaagguuucacaaagauuggcauaguccagggcuuuuaauauauuuacagaguguagcaguuugguaagaugauaccuaaaaagugucccuuggauuuucuaguguagacuaggcaguugauauuagcaagagcaauuccucaaaugaacugacaacuuaagugaggaacaggcugacgcaugugggcucccugccaguaaaagacacaggcauauucaaauucccugaccuuuuguguuacuggagaauaugaacuauacagaaaagaaauauacccuccccaccccacagagugaacugaguggugaaguagugaagacuaaauguggauacuucuguuggaaagcucauuugugaaguggagcaaaaugucauaccuggaagaaaaucagaaucaauguauagauuuuuaaauugaauauguaagaggaguguuugauaaggaaaugugauacaaauuuaguaauuuagggguuaauuuuuuuuuaguuuucuguacagaagcugccuguaguaguaucuagagacucacauuauagaauacucaacuaaguaucuggaccaccugcugcauuuguacuuaucagugacuucguggaucuuugcaaaaggauacuuucuuucuuuuuuuuuuuuuuuuuuggccgggaggagguccggagcugggcuggugcaguggcgcagucuuggcucacugcaaccucugccuccuggguucacgugauucucaugccucagccuuuugaguagcugggauuacaggugugugccaccaugcccggcuaauuuuuuguguuuuucauagagacgggguuucaccauauuggccaggcuggucuccaacuccugagcucuggcaauccacccuccuuggccucccaaagugcuaggauuacaggcaugagccacugugccuagcccucuauuucuuuauuucuuuuuuuuuuuuuuuuuuuuuuuuuuuugagacagagucucucucugcugcucaggcuggagugcaguggcgucugccuccuggcuucaagugauucuccugccucagccucccgaguagcugcaacuacaggcacgugccaccacgcccagcuaauuuuuguauuuucaauagaaacaggguuucacuguguuggccaggcuggucuugaacuucugaccucaugaucugccugccucagccucccaaaguggugggauuacaggcaugagccaccgugccuguuuucaaauaguaaaaccacguucgcucuggaacgcuaaugugcguauaaaucaccugguggucuuguagugcaggugcaggcuggcacuuguagaucagguucaguagaucuggggugggcuugaagauucugcauuucuaacaaguucccaagugauaacgaugccacuauaaaggucaguggaaaauauaaacuaaaaaucacuagcacauccaaaauucuaagagauuuuuauauuuuuaaugcaaauuuuuaucuuacauccuguaacauuagcauaucauguuacauuaguuuuaagacauagaagaagaggcagcuaacagguucuucaugaucuuuucaguuaacccaaugagguauuauuuuucccuuuuuagaaucaggguaacugagguucagagcuguuaacuagcaugugacuaguuaaaaagucagguuuaccugccuaucagucuagcauuugcuuuaaccaccacaucuuaauuuucuuuuuauuuuuuucuugauuuguacaguucuguuuuuuugucuuuagugaaaauaauucaaucuauuguuauuuuuauauuuagucuuagauuucuacuuuagccuauuucuccccugugcagaagaguugcaaauuuugcuggaaggacacuccuguuuuuccguugcauauccuuucugaaauguuauaugauaaaagagaacugggcguauguuuugaggacaauagcuuuucaugaauucugucaagccuuaaauacuugguggauuccagcaauagggugggguauugccaguuucuuuuagagcuguaaucugcaaaaauagguuuuaucucagaaauaugauauaggucaucauaaauguuuacuuuuuacuucuuuaccauaguccaauguugauauaaaaaugcucucuuuuagaaugugaaacacaggaaguaugccagauggaaggcaacauacauccauaauuguuuaaagaauggggagacuccucaagcaggcccuguuggaauugaagaagauaaugguauguauuuauuuauucugaguaaaaggacuuaguagaaucauaauuauucaguagauuacucaaaguuuuuggagggaacaauacaguuuuguuuucaucaggcccagaaucaaugaaaguuaaguauaaaaucauaaacuuagggacagugagaaauagaaauaaaggucaaacugcuguaauaccuguccaugucaacaaagugacuuaucugucuccugcuuuuuuuuuuuuaaugagacauagucucgcucugucgcccaggcuggagugcaguggcgcagucucugcucacugggagcuccgccucgcagguucaugccauucuccugccucagccucccgaguagcugggacuacaggcgccugccaccacgccuggcuaauuuuuuuguacuuuuaguagagacgggguuucacuguguuagacaggauggucucgaucuccugaccuugugauccgcccaccuuggccucccaaagugcugggauuacaggcgugagccaccguaccuggccuccuacuuuuaaucagauuucauuccuguuacauaggaaaggcaauccauuuauaauuuauaaaauguuuucaaaccacgaagaauaccguaucauuuuuuguaaaucuauuugaguuauguagguuauuugcggaguuaguaauacauucacaugguucaaaaaaauuguagaguauauaaaaaauaugaagugaauuucuccugucuaccacaucccccgucuucccagauccuaccaaaacucaaguaagcauuuuuaguuuuuuuuguguaucuuuacagagaucauuuuuuaugaauuuacuaccaaguagaaacauauaugcuccauuuuuucauacaacugguaauauacauacuguucuguaccuggcuauguuuuuuuuuaacuuaauauguacaggaaaauuuuaccaucacacagugcguuuuacaaauuuuaaucaugaaaaaauaaaggucucauuauuuuacuuggccuuucaguuaauguguaauagaaaagggaaaccuuuuuucacuuacuuguuuuuuauguauuagacguaguaaauagaugguuauaaagagaacgaccacuguucuuggaacugagaaaauuccaaacgauccuugcauuuuguuacacacuuuuaugcauuugugaagauaauuauccaaugcaggcaucaguaaacuuucuuaaaggaucagauaauaaauauuuucaguuuaugaaugauacugucuuuguugcagcuguuuagcucugcuguuguaguacagaaguagccauagauaauauguaaaaaaaugagugugguuguguuccaguaaagcuuuauuuacaguuaacagccugccagcccacuggccauaguuggccaaccccaaucuaauuaaucucuuuagaucuauuauuauaaugaauuauauugaaagauugccuauuauugaaccaauuuuacauugugugauaaaccccacuuggucaugauauauuauuuuuuuauuauacugauagguucaguucacuacuauaucauuuaggauuuuuauguugacauuuauaacuaaagauggucuacaguuuuccuuuuugguaucaauguuaugauguuaugcuuacuucauaaauauacucagaauauuucuagucuuuuucugugcuuuggaacaguggaauuaucuggucuuuaaaugcacccuggaaauuuuuugugaaaccaacuagcuguuuuacuuuucgggacuauuuuagauguugcauuuuagguauauugaaauaccuaauaaauugucaauuugggguuuucggcauucuuuccauaucaguaacuucucuaaucuuaaaacucuuuaacauuuugccuuugaaaguaggaagugugcauuuugauuaucacguugaucuguuuuguucugaaaugguuauuguaggcccuuacgauuaauaaugcuaacuaaauagauuauuaaauguagacaguuuuuguuuuccaaaagucagcuuaaauggaaguugucauuucuguuauuuauuuucauacauauuugcuggaguuucuggauaguggaaaauuguaagcuacagaauacuaauaauaaauccucuacaauauaaaggagaauauuuucacugcauacuuuuucaacucauuaacuuaaaacauaaccuguugucauaaucagggcuuaaugucauaaccucuaauaaugucuucucaaagauagccuauauaucuacaagauauaaugucauuaaaucugauuuugugugagaaaaaucuucuuuaagacuuugauuuguuuucuuuuuuugaguguagaauuauauucuguuguguuuuaggauuaacucuuggaacauagucuaaguguaaaagguaguauauuucacaaaaaccuaauugucuauuguucuggcauugaauuucuaguaaaaccguagaaaauaauagauauuguacuuaguuaacuuagauaaagaacaaaagaguauacacuuuugaaaacaauacuauguauuaaguucuagcugaauaccacaucacugugacauuugaauagauauuacaaacaggcuuccacuuaugauuuaacguauacuuuuucaccuuuaagaagauagcaaagcaauaugcauucaauagaaacuguacuucgagaacccuuacagucauuguuuuucaccuucaguacaguauuuauuaaauuauauaaaggcuuuguguuagaugauuuugcacuaauguaagugcucugagcauguuucauguaggcuaggcuaagcaaugauguucgguagcuuagguauuuuaaaugcauuuuuuacuuagauuuuugacuuacaguggguuuuuugggauguaacaccaucguauguugaugagcaucuguauguagaauuaaugauauaaaaaaagaacaguagaucauugaaaccauucauuuuauaugguaaauuuguuuugauacaauguuaaauuuacuggcaaguugccagaaugauauaaagaauuccaguaugccuuugauccagaauuaaacauucucucauugauucauagucugucccucuuucucaccccuuguccccuuuucucucuccccacucccccuaccacacauaaaaaacaaaggacaugagguuauuuuauauauuuguguguguguguguguguguguguguaaaauuucaaaauacaaccuggugucauaaucugguguuaaugucaugauuuuuagcaguaucuccuuagaaauggcuuauggcuucacaagaggauaucauuauauauauauuuugaaguauuuauuaguaaauuagagauaugcucuuuuacugcugaguacuucuguauuuccucagaagaguggcauucuuuuuacuacaguguacuuaucaaaaucgagaaguauaguauuuauuuaguguaucaucugauuuccaucuguauucagauuuuagcaguugacucaguaauacccuuuguaguuuuccuucucaugcacauagaucacacguugcaucugggugccauaucucuucagucuccuuaaucuggaguagcuccccaggauuucuaguguuucuuugccuugaugcuuuugaaaaguacaguuacuuuuuaacuguuccucaauuuguuugucugauauugccucauaauuaguuuaacccuaugcauuuuuugcagaauagcccaaaauaaaguuguguccucccugccuuacauuagaaguauaugauuuuggugaaauauuggugauguuaacugaucacuuggguaauguggugucuucuggguuauuccccauuaaaauuauuuuucccuuugcuauuaauaaguaauuuguggaagauacuuugauauuauguaaauauccuauauuuuuuaugcaacuucacccccuggguuuagcauucauugaugauuuaucauucuuuuuauuuuaauuaguuggcacucuaucauaaggauggacuuuccagucuauacauaaauaaauguauuuauucauuuaauuauuuacaucaguaugggcucaugaauuuauauucagugauuauaauucauuacucauuauucuuuauuaugauccuuuaugugacuccuguugcagcuucugcaccaguuguggcuucauuacuugagcaaauuaacauucuuugguaucuaguauacagcuauugaucuggccagugccuuuuucuucauaccuguccauaagguucacuagaagcaguuugcuuucaucuggcauggccagcaguacacuucacuguccuaccucagggguauaucaacucuccagcucuaugucacaauuuaguuugcagggaucuuaauaccuucuuacccuuccacaagauauuacacugguccauuauauugaugacauuaugcugauuggaccuagugagcaacuacucuggacuuaguggugagacauuugcuucucagagaaugggaaaucaaacugacuaaaguucagggaugucagugaaauuucuaaagguccagugauauggggcaugucaagauauucauaguaaggugauauuguugcaucuagccacuccuacgaccaaaagagagguacugugccuaguggaccuguuuggauuuuggagucaacacguuccucauuuggguguauuacucugacccaucugcugaguaacucaaucuucuuuucuuuuuccuuuaucuuaacuauucuguccuuugaguuuccacauaaauuuuagaauuagauuuucaguuucucuuuuuuagaaaaaaugccuacuggcauuaugauuaguauuaaacuuagggagaauuaauugucuuucaguacaugaacauaauguaucuuuccauuuauuuaaguuuucuguaauuucuuucagcgguauuuuagauuuuuugaaguagagguuuuuaccucuuuuguuaaauuuacuucaaguauuuuguguccuuucauucucuuguaaaugaaauuaauuuuuuaauuugguuuuccagucguuagcuucuaauaggaauuacaauugauuuuuguauaauuuuuuaucuugcaaccuugcuaaauuuaccuauugauucugauaauuacuuuguaaauuccuugagaguuuguauguagauaauuaugucauuugcaaggagagacaguuuugcuucuuccuuuccaauccucauuucuuucuuuucuugacuauugugccaguggcaauaaauauguccauuguuuuguuuuguuuuuugcccuaugugauacugagaaaucuucuuuauuucuagggugcugagaaguuuugucauaaauggauguugaauuuugucaagugcuuuuuaugcacuuauuaaaauuaucauaggacuuuuuuucuucuguuaauaugaguuacauugauugauuuucaaauguugaaccaacccugcacucauugguaaacuuagucaugaugaggccuuguauuauauggcugauuugauucugauacuaagaauuugugugucuacauuucaguauuggugagguuugguaucaggguuacacuggccucauaaaacaaggugaaaguaaucccuucucuguuuucugaaauuguuugcauaagauugguauuuuuucuuacuugaauguuugauauaauucacugcuuauuccaucuaggcucugcauuuucuuuguaggaggguuuuuaaccaugaauucaauuuccccaauagauuuaggacuguucagaucaucucuuuuugggugaguuaugguauuuuguaucuucaagugauuuguucauuucccugagguagugccauuuauuggcguaauauuuucuuauugucuucacuguccuuuuaaugucuguaggauguauuugauaucaccuccuucauuucucauauucauaauagcuguuuccucuuuuuccucccagucucuugacagagauguuuuaauuuuuuuuauuaucucaacaaguacuuaguacaguuuuuuucuucuuuauuuucuauuccuuuuauuuuuugcugcaccacacuuggaguuuaauuugcuuuuuuuuuuuuuuuuuuuuagcuucuuagggaggaaauguagaucuuugaucuuuaaauuuuucuuuucugauagaauaauuuaaaucuaucuuucaguuucccucuaagcauugguuuagugacauccugcaaauuuugguaucacucaguucaccauaauuauaguuuucuuugugauuucuucuuugaguaauggauuauuuauaaauauauucuuuaauuucagaauguuugagguguuuguagauaucuuacugauuucuaauucaauuccauuuuagucagagaacauacuauaaaagauuucgguauuuuguaguuuaucaagauuucuuucauggcccagcauaugaucugucuuggugaaugucccaugugcaguugaaaagaauguauucugcaguuauugcuuaugauguucucuguuaaaucuccaaguacagugguuuuacuaguucugccaguuuguuucauuuugagacucuguuauuauauuaggcacauguaccuuuauaguuauuuuuuaugaacuaaccuuuuuauuauuauggaacaucccacuauaucuugcugauguuccugguuacgaauucuauuuggccggauuuuaaaguuagccaccccagcuuuugucagcuugguauuuguguuaacguuuuaauccuuaugaaaugguccuuuuuaucucagcuaauauuccuugucauugauucuauuugucuguuauuaaaauuagucaccagcuuuugucugcuggauauuuacaugguuugucauccuuuuaguuuaaacaaaucuagaucuuuguguuuuaaaguacauuuccugcaaaaagcauauaggcacuuuuuuauucugucucucaaccccugugugagaaauaguguuuaguucauuuacauuuaauguaauugcuauagcuagauuuaaaccuauuuugccauuuccuuucuguuaauaccaucuguuuuuuuucucuuacaguuuuuccccccucugguuaguuuugucucuuucauuuguuauguccauguuuuacuuuguggccuugaacaaauuuauuguagcugcuuuaaagugcuuuuuugcugauuuucaauaucagggucauuuugaggucuuuuuuguagacucuuuuuuucacauuuuccuuuucuccccuaauuuuuaauaauuucuauuuguugauaacauguugaagcuccucugcauccuguuaucuuucucugcaaagucuugauucuuauuccagcagaccauugacuugccagaacucaaacuuugucccccuguuucagcuuuaaguugcuuuucuccagggcccccuagagucuuaccugagugugcauaauucaggggcuuguagguauuuaguugggguucauacaaacauuucauggcucacuucuuggcaacuuucuuuuauguagacuauugacugcccucagaugaacagccacauaaaaucaaauguuaccugguaagauuuccucuuacccuuacucucauuucuaccagcuuuuggucaugcucuagugccuuuauguuguggagcuuuuuucuuucccagaauguauaaauguuagaguucuccaguauuggggaaagucauguuaauguauguaaaguauaaauacauccacaagguugcuugauaaaaugcuuaucucagauuagguaaauuuaacuuuuuuucuuguuugaaauuagcuacauugaauaaccuguuuauaaucagacaaaaaaguuauuuaaaaaugugguaggaagcaguaagaucuauucucuuugaugagucuguagcucuagcuugcuuuuauuuuaaguuacuaugacucccaguagcggcugauggucauuuuauacucaaaauucaguuuuucaaaguaguuuucaaauucggcucacgauacaguauauuuuaaaaguuugcauuucagaacuuuucaaaaugaaauaucucauuucuuucugcauagcuaaaugcaaaauuucauuccucuguuuuuauuagcuaaaugcauugaacaacucacagauaaucauuuaguagcuaguacgcgguaaaucuuaaguaaaaguccgcugucagaaaauggaguucuuauuggauagcauaaauguggcauguuuugccagaaauguccuugagucuucauaaguuuaaagaaaguuuauuuuaaagaaaaacauauucugggugugguggcucacgccuguaauuccagcacuuugggaggccgaggcaggcagaucacgagguccggagauugagaccauccuggcuaacacggugaaaccccgucucuacuaaaaauacaaaaaaaaaaaaaccaaaaaaaaaacaaacuagccgggagugguggcaggcgccuguagucccagcuacucgggaggcugaggcaggagaauggcgugaaccugggagguagagcuugccgugagcugagaucacgccacugcacuccagccugggcagcagagugagacuccgucucaaaaaaaaauauauauauauauauguguguguguguguguguguguguguguguguguguguguguguauauguguguacauauacacuauaugcaaagauuuuauagaauuaaaaaauauuaaccugaaagaagugauaaucauauugucagguacaauuacauuuuuuaagaaaauaaaaaaauuaaaaauauuguuuuaagaauagagcuugcuucuccacugcauuaaauagaauugcauuuaaagauuccauuugucauguguauaaugaaauaagaauaccuagcacuuguauuucaaaauaccuacuguaacauuguguauaugugaucugauagauauugaagaaaaugaagaugcuggagcagccucucugcccacucagccaacucagccaucaucaucuucaacuuaugacccaagcaacaugccaucaggcaacuauacuggaauacagauuccuccgggugcacacgcuccagcuaauacaccagcagaagugccucacagcacaggugggaaacuguaacugaaugauuuauuuaauuccccuuuuauaaagaagaacugcauuucuuaucacauaugugccucauaaugauggucaugaaaacaugacaaguuccuugaauuccauuugaacccacaagaaacauuaaauuauuuucauuaaaauuuuaauauuaguuguauucuaauuauuugagaaaugacaaguauuaugugcauugauuacucuuaaccuuauauuuuauuaauaagauugguuuccaugcuuuucauauauauugcuguuuuucuuuuucuucucuucccuuucuuuuccccucacuguuguuuuagaauagcucggaggugaguggaguugauauuaggaugugucagucagggucucacugugauaucuagguuuguuucauucccuugggacuaugccucugcccugaagauggguauuauugaugauggggaaugggcuuugaggcaugaaaucucaguaacaaugaaaucauagacaggugaaagcagggauucggauuuuuuuuuuuuaaccuuacacuuuaaaaaacuaacaggaaagagagaccuaucugugaauaaaucaguacuguauguuuauguuuuuauuuuuaaaaaucugacaaaguuaguccuuaguaguuaagucagggucaguaaagacacuuugacaaaauuucaguuacucuucccuuuaauugcauuguugacaaaaugucaccuuuaucuccaaguaggacacuugcagcuauaauuuaaauuuuacauuuaauuuuuucaaaaacuuuucuuaaaaauuuacuuuuaucccaggugacuuaugguacuaaacuauacaaacacuuuaaaauaauuaauggaaugauagucauccuucaugcccugauuucuacuguuccuauuauguaacacacuacuacuuuacuuuuauuugucagccuuauuuuacccaaauuuuuuuuauuuuacccaaauuuugcaugaauuacauuauaugcaaguuuucuauuuugaccauuguaacaucaaguaugauuagugucuuuccuccuauuuuaaaacuuacaaguuuauauuaucugcaaaaauauugcuaacguuuucuuuaagauuauugaugaaaugauaauuuuagcacugaucuuuuuuugugucuucagucagcauauuugaccuugacuuuucaauauuuuauggccuaugugaugauauuaauagacaaaccuauuugcauuuguuuuggaaguaaaauuucuuggaacacuuuuaaguauuuuauuauguuuagaaauauucauuauuuccaguguggaauaauguaagugaaaccagcuacuuagaucuguuugccuuagaugaauacuguucagauuauacuugaagguugaaauccugaucaagagucccagacacaagcauucucauagaggagccaaggggaaauaaaaugcauuuaggaggcaaaucauauugguuauuuguuucuaccccaugcuaaagcauaaacucagcugauauuuaacuucucgugaccuuaauuuuuccucuuccuaauaugaaauuaaucauacuuacuucucaugguuauuuuaauuauuaaaagggaaaaacuguaaaaauggacuaguaguaggccuaucacaaaaucaguguucagcagauuagccuccuuucccucuuuuuuuccucuuccuuccuauuucugugccaaggaaagucaagguauuuaauggcaaguuaaugaacacuuaaaauuauuaugcgaaucaagagaaguaucacaacuggggguaggauauuaaccuuauagaaagacuguccaaggaguuuuguuuuagacaguauaucucaaggcagaguugugguauaggcacaucaguauauauuuuauauauagguacacucuaugaguauacaaaagagaacacuuuuaacaggagggcuauaguagaucgauccauaugaaauugcuaguuuuguguaacaaaaaugauaaaguauugauagucuuauauguucaaacuaauacacaguguauccuggcuagaauauucaugacauaaagauaaauauuaggugguuuuccauuagaaaguuuuuugucauaaacaguucaauuugaucuaguuaacucuagcaugagccucuuguuuucucugucuuuuguuccuuagagggaagaauaaaacuaaaaaacuuagaacuuuuauagaaugagauccuaucauauuuuauacacucuuguagccuuaccagucaaaugauuaucauggcuaauuuccacacuuauucuugcagcaacuauauuauguauuacugucuuuaacuuacaaacucucaagagacuaagcaauuauucuaagaaaacaaacauacccaguaaugacagaaccaggauuugaauccacguuuuuuugacuucauguuuuagccaugugccuucuauguuccuuccucuaaggaacuaaaauccucucaaauuaaaaccuacuuuucugauaguauauuucccuuuaagauugguuugagauguugaaaucuccuccuuuuagccccagauuuuuuucuauuauauuugaaacaguaaaaaaaguucauaguugccuaauaaaaaacaaaauaacauuuuuaauaauauaaauaauagcaaauguuuccccucuuacucacguuaagaaugauuuauuuucucucauauaaagguccaggaugcacuuuuaucaaagggaaauccuuaagauaacugaaaagaauaguauguacuaauuugcaguuuuuaguucuuccacaaaaaagcaaaggaggugcaaugaggacagggauagugauuguuuaaacaggcgaaguguuugcuucuugugcuuucaacacugcacagauaucacauguaguugauacaguguguuuuuuucuuucucaagaaacauaagcuuuuuauaguucauauuacaggagaagauuuuaguaauaaagcuagauuaaauaauauaauuauuuuaugauuaaagcuagccuuucauuguaaaaugcagcucacuucauagaucaaaauguaggcuguguacuugugucagaaguaccauguuugcauucuucuguaagcuuugauaaccuguuguugauacucuggccuacgcauuucucucaacccuguuucucaugauuacacuaagguuucacucauucuuuccuuauacuguuacucauagacaauauagguaacauuccuuucuuccuuuuucugugucucuccaaaugcuguguucuuucaggagucuguuuaaucacacuuucuggauagucuucucuauaaauagagauuuguuuggaggauuuuaauuuaggcagaaaugcaaauuacuuagcaaugaaugacauugaucuauagauuggaccauuagaguauaguagauuuaccuuguuuuuuaagauguauaugaaugauauauguaaucuacauaagccuagguacaccuguuucaaagcacuagacaugacuagugugaagauccaucucagauuuuacauucuagcauuuuuaaaauaauauauauuuaugugccuuucaguguuuggcaaguuuuguggagaaaauugucagauguuuauaauuuaaauauauuuggugaguacuuaucaaaaucaagcaaaaaauagucauugaauaggucagccuaagauuuggcugucuccucacuuugcauuuauacuuuuauacaguuuucuauaaauauauucauauacacaguauaugagaauauuuacuguagcauuauuuguaauagcaaaagauuggaaauuaaaacuuaaauguccaucaguaauggauugcuuuauaagcuaugcaugcagagaaugggacacuauggaaccauuaaaaacagcaagacagauuuauacguauuaaucuggaauuauugcuaggacacauuaagugaaaaaugcauaaaacuaaaguauaguaugcagaacuuacuaccauuugcaaaacacacacgcaaguaugccuucuagaagauuuugguuuagauaaguacacaaauuucuuagcagagaacagcauugacauauauauagauuggauuggacacacaguuauuuguagguggguggaaaggugucauagaaacugguacuagcccuaaacuuugggguaggagaggcaggcuuucuccuuuauauuuuuuuguacuauauaaaauuuguacuucaccuuucaucuguaucccuguguacuuuaaaauuuuucaauuuuuaguuaaaaagcaauauuuauauggcuuuuaauaguuccaaaggguauaaauacagagcgaguuuguccuggaaaacaauuaagugagguaaauaauguauauuuaaaccauuuuuucucuuagguugggguugagaaaaaucuuaaaagucaaaacuucuuaccagaagaacuuuagaacuucauaccagaaaaacuuuagaccuuuagaaaauuuuagaacuucagccaucuuuugugaaaccguuauucuagaacucucaguggauauauauccaucccccuagaaacuuccuauuuauuuuaaccuuuuucucuguuuccuuuuucuuauuccaguauuuuucccacuuuacccuuucuacaaauugccuauucgaauucaguguauuaguuuggcaaacaguccaucuugagagacuguuuaacuccauugauuuggaguaaucaacuuuuccucauuuuauuuuccugcugauugaaucauuucaguccuuuuuugggggaacuuuuaacacuuuuuguuaguuuuuuagaugauuaauaaauaaucuucaacuucaguauauuccuuaccauuaaucaagaaugcuaaguuauucauugauaugacaguuuugaaauguucuaacaaagucaaaacaguuguuuauuggauaauuguuuauuggauauguaaaaauaucuuaaaauguguaaacuagaaaauuacaaauguuaauuuguaauuucaugcacagugaugaaauuggauucauccucuaaguuaaacuaaauuagaauuauguucuacuuuaucaccaaauuauuuaauuggcugagaaauugaaagguagggaguuugcuacuucuacagauauuugguaagcuuuaauggagaaguaaugcgaagcauuagacaaaauacauguuaggaaaugcauagcccauacacauauguaaacacuugauauccuccaacaucaacuaaguaugucaaguuagaauccauugauguuucuagaaaauaagcaaaguaaugaaauugccucaugauuuuuaagugcugcccugcuguauaauuaaaagguguaauacuucuaugcccauuuuugcuuuucugauuugcagguguagcaaguaauacuauccaaccuacuccacagacuauaccugccauugaucccgcacuuuucaauacaauuucccaggguaagucagcugacuauuuugugagauacauuuaucuccuguuuuggguugcuguuuuguaauuuuaccuugacaguaccauauauuuaaauguuguuacugaaauuugaauuucuagguaauuugaaauaaauuuccuugaaugcuuauguucacuagauucucaaaugagccaggauuguuugacuuuaaaaauaccaacauccaaagcuguccccuuuuguuacaguucuuuuuuucaugcacuaccggauauugaagaacaaacauggagccaaggcuaccauggaagccuaugcuagauuauauuaauuuaguucgagauuaccaugaguucugauugugacuuuucuuaucuacacuguuauuaaauuaucuaaaaagaaaggaacugaccauuauuaaaaauaaaaaucucugagguuacuuugguugguugguuuauaggcuaagugauugguuuaaguauaaucuuuacuacuuuucugauuucucuguuuuuuuagcccaaaucaggcauuguguuuauuuuggucuuucucauucagacuuuuguuuucuucauaugucagaugauauuuaauccuuuuauauuuaaaaggauuuaaauuuuaauccuuuuauauuuaaaaggauuuaaauuuaaauccuuuuaauuuaaaggaagugaagaccuuuuuuguuuuguuuuguuuuugagacaguguggagugcaguggcgcaaucucagcucacugcaaccucugccucccggguucaagcuauucuccuaccucaaccuccccaguagcugggacuacaggugugcgccaccacacccagcaaauuuuuauauuuuuaguagagaugggauuucaccauguuggccagggauggucucgaucucuugaccucauaauccgccugccucagccucccauacugcugggauuacaggcaugagccaccgugcccagccauuuauuuuuaauagcuguuauuuaguuuccucuguuaaugucugccaguguguuuuucagcuugaauuuucuguucucccuguaugagugggaacuggccaauaagccuuccugccucucaaccauggaaugaggagagccuuuuaggggugagcuggauaucauaccuaccuuaagaguucuagcacugccugggcaguuuguuacacaguuuuagggagaugcucuuuaaaucucuugucaauuuucucuuuucacuuuuuucauucuuucucuucuccuuuuuaauuuuguggauuuauuuccuucuguguuacuuuaucauuucauuaugguuucagaaggaagaauaguuaauuauauaugcuuagucuaccaucuagaaccagaacccuagaauucuuuaucuaaacugucaggcagguguuagggcaaaauaauuuuuaaauauguaagaacucucacauuuugccuagcacauaccuuuuuuaaggaacuuaacucaggauguacuccaucaagauaagggugguaaucaagcaaaauagaaauaugaaauauaagaaagggugaaauauacuucuuuagauacuccaaagaagaaagauucuaugauagcuuucccaccugcuuggaaagcaauugcuccaaaauuagaauaggaaauuggagaacuccccuccuuuaagaaaaauaacauggauuucauuuaauauauagaauaggagcuucagaauaugaaagacauagauaagaugcccuagaauccugccaguaagaaaaaaaagugaacuaaaacaucuaauuuugauauuauacaagaaaucucaguuuggaagcaaacaaaaauaugccaugauuuugaacaguaauagaauuauggaauauaaaagaaaaggauuucauuugacuuagacacaaagaacauucuccuucaaaagguaaaaggcuuaugacaaaacauagaguacuucacucagaaugaaauauaaauaucaacacugacauuuuaacaucauacugaaaauccuagcuagugcaguaagaaaggaaaaagaaauaaaagcuauaaagauaggaaaagaaaaaauaacacugucuuuguucauagaugacaugauggucuguagaaaaucuggaagaaucaaucaaaaaauacacuuagaacugauaagcaauuguaacuggauugcaguauacaugauuaauaugcaaaaauuaauugcuuuccacauagcagcacaaaacaagugggauuugaaauuuaaauacacuugccauuguguuuguauuuacauaaauacaauaaucaaaaacaaaauaccauuuacauuagcauuccaccaaaaauauucagguauaaauguaacaaaauacauuacaagaucuauaugaggagaacuacagaaugcucaugaaagagucaaagaauuacauaaauggagauuucgugaucaugcauaagaagacuguauucucaagauguuaguucuucccagcuuggucuauagauuauggacaguucccaucaaaaucccagcaaguuauuuggugcauaugaacuccaacuaucuaaaguuuauauggaguggcagaagacccagaauaaucaacguaguacugaaggagaagaacaaaguuggaggacuggcaccaccugacuuaaaaacauaauacaaaucugcaguaaucuagauaguaugguacuggcagaagaacagacaaauagaucagugagacagaguccaaaaauagacccauacagaaaaagucauaugaucuuugacaaaaggagcaaagggaacaccauugaaaaaagauacucguuucaauaaauggugcuggcguaacaggacagccacauacagcaaaaaaagugaaucuagacacagaccuuccacucaucucaaaauuuaacucaaaaugguucugaugccuaaauuugaacuccaaaacuagggacuuccaguuccaaaauggcaguguagaagcauacuggcuucauuccccaccaacagaaaacgaaaaacaaauauacagcacugagauugacaccagcaacaacccagagcccaaguaugaggaugaaauaguuccuggggccacagagaaguggaaaaacuccaguaggagaaucagacuuccacuuucaugaugcuucugcccuacccuuaugcccacacagaaaaucucccccaccucauaauuucuacacugaaagaaguaaaauugaaguggucaaccaucuuccccaccuccuuggguucccuggcaggagaucuguccuugccuuaacccacagguagcaucaugacugccugcagggaaaauaucacugaagaccagcagagacuauuauucccagccccagaaacuucacugugcaacuuggccaaaggagacaccaaaucagaauggcuguucagcaguaccaugcuguaggagguacauuucccagguccuguaggcacaaaccccuaccuagccugccuucccacacugccaguguaauccauuugggacauucagcgcuccaaacauuuacuagagcugaggcaaaccugggcuuauggcgccaccuagagcugaaaaggagguagcgaccuagcagugaagauuuguugagcaaauauaugcaauaaaaaccaaaacaagcuggacagagaaaacuggaauaaauaacuaauucuuccagugcaaagacauaggaaagacccacaagaaacaacagcaaacagggaaucaugaccuucucaaaaggacaaagcaaaaauccuggccgggcacuguggcucaagccuguaaucccagcacuuuaggaggcugaggugggcagauuaccugaggucaggaguucaagagcagccuggccagccuggcgaaacccugucucuacugaaaauacaaaaaaaauuagccaggcaugguggugcaugccuauaaucccagcuacuugggaggcugaggcaggagaaucgcuugaaccugggaggcggagagugcagugagccgagaucuccccacugcacucuccagccugggugacagugagacuuccaucaaaaaaaaaaaaaaaaaaaaaaaucccaaaacugacccuaacaagacagcaguuugugagcucucugaccaagacuucagaauaacaauuuuaagaaaacucauugaccucuaagauaauacagaaaagcaauaaagacauuugacagauauuggaauaauuuuucaaaaaaaaucaaaucuuggaacugagaaauacauuugcugaacuggagaacucuuuugaggcucucaacaacagaaugaaguaagcagaagaaaaaaaucagugagcucaaagaccagcuauuugaaaauacacagucagaagaaggaaaaaaagagaaugaaaaggacuggcuacaagauauagaaaucuaccucagaagaccaaaucuaagagccauugauguucaagagggagcugagcgagagguagaaagcuuauucaaagaaauaauaacagaaaacuucccaaaacuugagaaagauauaaauauccagguacaggaaggucuuuuaacaccgaacagauucaacccccaaauaagacuaccugaaggcauguaguaaucagaugcuaaaggccaaggacaaagagaaaguccuuaaaacaccaagagauaagaagcaaauagcauauaacagagcuccaaaucgucuggcaacagccuucucaacaggccaguagguauuggaacauuuuaaaaaaaaacugucaucuaggaauauuguguccagcaaaauugucauucaaauaugaaggaaagauauagucuuucccagacacaaaagcugacccauccugcaagaaaagcuaaggggaguucuucagucugaaagaaaacacuaaugugcagaagaaaacauuucaagguguaaaauccacugguagaauuaauacuauguauauaauuuuuuaguauagagcaauuuuauaguauagagaauagagcaauuaggcaaaagaaagaaauaaaguucauccaaauugaaaaggaagaagucaaauuagccuugcucacagaugacaugaucuuaugccuauaaaaaccuaaagacaucuuaugccuauaaaaaccuaaagacuccaccaaaaaaccguuagaacugauaaauuuagugaaguuacaggauacagaaucaacauacaaaaaucaguagcauuuauauacaccaacagcaaauaaucugaaaaucaaauuaagaaagcaaucccauuuaccauagcuacaaaaaaauauaaaauaccugggaaccgaucuaacuaaagaaguuaguuauuaauaacuaacuauaauauuccguuguguauauacacuauguguauauauuaauaacuaagaaaaacuauauaaaauucugaugaacauaauacaaaaaauguaauacaaaaaaauauaaaauaccugggaaucgaucuaacuaaagcaguuaguuauuaauaacuaacuauaauauuccauuguauauauacacuauguguauauauuaauaacuaagaaaaacuauauaaaauucuguugaauguaauacaaaaaauguaauacaaaaaauacaaauacaaaaaaaaauaccugggaaccgaucuaacuaaagaaguuaguuauuaauaacuaacuauaauauuccauuguguauauauuaauaacagaaaaacuauaaaaaauucugauaaauguaauagaaguagacacauaaaaaauggaaagauacuccaugcuuauggauuggaagaauuaauauuauuaaaaugacaauacuacccaaagcaaucuacagauucugugcaaucccuaucaaaaugccaaagacauucuucacagaaugacauuuuaccaaaaaaaagaacccuaagauuuauguagaaugauagaagacccugaauaguaaaagcaaaacugagcaagaggagcaaagcuaaaggcaucacacuaugugacuucaaaauuuacuacaaagcuaugauaaccaaaacaacaugguacuggcauaaaaaacagacacauggaccaguggaacagaauagagaauccugauauacauuuaugcauuuacaaccaacuuauuuuugacaaagaugccgagaacauacaauggggaaaggacaauuuuuucaauaaauagugcugggaaaacuggauaacuauaugcaaaagaaugaaaguaaacccccaucucucauccuacacaaaaaucaagucaaaauggauuaaagacuuacaucugaaaccucaaaucuaagaccuaugaaacuuauagaagaaaacauuagagaaaugcuccaggacauuggucuaugcaaagauuuuuuuguguguaagaccucgaaagcauaggcaaauaaagcaaaaauggccaaaugggauuagauccagcuaaaaugcuucagcauggcgaaggaaaaaaucaacaaagugaaaagacaacccauggaaugggagaaaauauuugcaauccaucuaucugacaagggauuaauaaccagaauauauaaggaacucagacaacucaauagcaaaaaacaaauaaugcaauucaaaaaugggcaaaagaucuaacauuucguauaugaagaaaugcucagcaucacuaaucaucagagaaauacaaaucaaaaucacauugcauuaucauuuuacccuaguuaaaauggcucauaccaaaagacaggcauagagaacagugcagagguuucucaaauaacuaaaaauagaaguaccauaugauucagcaguuccaaaggaaaggaaaacaauauccaaaagaaaggaaaugaauaugcugcgagaaaucuacacucucauguuuaucgcagcacuauucacgguagccaaaaaauggaaucaaccuaaauggcuaucaguggaugaaugaauaaagaaaaugugguguguauacacaauggaauauuauucagccaaaaaaaggaaaagaauucuguuauuugcagcaacauggauagaacuagaggucauuguuugaaauaaaauaagccaagcacagaaagacacauaucguauguucucacucacaugugggagcuaaaaaagguggaucucgugaaaauagagguagauuagugguuaccaaaggccaggaaggaaagggggaaggaguggaggaugaaaguggaaaaaaaagaauauacguguuuuuauuaccacugaaauguaugcuuugaaacuguaaagauggcaaauuauacaugaauauuuuaccuucauaaaaaauaaauguaaaaaguaaaauacaaaacuauaaaacauguaaaagauagcauaagagaaaauccagaugacuuuggguugagcaaugacuuuuuaaaugcaugaccuauaaaagaaagaaaugauaacgcagauuucauuaagauuaaaauuuucugcccuucuaaagaugcugucaagaaaaugaaaagacagaucacgaggucaggagaucaagaccaucuuggcuaacacggugaaacccuaucucuacuaaaaauacaaaaaauuagccgggcgcgguggcaggcgccucuaaucccagcuacucgggaggcugaggcaggagaauggcaugaacacgggaggcagagcuugcagugagcugagauagcaccacugcaguccggccugggcgaaagagcgagacuccaucucuuaaaaaaaaaaaaaaaaaugaaaggacaagccacagacugagagaaaacauugcaaaaggcuuaucugauuaaggacuguuaacaaaauauacguagaacuccuaaagaacaauaacgcagacaacccuauuuaaaaauuagcaaaaggccuuuauaggcaccugacuaaagaggauauacaaauggaaagcagacauaugagaagauacuccaccgcauauaucaucaggaaaaugcaaauuagaacaaugagauaccacuacacaccuauuagaauggccaaaauccacaacauugacagcaccaaaugcuggugacgauguggaaccacagaaacucucauucauugcuggugggaaugcaaaaugauacagccauuuuaaaagacaguuuggcaguuucuuauuuaacuaaauacauuuaccuuaggauccugcaguuguguccuugguauuuaccugaaugcuuuuaaaacauauauucauaugaaaaccugcaagcaaaaguuuauagcagcaauguuuacaauugccaaaacacagaaggaaccaagauuaucuugcugucggugaauggauaaauaaacugcaguacaucuagacaaugggauauuauucagugcuagaaggaaaugagcuaucaagcuaugaaaagacauggaggaaacuuaaaugcauauuacaaagugaaaggaaccaauguuuaaaagcuauauacuguauaauuccaaguaugugacauuccgaaaaaggcaaacuauagaggggguagaagaucagcaguugccaagaguuagggggagagggagggaugaaugaguggaucacagagaaguuuuagggcagugaaucuauuuuguaugacacuguguuuuagucuguucucauauugcuauaaagaacuaccugagacuggguaauguaugaagaauagagguuuacgacucaugguuacacaggcuuaacaguaagcaugacugggaggccucaggaaacuuauaaucauggcaaaaggugaaggagaagcaggcaucuuccucacauggcagcaggagacagagagggaagggggaagugccacacacuuuuaaaccaucagaucucgugagaccucacuaucacaagaauaacaaggggcacaucagcccccaugauccaguuaccucucuccaggccccuccuucaauucaacaugagguuugggcagggacacaaguccaaaucauaucauucuguucuuggccccucccaaaucucauguccuucucauauuccaaaauacaaauaucucuucucaauaguccaccagucuuaacucguuucagcauuaacucaaguuuauaguccagacucuccccugagacaagguaaguccuuuccaccuaugagccuguaaaaucaaaaacaaguuaguuacuucugagauacagugagggugcaggcacuggauaaaugcucccauucuuaaugggagaaauuggccaaaacaaaggggcuacaggccccaugcaagucugaagcccaccaggaaagucauucaauuguaaagcuccaaaauaaucuccuuugacuccaugucucacuuccaggucaugccaaugcaaggggugggcucccaaggccuugggcagcuccaccccuguggcucugcaggguacagcccccuuggcugcuuucacaggcugauguugagugccugugacuuuuccaggugcaugauguaagcugucaguaggucuaccauucugaggucuagaggaugguggcccucuucucacagcuccacuaggcagugccccagugggcaugcugcaugggggcuccaaccccccauaucuucucugcacugcucuuguagagguguuccaugagggcuccaccagugcagcacacuucugccuagacaucugggcauuuccauacauucuuugaaaucuaggcagagauucccaaaccucaccucuugccuucugcgcacccauaggcccaacaccacaccuugguguggccauggcccaagccacaccuuggucccuuuuagcuauggcuggagcuggagcagcuggggugccaugucccaaggcuacacagagcagcuggcccuguaucuggcucauggaaccauuuuuuccuucuagaucuccaaccugugauggcggggucugcugugguggucugugaaaugcccuagagacacuuucccccacugucuuggcugugaacauucaacuccucuuuacuuaugcacauuugggugauagacuugaauuuugccccagaaaacaggguuuuuuuuuuguaccacaugaucaggcugcaaauuuuccauacuuuuaugcucugcuuuuuaaauauaaguuccauuuucagauaaucucuuuguucaugcauaugagccuacacuuuuagaaacagucaggucaacucuugaaugcuuugcugcuuagaaauuucuuuugucagauacccuaaaucaucucucucaauuucaaaauuccacagaucucuagggcaggggcaaaaugccuccagccucuuugcuaaagcauagcaagagugaccuuacucuaguucccaauaaguuccucaucuccaucugaaaccaccucaggcuggacuucauuguccauaucauuaucagcauuuuggucaaaaucauucaacaagucacguggaaggugaaggggaagcaggcaccuucuucacacggcaauaggagagugaagggggaagugccacacacuuuuaaaccaucagaucucaugagaacucacugucacaagaacagcaagggggacauccauccccaugauccacucaccuccuaccaggccucuccuccuauuugacaggagauuuggauggggacacaaauccaaaccauaucacacuguaacaauagauauaugucauuauaaauuuguccaaacucauggaaugcacaacgucaagaguaaacccuaacauagacucuggguaauacugauggaucaaugcagguucaucgauugugacaaauauaccacucaaguuggggaguuuaauaauggaggaagcuaugcauggugaggaaggggagauaagggaaaucucuguaccuuccucucaacuuugcugugaacuuaaaacugcucuaaaauauaaagucuuuuuuaaaaauagugcauuuauaaccacugucacuaccauuacuacugcuucuaguacuuauaccccuuuucugcuacauauuucuccuuacugcuuaguauuuaaucaccuuuuaaugcauauaugugugauauuaauguauauuaaauauauuguaaugaauuuauggcucacucuggagaauggaauuggauagguagguauuugaagcacaguguuuacuuuuuuacuuuuacaucucugaauaguauuagagugucaaugacaacuuaccugauaaaguuuuuugagcauuggccaggcgcgguggcacacgccuguaaucccagcacuuugggaggccgagauggguggaucacgaggucaggagauugagaccaucuuggcuaacacggugaaaccccgucucuacuaaaaaauuacaaaaaaguuagccaggccugguggugggcgccuguagucccagcuacuugggaggcugaggcaggagaauggcaugaacccgggaggugaagcuugcagugagccgagaucaugccacugcacuccagccugggcgacagagugagacuccaucucaaaaaaaaaaaaguuuuuugagcauuaagugauauaauaucugaauaguauuuagcacagcacuugacauaaugaaauucugccuguauucauaacuacuauuguuggaauuguuaagugacaugucucagcaaugccuguauguaugaagguucagucuguguccuguguguuccauccaagucaaaggauaauagaguauaccagaaugagauuauccaaggccuuugacauaagaauuucuagaacuaucuaguuaaauuggaaagagcugcuaaagacucauuuuggaaauauuuacaaauaaguguucuauccucucuuaugacauuagauauaucaaccuuggaaauggaugcuuaugucaacugagcacgcagugauuuuucuuuauaccaagugauguuaucuuugauccagugcugacccaggcucucuuugccacuguaguagaggauuuaacugauaguucuagcucucuucugccugaucuuguccugaccucugaagaggagaugaagcccucuuauauauagauggucuugucugcagcucgucuguaacuuauaagcuaagauuucagaagagagauauauuagacaaccccucuaaucuuugaagcaucuuuaagguccacuugcacccucucuuguucugauuauggccucuaguaaauuuuaaugauagaaaaaaaaaacagcuuuuauuuuggugcauuaagcuuauauugaccuuuuugaguauaaagucagauaaacugaaauuuaacacuuguucucuuucugaaauguguuuacccuuauauauuuuucgcuuacucuguugaguuuuuaaauacuaauuuuaaagacucauaauuaggugacauuuuauuuuuacucaguuuaagaauuuaauucauauuuuauuaaugaauguagacuaguauacuauauuuucaaaauaaaggagagccuauguguuacaaaauagcauguaacaugauuuuuuagcuuaauuuuucauuguugaaaauaaauaucucuauauguuuauaaguuacauuuuggaucuaaaucuguacauugguuguuacuuaguucuuguauuuuauauaugaguuacauaauugguuaugcaugucuguaagcuuuauguauuuuauaucuaguuauauuuuucuguuaauuucauucacauuuuuuaaauauugaaauuauuucacaaaaaaauacaguauuuguguuuuaaaauaauuuaauccuugguagauaaguuuauaaaacaaaaauaguaacagaguucuugccauuauacacguuuuaccuuauuaauaagugauaugucagccaaacagugcuaaagcuaaugguguaaaaauaaagauuaaucugaccauuacagccuucuuucagcauguccaguaaauucuggauggaugccuuguauauuuaaaagagugcccugagauaggagagacuuaaagcacaaaaaguagcguuaagguaaacucaauuuucaaagauguuuccucaccuagacagcguauguaguguaaauauauuuugaaaaaccauuaaagaaucugguagguauuuuucaagaucagaaauaugaacuggagcauaccugacuaaauugucaacagaacuucaggauaguugauguuuagguuuaaugggcaacaaaugccaagucaguaacuucuguuaaaauugggaucgguaaucccugauucacaacagugaaggccaaauuuuauguaaucuuaaauacuacuaguucaacaaauauuugaagacuuacucuagcacccuacacuaguaaguauauguguauuuuaaaaucugcaauuuaauuaauguuuaauucuauaugaacuuaguuuuaaaaugugggaaauaauuuaaaauacagcuuuuucauauucaugcagugaaguuacugagcaccugcaggugccuggcacugugcuggaaacaguagcaucaauuguuucaguacucuuuuugaaaauuuuagaaaauaauaauuuggaucagaauauuguauccacuugccuggaguugcuaccuaguuugaaaucuuugccuaggugaugucaaauuuuuaauuuuaugcugcguguguguauuuguguauacacacacgcagcauaaaauauauacauauggcaaaauuaaaagcaacuaaacgaagucauucuaaguacagccuuguacuuauuucaaacagaauugaaauauguugucugcuuguuauagucuaugccucccagccuucugauuaguacuccugagaauucucauaaaaauuuccaaagaaaauggugguuauuucaaaagacaagauacaauguccauuuuuaauuuugucuuuagaaauauauauucaaggaaauucguaucuuagauuaaaugaaauguuuuuaauguuuuuuuuuuaaacugaaauuguuuaguugggcacuacauguuaaucauauguauaacuagaaaacuugcuaagaauaaauuuuagagaaauaauauguaaugguuguuuacauguuuaauuguauauuucagugauauaaaauuuaagaaaccuuaagaaauuuuuacauggauggcacaaacauguaaaauacucucaugcuuaaaacaagcuaagcaaccugguuuucuuuacauaaaguuuguuauucacuuuuuuuuuauugaaggugauacuuacauuccagcucaaaugaggguugaauugguuuagucuguguguauuguuccaugaagagagaggcuaagugauuuuagcauagacaccaaagcugcuauccuuguuuguccuuauugcuucuugaaggaaaaucuuaauucaucuaaguuauuauguauugccgugucugugguuuauauuaguaauaaaaagacaauugaaaagaaugaagaaaauguaucaaaguucaugugagauugacuaaaacuacuguuuuuacauagccuuaaauauguuuuuuaaucuuaagcauaagcauuugcccaaccuuacagaacacuuuuuauauucuuauaaauaucccaauuguucuuuuucuucuaggggauguucgucuaaccccagaagacuuugcuagagcucagaaguacugcaaauaugcuggcagugcuuugcaguaugaagauguaagcacugcuguccagaaucuacaaaaggcucucaaguuacugacgacaggcagagaaugaagccuuuguaugacagacccauguauuuuuggcaugaggaacuaacaguccauuacucuaucuucagccuaucaggaucacaguuuuaaggaagacuugguuuuguugaauaugacaaugaaaucuguguguaucagauuuuuauugaagcauucaucagcagccucaaccaguuuucauuguccauuuacuagauucaaucgucucugaguauauagggcugauguuagcaagacccuaaaaauguccauugaacccugcuucaaaaaaugaaaacacaccucuauaaaauguguacugggaauaagcuuuguauuuacauacauuaggggaauuuuuuaaaaucuguaauguuuggacaaacagaugauauuacuuugcuauaaaauuauaaauguaacuuuuaauaaagauagccagaauauucuaaauuagaaauuacguuuuuguuucccucaagacauaaaacaaauauaaacauucuaaacugcuggaugaaucugaaaagacauuaaguucaaauuuuaauuuauucucauauuaaauauaacuccauuaaaaguuuaaaauuucaugggagaaaauauaauaagguaaagagguagaaucacuuucagacuuaagaauaauguugauuucccaagugcuuuaccuuaucuguuaaagcguaagaugaauugguauuugcuucauaggcaguuugacugcauguauuagagaaugaaaagaagauauuuguaguaaugccuggaaacuuggugcuuuaaauuaagguacuccucugcugcuguagaauggauuccacacaguggauagcuaugggugauucagaauauuauguuuagauucccauuuguuaaguuuauaaguuuuguggggaauuaugaacuuacuguguacuaccugcauuugugcugugugaaaaauaaauacaaggauucguuuagcuaauucaacuuacuacaaagacaaaugucuguuuuuauuugccugcuaggauugucuuuuuuaaaagucauuuuuauuuauaggaauauggguguuucuauaggaagaaacagguuuuuuguuuuuuguuuuuuaagauaaauuugacaaaguuaacugaaauuuaucugguccauuuuauucaugcuacuaagaugggaaucuuuaaacacaagggucagcaagcuuuggcccauggauuggccaccuguuacguaaauaaaguuucuuugaaacaagccuacacucauucauuuauguuuugucugugguugcuuuccacaacugcagaguuguauggcuugcaagucuaaaaacauuuacuauuuggcccucuaagaaaaaguuaagacaccuagucuaauggccuuuugggaaaaaacaaaucacuaacucauaaucauuuauauccauuauuuucugcauaaauguaaugcuauuguacaggguuugguagaauaaauauucagacugacuaaacuguucuaaauccucacaaaaaaguccccaaacaacaugccuccuaaaaaacauuuuccuaucuuuuacaagagguaugaacauuuguaggguuccacauuugcaucuagaaauccaaugcucuuuagaauguuauuacgaauagaaagauggccaggaugaccuuuaguguuacaugauguucagcaaauuuuaauucaaaccuugauaugccuggacacugaaaaguaaacgcaucaccuccuauuuuauacccuaccuucugguucccaauugggagagcacauagagggaaggagacaauauagaaacuacggaguccgcugguagugggcugcauggugugacagagcccuucucuguaaaauggaaaugacaccacuagccaucucaauaguuacaagaauuaaaagagauacaguaccugaagugcuuagcgcaugguagcauuucauaaauguuuagugucaauacuaaugcucuaauaauguaaauuguuaauaauuuauuucccuaauaucaggaaaucccaguugucuauguggcccagugcuuaaaaacgccuucuugcaugaggggauugaacuauacaauguuuguuaacuuuguauuuguauuuuuuccuauaaaaucuuaaaauaaaauuaggagauguguucugauguaacaguaggauuagcaauuuucauuuauuccuuccauauauauuuacugaauggcuacuauaugccugguauuguucuuugaaagcagaaacagcaggaaaaaaagucccucccucauagaguuuacauucuaaaagggaggaaauagauaauaaaauauacauuacauuuaa

SEQ ID NO: 192124 - RNA, 45698 nt, Homo sapiens
gccuuuucccuccggcucgggagcgucucgcuugcgccccgggcccgcggcgcccgcgcggcugcgagccucggguggccgcgugccggcuccaggaagccggagagggcgcggcggccaggauggcgcggcacgggccgugcggcuagacgggagccgagggaaccgccggcucgcgcccuccguucuuucccggagccggcuucacgcagggccgggaacggccgugccucugggauccgccuucgcugacgccgggcaccuaccuggacgcgagcgagcgagaugcccaaccccaaaaacagcaaaggcggccgcaaaaacaagcgcgccaacagcagcggcgacgagcaggaaaauggagccggggcccuggcagcggcgggcgcggcgggagcggcggccgggggggcccuggcggcggcggccgguugcggggcggcggcggcgggcgcgccgggcgccggaggcgcggcgggcgccggaggcgcggggacuggcgccgcgaacgcugcggccgccgcgggggcugcggccgcgggcgaugccaaaaacgguaagacggggcuggcggggcgagcgccaacuuccuccccgacggggacggcgcgguggcggggcccuggguggcgcgggcggugcguggacaaugcgagagucaggaagugcucaccccgccccuccgccccgccgcggcugccccuucgcgguccccacgccuggcggcggggacagaucugcggccccugcccgguguccgcgcggggggcagcccgcgccccacacucugaggggcucccggcugcggcagcgcugcccucgggcccagccugcugcccgcgcuggcacugccccgccgugugugccgggccgaagggaggaaggaagggaggaaagagccgcccaaguugagaagaaugauccgauugaaaacuuaggcaccgguuaauucuucccggugcuccaaggccacccguaacccccggaaugaaggagagagagccucaauucuuagcacacccaggcuugcugcgucgaucgccacaggugaagaggccucgagacauuuagggccucuguguuugcucuuuaauuuuuuggcuugcuugaggaaggaagagaaucugaacuugacuuccguucucagcccggaguuaaaaaaaaaaaaaaaaaaagaaaagaaagaaaagaaaaaucauucucuaugucauugugcuuaacauuuucagaaggaagccucauaaucuuagguagugccugaauguuccuuuugaggggacacuuaggaacuggcccagaugugacaggauuucuguucucauuacagagccaugguuuucguuauaaggugcugggcaaacacuuacuuauuuggacaguucuuugaauuccucuagucaggcacuuuuuccaggaagacaacguagguauuuuaaugaagggagauuugaauuguuauaucuggcuuuuaauuuauagcgucagcuuuugaagccauucuuuauguagaucaggcacuuuuuuguuuuguuuuuuuuuuuuuagacggaguuugcaauuucgcccaggcuggagcguaguggcgcaaucucggcucacugcaaccaccgucuuccggucugaagcgauucuccugccucagccucccgaguagcugggauuacaggcgcccgccaccacgcccggcuaauuuuuguuauuuuuaguagagacaggguuucaccauauuggucaggcuggucucgaacuccugaccucgugauccgcccgucucggccucccaaagugcugagauuacaggcgugagucaccacgcccagccagaucaggcacuuuuuaaacagggcaccugcucuuacaagcagcguacagugcucugaacauaggcggcugaaugucgccuguuagaacuguaggccccguuggcugugucucugcaauauugaaauaggaagauuuauuuauuuauuuucagaaacaaacuuaccccguuugugaauguuucagaauacuaguuuuggguagccuguguucuucauguucuuuuguuuuucuccuggcuuuaaccuucauuuugguauugauguggcagagagaaaggugcucagacucuggguaggacagacuccuagcucagccauuuagagcuucaucaucuuggaaaggucagucuuccagagccucaauuuccucauguguaaacuugaaaaaaaauuacccuggcucccuccuaguguuauugagaggcucagagugccccuucccuauuaugcucccaguucuuguuauuuuaaagguuacauauauaaugagcuuaaaguuucucacaaagagugcaugaacaaugaugacagcuuucguuuauucauuuaaaaaagauuaccugcaguguugcaaguaccguguucaauacuaagggauccagcgguaaucaagacgagacaucccgguccucagggagcuugcauuccuguucugguggugguuuugguuugcucugcccaccccccuaccagcuccuuuuuuuuuuuuuuuuuggccuauguggaagcuucaaguucacaguuuccuuuuuuuucuugcuccaaaagauuaguccaauuuaagguggcaugaggaaauuuuuuucuuaggcuacuuguaccuccuaguuuguacauaacaaacugguuaaggggccccuauuauuauucucugaaguggcagacucaaguauauuuagcagcacaguguaugugaagagcuguuucugauuaggagcuuauuuuauuaagugaaaggcggggagaaaaaggaaugggccaacauucccauagucagggucagaggauguaacuuauauuagaggagugagccaaauuuuaugaugccugauucuuguuucugaagugaugugaagucuucgugaaugauucaccuuaaugugaggaacccccccucaguucugcaguugaugauaacugaacuuggaugcugaggacuccugggugcaaaaucaaaugcuuuuuucuuuucuuuucuuucuuucuuuguuuuuuucuuuguuauuuaaagcuauaguuuauaagguagggguuugggagaggcguuacuggugaauuuuuaaagaggaaggggcaagagaugcguaaauucucaaaaucaacuaaggaccaauauuuggauuuuuaauguuaaaguuauuaucgguaguaguuuuaaguguauuucaauuuuuuacuuaacugugacauuagauuuuguaauuacagaaauuacaaaucaaguaauuauuacaagaaaggagguacuugauauucuuugaaacuuguaaauaguuuuucacuguucaagucagcuaucuacaucugcaaacaugcaaacuuaaugacuucgcuuaaaauuaauaguguuuauuuguaguuguuuggaguuuauagaaugguuuugugucuuguagcucuugggcagugcggccaccagagcagggcaauauuagcuuuuaguuguucaguuugucaagugggcauaaauaaauacuuauucuguaaaggaagauuacuaguuacggagagcuuggggaagccgcgguauaguugugguuggagaagaugaacuggcugcaguugugcaucuugaguaaguuuaauauuaauucuuaggauaucauaccgcuaauaagacauuuauuagauacuaauuuuaagauacuaguuuaugaggcuuauuuuucagggauugguguaaaagaccaccccaucuuuuuccuacauaguaaucugucugcacauaccauuugcauuuucauugcagguauacaagauuaccaaugguuauauuuagaaucuaguuaucaaaagguagauacguaguuucauucugguuccauuaggccucuacauuuuuauaucaggccuaaaaauauuugaaaccuugaucauaguauaucuaguuuucauugggccuggaucuuaaguacuuuuauaaauuccuguuauuggaugaccaugguucaucacuccacucauuccuuacugccucuagaacccgugggcagcagagucugccuuaauucauggaacuguuucuagcagauggaguucguuugcauagagauuggcuuuccauuugguggaccuagauucaaauccuggcuucucaaauuacuugucaaaugaccuugggcaagucauuuaacuucucugagccuugguuucugcuuuguaaaauggauuguaguaccuacccauacagauguaguaaaauaucuguaucuaucuauuaaauauauuuaaaauaaauagauuacauacauuagauagauuagaacagugucugacuuacaguaccagcuuacgaaguauuagcuguuugucuuagauccuggaaauagccugagcagagauacacgugcuggagguuacuggagagugcucuuggcaucauuccuaguggaggagggaaggaagcaggauugggcagaagcaggaguugaacugugaugcaucuguaacagagaccccaguugauccucucuugggggagcucuggaggugggauggccuuucugaguuaucucaccuuaaauaauaggggcagggccuucuacacacucccccaacucccaguugacuggucauuuggacuugggcuccccccaggaagagagcaugaccuugaggguggcaucucuuuaccuggaaacccuuuauggagagggacucugcugagaagcuucagcucugagugaaaggagagccauucuuauuccccuagcauuauggaugucuucauuuagaccaccaguaccauucacauaaaacacaggugugggauaaauauuucucacuaacaacuaaauaggcuuuguggaggagacugggaauuaaccaccauuauaacaguguuuccaugggaaaacgcauucugaauuccauauaucuguugacaaguagauuuuuuuuggaguaccaccuguucccuaugcacaggauuuguauuuugcugcauauuuaggccacuaaagacacuuuuuauaaccgagguuuguaguauauuuuaaauaguuucuuuuuagauguuuacuuuaauuccuacuacauuuaaauuaccuauauccaucaguaggaaaaugaaaaauguuugcuugcuguuuauuuucaaaucaaggaauaucuguugaggaucuaagguauauagguuaccauuauaaucuuagaaaacauuuucuugccuuaucuagaagucaguuuuuugggucucaagaacuauuugccuuuggauguugucuuuugaaauccaccuuuuuaguggagauuggcagaaaauauugccucaugcaucaaagauucuuccuguacacuucguguauuaaagugaagagcucuucugugcgccguucauggugcucuaugcgcagucucgucuuucucucauucuuuacuuguuagaggaucugugaucuguccuuaaguucuagaaacuaaaccuucaaugucaauuuuccuguaaguccaagaauauauuucauuccauggagaauugaaaacgggagauaaaacgggaaaaucucuugcagcuuaauccuccuaugaguuuacuucaggcuuuuagcuaugaauaauuuaaagaacuugaagguaccagaagagauucuuuacagaaaaaaaucuguccuaacugauuuugaucagcaacucuuuggcauuuuuguuuuuugagauggagucucgcucugucacccaggcuggagugcaguggcacuaucucggcucacugcaagcuccaccucccagguucacacuauucuccuaccucagccuccggaguagcugggacuacaggcacccgccacaaugcccggcuaauuuuuuguauuuuuaguagagacaggguuucuccguguuagccaggauggucuugaucuccugacaucgagauccgcccaccucggccucccaaagugcugagauuacaggcgugagccagcgcgcccggcccucuuuggcauuuuuaagggcuuuauuuauuugaaaauauuguguuauuuuauuauuuuaccaguaaugaaauaagcaucuuagaaaagaagcuuucuuugccuuucugguuaaacacauaauuccaccacuuaagagaucaacauuauuaauauuuugauauauguucuugcagccuuaaauuuuuuuucucacaaaacuuuuaaaaguacauauauaguuucugcaaaaagaagaucauauauuuuauaaucugauuuuuacacauagaauaguuuguggacauuuuagcagagcaguaaauauacaggugcaucaucauaugucugcaccuuggaaauuugaucauuccacuauuguuuaccuuuagguucuuauuuauauauuucugggcauuuguccacuuaauuacuucauguguuaauuuguuucugcugccacaacaaaauaccucaguguggauaauuuauaaacaauagaaauuuauuucucacaguucuagaagcugggaaguccaaggucacagccagcagauucuguaguuggugagaaucacagcauccucacauggcagagaaggugaaagggaugaacuuguuccuucaagcacuuuuaugagggaucuaaucccguucaugagagcccucauggccuaaacaccuucuuuuuuuuuuuuuuuuuugagacagagucucacuaugucaccaggcuagaguguaguggcuugaucucagcucacugcauccuccaccucccagguucaagcgauucuccugccucagccucccuaguagcugggacuacaggcacaugccaccaugcccagcuaauuuuuuuuuuuuuuuuuuuuuuuuggacauggagugucgcucugucgcccaggcuggagugcaguggugugaucucgucucacugcaagcuccaccuccuggguucacgccauucuccugccucagccucccgaguagcugggacuacaggcacccgccaccacacccggcuaauuuuuuguauuuuuaguagagacaggguuucaccacguuagucaggauggucucgaucucuugaccuugugauccacucgccuugaccucccaaagugcugggauuacaggugugagccacugcaccugaccauggccuaaacaccuucuaaaggcuccaccucauaauacuguugcacuggggauuaaguuucagcaugaaucuuggagggacacaaacauucaaaccacagcauguacuuaggaaaaauucuuccuguggacuugcuauauccaaggauuaugcauauucucgugacuuuuaauacaugcugacagauugcccuauugaaagguuguaccaguuugacauugcuguggucagagugcuuuuccccauggucucaucauucccugguuguuuuaaaggcaugcuggagaauugcucagcaaauucuccaaaaugucucagcaacuggagggccccauuugcauccggaauuuggagcagaugcugucguacauagggggacuuuccaaggcuggauguauuucuguuuuuaaaacagagauuuuaaaaaguaguaaugguggccaggcaaugguggcucacgacuguaaucccagcacuuuuggaggccgagacgggcggaucaugaggucaggaguucaagaccagccugaccaacaugcugaaacccuguuucucuacuaaaaauacaaaaauuagcugggcaugguggcgggcuccuguaaucucagcuacucaggaggcugaggcaggagaaucacuugaacccaggaggcggagguugcagugagcugagaucgcgccauugcacuccagccuggcgacagaaugagacuccgucucaaaaacaaaaguaauaaugguagaugauauuuuaguaacuggugauagaguuagugaagaugaaagcauagaccuuugaaauucugucuguauuaugauucuaaucuuacaaaguaagaucuggaguuuuuaaagcuuuagugaaaaaagacuggguacuucaggcuuggguguaaagcuaggugcuauaacuuacgcuauagcagagugacuuuggggcagguuauuuaaccuuucucagccucuguuuucuaaaugcaauccuuuaggguguuuuuuugaaggaaaacaguauaugugaaagacguuggcacagggccuggcagauaugagcccugucaacaacagcuuuguaaauuuugugguuuguucaaccuuauccaacuaaaaaacuuguuaagccauugugauguuaagaacagacacugaaagacauuaauguggaaaaagacuauaguaccgugcaaguuuuuauucaagcacugcuuugacucaaaaugauuaucuacucuucccccaucuucucuuucuuaucauaguuuacugggaaaaaaucagaugauuuagcuaaaaauaagcaaacaaaaagcaacauguaaaaauggguacaucuuccuuauauagaaauaaacgcugccaggcgugguggcucacaccuguaaucccagcacuuugggaggcugaggcaggcagaucacaaggucaggagaucgagaccacccuggccaacauggugaaaccccaucucuacuaagaauagaauaauuagcuggaugugguggcacgugccuguaaucccagcuacucgggaggcugaggcaggagaaucgcuugaacccaggagauggagauugcagugagccgagauugcgccacugcacuccagucuggugacagagcgagacucugucucaaaaaaaaaaaaaaaaaaagaaagaaagaaaugcaaguaaguuauuccauguauuaaacaagggcagcugugaaagagcaggagcauauguggcaaaauauuggguuaaauauaaguauuggauuugaagauggagaagucaaaugaguauguggaguuguguagcugaaaggaggugaggagcccaggauguacuuugggggaucagccagggcuuaguguuacugagaauuaaacacaggauccuucccucucuccaggcaacuacuggauucauuagauccucauucauucauuagauccucauucauuagauccuaauucauuguuuauauacucauccauuuacuacauauuuauuaugcaccuacuaucuccuaugacugagaaguacaauguuaaauuauacuuggggggaucagaauccauaccaucaagggcucacugugaagcuggcagagagacauggaaacaacaggagccaugauaauguacuguggauagccaguggggaaaaugauguuuccuggaggaggggacauuugagcugagucuugcaggaagagagacagugaauucuaaagguagaggaaggauguuccaaacagagggaagugaaaaagggccuugaguucugguugcuccaggaguuugauguagccggugucaggugccgugguaggacuggaggcuggaaagggggcugggucagacagucaaagcuggauguuuguagccaguggagaaccgcccaccuagguuuauaaacaaggacauggucagcugaauuugaaaaggggguaaucacagguuguugacaaguuuguaaaauuauauauuuuaacagaaugaguaucuuuuaauauaacuaauaaaggauuggagguggagccugccauggacccucaauugugguuuuucaaugaagcagagggcacauggcacaugcugcuuuucugcccaggaugacaguguugcaggauccaagacugcuguauggaaagccuaucuuaauugugggcagcagcagcccagugcuuucugagccaugugagguuacuaauugagguuaacaucagagaacuagaugccagugggagggauugggaccauuugagcaaguaagauuuucucuagaggcaggggcuugucccuaugguuuauuuuucguaccuagguagaaaguguauaucucugugccaaguuguacuaauuaucuugguuugucauuuuauuuuugucaacaucuuaccaguuuuuaaaacaauaaacucuggugaggggaaaugcuauuuuguacagagugacuguguguuuuaauuuuguauauuucagaaagcuuccaguuuucagugguuagcgaaauagcaacuugcuuuauuuaaucaacaggauguuuuagcuuaauuguacuugagagcuuuuuauaaacuagcaaaaagucaguagcauuucuaauacuuuaaaauguuacaauuuuucagacaaauuacuuuugcuaaauuguacagaugaggauaauacuugaaaagucuaagagugagaaacaagaaagauacuaagaggaagcuuaaagaaaagugaggaaaaaggaagaugaaguguucaauguagucauauaauugcuuagauagcauuuaaugagaaaguuagcauuguucucauauauacacguaauauaguguauuucauagauuuaaauagucaaggaggaaaaacuuucucuacucucuuaggcuuagugauugagggucugcaaauuaaauugacaagagacagauugcaagauaaaagacauuuaaucauagaagaaugugagccaaaggaaugguuagaaguaggggcuuguauguuauuuuaauaggggaaggggaggggagaaaagggaacuuaugggaaaacaaaggacuuuuuggaaagauaagugggcguuuaggagaauagaugaaagaugcgauaguuuggugguaauaucagcuugguguggugugaagacuuuucaucucuggugaugagucgcucuuccuugguugcucuuggggaggggauuuauguuaauugaauucuuuuugagagccucugcuuuuaggccaguaagagauuucaggaacuuaaucacuuucagcucuuuaauuuuuaugccacaguggcauauucuggacccccucacaauauauugccacucaaaucauauuaccuccccuccccuaccaagaacaauuacagauagucggauaggaaaagaugguccaggugucacaauucacauuucuuuuuauuucauuuuauuggaaauucauuaaaaauagaaugccuuaagauuuauuccuucauaacacgugaucaagaggaugaauucagacaaaaguuaguaagguaucaaauugcuccgguaaguuaagcagcuacuugccacauugaaaauguauauuuuucucuagggguaagcauagguuugauuauacuuuagaucaugucccuucaaguuauaaagucaucucaguagagucuuuggacacuaauguugaaacugagucacaggcuuuguuuucgcuuuauaaaugagcacuccugagugugaugcuuauuucaguguaauauuuaguauaacacaacuucuuauuaagguaacacacuaguuguuaugccuaacacagcucaguaggcagaagucgaaacagaaauguacagaaucaaguucuggcuauuuuugauuggcagcggguacaaucuguaaucugagagcgggagccugagauggcuggugauaggugucagugaacagacacggagagcccagaacagugcugccagaagccaugaagagggccuggcauugaaaaauaagugccugcugugguggaggcagaaguguacaugccugaaaacauagggaagcucaaagaauucuuccaaauggcuuccagcuccuuggauccguucuuacugggcagugccuacaugucacagugacuuucuuuaccucgguaaugauacaguuccacuguguuaggcauauaguuuuaguagugaaggugaugugcuguagugcagaagcaaauuaggcaagacuccugggugauugguguguugggucuguagaacuuacggaaaggagaagcagccauuccuagugacaggaaaagugaaguugccacagcuccccuuuuugaguguuuaguaggagucaggugugacaccugcagucugcagucuacauuugaguaugaggacacuaagcuucagagauggccuucccuucuugcagaaaaggcuuggcuguagggaagugugccugacccccaugcuuuauaguuggaaucuuguugauguuggguccaucuugacucacacacauacguacauaaauaaugaaaaacuguaugcagauuuuuaaaggagaggacugaaauucaguguaaaaacaccaauaugguuuuuauacugaauaaggacauuuacauuacuuuuaaaaggucuuaugggucgggcguaguggcucaugccuguaaucccagcacuuuaggaggcugaggugggugaaacacuugaguccaggaguucgaaaccagccugggcaacaugacaaaaccccaccucugcaaaaauacaaaaauuagccggauguggugaugugugccuguagucccagcuacucgggaggcugaggugggaggaucgcuugagcccaggaggaaaggcuugcagugagcugcaucuagccugggugacagaacgagaugcugucuaaaaaaagaaaaaaaaugcuugucauucugguacuugaacugaaauuacauuuguaaaacaagaaaauacuugacccaaggaagcacuuuacucacacauuguacacguauguugaucugauccuucuaucacagaaggacuuccuggucuuggcuugggagauugugaacauuugaacuggcacuuccuguucuuaauggaccagaguucauaacuagcaugugauuaucuuuaggguaaaguccuagcaguaggaucacugguuugauacauauugccaaacugcuccuacagacgagguuugccaguuuacaccaucagugguggugcaguuccuucgcacucuguaauguaaauuucgauuaccauuuucaucuuugccaaucagauagaugaaaaaucacaucucauugucauaauauuugcauuuuuuggaucaucagugaauaucuuuuuauauuuauauugaucauuuguauuuuuuucuuguuugugauuuuuguccauuuuacuaauaggguauuuguguucuuacugauuuucacaaaguguuugcguauucaggguacuuuuugacauacgcuuucccuaauuuauuguuugccuuucagccuuauuuaugguugucuuugcugguuagaaauuuuacaguuuuguaugauuacauuaacauccacauagaaauaaagguaaagguaagggagugugaggaaaguugugaaauuacuuguaggcaaagcaguuugggcauggcauaaaguuagcaacuuugaguucauuuguauaccagugcacaguaaugcuauuacauuuaugagguuguguuuacuuuuuaauuuggaaggcucuguuucucagaauugguugcaacccgccaggugugguggcuuacgccuguaaucucagcacuuugggaggcugaggcaggcagaucacuugaggucaagaguuugagaccaacuuggccaacauggugaaaccccaugucacuacuaaaaaugcuaacauuagcugggcaugguggcgcaugccucuuaucccagcuacucgugaggcugaggcaggagaaucgcuucaaccugggaggcagagguugcagugagcugagaucaugccucuaaacuccagccugggcauuagagggagacucugucuccaaaaaaaaaaaauugguugcaacuccugcugcccucccuuaccuccucuccgagucucuggccacucacugcugucgagucaauagcugagcuccagugcucaauacccgucucuucuugcacauuucuaaaaucccuuguaguuuuuuuccagcuauguaggacuuugacacuuguagauaaagacucauuauuuacuuguaauugccucuucucaagaaccaggcugcaaacugaggccucuuaaggcuaaauugcccauaaguugcuuaugauaacagacuuaaaugcugaaucauaagaaaguucucauuuuucuccuucuggcacuugaacugaaauuacauguguauauuaauaaaaugagaacauagcacucgauugaaccaagaguuuauucacacaccaugcaucaugcugauccagggagccuuugugccuucucagaugucugugauuuggaagagguuuccaaacucauuucuguucuaaacagugugagauuugggagacacagguuauaggugaucuggcucugccauuuugcaaggcugccaaaccuugccaagcccaaguuuuaucugcagaaagugagcaugacaugauacuguuugugacgagcucuuuuucaaaccauagagcuguuuggaaaagcaaaucguugugccaugauuugggguuuuuaguuuuuucuaggugaguuuuugguucucuguuuguaauguggugcaguguggcugcuucccaaccagugaugaaugcacacacugauuuguuggaagaaccagugcagauguuggcuuucccccagggaguuugcagugaaugccggucuuccaaaucuguauucugcugcuuuggggggagccuuucguuucucugcaaguuuggaucugggagcucuugcugugcaaauuuugcccagagaaucuguaguauucauucuccugccggucucagggcaagcccaguuuuuugaaugagaccuucuggagcuacugcaaacagccuuucugaccccacagugaggagaaacugaggcaaccgaagccuugaggaggguucuuucaccagugugagcauagcugacuuugggauucuuuuguugugaucuguggaucaauccugucccugagcucuccugauuuuguuauaacagcagaguccacuuagauuuuaaccauuugaucagcagagccuuguuuuuggccuguugugcugcaugauuuacagugugcaucuggauuuguaauuaugccucacauaguuuauauuuugauucacuucaggcuuuucugcuuucuccucuuuaccugccucuagggccauauggaguggaaguuugcauguuguuguaaaagcauuuugaaauguucaucagacuuucaugguuuccuuacuucccuuuuagguuuugcauuuuaaauuagguuauagaauugugaauuuaccaaacuauauuguggauuuuauucaaacaguuucuguggguaugaaauacuggucauguguauguaucaauauuuuauauggaaucauuauauuucuugggguuaggcugacaaaaaacaaucuguuagcuucauucaugagagguauucagauuugaaauuuuugacuuuggaauaaaucaguuuuccucaacuuauauuuuaauguucugugauauaugugaucuaaagaugacuuugggggugagaguggggcuaaaaaaaaaaaaagaaauagaugauaaaaaagaugacuuugaguaauuuuuaaauaauuaauuuuaaauauuuuuuucuugaucaauuuuggacauaugaguuagaauucauuuagaauauauauauauauguugaauauaaucauagguaauauaacaaauucuauaauaguagaaaguaaguuuuagauuuuuuugguaacucuuuucacaaauguuauauuauuuuuccccucugguuugaaaugaauaguuuugagucuuugagaauggucauaccauaaaauuauaucuguguuccacaaaaguuaguaauuggaaaaggaaugaacauuuaauuaaaauaucacuagcuuaaacuaucaauaggagucuguaacucuaaguuuacuuaauuuuccuuagaaaauuuuaugaaauacucccuugaaaucaaaucauauuauagcaaguugcuucaaguuaguauaugugaacugcuaguucacaacaaucaugacugauuguugagucuacuuuuucauuuuuacugagguauggauaagacuuagacaugcccucuucuuugacaaguuuuuccuuguugcaacagauucuauaacuugccuguugguugcugaugcagcuuuucagaaauaggccgugcaguguggccccaggcaaaagcuuugucuuuucucccaagaaccuagcggaaugacugccagagugaucacuauaaagcauuuuaccagguuauuuugaagggacgcagggagcagaaagaguguauuucagaaaguucagcagggcagaaaaggccuguggaaaacaaaagaguguaaagauuucauuuauuuuaggguauggauaggguaaagaagugaauuuagcuacaucgugcugagauuuuauugauuuaaauacaguagucuuaaaaucaucuugggaguugguguguuaacucaauccguuuaacuaaacagaaugcaggcaaggcaggcugaacuucuguuucuuccggccgugcuuuuucugcuacuuaauuugauauucuccauacugagagaaugguguuucuuuacauucuuucaaaggaaaauccuccucuuuugaguuuagcaauucuauuaacuagagcagauugacuuucuugucauuauuuuuaaggagugcaaagauuggggucaggaaaccuuuauacuguaauugaguuuaaguacuuuuuuaacguggucacuuagguuggugcaaaaguaauuugcgauuuuugccauuacuuucuuaccuacuuuuuaaguacucuaaggauuaauaugaggauugaacauuuugaauaagacacuauucucaauuguagaacuacauacuacaaucugguuacgcaaagcuguggggucacagccucuccauauaagcuggcucugugcucucaauuguccugugugcaguauggguggaaauacaagagagaaggccacuuacuagcugaauggccuugggcacaucaccaaaggagccuuccugugcucagaaagaguauguggaaucuggacuaaagugauuguccuauuucuauucugugaaacuuugauacuuuuaagaaacauuuaggauaaacuaugacacuauuaucuucauccugauguucagccuaaaccaggcauauucuggguccguauucuuuugggucuugacgugucuucuauuagacaaggaaaauaugaaucuucuacuuuauagucauuauugaugugauuucuuacugagaucagagcgucagagccagaauggaaauaacagguaaaauagaaaccuagaguuuuuuauuuaguuugaauuugaggcuggguagacuuguggguuuuaauuucaaaguaagaaaagggugggucuaggagaacagacuaaauauauuaagagaauguuaaaaacccaaguuguaaacuguauugaagcauuggauguguguguguguguguguguguguguagcuuccauguuuauuuugacagagugguuugccugaguaaaagcuuuucguuuaaauccuacuguaagcaaagaaaaacauguuuaacugaauguaauugccuugugcucaauuugcuacucacuuuggagcagguucacacacuaaaauaacauaaggggagguuaaauuacaucaaagguuaagacagauaagcuuaagugaucucauuguagcuccuauacuaauuaaaacaaguugacaaaauauuuuuguaaguacuagccuuccuuuauguguagugcuuagugucuuuauuuuuaguagaaaaaaggucuuaaaaauauuugaggaaauuuauauuaaaaccuuuugaguuuucauuuaaauaauacuugccgguuaaucaggaaaugauucuuuaaauuucuuuuuauuuuuaauuuuuguggguacauaguaguauauaggaaaugauuccuaaacacccugugaauuugaggcacaguguggagcaucagugggcugcaguuagcuucuuuguccacuccugugucuuaccuaauuuccauguuacagccacaggaaugggccaaggcugaagcagagacuuuacccuagcuggugaucagauggaaaagcaaggcuggggccuaauuacaggagcuccuugaacaugacccaagaacuuggagcauuagucugaguuucugagguuucugaauguguguaugaugugaucauagucaaguuuucagaaugccgaucugaagguauuaaucaaucaaacuuuuuuuugcuguguaucuccuaagagaauuagaaaaaaaacaggguucuuguaaauuuuuaaguugucacacccaguuuucuaaagacuuaaauagaugcugaggauacaguuuccaguucauuguaaacauuguaauuuaugcaaacagaauccuaauuaucguaguaacuugguaaccauuaucauccauuuaaaaaauaauguaauuuuuuuuuuuuuuugagagggaguuuugcucucgucgcccaggcuggagugcaguggcgcgaucucggcucacugcggucuccgccuuccagguucaagugauuuuucugccucagccucacgaguagcugggauuacaggcacgugccaccaugcccaucuaauuuuuguauuuuuaguagagacgagguuucgccauguuggucaggcuggucacuccugaccucaggugauccucccgccucagccucccaaagugcugggauuacaggugggagccaccgcacccggccuaaaaaaauaauagaaauuuuacauucuuuucuuuauuuccauucaguuuguacucagaauuugauccuaagacaggguauuguccugcuuagaaguauuuuauugaucauccuaucauauuuuccuauaacaaaauauacauauaaacuuuuaaauuuuuauuaagauggacuucugagauggcagaguaagggccuccagaaauuugcuccuccaugaaagcaauaagaacacugccaagaauuaccaaaauuaacuuuuucagaacucuggaaauuaaccaaaggcuuacaguaauucuaagaguguucuuucaagagaaaugacugaaucauaauaaaaacagugagcugugguguuuuaacuugguuaguaccucccccuuucccuagcucugugguaucagagcaauguaauugcuauguaaauaguuguuauacuguauuuagggaauaaugacaagaaaaauaagccuguguauguucaauacagacacaaccaucuguuuuuuuuccaugaauauuuuccauugacaauuggucaaauccauggauguggaacccacagauauagaggacagacugcauaugaaugggguggagagggagucuuagcuaccuggagaaugugugcugcaccaaaacagcauucugauucacauuccaaaaaaaaacucuggacugguuuacuaagacacaaugcaggccaaacugccccauuggaacucugaucuaggggauauauagacaucauaucaccuauuaucaguugagcuuuuagaauauuuugaacagcagggaguugugaguuguauuuucuaaccgguaacuggucuacggaugacccguguugccaguuaaucaugcagucuuaugcuuuaccuguugggcagacaagggaagggguaaagucauuagucuuuucagcagaggucauugggauuucagagguaaggggaaggggccaaaucggccauggccuuuggccuccaaauaccauuuuggggcucaucaagagagaagaagcagguccagcauuuacacugcguuguaauuuacaugguaaaugaaaaucacauagauaaacuaugaguaaagagguuugaguauugccacauuuugaauauuugugcugacaaaggaggacauuaauauggauaaucaaaaucaagcuuauuuuccuaagcaaggauaauauuggaauacaguacuaaagacugacaugaagucuuuaaaaauaggauuguuuaacaacugguuggacaguuucuccgcaguuguauauauacagucaugcauugcuuaaugacagggauacauucuaagaagugugucauuuggcgauuucaucaucaggcguacaucauagaguguacuuauacaaaguauagccuacuacauacguaggccagaugguauacccuguugcuucugugcuacaaaccuguacagcagguucguugaauacuguaggcaauuggaacacaauggcauuuaugcaucuaaacauacagaaacauagaaaaggcacaguaaaaauacaguacaaaagauaaacagugguacacacauguaggccacuuacacaugaaaggagcuuucaggacuggaaguuacucugggugagucagugagugaaucugaaggccuaggacauuacauuacuguagacuuugauaaacacuguacacuuaggcuacccuaaauguaggggaaaaaugagguagguauacuaggacgucacuaggcaauaggaauuugucaguucaguuauaaucuuaugggaccacuguuguguacggaguucauuguugaaucaaacgucguuauauagcauaugacuguauaugcacacguacauauacacacacauacacuuacacauaugcuuagucuggaguccucuucccauuuuaugauagugugauuugguuccaagagcuccugaaucuacauuuccuucagagcauauuauguagugcauuuucgugcuaggaugcuguguaguuuucaaugauuuaguacccccaagaucuaaaucuccaaacaagagaaaaggcagccugcuaauuucuuuucuaguacagugugaucccauuauaugcaaauugaauuaugcaaauuucaacuacucacauauaaauaauauuaauaaaagcuucacauugugugcaaaauuucaacaagcauguuuucccaaauuaugugugaagccauuucauauuuucaaagcugucaggucaacugaauuauaaaagugcuuucuuacccaguggcaccauuuauauuuuuuauauuuuauauguuucuauuuuauaaauauguuuauauuuuauauguuuauauuuucuuauaaacaaauacuaacuuguggcaguauuaugugaacucuucuuguugcuagaacuucuguaaggauuuuggugacguuuguauuauuauuuuuuacauucacuguuacaauuuaaaaucuuuacuauagcuuuuucuuuuuuuuuucuuugacagggucuggcucugucacacaggcugugguguaguagcaugaucuuggcucacugcagcuuccgccucccaggcucaagccaaugcuuccaccucggccuccugaguagcugggacuacaggcacgugccacaacaccaggcuaauuuuuguauuuucuuuuuuugauagagaugagaucucaccauguugcccaggcugguuuugaacuccugggcugaagugaccuuccugccuuggccucuuaaaaugcuggaauuauaagcgugugccauuguguccagccuguagcuuucaaaauaucaccuaagugugcuaauacuggugcugaaaaacauccuggaaaucaguaacuuuggaaaagaaauuagaugugauaaaagauaccaggaaaugacaugcuguuaauuuaugaaauaaacucagaaguaugagaguuaaugcugauagaauuaaaaaguaugaguaaagcagaaauacagcacaaugacggcacgugucuguguucugagugugcauuccgcauacucuauccuuagacuauggaauaaucuguucugaauuauguaaguucuucaggaccaugucccaugaguaaaaugcagucaugcuucaugaaucucuguuacccaugcuagggaaagauggauuagguuuaaaaauacauauuguuacaggagagggguccugauccagacuccaagagaggguucuuggaucucgcacaagaaagaauucagggcgaguccgcagugcaaagugaaagcaaguuuauuaagaaaguaaaggaauaaaagaauggcuacuccauagacagagcagccccaagggcugcugguugcccacuuuaugguuauuucuugaugauacacuaaacaagugguggauuauucaugccuccccuuuuuagaccauauaggguaacuuccugacguugccauggcauuuguaaacuugucauggcacuggugggaguggagcagugagaaugaccagaggucacucucgucaccauuuuggguuuggucgguuuugaccggcuccuuuacugcaaucuguuuuuaucagcaaggucuuuaugauauguguuuugugccaaccuccugucucaucaugugacuuaacuaucugggaaugcagcccaguagguuucagccucauuuuacccagcuccuauuuaagauagaguugcucugguucacacgccucuugacaauauaacagaguacuuauuugucugacacugagaagaacaucuucaugggguuagaagaagauaauuuugaaggucuccuuuuccuucuacuucuuugacacuagucaguaaauauugagugaauuaucuuaugcaugccauacugcuuuguugugaagaagaaaucuacuucuugccccucauaagccuaaagcacacauagaaagucaugacugacaaaaguguaaguugggagagcaugcaaguggcaacauuuggcccaagaguaauauagagggcuguagagagugggaugguacuuucccagcuaagaaggcuggcaccucccugggcuugggaagauguggaagggauugggcuugggacaggauugaggcgaggcacagguggaggagggugugugccugcauguagcaaaagggggcaaaugagagggggugaauauaauaacacugaagugcccaacuccuggugggcucggccagccuugcacuuaauguggagaaaggaggauggauggccacuuccugguuguggcuuugcucuaaacuuguucaaaaucucuugauuuuuaugacaaguaauauaaagugauauggcauuuguuaacaauugcuuauaguuaaacagugcuuggccaggugcaguggcucacaccuaugaucccagcacuuugggaggcuaaggcaggaggaucacuuaagcccaggaguucaagaccagccuggguaacagagugagaccccaccucuacaaaauuuuuuuauaaaaagucagcuggggcugggcucgguggcucaugccuguaaucccagcacuuugggaggccgaggcgggcagaucacgaggucaggagauggagaccguccuggaaaacacagugaaacuccgucucuacuaaaaaauacaaaaaauuagcugggugugguggcgggugccuguagucccagcuacuugggaggcugaggcaggagaauggugugaaccugggaggcggagcuugcagugagcagagaucgugccacugcacuccagccugggugacagagcgagauuccaucucaaaaaaaaaaaaaaaucagcugggagugguggcgugcaccuguagucccagcaccuguagucccaugcugaggugggaggauggcuugagccuggcagguugaagcugcaguaagccaugaccaugccacuguacuccggugugagcaacagagcaagacccugucucaaaaaaaaaaaaaaaaagaaaaauugguguuuaggugccaagcacuguucuaacuacuuuaauaacuucuucauuccucauggcaacccuuuugggguagguauuaguauuauuauuucugggccaggcacaguggcccaugccuauaaucccagcacuuugggaggccaagguaggcagaucacuugaggucaggaguucaagaccagccugaccaacauggagaaacccuaucucuacuaaaaauacagaauuagccaggcaugguggcgcaugccuguaaucucagcuacuuaggaagcugaggcaggagaaucgcuugaaccugggaggcggagguugcggugagccgagauagcaccauggcacuccagccugggcaacaagagcgaaacucccucucaaaaaaaaauuuuugaaaaaaaaaauuauuauuucugccauuuuacaggauuuuacagguaaggaaacagaggcacagggaaguuaggugauuugccaaaggucuuuaauaaguugcagagcugagucacauccaggcaggcuggcucugugucaucucccacagucuggagucgggaagcuggagauggaggacacuggucagaaauucauacccuaagaggaccaugcucucugcaaacaaggggauuuguucccacauaagaggaauaaucagcgaucuaauaaaacaguuuugaaaccuuacauuuguaauaaccaguucacuuuuacacagcuaguaucccauggaaccgggacuuacacauaaaugucuuuuuuuccuccuuuaaaaaaaaaaugguaccugggugccacaaggaggguagcaggaaugauguuaguuugaggaagugagggugagggccaggcucugucccgacagagaaggccuggacugaaucuaggagaccuggcuggagcucugcagcugccuccccagcagcugggcugguucuccccauggguucacccucucucuauuacuguggucacaaccagaggacugagucugguugggucauucuuuccuucaucagaagauuuauuaaacacuuauuuaugcaguaguggguuuacaaggaugaaugugacuaagucaucccuauuuuagauuuugccuggaaagccucauaugacuuaagaagacccuccuuaccuucauuccacccaacuccccaccugcuuauggugcagcuguuuuaagggggauaaaaauauuuaacucauaguuuaaaagcugaaaauagcaauguccgguuuauggggcuccucagugaaugagguugucaggagauuugggcucauugggcauucagugugauccuccucuuucaauagguaaggagcacagaguucucaagugagggcaggaugcaggguaagaaagcuggggagacaggauaggcuuggcccaggugacugcagccuagcuacccuguuauccagacuugaaacugagauuuuugcccagaaucacaugaacccuguuuauuuuaacuugagcagaagaaauagaagcuggguacugacuacuugaugaugaaccuaaaauacaggccuuggaagguuuauauacuuuuuuaaacaaugccaacucuguguaaaggagcauuuuucuguuuugcuuguuagauuaucacaguuuagauuaaugcgccaagggaaguugguggcacaaguguaugauacccuucucccaucucuccuguugaagauuuaauugugucagaucaaucuauauuccauuuaugccuuugugggacugcuguucuguuuuuaguuuggagacaagguuucacucauugccgaggcucacugcagccucaauuuccucgacucacuugauccuuccaccucagccuccugaguagcugggacuauaggcacaugccacugagcccaacuaauuuuuuaaaauuuucauggagacggagucucacuauguuguccaggcuguucucuaacuccuggccgcaagugauucucuggccucagccucccaagugcuggaauuacaggcgugagccacugugccuggccauacuuacuuauuuucuaaacaccuguauggcauguucaaaacauuggaaaaaguagaaaacauuggagcaguuugcauuuaucuggggagugaaauacagcgguauaaaauuaugguagcauauaagcaaacauuuuuaugaaacuuuacuauuuauaaaguguuuucauguacaugagcugaauagggcaagcauuuuauccccacuuuacagaugaggaaacaaaacugcucaaugucaaacaacuaaucaggagcagaccuggcaucagacaccucucuucuguuauucccugcugcuuuuccaguuuggacaauguguguguguggugugugugugucggggacagggguggugcuaaugagggaggaaaguauguuugaaccgagccuugaaggaaauaauguccgaguuuagaggccaacacacuucagcaaaagcauugucagacauccucugacuauucccgagguccacccuguuaccccauuuugccugucucccugggagccucacccugcuggugugucauagggugaagugucuguuguguguauuacuggguguauuuaacaugcucuuggcuuuguauuuguuuuugaagccuacccacaaggccacaucaaaguggcugacuauaaacaagcagggcuggcaaguuggagugggggcucuucauacaaggaagagguuuucugguuaggaaacaguggagcauggcugugaacaugacaaacacuguuaaagggacagggauggggcacagcugugguaccuugucuguguuccaugugugcacuucuguuagaccauuagagcucuuagcucaagaccuggcauguaggaagugcucaguauugguuaaaugaaauauuugcugcuuuuugaaaagacacagaauuuuuccucucuuaauccaccuuucuuuagugugaaaauacuuuucaaagaaauaucaagucagucucaacauuuacaguuggaauauugugaaugcaaauguuaguuagaucuuccuuugaccuaauuugauuuuauuggucuuggguuaguaaaauuugguuauugugguuacauuucagggacguuuacuucaaggcucuucaucugaaggaucaagauaaaaacaacuacacuuaauaauugaccaauuaacauuuuaaaggccucuaaaggucacagcccaggugacuggugaauuuacucaguuucaaaccacucuucuacuucuuuuuguugugcuucaguacauccaggucugacugucuaggauuacagcucucuuuuucacuucugcuccucuugucauguguggguuuggugagccaguaucuuuaaugcgacuuuuuucagcacuggaguuuuacaaagccugggcccaguggugccggaaacacuaagaugaguaagaggcuuccucuccugagucgucagcugguggggauuaugaagaguccccaugaugagggacucaaguaagauuggggccagaccaucagggaggggaggagaaggguuggagucaggauaggggggcaauccugguaaaauugguauguagagaggugggccuugaagcaguaggaguggggaggaaguuuacuagaugccaggugcuuucucagcauuucauguguauaguuuuuuucauuucauucuucugaaccauuuaagguacauucuguuguuuucugcauuuuauacagaggaaacugacacaaagagaaguuaaguaaguuguccaagagcaugcagcucauaaaugguccugccuggauuccaacucaggcagucugguugcagagucugaacugugaauugcugucaguggcugaaugggauuuggacaaaugaagauuaaggggaaaccacggugaucaaauauuaauacauagagguagacaaauugguuuagggccauuuugccaaggcccuggaaucccacaccugaaggggauaauuguaacauaugacagaacuaauauuuguauaggcuuuauggguccacauugccaccacccucugcugauugauuugguggaauguugugucugugguucagugugcagggauaagguugggaagguuguugaguagaggagucacaugguuuguucccucucauaugucuuuaagcugucgugagguuuuggccuguauucccugagcucaugaacaugguguuaaggcucagccucugcugucuucuguacccugcccaugcucuuucccugcccuacaguuacccucuggaaagaguuuccuggagucucccuguuucugccuuuucaccucacugucuaccucugaccugcccuccaucauucccgcuggagcuguucuccgugaggagacagugccuggcucacugcucauuuuggcugggacuuuucagguuuauugcauccagugaauucuuaacucggggugauuuuacccccuaggggauaccuggcagugccuggagacauugaguggggcuggccucuacgggauggacagugagguugcugcuagcugcuagacaucuuacaggauggcucccacaacagagauccagcccaaaugucuguagugcagagguggagaagcaccgauguuaccuggugcucugggacauuuugcaguucuccauucuuuuuuuuuuuuuuuuuuuuuaaagggagucucacugugccacucaggcuggugugcaguggcacaaucucuacucacuacaaccuucgucuuccaauucaagugauacucccaccucagccucccgaguagcugggauuacaggugugcgccacuacacccagcuaauuuuuguauuuuuaguagagaugggguuucaucauguuggccaggcuaguaucgaacuccugaccucaggugauccacccgccacggccuucgaaagugcugggauuacaggcgugagccacugcgcuguccccugacugccuggacauaauucucuccugacuuguuuuucaguaaauucugaguucauuucuuaccaaucucugcaggggaaucuucuccuccagccuugguuccaguccuugcaucccaggauucuuuuccuggccucuggucucugcccacuccucccguuuuucuugggcaucucauuaguccuagggauuugaccuucaucugugggugagugacuccacaucuguauucacagcucuagcucucuugagcuccagucaaauucaugucuccuccaccucagugguacacaggcacuucuaaaucaguggguccuaaauagggcagcccuaagucuuuuuccaucuucccuguccugcuguucccacauugcuguccgucagcauggacucucacacacacacacacacaaacacacacacacacucucucucucucucucucugagcaucuucucacacugcuccugaagcacaggcacuccuuauuucucaacccacagcacccucccucuggccuccuuacuuccagucccgugccccacgcugccaccaggggagcuuucuagagcagaacucugagccugggagucugccuuuagcuucugucaucuauacacauaaucuaaacugcuucaugaccaagcccagugguucccaauugggagaguaguauuucccuccaaaggggcccuuugaaaguguuaugaacauuggggguaucaugauggggaagguggggugggugggcuacagauacugagugcucaggccuagugauguuugcuuccuguagugugcuggacugggcuguccagugcauuacaggaagagaauuguccagaugccaguagugcccucauuaagaauuggcgauguaguuuuuagcuucugccuagaggaugaggagagaaaugcugagcacugguccuggagaguacuuauuuuggggauugggaggcaaaagaacugcaugguauaaaauccuacggaaaugcaagcaagaauguaagggagugaugaauuguauugaaaauuguagaaaugccaagacacaaguggggaaggcuguuaguugugugacucccugaagcacccuugucaucccagccuguaagccacacuaaccucccccccaccgccccccaccgcucauacaaccggcagccacucuuuugggccuguggcaacagguuuccuuccuugguccugcacuaugagacucucagucucccaguuuggccccacauuuggucaguuuugccaucucuacauuagccccuuccaccucuggccaccuuauuacacagcuucuuuuguaaauaaaaauaucccaagcugugucacagucagcuaacgacaagaacagcagcaacaacauuaaugauccuuuaugugccagguacugugcuaaacucuuuauaagcauuucuuauuuaaucuucaaaaaaucucuauaagguagcuacuacaauuaugcccauuuaugguugaggaaauggaagauuaaacagaugaaauaaccaguucacuuuuacacggcuaguaucccauggaaccaggacuuauacauacauguccuuuuauuucucauuuuaaaaaaacagauuuuauuuuuuagagcagauuuaaguucacagaaaaacuggagguauagaguguucccauauaccuccugcccuccuccagccucccccacugugaauacagaaugguacauauguuacaauugaugaaccuacauuuacacaucauugucauuuaauuucauaguugacauuaggguucccuuuugguauuguacauccuguggauuuugacaaauguauaaugacguguaucugccauuauaguaucacgggaauagauucacuucccuaaaaauccucugugcuucaccugcucaucccccacccccuguggcaaccacuuuuuuuuuuuuuuuuuacugacucuaucaugucuuuuugacauuuuagaaauaaauucuaagcucagauguucaguuaucauugaauagcuguaaggaaucaguggaguucccauauccaugaaucauguuuauuucuuaagaauuggguuagcggauucuacuuucugucaccauguuuucuguccuuucugggaaccggcuuggcuguuugcacagugugggacaugugugggacauguacuuaagauagaguacaacuauguuguucccacuuccuguccugguagcuuuggaagaauucugguuuuuuccuucacagccuggcuuuguaauuuuguguagaccaacaauuaguuugauucaauaucccugccauugggugucagaccaccuuagacgagaaaucgguaugagaccgucuauguuccagcggcuuucugguauucaggacaaccuaaagcucaggaugaagggcguugaagguccuuuuuagagauuccaccagacugguugguuaaguagcuucaucauauuauucccugguucacuggagugauucaucuuuaaaggaacccuggaacugccuuucauuauauucaugucuuagaaaaaccuuauaccauacuguugcaaguacagguugaguaccccuaauccaaaaaucugaaaucuguucucucuuuauuccucccccagaagccccaugugccacuccccugaucugcagcuucgguaggccgguggaccuggagaaggacgacuaccagaagguggugugcaacaacgagcacugccccugcagcaccuggaugcaccugcagugcuucuacgagugggagagcagcauccucguccaguucaacugcaucggccgcgcgcgcagcuggaacgagaagcaaugccgccagaacauguggacaaagaagggcuacgaccuggccuuccgcuucugcucuugccgcuguggccagggccacuugaagaaggacacagacugguaucaggugaagcggaugcaggacgagaaaaagaagaagucuggcuccgagaagaacacagggaggccuccuggugaggcggcggaggaggcaaaaaagugcaggcccccaaauaagccccagaaaggcccaagccacgaccucccccgccggcauuccauggaccggcagaacucccaggagaaggcagugggugccgcagccuacggugcccguucccccgguggcuccccgggccaguccccacccacgggcuacuccauccucucuccugcccacuucagcggcccccgcuccuccagauaccucggggaguucuuaaagaacgccauccaucuggagccucacaagaaggccauggcugggggccauguguucagaaaugcccacuuugauuacagcccugcgggguuggcaguucacagggggggacacuucgacacccccgugcaguuccuucggcggcuggaccucuccgaacuccucacucacauccccaggcauaagcugaacacuuuccacgugcgcauggaagacgaugcccaagugggccagggggaagacuugcggaaguucauucuggccgcgcucagugccagccacagaaacgugguaaacugugcccugugccaccgggcgcucccgguguucgaacaguucccacugguggauggaacuuuguuccuaagcccgucgagacaugaugagaucgaauaugauguuccuugucaccuucaagguauagguguuaauucaccuugccugcuuucuguuuguuaaaaaccaaacaacaaacaagacagauugcucuauuuugguguaguuuucaccaguguuguuuuuuuguucuagucaggugcuagguaacauuugaauauuucagcuucgcccagugacgcggugauuuuuuacucugaugucacaguaccaaguacaguuguccuagcggauaauuuuguguguucuguaauuugaagaaaggauugccgguguaugguuuugcauaauggggaaggaaauuaguggaguuguugcauauuugucacuuacuguaaaccuguuuaaugggcccaucuagcuguguauccucuuagauccuuauaaacauaacagugaggaaaagcaguggucagaaaagggccaagguauuuuuagauuaguugaauuaauuuugaaguuuaugaaagaugagaguguguugauagcagcaaaagguaaacaggauuauugaaagcucagacauuagcccggugguggugguggaaggaggggcgauggggaagcuuauuauuccuguggauggcauauaaggauuugguacauuucagccauaaauugaaugacacgagguugguuaguauaagaaaucugucaguucauguacaacuacugaacuuccauaaagaugagacacaucacauauaacauguuuacacuuuaaaugugugcuaaaaagcuuguugugaaaaugauauauccccaccugucuccuucccaccaacccugcugugucaguacccagacaaacauuuucaaaucuuagcugaugcuucaaguuuuugacaucgugauuguaaauacugcugucuucauucuccagcuuuacauauuaucuguuuauugacuggcuuugaagguggaugacugugcaucccccuccuccuuccucucaggauaagauaccacaauuauuaguuaaauccuuaauguuuacuaaugugaauauauauauuuaauauugagccaagaaguauaggguuuuaucuuauuauauaguaccauauagucuaggacuccuuuuguuuuuauuaggguuaauugauuauuuugauuugcauaguuuuuuuuuuuuuuuuuaacuuuggcuaguucucacucuccagcagcuuuacaaaccaucuuucaaagacauuuccacauaccugucagauuuuuuuuggaaaaaaaauuuuugccccugaaaaugccccucguggagacucuuacccuccugcuucuaccuguccuggugcacucaggaccugguguaccacauagcuguccuucuaggaaugccuucauuucuguccuauuuuuaaaaaucuuguuuccuagaucucaauauuuuauuuuuuucucgguuuauucucucagcuuuuaggaaacaucccccaggagcuuuuugagaaagggagcaugggaauagaugauuugagacuuucaacgucugagaauauccugauuuaaucuucacucuucuuugcuauuuagcuggcuguagucuucuaaguuauacauauuuuccccuuggaauuuugaagacauuucuuuacugucucccaucuuacaaugucacuauuuugagaggucugauguuacucuuauuccugucuuugccuccaucuccaccccuccaugaagguuuuaagauuuucuucauauaucccuaauguucugaaauuucaccauaugugggucuuuuacacaguuuccucuauuugucgugcuuucuguacucucuuggcccuuuggcucuauaaacuuaccaucuuccauuuggagaaauuuguuuuuguauuauuucuuugacaauuuccgcuacccuauuuucacuuuuaaaaaauucugugaaacucucauuaaucagauauuagaccccuuagauuauuuuuuuuguuggaguggagaacuccuuuauuuuauauauaauaaaggauauauaauaaauauauacauggcccuauucaucucuuuauucugcuuuauggaaaauuuccuugacuuuuuauuuugguguuuuuacggaguuacaaauuuucuguucuuacauuuuuaauuuccaggagcucuuuuuaauagcauucucuucuuguuucauguauguaauuucuugugcuaccuuugugagcaaggaaagggagcugaaauugcagagaguagucucuuucauuuugagaauuguaccuaacucccuuuaucuuguagcauuuguuauaaagcagagcauuccaaaacuuagugguuuaaaaggauaauuuaaugacuucucacaauucuguggguggauuguuagguuggcuuagggggccucagccggaauggcuugucuguguuccauguagucuuucaucuuccaguaggcuagcuuggacuuuuucacauguugcucucaggauggcauucaagagauguaaguggaagcugcagagucugucucuagaggcuuaagcuuggaacugaguaacaucacuccugucacauuuuguucaucaguauaaguccuaagucuagcccagguucagaugaugcugaaauacucugcuuuuugauggaaagugcugcauagaauuuaugguuguuuguaacuuauugcucccugcgagcucccuacaaacuccccggugcuuguccaguuucugagcuuaaccauuuacuaucccucagucuacuuucugacuucauauaguuuaauucaggguugaaauaaccucauuguuucauggaagauggaguuuguguuuuuguuuuuuuauccuguuuggggguaauuuuagagggaaguggauggaaacaccuuuauuucuccauuguaaaacuugaaacauuuuuuaugaagaugaauauggguacagcagauaugagaauaguaguguucuuuuucuauccaugauggacagauuauugucauguaauccauucaucaguucaucaaacuuacggauaucacacaugcuggguacuaucaguucuugcuugucaucaauuuauaaucuuaggauaagaugcuuuuauaaaauguaacuaacuuaccaggcuuaaaguucuaguaucauaccuggauaugauguacauuaaguauccuauaauuuccagaggaagggaccacuuuggcuugguucguaaaaagaggcagcaugaaugcugaugucaaaagguggacuggaucuugguaagcagagggucuacccaggucagguguuuguugaugaggagggagugccugcaagcaaaggaagggugguuaaaaagaagaagggcagguugcgaugaggagcuagggagagaacuguuugguuggagccaaggguguucuagagugggaaaggaguaggauagggagagaagggagagaacagauugcagaaguacuuucaagccauaauaaagaacuuugcuauauauucuuuaugaaugugaauggaaagauuuucaguguuuuuuuaaagcaggcagucacauggaggaaaggugcgggaaagggguuugaaaggggugggaucuagagacagaguugaggcuuuguagucuagauguaaggagauaaaagguguggacagaauggaagggaggggauauugucaagagguuauuuuaaagaaaaauuacagcuugugaauuuagaaacaaaauucacuuuguuucuagaccagauaaauggugcaagaguagagaaaggagauggguagauaaagguggggaaagggccugguuuugcgggcagaagaugagguuucuguguguuggguuugaagggauguugggacuuuuguguggagaugucuagcaaacaugguuaaaaauaagcauuuggguugaacacugggaguuuauaacaguggugguuaaaauccuaaggguggaagagcucuuggauaggaagaaaagagaaaaaaaaggaaggaggauaugauaaacccacaaccaaaucuugagaguaccuuucagggagcagaugaagaaagaggugaaaauuaggccugaguacuugugugugcguauauauacacaucaaaacauagacauacauaaauagauaaugcgcacauuagaugugcccacaaagauacugagaaguugaacguuugauguaaaaccugaagaucaggguguuuaauuauuaccagagaaguuaucauugccacaagugaggccuugaccacauaucagcauuuuuauugccacaucuuugagaaauccaugccgucuuauuuguaguaagaaaauguaaaucaugucuucaaucaccaauuacugaccacacauucuucuauuuuucuuuucuuuuuucuuucuuuuuuuuugaguaucucagucugucacccuggcuggcuggaaagcagcggagugaucauagcuacugcagccuuggacugcugagcucaagcaguccuccugccccagcuucuccaguagcuaggacuguaggcucaagccaccacacucggcuuauuuaauuuguuuaaacuuguuguuguuguuguuuguuguuguguuuuuuuuuuuugugacgggguuucacuuuuguugcccaggcuggagugcaauggugcuaucucggcucacugcagccuuugcuucuggguucaagcgauucuccugccucagccucaugaguagcugggacuacaggcgccgccaccacgccuagcuaauuuuuuuauauuuuaguagagaugggguuucaccauguuggccaggcuggucucaaacuccuaaccucuggugaucuacccgccuuggccucccaaagugcugggauuauaggcgugagccacugcgcccagcccuaaacuuuuuuaagagauggggucucacuguauuauugcccaggcuggucuugaacuccuggccucaaaugaucaucccauuucagccucccaaaaugcugagacuacaggcaugagccacugugccuagccugaucauguguuuuuuaaagcauuuucaacuccaauagaagggccacacugcaggccacaggauugcacagcaugcggggcugacaugcugcugcaguacuugcuguguucaguggcccuuucuggauuacuacucccucgcccugcccuuuaccacucacugcccuccccggacccugucucuggacuucguuugcucucuuucccucugaaaauagguuuuguuuagcauuaauuuauuaagauugaucuaauuaagaaguucuuauugggcuucuuuaccacuuugaaccacaugugauuguucucugaagaaucggcuuuuuguuuaaauucacaaaggguuuagaaauucaaaauucucuguggucaggacaauguguagcagaacugaaacaaaucuagacucaguccagaccagguguuccagugaguuugccuguagguuacggauccgagagacaugaaucagucuggacuugcuacuuaaaucuuaagaacuugggcaagcugcucagcucuguaagccucacuuccuacucucagaagugggagcaacaguaaugucuauucuguaaugcugcuguuaggguuaaaugaaaugauucacacggagcugguagcauagugccauacccucgguuaacucuuaguaaaaguuacucugucuucaucauuauggucaucguuagcaacaccugacuucugugucuaaggcugcccuuacccuucucagcuguggccucuguaccugggaauguuugggaauugcauugaguaugcaggacagagagugcaaaugaaauuuuuuccaguggcuccuggauccuugaacggacuuccuaacaugccccgaggccagaguagauguggcaugugagacccuuuuauuuucaaugccguagagcagagguggggaguauuucaagaaguucuugucauccuucccccuuuuggcauaaaggcccccaagguuaucugucuuuggcuguuaacaugccccauccauuuacccaacauacacuuauaaagugcuuuccacaucccagacacugugcuagucacugagucuacaaggaugacuaagacaugguucuugcccucaaggaggaagggggucaugcaaguaaaugcaaacgaagggcucccccuaaguacuguagauggaacauacauaccuuuccaucggguaaggagcagguugauccuuacuacugagugcugaagacccauagucugacugauggcagugagcagcacauucugaauaugaggccacuuaggauuauguguucuccugaugguaguuuuuaacauggggaagcacccuggguuccacacagagcagaaauguugcuguuauacguugccugggcagauucugggcauucugacucuuuccuaauuauuuaaacugugaugcuuccauauacacuaggaugacaucuuuccuuuauuaacauuaagauguuaucaaauaauggagggggaucauguuguaacuuuuaagagcucggugaauaauaagacauugaacuucuuuuaaaaaauuacgaguaagauauaauucugguuccuaaauuagauguggugauggcugagcauuuugaggacaaggauaguuaacaguaauuuugguugugguguaauucugggcuaucaguccccaagacagacuuuugauuuuuaugaugggacuugucacaagagagcuugugacaagaucagugguguugguuaagucucuauaugcuaaacauaaacuuuugagcaggaaguccugcgugaauacaguacaggcugguuuugaguguauguggcuuuguuacuugaauuuggauggacccauuauguaagcccagcagcccuuuuuggaaaagugaauugaagccaaguuuuuaauaugcuugaacuuaaaauacaugcuuuauugacaacagcuaguaauucaucauuauccugaaaggacagcuuguguacuaaauauugauuuuucuuuuuauauuuauccaaaugauaaaaucuuugcuuauaauugguagaugaaacauuuuuaucuccuuggagaugaaaugugauuuccaugauggccacucagagccuugugucuucugugcacagggagacucaugcaucuguaugccgugugcguggacugccuggaagggguucacaagaucaucugcaucaaguguaagucacggugggauggcagcuggcaccagcugggcacuauguacaccuacgacauccuggcugccucuccauguugucagguagguacugaacacacugagggagcagugggugauauuaggcuucuguccccaagugaauguagggaagaugcgucuggcaauaaagaagaaauucaguccagcaaugauggcugaguuacuacuuguaauguagucauuuaguggaauacuauucagucauuaaaaggaauacuguagaauaauauauaauuaugugggaagcauuuccaguauauuaggucaaaagaacagguuauaaaaugguauaauaauaugcuugcauuuguaaguaagugagcaugaaaagggaauugcuaaccuguuaccagauggucucaguggugggaggcugaaugguuccuuuaguuuucuuuuuccuugaguauauuuucuaagauucuguaugauuagcuuauaguaaauuucuaauagaaaaaauguuauucaaaaggaagaaagucacuuucuuaaauaggauuuucuuguuuucuuucugugggauaguacaguuauccaggaauugcaugccuuguaagguguuugagguuguaauccuuaaagcacuacuaaaaggaggcauugucucaugcuaugaggacaucugaaauuuagcugucaucagaaaaagagggaaguauucacauaugaaaacacaaauaaccuauagaaucacaggagacaaaaugcuuggaaauaucuugcuuuauuuccaagugcuuggggaagaaaacagcuuguuagguaauuccuugauacucucaugggcaggagagaaauuuuucuuugcucuaaaguguuccagccugguuuuuuaguacaaauagcugauacauacuucauuaguuacugcauaguuuuaugucuuuagcauuauggcuugauuuuuguaaagagaguaucuuuacuauuaucaguaguuauucacuguggcauuuuaugauaguuauugugccuugaugccagcucuugagagaaaccagaggaaguggcuccccucugcacacacacaccguggaggauuaucuuuuaaauugaagaaauaaggaagugaaagaacuuuugagccuguuaacucagaagauuagcacuggaaaggaccugggaucuagaccgaccuccuuauuuccucauacaauggaggccuacaaacuugggauguuuuacccaggucuacauacauugugucacagccaugacugcaccgugugacuccuguucugguguucuuucugguacaccauugaaaggcaaugagauuauuuccaugucuuuaggaggaaaaacagaacagcauccugccacacccagccucuugguauucaccaugcacuguauuucuuccuuaaaacaauugaagcccagaccuuucuuuucuggcccccuacugaaauggaaaauauguucgauuauuguuaauuuaaaaaaaucagugaggauacaaguguuagacgcuacuaaugaaucaagggaagucuucaauaagauguagccaaaaauaagcaauaauugauucuuagaaagguauaacagugugaagacggguuugcucagaaucacacuuuuaauguuguucagagagauuacguaguuaaaagaguguuuaucucagguuacagaaaaguaguuccugcaguggcugaggaucagcaggcugcuuugguucacuccagccuugcugcuuucuaaccauggucuuuggcauggugcuuuaucacaugugccucaguugcauuaucuaaaagucagcuaauacuaccuaccucccaggaguauuuugagaacaaguugagauuauacuuuuuaaguacauuuuuaaaaugagucuaaauugagucuguuuuauuuauaauuugugguuauucacuuaaguccuggacccauugcugaaagguuccaggacugugcuguuacggagaggcuaggcaugagugaagaugcagggugcugggaacuccagaagccucagaccagcaccgcacuuccuggauugcuaauuuuacuugaguaucuugggaaauuuuauuuuuacaucaaagaaaacgcaacuuuucuauagaguagaaugaaaaaugaaauuucaaagaaguuucguggagguuugggugagggaagucagcuucagccgcugucuuaaaauccagggggagggguuucuuauuguuagggaacuucaguggagagcauuuaggcaguaguaguuuagaauuuucuucucauaaguaggugaaacagcuagcagugcugcauaucaggagagaaguugggagucuuucagguauaccccguuuccauguuuuugguaguaaaagggaugcuuugcaaagcccuugaucaguuucccagcauuuugguuuggaugacuuugacaaguguugggaaguggagggguguuguggcugauggugucuguuucccccaggcccgccugaacuguaagcacugugggaagccggugaucgacgugaggaucgggaugcaguacuucuccgaauauagcaacguccagcaguguccacacugugggaaccuggacuaccacuucgugaagccauuuuccuccuucaaaguucucgaagcuuauugaugaaagcuuugcuuuaguaauagcuauuuuauugauauuauuacuuuauuacauaucuuuuauagggaaacauucugugacauuaauuuccuuucuaauuuaaaggagaguuacuuuguuguaugugugccacuaaaauaggggcugcccuugcccugucuugauucccgaguguuaaucugugguuuugaccagagcccagauggguaauccugugcauuuggguugggguucacucuuaccaagaaucuuugaugcagcuuuaagaugguggggaggauggggugaauuuaggaaaggaauuugugguuauaaacuaagagcuugauaggaguuggaaggaaacucuuacuaaaauguuaacuuucuaaaaaccuucuuuuagaucuuccuugggccuuuggaaaaauaugugacaagugaauguaagucugugccuggagagcuaauagugcauuagucuaucucagccuaguguucugcagcacacaugggcaggcaguuuacucacacugacaggugaccugaaaguggcacaagugcuguuucuaucacuauuguaauuugccaguucauuuuucaugcugaaaguaauauccaaauuguaagacauaugaaagauauuaguguugcaaauauguuuagguaaacugaccuauaacagaauaugugaaaugaauuuggaaauaaugcaagaaggcagaacucaaucauuuaaauugugucuuugaaguugguaauauagcuuuuaaggagaacccaugaauaaccugauuugggcagugaugauuuauuacagguugcacuguugaagugucauuuggugucagguucuucucacagguaaaucuuucagccacagaaucuaacuggugagcuucagaaccaauaauugccacauuuauuguccucaaaauugcuuauggccauguauaaccaauuaauucugaguuuccaaaaucaaagauuugaccuuaagagggaagggaaaaaagugugaaaggaugaugaagaaaauaauuuuacuauuucuuuuaaaaguauguuuuggaaaaucaaugauuuuaaugcauagcaguauguuugaaaaauagaccauucuaaaaagcccaugauaccuuacuguugaugaaaaaggaugaucauauauauagaacuugauuagucagagcauugggcauuccaaaauacagccuuugguucaguagauuuuaaugcuuuaaauagacugacgucgcauacccuuauagaauuggaauaugauuucucaaaaauuaauuugauaauuucauguaugaugugcauauaugcuaaaagaaugcagaaaaucauuuuaugaauagccaaauuugggguugaugugaacauuuuauguuacucauuugguuuauacuuuuuuuuuuuuuuuuuuaacugugugguuuuucuuuucagaaguauuuaggcaauauugcacgugaguuucaguucuuuuuuucuuuuuuuugagauggagucucacucuugucacccaggcuggagugcaguagugcgaucucagcucacugcaaccucugccuccuggauucaagcgauucuccugucccagccucccagguagcugggacuauaggcacgugccaccacacccggcuaauuuuuuguauuuuuaguagagacagcguuucaccauguuagcuaggauggucuagaucuccugaccuugugaucugccugccucggccucccaaagugcugggauuacaggcgugagucacugugccuggccaaguuucaguucuauaugaaguauuugauguuuuguuugaaacaauacagcauuaaagaaccaauguuauucacuaauaucauucaucuuucaguuuggaugauuugguuugcugcaucuagguugguguuugaucaucugaaaaaacauuucagugggaagaaaugcauaaaaugccuauaagaaguagaaagucauugaacugacaguguuugaugcaacuaaaagaggauuguaagacauagcuuucugcaaacuugucuuuaaugcacaaagcuguaguggugaauuaacuaucuccuuauugauucucuccuguacccagaugcaaaaagugcuaaguuucucuuguccucguaauaccauuuggauuuuauuucugaauuuaaauaguaaaauauuuaugaugcugaucuuuaacccaccuaaaauuuuauagugaaaccugcuuuauauuguuguucugaagcuuacaauugaccuauacauugcauucagcaagcuccugaauuuagaacugccgucaguguaguguaugcuguguuccauguugccuuuuuagauggcuuucuacccccugaacaauaaauaggaugagguuuuacuguaauuggguaaaguuuacucuuggacauuauuucgaugcuaaaguaaggauucuguggauguuacuuaaagagaaaagcauaagagcaugaagcauaucugggaauaucuuuugccuuuaagacgauucauucuugucuagagggaaaaucuggcugauuugggaauaaaauauaaucgaauauucaacaccaugaagauaaaucuuauuuuggaaaucuacugaccuuaauaccccaagcuugcccugaauacuuugauuggaauuggaauauaucaaaaaagguuaguauuuuuguuguaguuaggauacuaaaaggauauuaguuacccaagagauccaauuuguuuuucugaugaauaguguucaguaaaaugaagcagucuuaagagugacuaauaauuucaaagugauuuuucgucuauucuuaauauuuuuuaauuauuuauuuuuaagaguuuuauaccuugagcagauacaaugaucugcuuuagugagaggacaauuucugauugauuguuuucucuucaggccaucucaccucuucauucucuuguuacauuugaagcaguugauauaauggguuuauacuuuaaaagauagacauggugccaugaaguuggggaguugggugaauuaucccauucuaguuacagaggagcuuuccuuaaaugcccuuuaacuucuagguuuuguucaagaaguucauuuucugaguaaaagguauuuucauauauguugggggaaaauuaacucaucuaaaaagaaucuuauuagguauuugaacucuaaaacuaacagauaagacagauauguaccuuauuagagcaccagaacuaauuugcuaagucuuuuguuuaguccugcaagacugaugcuuaauacacagucuguucuccugugucuaggucaggaacuccaguuugcuuuucuguuuuguguccugguagcagcuguugaguaacuuucauuggagguugggaaggaagugaggagaaaguguucuuguuuaguguuuuauuuccuauaauaggaugcugccuaacccaguucaucucuauguccuguucacugaauauuccggguaauugaaagaaaauauaauggaugggcuccauuaaaaccagcucaaaaauaaauucuugucaguaaagauuucuugucaagaugucuuggauugcacuuuuguugaggaaagacaguguaaauaguuaaagaauguugauaaaauugaaacauuugguuguggaauugugugugguuuuagaggguuucuguuugugaaauguauguauuaaaaauaauaaaauuccagaaacuaacauugua

SEQ ID NO: 192125 - RNA, 21947 nt, Homo sapiens
acagaccccggugacggaagugacguaaggccggggcuggagggcagugcugggcuggucccgcaggcgcucgggguuggagccagcgaccgucgguagcagcauggcucuccucuuucuccuaccccuugucaugcagggugugagcagggcugagaugggcaccgcggaucuggggccguccucagguaccgucguucgcggcagggcugcggccgggucgggacgagagggagggagggauccgccccagccgggaagccccgccccgcuucuccgaggucgcccuagcccgggaccccugcgucgggcccugagcgggcgacggggacgcgagguggggucgcgagacuggggcuccgugguuugaacucgucgguugccuuucuccugccucuucccugguugccgccacaacaaaucacgccgcuuguuuuuccgacucuuguaauccacuuuuaaauacgauuaugcgcugcagaaggacguugcuggucaaugugggacagcguggucucaaagauuauaauaucgucuucuuacuguaccuuuuuuuaugguuagauacgcagauacucacuaguaugcuacgguugccugcaguguucagugcagugacaggcuguacagguucaugaccuaagagcaguaggcugugucaucuggguuugucuggguuucuacugcccgaagaaauugccuaaggggacauuucuccauuucucagaacggaucuccaucguuaagugacgcaugacugugaguguccugaucagcauguggcaucguggucucaguucguggcuuaaauacuucuuucuuagcggggguggggggggggacucaaagugcuuaggguaggaaaguaugcauuaugucgccagcugagaaguaaguggcagcugagaaguaaguggcaguccgucuuaggucucagucuggaagugguggauugccggcacucacuagcagauuuggcaguaggucucuucguacggguuuguucuucggagcauuuuauuuccaccugcuuauugacauuuccuagaaaacaaauguugaggguggcuuuucugaagugcagaguaauugugauuacgagcuccagagaaaacaguaaaccuuuucaauucaguuuucuuuuuuuuauuaugauuuaugauucauagggacuuugaaagguccacguuuugguucuguguucacaacaaucuucuggaguaggcguuauuugucucucucuuuauggacgagaaauugaguuacggagaggccugcccaacuggcagagaggucauagccacucaguggggagcugcucaauuuggcuccagaguccaaguucuuaacugcucuucuaggcucuagucagucauccacaugggcaguugcaguacuuugcgguaagagcuugcacuuaggcacagacuaguggaaagcaaggcggggugcuugucucuuuuagggaagucagugaagacuucacaaaggugaccccaguguuggaaccagaggugcagagacugaggugcagaggugugauagcauguugaauucguggaauauuaagcguucuauuguaaagugugugugagagcuuacaaggggaggagauagguuagguggagaaguaggaaccaaauaaugaauugccauauuauguguaccagcaagaaaccuagcuuuauuaacuuaagcaaaaagaggaauuuauugucucagaaaaaccagaguuaaacagaaaauuauagaugccagcugggucucaagaggcuagaaccaggaacccaaacugcuaggacucuccauuucuuauuucugucuggguauugacagcuuuccacacuuggcaggaaucauggaugcugacagcuucugaguuuugacaucuugcagccuccuccauucuaacaaaaugccagggaaaggcucugauuugcccagcuagguucaggugccagcuugcaugggaaggacauucucguagaggguuggguuggguuaccagaagaagcggaauggcgugccugaaguacagguguugagccaacaaaauaauacacccacuaugccuugcugaagucagucauuauuuacuaaugcugacaucauuggauuaucaauuacaaagggaaaugauuuuaugcaggaucagacaugccauuuagaaagaccagucaucuuauaaaauaguuugaggguaaacacaaggcccauuaggaggcugcugcuuaaguuggagucgauaaguaguuuaaguggagaagaggacaguuagcagaacauuuagaaggaagaguuaguaggccucugacuggaugucagcagagaaagaggauaacgcuagcgcaggcauagcguuaaagcaagugccaggcccuuccuucugaauacggggcccuaugagugcaccgugugaccccugugagugcacaauuugcacguccuuguagcuugcucugggaggaggauugccugucugccucccgugggaagaucaacugcagccuucuauauucugcagaaacuuuugaauuugucucuguaccucucguucuaaaacuggggucacuuuugugaagccuuuccugacuccccuagaagagacaagcaccccggccuugcuuuucauuaguuucagugagcccucuuuuuaaagugcauuucuaacacauuucucuagauuuuucagugcauuucucuagauuuuguuguguucccuguucuuuuaaaguuaauuuaaaacacaaaaucuccaaaguaggaagaaaccaacaaugcucuggcucuugcuuagcuucccagccuuauucuuacuguugcugggcuugacucuauaguugaaguucaucuuagaugagaggaccugguaagaacagggaagcagacaagugaauauggugauauagucagucuccaggaaauccagguguuuaggaauguauuguguuacauucaugggcuuucauuaauacuucuuaagugaaaauaaaaucugugugugccacuuaaucaguaguauuucacucuucaugcacuuuuacacauaaaaguaguauauauuuuuaagugaaucagggugugccacuggcuuucuucauccagaugagugucccacucugaguaauagcugaagagcuaggcuggacuucacaccaacuggaaggcucuucacugaccuuguacaguuuaucagcuaugcuuccuacuaauuaucugacuuuaggauaaagcucugaguacuguuuaaauuuuucacuauuucuuuggauucuauaguuauuucagagauucaaaauacacaggauaauacuuuuuaauuauauuuauugaauaggguauuaaauuuucuuuuucauuuuauucugauucauaauucacacagacuuugaaaggaccauauuuugguucuaucuaaaagaaaaccuaggcugggggcaguggcucaugccuguaaucccagcacaucggcggaaggaucacuggagcccagaaguucaagaccagccugggcaacauggcaaaacccaucucuacaaaaaaauacaaaaauuaacccugugugguggcaugugccuguaguccuagcuacuggggaggcugagguaggaggaucacuugagcccaggaggucuaggcugcagugagccaugauuguaccacugcacuccagcuugggcaacagagcaagacucugucucucguguuuguguguguguuuguguguguguguguguuuguguaugaaaaccuaaagaaaaguaauaaacagcuaucuuacaaaauuuggcagcauaccaguagugaaguugcuuuacaaaccagaugaguaauuaaugguucaauuuugauugaacaaagaaucagaaugagguuugaaccagaaugaagugaauuccuaacagaaaggaauuuacuuguaauuuucuuauuaaaggggugccuuuauuuuagauuauccuaaugcauaguaaucagaauacuagguaucuguuuaggucuuguguauuuuuaagaaauuauucauuuuaaugcauuguucaacuuuugcaguggccauaauauaauugugauaauguaauaaaaucaggaaacauuaccugaagcagaugcuuuugaagucaccagaaaauagucuucuccaauuccaauuuaaauauggagguaauuuaccccuuauuuuauuaaacgaucacaaagauguuggaagcauuuuucuuaaugaaaaccaacaaaacuuugcauauugucaaguuacguaacuucucuaagccuuuguuuucucauugguaaaauauguaugguaacauugucucccucacgggauggaugugaugaguaucugagguaaugcauuaaaaagguaagcacacugugugucuuguaguaaauacuuaauauguuagggauuauucaauaaugugcauuauuauuuuaacaaauauaucuuuaaauauuaaauucccuuagucauaugugagaaauuguguuggcuuuuaaaaaaacaaacuuaaccagaucaguaugagaaacuuaaaacaggcucagcagcuaacucauucuuccaucucuuccaacagacaaaaaaguuugguuuuuuaguagacuggaaaggccugcauuguuuuuucauuuccucaacuguuuuucaauucagaaugaguuaguccaaaagagaauuaguguugagaaaugacuucucucagggacuagauuggucugguccagucagaacuaaugccagaccaaacccaacuagaugaaauuggauaaauaggaguaagaauaaagcccuggauuucaagucagaaaaguggcugagcagauauuuauuggauaagccccaacuuggugguggugcgagggaaaaauauaggggagguuaguuacuuacaaguucacugcaggccacuauguguuaugccuggcucuuuaaaaagaaaaauuucaauuagaagauuucaaugaacacuugaaacaucaccugcaagaauuaucaaaaugucuguacucagcuuaaaccugggggaugcggcuccuugcuacggugaaaguuggaaagcauuaagaaaaauagucauuuuaucaccacuggaagccauucgggagggagauuguaaucaaauauguucugacaaaaauacaaaggccuugauuugguacuuuucauuuauucaguguggauuucuuaugcugguucuguuugcugugcagaugaaaccuuugugacaguccccauuccugucccuguaucuuuaacauggggaagguguuagaucuucucugagaguuguucuuaaggaaaagauccagaugcuuuaauuugaaacauuuguuuuugaguuguagugucagaugacuuagaauccagaacaacaguuuacuucauccucacuuccuuaugcuucucagcgugcucuucccaugaagagguuggugagcagguugucagaugauuucugcagaguccauagcccuguuccaccauagauguacaaaccuuuuauacagucuuuuuacacuaguguguuaagaugggugaugaacuccucgggcuguccuuuuuuaaagagacacagaugcuuuuggugguuacaggauggacucagguagcagcccugguuccugucacccagcuaugcagaggaaauggccagugucuucagacuauacucugcagguaucuguaguuugccauccacccuacauucaccaacauuuauugcagagcuaucacgacugcuauuuuuugguccuuugugacauuguuauggucccgucgauagcacugcucuguaucaccugcugaucuucacuggucuuuuguguugucucucuuuuuucauauccugucucuucuggcuuaucagcuuucugaggaaacaguuggcuuuaaccagggcccuccuuuuuuuuucugcauuguaauuaaaguguuaggaaaaacaaauucuucucuccuguguuuaguuuucuuaaauuaucagcugugaguuguaggggaguucugggaauuagaucuuaaaauagcuaaaguuuacuccggauaguaugcagauguaauacacuaaauaauucugaguccauuuccaaaagcaacaugaguuacacaaaacuaucuuggcauuuucaagagaugggaaaaucuguaagauuaucuuauuucaugaaaucacucugguaagaucuuuucuuaagccccagagauaauaauacucuuuugcuguuucuacauauauuuuuauuuacauaguguaaauguauuagaaguuaauuguaagccuuaauuaauuuaaucugaauauauaacaauuuaaaccucacauuacaaaauucugaagcuuaagaaaacugcuuaugucugucauauuauuuuggcaaauaauauuuggcaaaaaauaauauuuggcaaaacaaaggcagaugucuaauaaccacacaguuucuccucugguagcauuaaaaaccacagauuacaucuuuugguguaaauuuauaaguuuuucuuuuaaccuaguaguaauuucuuuuugcuauaaaccauugaaauauuuuccuccuaccaccugucugucuugcuuugaaagcuaugauuuaaguccuuguccuagucuaaccauaucaggcuuuuacuuaaauuauaggaaacauacuuugauucacguuaaaaacuaaucuaaugcugcacaagccuacuccuguuuguaguuuuccauugugugauucaguagccccuuccuaaguacaaaugcacuuuguuugauauucuaguaugcagauugacuucuauaugccuuuuucucacaggaauuucagguugagcguauaccauuauaaagccauuccuacuggguauaauuaaaaagagagccuuaggcugggcccgguggcucacaccuguaaucucagcacuuugggaggcccaggugggcgauucaugagguugggaguuugagaccagccugaccaacauggugaaaccccaucucuacuaaaaauacaaaaauuagccaugucugguggugcaaaccuguaaucucagcuacucgggaggcugaggcaggagaaucguuugaacccaggaggcagagguugcagugagcagagaucaugccauugcacuccaaccugggcaacagagcaagacucugucucaaaaggaggggaguggagcuuaaaaggaagcaaaggauuuccagucuuggaaaccuagaggaagggggguccuugcuauguaguggcagaaagcugagugacacuguagccuucagugacaccaaaaguagagaaugucugaggagcugugugaucuagcucaggagguuucuaaccagagugcugaaagugccaccugguuucuucuugcgucuuauaguaacaggugagacuuugcucaaucaugggaagaacuguuaaaaagaaaccaggaccaccugguuugaaaauucucagccucucgagaggcaaaaaaaugccaaaaugaagaaauggucuccgaaggaaggcucagauuuaguaugaguuuucuuagcaucaaguaccucuguuuuccgguugaaaaaguauauuuauaugugugauuguuauuugauauuaauguugauugaacccaggugaagaggaaugacuuuuauuucuaccuaaaauauggauugugaaguauuugaguuguuucaggagguugagaugcaaacgugugauagaaaaaagacccucuuaaggaagccucaguauccccugcuaugaauggccaugggaacucuacaaaaaacaaagagccaaggcuacucuggcaagaacagugccuuagggaucaccuacaaggaaguugcuuagagaaccagagauggcagguaccaagagccuucagcugcgccucuggaagcagaaggagaaaaccuaggugucuggucacuggccacaaaaaggucaaguuaguaguaugaaguauuugaaucuucagacccuccccagcuugauaaucucaaccuuuuggcccaaauuauuacaccauuuugguaaauaauauagaaguuagaucuuuuggcaauaaccaaaucuauucauuuguuugaggggagccaugaaauauacagguuuacuguaaagcauucuguuuuuaaguuaguuuuuccucaacuuuuuuuuuaaagaacacuuaaauuguaaacauaaagcaggguuucucaaccuuggcacugcuggcauuuggggcuauauuauuuuuuguuguggaggcugucugaugcauuguaggauauuuagcagcacccuuggucucugcccucuagaugccagcaguaccucccccacacacuucuucuccagguugugagagccaaaaaugucuacagacauugauugccuaaugucuccuggcaacaaaaucacuucccacagagaaccacugcaauaaaggaaaaaauaaucagaaaaggaaaauaauaauggugauagcauuuaauuguccauuagugccuauuauuuaccuaaaaaacucuuaauccauguucugcuuugaaaauauauguguuaaauaauuguaaauuaaggcaauauaccaguuuggucuugaauauuggaauuuuuguuuggggaaaauauagauuuucccuucagcaguaagcaaauaucuuagggauaugaaaguaacaccucaugacagaucaggaaaucugaaguauuuagcaguguggccaagaaagaacccaaauuuauuaauguuugaccuagggaguauuuuucuuauuuaagcagucugcuugauauaaauauaaaucaucaucauuaucauccaaggcacuuuggaaaaauagaaacuucugucccucucacaauuuuugaggaugauuauaaguuauguuuggaagccacuguuccuauccacauggacauucauuuauuuguuuuaguuauauaaguaaaucauguuuaauagaguguuccagggaggugagauugaauaaccauaaauuuggggucacaucgcuaacuguguacauucauguuuaucuguaaagaagugaagggagaaaggagaaguguguguguucaguuuuccaagggguguuggauaacaaccuuuuacaccaaacaguggggaaaaaugacuccuuuuuuuuuuuuucuaagagaacugaaugcaguggcacagucacagcucacugcagccuugaccuccugggcucaagcaaucuuccucagccucccgaguagcugaaacuacaggcacaggccucuucaccuggcuaauuuuuuaauuauuugcggagacagggucuccaacuccugagcucaacagauccucccaccucagccucccaaaaugcugggauuacaggugugggccaccgcaccuggcccaugacuacuuuuaauaacuagauuuugguagugucugauuagauguuaaaaugacuucugucuguucucuuacgugacucaagucuuaucaacagauguuuucugaaagagugaaggcaagaagaaauguuggguauguuuuguaaaaagcccugcacaccccagagagcagaguguugaugaaacuggaauguguggcuccauuguucaaucuuuagguaucuauuccuguacuauagaaaaaguguggaaggcauaaauaguaguauguguagaguugagagguugaugguauuuuagagugaaauuggccauccucauuguagccaguuccucuguagacauuuguauuagucuguuuucgugcugcugauaaagacauacccaaggcugggaagaaaaagauguuugauuggacuuacaguuccacauggcuggggaggccucagaaucacagcaagggcgaaaggcacuucuuacaugguggcggcaagagaaaaaugaggaagaagcaaaagcagaaaccccugauaaacccaucagaucucgugagacuuacucacuaucacgagacuagcaugggaaagaccagcccccgugauucaauuacuucccccaggucccucucauaacacgugggaauuccaagagauacaauucaaguugagauuucgguggggacacacaaccaaaccauauuaugcuaccccuggccccuccaaaucucauguccuuacauuucaaaaccaaucaugccuuccaaacagucucccaaagucuuaacucauuucagcauuaacccaaaaguccacauuccaaagucccaucugagacaaggcaaguccuuucugccugugagccuguaaaaucaaaagcaagcuaguuacuuccuagauacaguguggguacagguauuggguaaauacagccauuccaaaugggagaaauuggccaaaacaaaggaguuauagagcccaugcaaguccauaauccaguggggcagucaaaucuuaaagcuccgaaaugaucuccuuugacuccaggucucacauccaggucaugcggauguaagagguggcuucccauggucuugagcagcucugccccuguggcuuugcaggguacaggcucccucucagcugcuuucacaggcugccaucaaaugucugcagcuuuuccagaaguugucagcagaucuaccauucuggagucuggaggaugguggcccucuucucacagcucuaccaggcagugccccaguagggacuugugugagggcuccgaccucacauuuuccuuccacacuggccuagcagagguucuccaugagggcccugccccugcagcaaacuuuugccugggcauccaggcauuuccauacaucuucugaaaucuaagcagagguucccaaaucucaauucuugacuucugcacacccauaggcucaacaccauguggaagcugccaaggcuugugacuuccacccuccgaagccacagccugagcuauauguuggccucuuucagucacagcuggagcagcugggacgcaaggcaccaagucccuaggcugcacacagcacggggacccugggccuggccacaaaaccacuuuuuccuccuaggccuccgggccugugaugggaagcgcuggcgugaaugucucugacauggccuggagacauuuucucgauggccuuggggauuaacauuaggcuucuugcuacuuaugcacauuucugcagccagcuugaauuucuccccagaaaauggguuuuucuuuucugucucauagucaggcugcaaauuuuccaaacuuuuaugcucugcuucccuuauaaaacugaaugccuuuaacagcacgcaagucacuucuugaaugcuaugccacuuaguaauuucuuccaccagauacccuaaaucaucucucucaaguucagaguuccacaaaucucuggggcaggggcaaaaugccgccagucucuuugcuaaaacauagcaagagucaccuuugcuccaguucccagcaaguuccucaccuccacugagaccaccucagccuggauuuuauuguccauauugcuaucagcauuuugggcaaagccauucaacaagucucuuaaguaaaguuccaaacauuuuccuauuucuucugagcccuccaaacuguuccagucucugccuguuacccuguuccaaaguugcuuccacauuuucuuguaucuuuucagcaaugccccacucugcugguaccaauuuacuguauuaguccuuuuucaugcugcugauaaagacaugcccaagacugggaagaaaaagauguuuaauugaacuuacaguuccacaugguuggagaggccucagaaucauggcgggggagaaaggcacuucuuacaugguggcagcaagagaaaaugaggacgaagcaaaaagcagaagccccaauaaacccaucauaucucaugagacuuauucacuaucacgaaaauagcacaggaaagacuggcccccaugauucaauuaccucucccuggguccaagccacaacacaugggaauucugggagauacaguucaaguugagauuuggguggggacacagccaaacccuaucaacauugaauacaaucuguaguaucaaauauugaaaauucuagugaugaaaugaggauuauuaauucaauaaucagugcauuugauuauaaaacuucuaucauauuaagggaauuuauugcuucaugcuguauuuguguuuccuuuauauugcaaugauguuuccauaauuuaaaacgaaucagaacucuucuauagauuuuucaauaaaauuaauuucuagaugucuacucuucauuuaaauaauuuugguauccuggugaauucuacuuuucuucaaauauacauaucugggcaauguggcaucuuacaauaaggcuuuccaauauuaauguuaguuucuuacaauugucccuuuuacuuuuuuauuuucuuacagugccuacaccaacuaauguuacaauugaauccuauaacaugaacccuaucguauauugggaguaccagaucaugccacaggucccuguuuuuaccguagagguaaagaacuaugggugagugucacucuuuuauuuauccuuuuuauuccauuuuuguuuagguccuuggaaauuccacaacuguguucuuucaucagccuucccacguggcaaaacauucuaaacugcuuauagagguccaaaaguacuaaagaugcaaauucuuugccaaauauuucuugccucuuauuuccucuuccuuaucaguauugaaauagagaaguaucacuaaacuucugagauuagcaugacaaauaaagcuaauaguuacuaugucaucuuccuguaguguauuuuuaguagaacaauauaaauuucaaaaaacuuuuuugacaacuguuaguuuuuuuaaugugcuuacuucuauaauuaacauauauaaauggaauuuagaguuguuuaaaaaaacagauuuuuaaaaaauugaauguggaauguggcuugcauaggucuuacauuuugaauugagccucuuuacuguaacagaguuuguaguucuucuaacuaaagaguaaggguuuccuacuuucucuggcgucuccauccuauucuuagcucugcucuuucuaccgcuuugugcugugaauaaaaagcaaagcacagacagaaaugguuugaguuuauuuaauaacaauaaaaguuaucuucgcauuuuuuuauucuuuuuaguguuaagaauucagaauggauugaugccugcaucaauauuucucaucauuauuguaauauuucugaucauguuggugauccaucaaauucucuuugggucagaguuaaagccaggguuggacaaaaagaaucugccuaugcaaagucagaagaauuugcuguaugccgagauggugaguagaauguguacacauguaaauuuuaaauuggaaaauauuuauacaugucuucuguauguuugcuuuuauuagcaguugcugaaaauuaucacaaugcuuaagaaacacuuggaggaauuuagagucaguacagguugagcaucccaagucuagaaacccagaaugcuccaaaaucugaaacuuuuugagcgccagcauggcacucaaaggaaauacucauuggagcauuuuggauguucagauuuagaauguucaacugguaaauauaauguaaauauuccagaauccagaaaaaaaaacucagaaaccgaaaauacuacugaucucaagcguuuuggauaugggauacucaaccuguauccuccccuucuuucaagccccacaaaauagggcuaacagguggccaucacuuagcugcuucuaugccaugacauuuccacuucauacaauuaugggucugugcugcccagcgguccccugcaccacccuugcccuucccaucuuuugucauucauuuguaaguuauauucacuaaggacuuuggcagcuaacucuuauucugaaugccuggggaaccugaauaccaccuuaauacauuaaaaaauugcagaguuccuuauucucuucagccacugugauuuucaggucuucagucuuccagcaucccacucccauaguguaccugauguuugcugucaccucaaacucuugaaucuuuaauuccaguuccuguauuccaacuaugacauccugccuuagcucucagacccugacuccuggguaaaagacaccuuuagucacuugacuccucccuagucuucuagcccuugggucccuuucccucuagccucacuuccuuucucugcuccugccuuuuagauugugccaccucggucucuucuacaggcucuuccucuccuuacccuuuaaauacuuuucuuccccagaguccacaauuuugucauaugauuaccacaccaucugcauguuagauuuuuuuccauauagauuuaucaagggccuacuacgugccggaaaguauacugggcccugaggauacacugauggguuaaaaacagaccugccuggcacacagugguacacaguaauaugugaagacuagauaaaugguucacaacaaagucucaaacaucaaagaccuaauaaauauuuauggaauaaguucugauuuuucacaguaaaaagaguuuugaugagggaagaaaacuaaugccauuucugaaacguuuuuuagaauccaggcuucuuaauccacagaagcaaagauaaaggaaaaauuacuuaauagagucuauauuaugugaagucuuuuuuuaaccaaaguuuauaacuauuuuuauuuacaacuagaaaugaaauuaaacugcuaaauaggcauucagauuaaauaagaguacuucuugccugagauuuaugaaacauuuguuuauuaaggaccccgagacuaucuucuagauauuuguggagugguuuaaaugugguccugcuuuagaacaaccagaacaaaaacaauagguugauugauagauucugguaauuuuaugaaauguaccauuuaguuccaaggccaguauuuauuauacuuccuccuccuccuuccccaggaaaaauuggaccaccuaaacuggauaucagaaaggaggagaagcaaaucaugauugacauauuucacccuucaguuuuuguaaauggagacgagcaggaagucgauuaugaucccgaaacuaccuguuacauuaggguguacaauguguaugugagaaugaacggaagugagguauguguuucacauuuuucauaauggaaauucuuguguagcuagcaaaaguuguuccuuucuguaguguaaugaaaauaggaugcuuauaaauauucaagcaagacucacagaucauagauuugauaagaaaaauaugugaaugcuauuaaagcaaaaaugauacagaguuagucacuaacacugaccaugugaauacauuuaguuuuuauuugcuucauuuagcagaauggcucuaaucuaggauuuuucccaguacaccuccauugcuccacugguaaaaugaggauuuucuuccucauuggcggugacguaaaguaauauuaauacuucuguuucccaccagcuaaauuucuggacaaaugaauaggacaaaugaacauuuguuaguuuaacaacuaacaauaaacauuccugcaauuugaguuuuuaaauuuaccauuuuuauaaggaauauaacagaugcauaguaucgugcuguguugaaguaacaaauugacuuauugauaguaaagcuauuuuuagacauguucaagucaaucauauauauuucuucaguuguuugaccaggacuaauauggugauuuuuuuuuuuuuucagauuaaaagaagcugugcauuuucacuguuuucuuuuuucaucuagauccaguauaaaauacucacgcagaaggaagaugauugugacgagauucagugccaguuagcgauuccaguauccucacugaauucucaguacuguguuucagcagaaggagucuuacaugugugggguguuacaacugaaaagucaaaagaaguuuguauuaccauuuucaauagcaguauaaaagguaaguucuugccauuuuuuuucuaaauauagagggagcaguaacuaaaauaggaucaugugaggaaagcaaacucauuugcaguuucaaaagaucuguuuuaacaauauucauuugcauuaguuccauuccuuagagaaguucaaaauuaaaaauaaagcaguuucucacacauuuaaagauauagaacaacuaauuuggaaagccaugugauggccccuugacccaggaaagaaaaaauauauaauaaguacauaaaacuacacaaauguuugcauuucaggauuaugaauuauaagucaguuuguuacuucaccauagcaagauguugugaauccacuaaaauguucuuuauggggauuguaauuuaaagacugaagagcaggaacgaucacugguuacaacuguaugacguggacuggacaaagacucgagauuaauauccaaaaaaguuuauagauggguuugaauaauagauaaugggucauuuuuauaacauuuuacaauaauuaauuuuauuucaucuuuuaaugugggggguggggagguagagauauauaugcuagaacuugaacuuuagaacuguuacucucaggugucaggaaccuuaaagaaguuuggacuuuucuuugcaguuaggaaauguaaguguucauuauagauaauuuauaaaauaugaaaaaccagaagaaaacaaaauaaucuguaguucuaccaugcaaaaauaccccauuauucacaguuugauauuuucuuuaguuuuucuacauagacaugaucauauuguauaguauauaugauuuuguguauugcuuuaagcauauauuguaacucaugcuuugaugauuaucuuuguguguguguguguguguguguguguguguguguguguguguauacauauauuuuuuuccuuaggauuuuuuuagaauagauuucauagguuuaaaauuuuaugaugcaaguauauuuucgaggaauggaaauauaggcugaagagccagaacaaacaccuaaaauucaauacuaauaacuucaagccauuauaugaagguuucaaauaggugauuuaaagcagugcaaugcauuuuaugcuaauuuucguuaugcuauuugaaaaauaaaacccuucuuaaugcucaaaauuugaaauaaugcaaaugccgcagauuuguuuuuagccugaauuauacacugcacugauaguauggccacacgguggcauugccguggcuccugagcagcagcccugccugcuugccucaaugccuugcagccagcacuugcucagcccgugggacuucuaacagcacuaauguugguuuuguaguuauuuuccuuuuuacuuuuguaaugauuuaacuuuuuucacacccuguaauaagcguaauagaagcauucauuaguaacuuccauaguuagaaaauucuggguaacaaaaugcccuaaaggaugccggacauugucacaguauguuagagugcuguuaauuuggaagagagaacuaugaaaaaaaaaaaauacugaagauugugcugcaaaaauaaaaggcagcauuacagcaaaguacacaauggugauucuagauguaugugcuuggaaacaaaucuuuccuauuuuauauuauuuaugucugguuuauaacuaaggggacuuuauuccugugcagcauugcugugugcauguacaucugugaagcuuuauaaguauuugcagucgugaaauaaauguaacaggaaauucugaggaguggggcuaaaucaucuuaagagcaauaaacauugccagaauuucuuucuuuuuuuuuuuguuguuuuguuuuguuuugaaauggagucucgcucugucaccaggcuggaguccaguggcacaaucucagcucacugcuaccuccacuucccagguccaagcgauucuccugccucagccucccacguagcugggacuacaggcgcaugccaccacacccagcuaauuuuuguauuuuuaguagagaugggguuucaccauguuggccaagauugucucgaucucuugaccucgugauccgcccaccucgacuucccaaagugcugggauuacaggcuugagccacugugcccagcugccagaauuuguuucuaaggagagguauuuuuaaaauuauucuuuugcauuuuuaaccgaaagaaaugcauaacccuggaaacacacuguauguagggcuguaaggaaauuauuguagaaaagcuauuuuaacuauguugugucauaguagaauagucccagaaaguucuagaauugcagagcugggaagaaccauauugcuaucuaagacagauaccuaauuuuuuacucagauuuccuaacuucugcuuccuucaguguucuuuaaaacucuggcccuauucacuaauuuguaaaucuauucaagaauggcacuaagacuuuuugauagauaauagcaguauuccaucuuaauuguaacuugugauuucugccuuuuuuaagguucucuuuggauuccaguuguugcugcuuuacuacucuuucuagugcuuagccugguauucaucuguuuuuauauuaagaaaauuaauccauugaaggaaaaaagcauaauauuacccaaguccuugguaauguauuuaauuuuuuuauauacacuaaaaaguuaacuugaaccuuuuuugauaguuucuuaaauuauguuuuuaaaguagaaugauauucaacaagaugucaccugccaucaaucagucagucuaccacacaugcaaaaucacauacugugucuuuugcugugcagcaaguauuuuguuuuuuuuuuuauucucagggaaaaacacggugagacaauucuguuaaagaucuuaaagucuagggggaagaaaagauaaauauacauuggcuauauaacgugugauagauucaaagauuuauaccugagcccaugaggacuuuguccagcuuuggggugggguuagucauggcuuuuccagaggcaaugccugagcagucuugagggacauacaggaguuuaggcacuaggggacagaaugugcugagguccagagccaagaaagcaugacuuugaaagcucugcaaauacagaaacacuucauuaugguuggaguaugaaaggaaaguuggccaaaaaugagacuaacguaggaguuugacgauuuuaauguccaacauuucaaagccuuugauguaaagaacauuuaaagguaacagaauaguaucuauuugagucaaauaugacaggaauaauaucugugaugcucaaagggcacauuaaaauuugcuauaaacuaccuuuaaaguggauaagaacucucaacaguuaguagucaacucacaaaugaauuauaauauuuuauucuuacuaguaauuaagcacaaaguaaccuugcaguaugccauuuuacacgcgcuagagaagaaaaaagaaaccuggauauccaguaguaccagcaguagcauaacggguaaaugcuggugaaaaguaaucuagcccugguaagaauaaaagcacacaguggguauucaguguaauagugacguaaacauaccauuucuuugauauggucacuccacucuuaaaaaauguauuauaaggaaauaauuucauaaauaaaaagauguacaggauauuuaacauguuccauagcuaguaaaaauuggaaacauuuccccaucuauuaaauuauuuaucaguauaaagaaauaauaugagcuacuaaaaauuauaaugaugaaggcaaguaaugagaauauuacuuaaguagaugugcccacuuuguaaacauaaugugcguacauguggaagauaauuguauuaggauucucuagagggacagaacuaauggaauauauauauaaagauauauauauaauaccaaauaaacuccccuuuauauaaaucuauauuuuauauauuauauauuauauauauuuuauauguuauauaauauauauuauauauuauauauaauauauuauaaauuauauauuuuauauaauauauuauaaauuauauauuuuauauaauauaaguuauauauuuuauauauuauauuauaaauuauauguuuauauaauauauuauaaauuauauauuuuauguaauauaaauuauauuuuauauaauauauuauaaauuauaaauuauauauuauauauuauaaauuauauauuauauaauauauauuaauuauauuuuucauauauauauauauaaaggggaguuuauuuaguauuauuuaguauuaacucacacgaucagaggucccacaauaggccaucugcaggcugaggagcaaggagagccaguccaagcuccaaacuugaagaauucagaguccgauguucaagggcaggaagcauucagcaugggagaaagauguaggcugggaggcuaggccagucucucuuuucacauuuuucugccugcuuacauucuagccaugcuggcagcugauuagauugugcccauucggguuaagggcgggucuuccuuucccagcccacugacucaaauguuaaucuccuuuggcagcacccucacagacacacccaggaucaauacuuuguauccuucaguccaaucaaguugacacucaguauuaaccaucacaguaacguacaaaaagcaacauauauuaguaagauaucugauggcuuuuuaaaaauucuaaaacuuuguuuuuaauauuacuaugggaccuuucauuaaaaagaaauggcaacaucugauucacccauuauccuaaaugugccauuuggugguccauuacuucagaccuuuguuuuuuuugaggguaggcacuuaagcuuaacaauuuuuuaucuuuaaucaauuuuucuccccauagaucucugugguaagaagugcuacuuuagagacaaaaccugaaucaaaauauguaucacucaucacgucauaccagccauuuuccuuagaaaaggagguggucugugaagagccguugucuccagcaacaguuccaggcaugcauaccgaagacaauccaggaaaaguggaacauacagaagaacuuucuaguauaacagaaguggugacuacugaagaaaauauuccugacguggucccgggcagccaucugacuccaauagagagagagaguucuucaccuuuaaguaguaaccagucugaaccuggcagcaucgcuuuaaacucguaucacuccagaaauuguucugagagugaucacuccagaaaugguuuugauacugauuccagcugucuggaaucacauagcuccuuaucugacucagaauuucccccaaauaauaaaggugaaauaaaaacagaaggacaagagcucauaaccguaauaaaagcccccaccuccuuugguuaugauaaaccacaugugcuaguggaucuacuuguggaugauagcgguaaagaguccuugauugguuauagaccaacagaagauuccaaagaauuuucaugagaucagcuaaguugcaccaacuuugaagucugauuuuccuggacaguuuucugcuuuaauuucaugaaaagauuaugaucucagaaauuguaucuuaguugguaucaaccaaauggagugacuuaguguacaugaaagcguaaagaggauguguggcauuuucacuuuuggcuuguaaaguacagacuuuuuuuuuuuuuuaaacaaaaaaagcauuguaacuuaugaaccuuuacauccagauagguuaccaguaacggaacaguauccaguacuccugguuccuaggugagcaggugaugccccagggaccuuuguagccacuucacuuuuuuucuuuucucugccuugguauagcauauguuuuuguaaguuuaugcauacaguaauuuuaaguaauuucagaagaaauucugcaagcuuuucaaaauuggacuuaaaaucuaauucaaacuaauagaauuaauggaauauguaaauagaaacguguauauuuuuuaugaaacauuacaguuagagauuuuuaaauaaagaauuuuaaaacucg

SEQ ID NO: 192126 - RNA, 23529 nt, Homo sapiens
cauuaccaacgaggcgcaggggucaggacgacucucggcagcgccauugcgcgcccucuaguggcagccgguuuugaggccggccuccggcuuugaaguuccucaccgcgucuccuucccucuccccaaagccuggaucaccgcccagcgucaggcgaggggcgacgucucgagguaaaacggaggaggugcgggacgcggagacugcgcgggcccgguagcccuggagaggccgaggcucuaggccgcgaggggcgggugcaauggcggaggaacaggugaaccgcagcgccggccuggcccccgacugugaggccucggcgacugcagaaacuacgguuuccucaguggggaccugugaagccgcuggcaagucaccagagcccaaggacuacgacagcaccugcguguucugccggaucgcggggcggcaggacccgggcaccgaacuccugcacugcgaggugggcggcgacgcgcggccgggggugggugaggaccuggccgccccucggagcuccggcagggaggccucgccguuguggagcgggugcagaggaucccgaucgcuacucagcucgcagaggcagggccgcucuguguggauggggcucggggaagcuggggauacgcccacuacgggccuuucugcaggguccgggugcugaugacagacucacuccuaggggacugacaggcaguggcuccagcgguaucuuugcuguucccaggggcaaagagugaaugacagggccgaaugcuuuggccuauguuugcagguacccagguaguugguacaaauaacauuuuguggccucugcuuuuauuacaaggauucuucuccaccuucaagauacugauuuuaaauccugcacacucuaauaccgauacugaugagaaaacuaguagaaaauagguaaugauaauuguggaaagcuguuuguuagauuggcagaaaauaggcuggagggagugggucugaggucaaacuauuauugaauugccucugaauuccacugucaguugggaugcguggacauuuucagagcaugaagacuuugcccagauauuuuuaaacggauaaucuggcacacacuuuauucuguugguuuuacuuguccauauagaaacaacuuuuugagagaauuagcuccaaagauugugucuuuuguaguaaacauuccuuuauuuuuuaaaaaauaaauauaauuccuucuaagcaccuuguuuuggagguuuuugagcaagauaagggacagucugugucccgauuuuacaaucuaaagggcggaauguauacagaggagguagccaguuacaaugccucgugcuguggucaggugauuuuacaguauuuuguaagcuugugggaggagcaucuaacccagcucugaagaauuagggaaggcuuuccagaggaaaugagacaugaagaaauaaguaggaguugaucagaugaggaaauggagagaauaaugucccagguugagagaccccccgagagguucaguuugugugauagaaaaacuaacagaaauugucuaacuagugcauagaguuugagaggaugaaaggcgaggcuggagagguaaacaagggaccagauuauuaaguguguuggaagucaugugaaggaauuugucuuuaucugaagagcaaagugaaacuucacaauguuuaaugguggguugggaggaagauguugcggaguuauaggaaggggguugaucuuugaaaggucauucuggcaucauuguggagaaugauuuggaggagaccagucuggagguauggagacccguuagaaggcuaguagauuaaucuacccugaugauggccugaaaugagaaugugguagaggagauuaugaaaaguauaucaauuuaagggauacaguauucaggagguaaaacagggaggacuugauggauacaggucagugauucucaacugggggcaauuuugcccucccaggguacauuuugcaauguauugagauacuuuugauuguaacaacuucuggcacuucuagggguugcuucugggaccuaaauaauggauaaaagccaggguugcuauuaacaugguacagugcacaggacagcacccccaccaccccaucaacacacacacauaaaacaggcuuauccagcccucaaaaugucagaagugccaagguuuagaaacccugauuuagauauaagaggauaaggaaaugaaagagggugaagucaaagaugauuuccagguuucuggcuaggguaaacuaguaguggugguaccauuucauuaagcucgggaacacaggaggagaaaagauggccaggggaguggugggagguagcaaagcgaugaguugagcuauggaguuguggaguuugaggugaguuugaggcaucuaaguagagaugucuuuuaaaugguuggauagucuagcacucuguagagggaucuguaucucuaacccagauuacaggaacugucgguuuauagauggaaacugaaaaagaagggaagcgaugagaucacccaugagguaaaaagugaaggggaggccuacacagaacucugaagaacacuaacaucauaagggacagacagaggaagaggaccuggaaagggaauagagaaggaacagagaaauagaaggaacgcuggaaaggcuaagagaagggaguaugucaaaaagaaaggaauugccagcaaugucagcagcaauauuagccugccuucauccucaaaucuggguuagaugacccuuguauguccuugcagagucagagcaggacugguuguguccccaaagugauguucauugaccuugaggagagcaauuucaugaaguggugaagcaaaaggcagauagcaguugauugagaagaacuugggaaaggaaggagugaagacagcaaauacagacaacucucacaggaauuuggcaauccaggggaggagggaaagguagugguagcuacaggagaaguuggggauuaagagaaagcuuuuaaaacagugaaaccuuuuguguguucaaaucccagugggaagaugccuauagagagagguuuaaaauggcccggcggguagaauguugacccugggaaagaggaaacucauuccucacucucugugugccaggcacuguuggaggcauggggauacagccguaaacaaaacaugcaaaacuccuugcccuuguggagcucacauugucguugcagaaaaggauaauaagcaaaacaauaaguaaaauuuauaguuuauuagauggcagaaaauaaagaggaaggggaugcaguuuuaaaauuuuagucaggaaaaucugcacuaagcaggugacauuuggguuaagccuugaaaaaggagaaggagcaauuauaugguuauaugguuauuuacaaguaaaagguuugaaguagcuccugugaaggcuaggagagagaauuagggaaacaaggauuguuguacagcgggucacgugagguugaggacauucaauuucaggucauaccagucugcuuaguugugugauuuucuucccacuuuccagcagcagccaaaggcugagauuacacaagguaggcaguuguauugacccaggguugggauuuugccaugugguuguuauagaaguguagugagacacaguuaagaaguuauggagccgggcgcaguggcaaacgccuguaaucccagcacuuugggaggcugaggcaggcggaucacgaggucaggaguucgagaccagccuggccaauauggugaaaccccaucucuccuaaaaauacaaaaauuagcugggugugguggcaggcaccuguaaucccagcuacuugggaggcagagggaggagaacugcuugaauccaggagguggagguugcagugagccaagaucgcgccgcugcacuccagccugggugacagagcaagacucucucuggggggggggaaaaaaaaagaaguuagggcaagcaaguggcugaagugguagaccauggaauauaugcugaauaggagaaggaaguaaagacagcaccugacagggagaaagaauacgcacaucaguuuucuguuugcagaccuuuguuggacugacccauagagucagaagggaccuaguucugccucuucagucucccuuuauuuuacuaaauauaaaaguaggcuaaagagagguaaagugcauuuuuaaacucagaguucaauauuuaguagauccuuagaaacugcuuuuaaauuuuguauucugcaguuccaauaaugaaacuaauagaaaauagauacuaguagcaguagaaagcuuugucugaaaauagucaucaaaaggggugggauccagacuucuaucacauccaaggugagaauuuuucuugguuaggaacaaaguaaacaauaugaagagacuggggauauuuucaugguagaaauaagacaugaucaguacuuucaacuaauuuacacccuaaauuagggaaacggggaauauauacaauagcccauugucaguggaaaaacacaaacugugcuuuuuuuguuuucccauucaacaacagcaaucaacacagaacacuucugugaccaaauguauggagguuuucccccacacaccaagcaaacaaucaguuuugcagcagacaccagcugguuguccuccauuucaauucuuauacuaucuaccugaugauagcaucagaucccgcagguugaagacucaguccccaagacuggccugcccuucccacuaguugcaaguccaggccucuggaacuucugaccgaccagcuugaaguuggggaucccacaagcuucucuuuggguucuaaagcuugcuagaguggcuuacagaacucagggaaacacuuagguuuacugguuuauuauagaggauauaccaaaggaugcugcugaagagaugaauagcccaaaguauggggaaaagggggcagagcuuccauguccuccucaggcguguccucucccaggagccuccaugaguucagcuauucagaagcucucuaaacucuguucucuggggccuuuuauggagucuucauuggauaggccugacugacaauucuguauuaaugugacuggacaaaaaggguaugaucuaauacuaguagacugaguggggaaacccagcaaggccuguccagauucuucuuggccucucugugaagcuuuccuuccuccaggguaugaggcagaaucccuucagaaaugaggguuuuaugacccacaaucagaaaggucagggaagauuauaguccugacuugggcaggugaggggagggcaaaagaagggcagagagauugugagagagauucuuuuucugaggccugucucugaggccuaaaaugccucgacaugguaacaaaagacuguaacaagggcauugggaguuauaagccaggaaucguggauggaaacccauauauauauacacauauauauauauauauauauauacacauauauauauauauauauauacacauauauauauauauauauauacacauauauauauauacacacauauauauauauauacauacauauauauauacacauauauauauauauauaucacacauauauauauauauauaucacacacacauaaccguauaauacaaaacguaagauacagaugcguguauaauagugcucccaaagguuguguaucuuuuucaaauugaaucuaagaugacuugauguacaagagcucacucauuaaaggguaaagauuaaucuuuuuaaaaagaauaacuacauaacauaauucgaugguuuacaucauacauucauauacucauucaaauauauucauugcaaacauuuagaaacuguuggguuuauauaaaguguaauucagguacaaaagagaaaaauuuccauuuggaaaaauuggaguuaccagcaucaugagggguuagucuggcaaaccuuuccagcaaaagcuguagaagauucuucacuccauaaaccuccauaugguguugucuaauuguauacugcagauuuaaaacuaagcaaaggcugaaccaugcauucuuaauggggcagaugacacucccaaaggggugaaaauugguucuugguggugguggggcaauaucuuacuuuuucauguaugaggcacagauauacauaaacagagaguguagcugugguauuaaaaucucauggagaugggauuagaagaaaaaaaagucuuaaaaggcucauuagauaaaaaauaaugaaaaaguaauugaguaacacuggacuagaauuuaccuugcuuggaacuauacugaggaaauaacucagugccaauuuaacuugaacguuguccccuguuggaagaugguuagcauccccgaucucggcgcaccaaauuuuagcaguaugcgugaucaaaagggcgucuauguauuuccaccucugguugagaaacacugcuucagagccacacuccaucugcuggguccacgcuggcagcuuuuucccaacaaaaaauagaugucuugccauucuugacauccgugaagcuagugauaagguauucaaaagggggagggggagaaagauaaagaaaaccugucuuuguagucuuaaagcuggccaaguuugcuagauggaugauaacagaagcagcaaaaacauggcuuuuugauuggcaagaucuaaauucccucugggauuuuuagcuuuuuuaguucugcauuacagaaagcacagaaauauuuagaauggagguugagugccagucugcccuauuuggguuuucagauuuaaagaaaucugaaacaguuauucguuguauuuaaauuguuuauuagagucaguggugauaaugaagucaggauaggcuagcucuuccucuaauccaugcauuuccaaaaggauaaaaguugguucuucccuggggcagagcagagguggcaggagaaaaacaauuuuuauucuuuuuauauguaaagcauagguauaccauacagaacauaaacauauauacauuguaucugugccauuaaaacaucaugggagggggcaaucagaaaacaucuauaaagucuccuuagggagguguuaaugagaaaagguugagacacacugaucuaauucaaaaauggccacaauuccaauuuaagaagggguuuugcaaggagaaacugaaagaucguagaaaauccaucucuguuccuggaaaaauaccugaaaacccaaaugacacaccauuuuuuaagggguagagaaggguguaucaguaacuuuaucuucuaugaagcaucugucauuuauuuauucagcaguuuggcaggcguacuuuguuauucacuuggaguucaaagaugaauauggcaugccccacacuugaggagcuucccugugauccaaauucagugcaggaaugaaaaugcucuuuaguggaugucauuagggauggauaggcaaaauacuguaucuuuaagucacuugaaaucauucucuucuuugaauggaaugauuaugcuaccaacaugacauccaguuagguuuauuguuuguuuuuuauuuuuagggauugcuuuuuuuucuugugaagugugauguauacauguuaaauauuuacauguuuucagagucaaaauuguaaagcaagguacauuuggagaaaucuagcauccauucucuugucaucucuaccaugucucuuucuccauaagaaacuuuuaaaaacuuuuuuguuuauccuuccauugugaguaaauagguauucacaugucuguauuuguauucuucuuucuuacacacaaaagauagcuuaaccacucuccugcuccuugcuguuuuuuaaaaaaacuugaauauaucuuagaaauaauuucguauguauaugaagaucuuccucauuccuuuuuagagccacacaauacuccauuguguggauuugccauaauuuauuaaaccagucgcccagcugcauuaugaauguuugguuuauuuuucagucuuuugcuaucaugaauaaugcugcaaagaauaguuuuauacacacacacacacacacacacacacacacacacacacaaucauuucauauuuuugccagcguaucuauggaauaggaggaucauuuuucuuaagaugaaccauguaaaugaugccuggaucagcaguaggaaugggacaaagggugacaucagagcuaguuucaauauuucagaaagcuucauggaaaucuaauuuagucaggguguaggcuaacuaaaacaucaaguuucuauauuuuugagaggaauuuuaucuauuccuggugauaagagucauguugauugguaguuuuuauuaggauugggauuguguaauuaauuaagauugggaaaauaaauuauugauauaugagaguuaguaaccaaaaccuuucaauauagagguuggaagacaaaacuaagcauuuugguucauucuuaucgcuaaguuaugcaguaugagacagcagauuuuuaggaaccgcuuuagcuuuucuccugcuagccauuagacuggcacuugcuaguucuguuaaucuaaagaagugucauuccugcugugagguagaguacagcuacaucaucucaaacuaaccagguuguauucuguaccagaauuaccucuggauuuuaaaaaauuaaugccguaauugaggggaaauaaagauauauaacauuauuguguuaugaaucaaucugggaaguaggauuguggcaauuuucuuguacuagauuuaacccccaauuuuaauuguuucugagcuggaaguauuaaagaaauaaugguaaucccagcacuuugggagacugaggcaggaggaucgcuugaguccaggaguuugagaccugccuggauaacauagggagacuccaucucuacaaauauauauauauagccuggcauggugaugugcaucccagcuacuugggaggcugaggugggaggaucaacugagcucaggagaucgaggcugcagugagccauuauugugccacugcauuccagccugggcuacagagagagacccugucugaaagaaaggaaaaaaggaaaauuuuaaacaauaaaaaacaguguaguccuugaccuuauccuuuucuaaaacauuccauggauaucaauuuuuaauuuuaauacuagacagaaaaaccauaauaaaaaugauagaaauggauuaaaauugauauauaauuaucauguuuguuaucuuaggauaaccaggauuacuggaauggauaugacgcacuuguuugaauugaauuuuggcucuuggaacagagaacuauugagcagcauugcauucauggauuuuuucuaagggaaacucugcuuacacugauuuuaauuaauuuuuauuuaauguaaaguaaaaauuaaaaucaguauaagauacugaauaagauauucacuaucagauauuuaauaugguuauuuagugaauauaaauuuucuuuuaggaaaguucgaaauucaaauguuaauagguugaaacacgcucuuccuuuccuuuucuuuuuucuguagauuacugugugggguaauguaaaccagaaaacugaugccauacauguaguguaguggucccauaaauuaguacaauauacuggaauuuguuucagcauuucagucuuuuuaauacuguaaaguggcaaguaaaaaagucuuuggauauaauugcuuuaaaaaguguuuaaaaaaugcaaucccuggacauguaaaugcuagcugguguucuuuuuauaauugaggaaaaugcuacguugggaaaaaaauuaaauguagaaaggaauuuaucuaucuuguugugauucuguagccaaaccuuuaaaaauaugugucaagguaaaaaacuuuaggguagggauagagaaauguguaaugaaauaauaaacucugagauuauugguaaugaaauuuuagugaacuuuacucauaauuguuuccccaaaauugauuuuaugugucuuuuuuauucucuggaaucaauaagcaucucaugaaggaaguguuaugaacuuaaugcguaauuauaaaauugcccaguggggguuagguguaacauaaguaucauuucccugucagacugagauuaaugauauuuaagucaugccagaacagcauuaagaaauucuuuuuaaaaauucacuaacaaauguuuuuuccuuuagaaugaggaccuaauuugcuucaaagauaucaaaccagcagcaacucaucauuaucuuguggugccaaagaagcauauuggaaacugcagaacucuaaggaaagaucaaguagaacuggguaagaugauggcaguauucuucauguuuauaucauuuucaguugguaucagugauggcagugaagauuaaaaagaaaaagucuaguuaaguacugugaaaaaggagcauuaugacuuuuugaaauuuucacuauaaagaauuuuaaauucauuaaaaaauaguauaauacucguguauucauuaugcagccuccacauuuaggaacucauggacaauuuuaaaaaauacauuaaccuuuucccacagugauugugaagcauaaaccagacaucaugcuauuuaacauuuaaacuguccaaaagauaauauauuuuuaugacuuuuuuuuuuuuuuuuuuuuuuugagacagaaucuuguucagucacccaggcuggagugcgguggugcaaucucggcucacugcggccucugccuccuagguucaaguaauucuccugccucagccuuccaaguagcuggguuuacaggcaugcgccacaaugucuggcuaauuuuuguauuuuuaguagagacggaguuucaccauguuggccaggcuggucuugaacuccugaccucaggugauccacccaccuaggccucccaaagugcugggauuacaggugugagccaccgugccuggccuauuucuaugacuuuuuaaaugauggacuuucuugacucugaaaugaaaggugcuaugaaaaauuauaaacaaacaaguuacgauaugacaaaugagcucauauugccuuauggugagaucauguugguaccugccuuauaguauccugugaagaugaauuagcaccaaaauuuaauuaugaguuuuuagugaugaacuucuagcuucugaaaaggagauucugaaucuugucuauuaaggaugauugcucauuuuccuacucaugccuucuguggcuugucaccuaucauuuucuaagacauuucuaagcuuacuucaaaucugccuuuaaaaaagauaauuuuuuauuuuagauuugacgguuuagauuugaagauuuagauaaaacuuuuauuuuagauuugaugguacaugagcagguuuauuacguggguauauuguguggugcugagguuugggauacaaaugaucugugacccagguagugagcauaguacccaacaguuagguuuucaccucuugcccccauuucucucucccacuuuuaguuguccccagugucuauuguugccaucuuuuuguccaugaguacccaguguuuacccucuccuuauaagugggaacacagaguguuugguuuucuguuccuguguaauucauuuagaauaaucgccaccagcugcauccaugcugcugcaaaggagaugacuucauucuuuuuuauagcugcauaguauuacaugguauauauguaccacaucuucuuuaucuagucuacugcugaugggcaccuagguugauuccaugccuuugcuguugugaauagugcugugacucacauacaagugcaugugucuuuuugguaggauaauuuguuuucuuuuggauauauacucaguaaugggauugcugggucgaaugguaguucuauuuuaauuuuuuugagaaaucuccaaacugcuuuccacaguggcugaacuaauuuacauucucaucaacagcauguaaguguuauguuuucucuucugccuuaccagcaucuguuauuuuuuuacuuuuuaaaaauagccauucugauugguguugaaauaguaucuuauuguggguuugauuugcauuuccugaugauuagugauguggagcauuuuuuucauauuuuuuuguccucuuguaugucuucuuuugagaaguguccguuuaugucuuuugcccauuguuucauggugauuuuugguuguuuaauuguuuaauaauuuauuuacagauccgggauauugcaccuuugucagaugcauaguuugcaaauacuuuuucccauucuguagguuauccauuuacucuguugauaguuucuuuugcugugcagaggcucuuuaauuugguccuacuugucaauuuguguuuuuauugcguugcucuugaggacuuagucauaaauuguuucccaaggcugauguccagaaugguguuuccuaggguuuccucuaggauucuuauaguuugagguccuacauuuaaaucuuuaauccaucuuguguuaauauuuguauauggugaaagguagggguccaguuuuauucuucuccauauagauaaccagcuaucucaacaccauuuaacugaauauggcguauuuucccauuucuuauauuugucaacuuuguugaagaucagauggcugcagguauguggcuuuauuucuggguuuucuguuauguucuguuggucugugugucuguuuuuguaccacuaucaugcuguuuugguuauauagacuuauaguauaguuugaaguuggguaacgugaugccucuagcauuguucuuuuugcuuaggauugucuuggcuacuuggguuuuuugguuucauaugaauuuuaggauaguuuucucuaguugugugaaaaaugauguugguaguguugaauccauagauuacuuugggcaguauggccuuuuuaacaauauugauucuuccaguccacgagcauagaauguuuuuucauuuguuuguaucaucuaugauuucuuucagcagcauuuuauaguucuccucguagagaucuuucaccuccuugacuagcuguauuccuacguauuuuuguguguguguggcuauuguaaaugggauuguguucuugauuuagacugucaguuugaguguuguguuuggaaaugcuacugauuuuuguacauugaauuuguaucccgaaacuuuacuaaaguaguuuaucaguuccaggauccuguugguggagucuucaggguuuucuagguauggacucagauuguuggugaagagagauaguuugacuccuuuuccuauuuggaugccuuuuauuucuuucucuugccugauugcucuggcuaggacuucugaaaucuggaaaggcuuugucaugagguucugggauuaguuugaucaauauuuuaagguagccuacaugauagaucaauugggcuagauuuuuaagagguaagaaaccacuuuaauggaaaaccuugauguguaguucauuaauauuuaggcuagugaauuaacuaacaauuuuuaaacugucgauucugaauacagcuaaguuccuuagucauuugaaguucuaucaguacauuugagaacauauaugauuuauaacuacaguacccuguacuguacauuugagcuuauaacaauuagauccaauuuagauuuaccugauugaaacauuucaucuuucuuauuaaaaguuuuuauuuucauucuuguaguuauuucuuggguuucacacuuuagcuuuuuaggaauuuuucaauuuauauucagcagaaguggagaauagaggcuguuauaacuaguuuuuauaauguugcaaaucaaauauugcuaauuuugaagcagcugguagguauuugggauuccauuacauuuuccucuuugcuuuuguguuauauuugaauauuuccauacuaaaaguuguugcaaauuaauaauuuuuauauaauugauaaaguugaggaaauaauaagcauauggaagaguucaagaacacuaucaaggaauaugacuauaauugacauuuacagaacuccacuuaaauacagcauacauguuuuuuaaaaagcauauguucaccaaaguugaccauauuccgagcaauaaaauacagcucaauacauaucaaaugauugaaaucuuauaaauauguucucuaaagacaguauaauuaaauuagaaaaagaaaaaauuccaaaaaaagauauagucuggcuugaaguaauuuggagcuuuuuuuuggacucuaugguacugaccuagucuuggaaggcuggcagucucccagcucaaaccugacuuaaagaaguaaacauuaacaaugauuuuguaagucucaauauaucagcuauccucuguagauguuuuuacuucuucgucuuucaaauacaugauuacaccauuuagaaacuauggaggccuaacauuuggcauggugcuuugaagaucccaggugaccaaaauuuuuuugguggacagguuuauucccaccugaaggccauaaaacaccaagagaagaaagaugauaaaggagauggaauuuggaagccagagucauuauacaaauuuuuggcuagucaaggauaggcugacuggaagggauaccauauccuuaauuugggcucaaagacaaauucaaaguuuucuugucuuauuaaaucaaacaauuucuguuuaauuacuuggucuucuugaugagaguuaguccucauaugaucagauguccuaaauagccagcuguccuaaagucuacuuaucugugagauuuugugauagugauguugcacugaggcucaauuugaaacuuuauuucaguuguugauaagcaaacuucucagugacuuaaagcuacugaaugucuuuauuuuuuauuuuauuuauuuauuuuugagagagggucucacucuguuaccuagaccugagugcaguggcacaaucauagcucacugcagccucgaccuccugggcucaagaaauccuucugccuccacguaucgaguagcuaggacuauaggugugcaccaccaugccuggcuaccuuuuuuuuuuuuuuuuuuuuuuuuuugagacagacucuugcucugucaccaggcuggagugcaguggcucaaucucggcucacugcaaucucugccucccagguucaagugauucucuugccucagccucccgaguagcugggacuacaggugugcaccaccacgcccggcuaauuuuuuuuguauuuuaguugagauggggguuucaccauguuggccaggauggucucgaucuccugaccucgugauccgccugccucggccucccaaagugcugggauuacaggcaugagccacugcgccuggccacccagcuacuuuuuaaaaaauguuuuuuagagacgaggucuuaccuuuuugcccaggcuggucucaaacuccuaggcucaagugauccuccucccaaaguguugggauuacaggggugagccacugugccuggccugaaugugucuuuaaauguuuacccauuugauaggacaagagugaagaucaauggcaauuugugaccuuaaugucuccucuaguguaauguugugucuuuucuguuuuacaguugagaacaugguaacuguuggaaaaaccauucuugaaagaaauaauuucacugacuucacgaaugugagguguguauacuuccagauggaaaccaauauuauacauuauugacguuuuucaaaaugucauuucuccauggaaaauggaaacagagguggcaguuugugguuuaaauguaguuuuccugaaagugagaauauaguucauugguaguauaaauguaauaaaacuuccucuugugucucaauaucuuccaauaauuuccacuugaaguuuggacagacaagucuauaugggcaguggguagguaaaauaguuacaagucuacuuuuuaaaaaaaaauuuuugagauaggaucucacuguguugcccaggcuagagugcaguggugugaucauggcucauugcagccucaaccucccagacugaguauccuucuaccucagccuccagaguagcugggaccacaggcaaguacugccacacccggcuaauuuuaaaauuuuuuagguagagacagggucucccuauguugcccaggcuugucucaaacuccugggcucaagugauucuccugccucagccucacacaaguucugggauuacaggugugagucaccacacccagcaaaucuacuuuucuuuguucaauaugggcauuccuauaaaacuguaugcaaguugaauuuucuuagaaaaauuuuauaugauuuaaaaacacaugauuauaauucuaacgugaaauuaacuugaauuuguugucugcugaacucuggcguaagcacaugauguucaauuuuucaacuuuuuuuuuuuuuuuuuuuuuuuuuuuugagacggagucuugcacugucccccaggcuggagugcaguggugcgaucuuggcucacugcaaccucugccuccggaguucaagugauucuccugccucagccuuccacguagcugggauugugugugcaugccaccaugccuggcuagcuuuuguauuucuuauaguagagacaggguuuugcuauguuggccaggcuggucucgaacuccugacaucaagugauccgcccgccuuggccucucaaaaugcugggauuacaggcgugagccacugcgccgggccuuuucaaauguuuuaauuugucuaaguaauguuuuucuuuuuaaaagguuuccaauuuugcuucugugacccaagcagguauaauggagauuacuucuaacacuuuugaccuagaauucagaauagacuugaauucuaaugccauccaugcuacuugugguguacucuacguacacugucuguauuaguuuagacaugccauuuagccucuccaagauaauaccugcucugccugcugguaggugcaaaugagauucucugugugaaaaauccuccaaaaacuguuaaguauuaccaagugugauaaugacaaggaacaaaugguguuugagacccuuuggccagaagccacacauuuccuucacagucauaggauacuuauuagaagaaugaacacuggacaaagaauugagagcccugagucucaacuccagcuccacgacugucuaacuuugggaccuugggaauauuuuaaacuuucuggaucauggcuucuccaucuuuaagaugaaaagauugagugaaccuuugaguugcuucaagcuucuagauuauuugauucuacauuauaugacuguuuggcagaaggaaaaccuagucuccucuucuagguggugguggaaauuuuaaaguauguacugcauaucugacuccacauugcuagucccagaggaucacugcugcaguauagcacuucuaugccuccuuuccacacuuccacucacugauaccuugaacaggcaaauauuucuaggcuuugauuauuguuacagguguguguugcucugcugagcauagguggacuugcaaaaauuuuuguaagcuuauuuuuaagaguuuaaaucauauuuuaaaaacuuuguaaccauuuaaaggaauucuuguguaucuuuuaggaagcacauaauuaucauuaucaucuaacuuauuuuaaguauuaaacaagaaaccugggugaugacgaaaguuuuuuaugaugacauaauuaaucucacuacugaaauauuguugguuuggugggaaaugucugaguacuuuauuaaaggaaaaagugugccaucuacuggcuauguauugaauaaaggaacacgacuacuugaguguccagugauguuuuuaaaaauucauugcaagagcauauuuuaagagaaugaaagcuuacgaugauaaagacugaagugauaagacauuaugccaacucagaauucauaaagauuauauugaggcguaauaugcuguuaaggccuuccuugaugaugagcuuauguuacuacgaacuucaacaugaaaagaagaggaagugugugaauccucugaagugcauaaagagaaacauuaaugagauuugugacagucuauuuaccuuagguacuuauuuuggaucucauuaaaauuuauguguuuucaccugaaaaaugacuuuauuuuagaacugguuugucaaucaucucuuuacuuucuauuuuaggauggguuuucauaugccaccauucuguuccauuucccacuugcaccuucauguucuggcaccaguggaucagcuuggcuucuuauccaaguugguuuauagagucaauuccuauugguuuaucacagugaguauucuuguuaugucagcagcauacaaaaauauuuaaaauauccuuuucauuguaguuuuuucuucucaacaguaggcacuuacagcucucauagacuugauuaccuguuuuaacauacugcuugcacauauccaaaauaauauuuuuaauuugggggauuuugaagaucaucagucuguaggaagagaagcuauggcuaaaucuuccccauugcaaguagcagauacgauauagaagaaccaugguauucagaguucugacucuggagucagaucuggauucaaauucuggcugcagugcuugcuugaggguccaugugaaaguuacuuacauuuuuuaaggcucaaggucuuuaucuauuaccugcauauagguaacagugccuauaccuaggguugauaagagaguugaugagguaacuuaugugaaaagcacuuaaaacaguaccuugcaaauaguaagugucaggaaauguuaccugcuaccucuauuguaucaucaacaucauuguagaaauugaguuuuuguaguuuuugauaguucaaauuccuuagaaaagaguuguaguaguagcaucaccuaucagaucuguggcugaagaguuguuuuuuuuuuuuuugagacagucucacucugucaccaagcuggagugcaguagugcaaucuuggcucacugcaaccuccgccucccggguucaagcuauucucuugccucagccucccaaguagcugggacuacaggugcaugccaccaugcccagcuaauuuuuguauuuuuauuagagaugggguuucaccauguuggccaggcuggucucuaucuccugaccucaugauccacccgccuuggugucccaaagugcugggauuacaggugugagccacugugccuggccugaaguuuugagucuaaaaaauuacagcauucugcuuuuccaaagcaaaaguggaguagaguucagcuguuuauacaccuguggucugaaagucagcccuuagauauuaagugacucuggggucccucuaaggccaauugaccacuaauuuaccaggguguuauuuuauguguccaugaugacaaagugaucuguaguugccauaucugaauaaucauccaauaguauuuauuuaucauuaguuaaugaaugguauuauucuagucauaguacagaaaaauuuaaaaagugucugauuucuagaaacuucauauuucaaacauauuaucccugucuucaacuuguugcccagaugauuucauuuaaauaauauaaaaauacaaaaauuagcuggguaugguggugcaugccuguagucuuagcuacuugggaggcugagauaggaggaucgcuugagcccaggauguugagucuguagugagugaucaugccacuccacuccagccugggugacagagugagaucuugucucaaaaaauaauaaaaaauuaaauaauauauaagauacauauauauguauguguguguguauguauuugaaauuuuaaaaagugggauauucugccggacagcugguuuggguuuuuuuuuuuuuuuugcaaaguuuguguaauagaaaaugcuuuuuuuuuauauuuguauuucuaauuuucuauaagagcuauaccuuuauaauaaaagaugaaugaaaauacauuuuuguaauguuuugacuguauuuucuuauaggaaauacuuuuuuacuuggaaaacaucuuauaaaauauguuguugguuuauccugagaaucugaacucuucuuaaaucugacuuuguuagcguaucuuaugagacuuugaaaaaaaucaagauaaagauauugaaguuaauuucaaaaucuuauauaaugauccagauuauauagugugauugagaaaaacacugaaaugauguaacucacagacuuuaguuuaccuuuuuaaaaaauagacuuuauuuuuuagagcugauuuaaguucacagcaaaauugaguggaaacuacagaguucccacgcacccccuaccccuccacauguacaguuuccucacuaugacauccuacaccacggugguauauuuguuacaaucaaugaaccccauugauaaauuguuaucaccacaguccauaguuuacuuuugaguugacucuugguuuuauauucuguggguuuugauaaauguauaaggacauguauccaccauuauagcaucauaccuaacaguuucacugcucuaaaaauccucuguaugcugccuauucaucccucuuuccccucuaacuccuggcaacugcugaucuuuuuauugucuccauaguuuggcuuuuugcagaaugucauaugguuggaauccuacaguauguagccuuuucagauuggcuucuuucacuuaguaauaugcauuucaggucuuauuuuacuuuuuaaaacuuuaguguuauauuuauuuuccuuuucuucuugaaacuuguuaaugaauuugcaauguaggcaacaaucugccuauuuacauacaauguagaauaauuauauauagauauuauacugaguuuuuuuguaagauauuuuuaggaacagaauauauaguacucaacucuucuaauguggcauauuauaauagggauaccaguagaauuauuugauagagacuaugauaucuagaauuaaaaaguauguuuuuuaauuacaggcugaucacuugauugaaaaacuaagaacaugaaaaugucaagaguggaagauuuuucuaaucuugguucagcaugaagugguauuuaggucccuuuuaagucuaauugcaauuuuaagauuuguuggguuuuaugagaggcuguuacuuaguggccuuaaaucuuuucugaaugucuguuuccuaagaucugugauacaguuaugugaauauuuuguuacugacuuguuucaaugguuacuuguauaaggauuuuauauauaugauacuauagauaaaauccuauuuaagacaaauucuguuaaucaacaagggcucuguauuuuuuuaaguuaaaauauuuucauuucucaguaaguagucaguuauaauagugauuuauuuaugaagaauaaacuacuauagaaaguacuuugugggaaccuuuauuacugugaaggagaaaaauagcuauuucuugacaguucuauaguuauacacauaaauuuucaaaauaaagaauaccauacuacacaaugaucucugauuuugcugagggaaggaauuauauaugugccacuuuuuccucaaauuucagaugccaguuuucacuuuuugaagcauugcaucuuuuuaauaaaucuauccugaaagcuauauaauauauauaauuuauaucaaugaauuuacaauaacuaucaaauuggcuaucagaauucacuguaauggaauuuugccucuaauaacauaaagggggaagaaacauaaagugguucucuuaauaaaacuagcagaaaauguugcuuuauggcauguuuuuguaucaaagagaaaucagagguuaaacuuugcuuuuaucaugaaaagggccugauuugaagguagagauaggcuuagaugagaaaaauugauaacgcaauguuaauacuauugauauuucauagguauauuuuguuagaaauugguuuuuuggugcuaaucuauaggcacaauagugaauaugaaugaagaguaggugcugcaaguuaauccuacauugugccaguguauauuaguaccauguaaaugaauaugaauaaaugaacaugaggauuaacgaacuguugaaaauaggcugagauacuaguuuucuuucuuuuuuagagggggcaugauauuaaagauaguuuuaaguaacaaauuacuuauuacaaaguuacaacauguggaaucaauaguuuuauuuguucauuaauuuauucauucagcaaacauuuguugaacauuuaauguguaccagauauugccaggaucaggaaauaaagaacuaaaaauggacauucagacugcaauugcuaguacaggggucaaacaaaaucagugauuagaauuuagugcguuaaguucccugaugccuucacagccagaagaggcugugaagggauaaacacuucugagagugggugguaguagaacugaguauucaagacugaauguuaggcagguagacagugacugguuaggcugagaaacuuacaaguauuuucguugaguucugcuuccacuauuauuuacuuuacaauggauaugaaguucagauuucaucuuauuuacugaagguggagaaaggauguggaaguagggguuaugggcucucaaaaguagauuuagagagauuuuuuuaucacuguuuuaugauauaguucacugagcacuuacauagauuaacaguuacaaguuuccauaaaucaguuagaauaugacuagcuucagggaaggaauuuucaacaacugcaaucuuugauuguuuuacugugggaacuugcagugauauaauugacaacauuauuuaacaauaauagguaaaguaggccgggugugguggcucacgccuguaauccuagcacuuugggaggccgagguggguggaucacaaggucaggaguucgagaccagccuggccaauauggugaaaccccgucucuucuaaaaaaauacaaaaauuagccggguaugguggcgcaugccuguagucccagcuacuggggaggcugaggcaagagaauugcuugaacucgggaggcggaggucgcagugagccgagaucgugccacugcacuccagccugggugacagagugagacuuugucucaaagaaaaaaaaacaauaauagguaaaguauuuaaggaauucucagaugccuuauggaccucuucaaaaaugugguuagccaauugauucaacuuuuauagguuuauaugcucucauguaaaccuauuuguuuccgagaucagacgagaucgggcgcguucagggugguauggccguagacaaccuauuuguuaaaaacccuuggaaacacaucuuuuaguagagguucuuauuuacuuauaaagauuaauaaucaaauuacuacaauuaauauccauuuagccuuuucaguagucuaaauauuugguaacucccuagccaucuauaacacuaguucaaaacaaggcuaauucauaaccugucuuaaaaauguuugaagugguaucaagagcauuguuuaugcauguugugauacuauuuguggaacuguuuaaugagcuauuucaaacugcuagaagaaaaugaaauaaaaauggaaaaauacugucaa

SEQ ID NO: 192127 - RNA, 109225 nt, Homo sapiens
gcugcccgaaggaccuguugugccggguccggaaagcguguuucgcucccuuucccuugagggaguggggagggaaugugacucuuuucgcccagcgccguggacucgcggcuuguggcucccaaguuagggagugagaggaucgcccgccgaggggguggcuccgcagcccggcugcgcgagacgcuucccgcucggggacccgccuuccgaggccaggugaacguuaccggcccccugaccuccagcagauccacacgugagucccgguuuccgcgaucggggagcgaccucugccucccguggcgcgcggggcccccggccgcccagcucccugcucccggggcugccugcuggaggagccugcgguggcuucaggaagggcggccucauaucuuggggucacacuuggaacaggguuggggaauuccgauggaaucguucaagaauggggguaaacggaccguggaaaggggcagaggugggcggauguggagcgagagacaagugggaaggaaacggacucagugaucuaccuuggggagcaacgcccagaagggauggcuugcggaguucagccuuuaaggcaaucaaagccaccauucuuuuacacaguaggaaacucuguguuggcucuuaguauagauaaaaucucauuaaaaagaaaaaaaaaaagguucaugaccugaugcgcucgcccucuaggggcagaacgcccugaaugagaguggguuggcgauugcgugggccuggagucgcccaacagguuugcugccaggauuacaauugucugaacagcacgaaccuuacucguuuguuccauccuccuaaguccugcccguaaagcugccgcuucccauauuuuuuccucuauuauguagauaggaaaugauaauucaaccaagggugagggcaguuggucaaauucaaaagcagaggucagguuggaggccuucacgccagaacugaagcuggugggagcagcaccggagcuuuccaaccugacuugcauauuagaauuauuuagagagucuucauuacuggccuuggccaaccccaucccagucaaacuggaaucuuuggaaccugaacauggguauauuugaaagcuuauauuagugaggauggagaagaacuauagcagauaggaaacauucauacaacuucugaagacauccgaaacuacagacugguaaccacuggugucacugguuugcuuuauugcuuugcuuuacuuccaagauuuacuuaacaaauauuucagugcuuuccuuugccaagcacugugcuaagaagagcaaagacagacuugguaucugcuucauaaaauuuacaguagaggaagagacaaauauuaauuugauagcuauuugaaaaauaacauguaaaaucacugccaugcugaugcuaagaaagggccucauagugcagcgagagccugaaaaacuauaacccuaguaugcaauaaucagaagagcagauuguuuauugugucccugucucuguucuucgugcuuugcauguauugauggacucauuuccugugcgcagcagucccaugagguaguucauauucucauucccauucuacagagaggaaacaagcauggaagguauuagguuggugcaaaaguaauugcaauuuuugccaugacuuuuuaauaaguuccuuguuuacagccagauagguaaaaaguagcaaaguggaugcugugagggacccauucucacucaaagccuaugacuuuuggaggaaagguaaaacuucaguccccaccugaaucuccagcuguccuguggugcucuuccuuuccccucaugacuggauggaaacuuuagguguaaagaggacuaguaaaaaggcaaauggauaugagaaaagugaacagauuuaauaaauacuuaagaggccaggugcaguggcuuacacuuguaaucccagcacuucgggaggccaagguaggaggaucacuuagagcccaggaguucgagaccagccuggacaacauagagagaccucaucucuacaaaaaauaaacagaauuagcugagugugguggcaugugccuguaggccuagcuacuuggaaggcuggagugggaggauugcuugaggucagaaguuuguggcuacagugagccaaaaucccagcauugcacucuagucuggacaagagugagaccuugucucaaaaaaaaaaaaaaaaagagagagauacaaaaaaggccagccacaccuguaauuccagcacuuugggaggcuggaggagacagauuuuuugagcccaggaguuugagaucagccugggcaacauggugaaacgcugucuccacaaaaaauacaaaaauuagcugggugugguggugcgugccuguaucccagcuauuugggagguugaggugggaggaucaccugagcccagcagguggaggcagccgugagcugugauuacaucacugcaccccagcuugggcgagagggcaagacucugucucaaaaacagauaaacaaaaagagaauaacaacaaaaaaacuuaagaaaagucaaaauuggauugaaugugaaggagggcagugucaaggaugaccagcuuccuacuuguacaaucaaauggaggauaauuaccucuuaaaucuuuauuugccuagcauuuuaagauuuucauuuucagacuuuuuguuauuuauaaagcagagauauugaguuauuuaagaaaaaacuucucacaaacuguuuauagcauauauuaaagggaaaucuuuuuuccacuugcacauuuuuucuggcuaaaugaaugauuugccucuuagauucuagauaagacaguucugugauuuuuaaaguguaaguuuccaccuucagcacaguuuauuuuagaauuaccuagaguggagauggcuugucuuucugccugcuaaucuagagacagguaaagauaagugagauuaagcaggcaguugcugaugaguuguaccucauauuguccaggaagacaccaagguguuauggacaugauucgcccauauagcucaguaagugcagcaacuuacugcacuagaaacuuucccauaagugaaauuaugcaaauauguucuuugacuuuguaaaauaauagauuacuuccagcaaaacaagaggacucucaggggaggugguaggacacuaaacaggaagugggauuauggguggagcuguucacugaggagggcuggagaacaacguggagagagauguccacaggagaauggcauuccuauuugcuuuccucugguaccagauaauuuugcuuuaagacaacugauauguuagagagggaauuggguuggaaauguagcauuuucccgaaacauacaguaguccuuuaaaauaaaaacuuccugauccuuuuaaacuacccuucaauauuuuauuauucuaaauggaaauaacuuuguuguuuucaccuuucccaacgucuuuaauguuacaaggaaaacugucuccuuuuaacauuugcauauauucaaauuaauaacuauguuaguuucucaaggccacuguaaaaauuaccacaaacuucguggccuaaaacaauuaacaugugcugucucauuguuuggcgguuagaauuccaaaggcacuaucacuaggcugaaaucaaggugucggcagcgcuguccuuccucuggaggcucuaagaaagaaaucgucuuucccucuuucaguuccugguggcugccgacauucuugggcugcaucacuccaaucucucugucuccgugguuaugcugcuuucuguucuguucgcaucaaaccucccucugccucucucuuauaaggacacuugugauuucauuuagcaccuaccuagauaauccaggauaaucucucucucucucaagaccuuuaacuuaaucacaccugcaaaagguaacauuuccagguuccaggaauuaggauauauuuaggggccaucauucaguuuacuauaauaacuauuuuuuauauccacucaagaagagucucagauguccaugaaugaaauaaagcaauaaauaucagauuaacccuacuguuugcaaaguccuuuaaaugaaaaugucauuauacuuuacauuauacuuuauacuuacauuauaaguauacauucuacauuauacauuauacuuuacauuauacuuuauaccuuacauuauacuuugcucacagaacauuuauauaauuuuaucuuguuucaggaaguacauaaggcaguuuauauggauacuugaaaugcaacaagauaauguaaauuaaaaauagaugaaagaaaauaaaugaggauaagaagagaaaaggaagcaagggaugaagcucuagaaaaaugaauauaaucacauuacuuuuauugauauugcauggaagauaaauucuuacuuuauaaaggaaguauggcauuuuguuauaaaaugauaaaagaaccauucuuccuucugucaaacagcagcagguccagucucuuauacaggcauaccuuggagauaguguggguucaguuccagaucaccccaaagaagugaauauuggaauacagcgagucacacacguuuuuugguuuucuagugcauauaaaaguuauguuuauacuauacuguaguuuguuaaaugugcaauagcaugcuaucuaagaaaagguacauaccuuuauguaaaagauacuuuuugcuaaaaauugcuaacgaucauuugugccuucacugagugguaaguguuuuacugguggagggucuugccuggaugucgauggcugcugacugauccgaauggugguugccgaaggcugagguggcuguggcaauuuauuaaaguaagacaacgaggaaguuugucacauagauugacuauuccuuucaagaagauuuauauauagccuguaaugcuguuugguagcauuuugucugcgauagaacuucuuucaauauuggaaucaauccucucaagcccugccacugcuuuaucgacuaaauuuauauaauucuaaauccuuuguugucauuuacacagugcugugaacaucuucacugggaguagauuccaucucaagaaaccacucuuugcucauccauaagaagcaacaccucauucauucaaguuuuagcaugagauuaaaaugucauaaauuuaguuacaucuucaggcuccacuucugcuucuuuugcuguuucuaccacaucugcacuucauuuccuccacugacaucuuggacaccucaaacucauucaggaggguuggaguccacaucuuccaaacuccuguuaauguugauauuuugaccaccucccaugaauuacgaauguucuuaaugacaucuagaauggugaauccuuuccagaauguuuucaauuuauuuugccuaguuccaacaaaaaaaucacuaucuauggcagcuguuuucuuaugagauguauuucuuaaauaauacgacuugaaagucaaaauuacucccugauccacaagcugaagaguggauguuguguuaguagacgugugagcaauguuaaucucuuuguacaucuccaucagaacucuugggugaccacguaugauauuguuuggcuguguccccacccaaaucucaucuugaauuguagcucccauaauucccacaugucaugggagggagccauugggagguaauugaaucauaggugccggucuuucccaugcuguucucaugauagcaagucucacgagacaugaugguuuuauaaaggggaguuccccugaguauguccucuugccugccaccaugugagaugugccuuccaucaugauugugaggccuccccagccaugcggaacugugaguccauuaaaccucuuuuucuuuacaaauuuccuagucucggguaugucuuuauuagcagcauaagaauggacuaauacagguguguuaucaaccagaaguaauauucagaaagaaauauuuuuuuucugagcaguaguucuuaauaguggacuuaaaauauucaagaaaccauauuguaaacaguuacccaggcuuuguuauucuauuuauagagcacauuuucuaaaucuauagauuuagaauaauuauuuauuuauuuguauuugcauuuucauagaugaaaggucuugcucgguugccuaggcugaaguacagugggaucaucauagcucacugacaccuugaacuccugggcucaagcaauccuccugccuuggccucacaaaguguugggauuacagucaugagccacugcaucugguuacaguuagaauaauucauaagggccuuagaacuuuuugaauaguaagugagcauguaacuuaaagucaccagcuacauuagccccuaacaagagagucagccuguacuuugaaguuuugaagccaagcaucgacuccuccucucuagcuauaaaaguccuagcugacaucuucuuccaguguaaggcuguuucaucuauaugaaaauguguuguuuaguuuagccacuuucaucaacuaucuuagccagaucuucuggagagcuugcugcagcuuuggcaacagcccuugcugcuucaccuugcacuuuuauguuacagagaugacuuuuuuuuuuuuuuuuuuugagauggagucuugcucugucacccaggcuggagugcaguggcacgaucuuggcucacugcaaccuucaccuccuggguucaagcaaauucuccugccuccgcuuccugaauagcagggauuacaggugcgugccaccacgcccugcuaauuuuuguguuuuuaguagagaugggguuucaccauguuguccaggcuggucuggaacuccugaccuaaggugauccaccugccucagccucccaaagugcugggauuacaggcaugagccaccaugccaggccugagaugacuucuuuccuuaaaccucaugaacaaaucucugcuagcuuccaacuuuuguugcacagcuuucucauuucucucagccuucauaaauugaagagacuuaggaccuucucuggauuagauuuucacuuaaagaaauguuguggcugguuugaucuauccagaccacucaaacuuucucccuaucagcaauuagucuauuucacuuucuuaucauuuguguguucaguggaauagcaugcuacguuucuuucaagaacuuuuccuucacauucacaacuugaaucaagaggccugcuuuugaucuaucuuggcuuucacugugccuuccuugcuaaguuuaaucauuucuagcuuuugacuuaaggugagagauuugugucucuauguuucacuugaauacuuagagacuauuauaggguuaauuggcauacuaucaauauuguugugucucagagaguggagagggccagggacagggagagagauagggaaauggguggcugguggagcagucagaacacacacaggauuuacugguuaaggucaccaucuuauaugggcauaguucaugguucuccaaaacaauucugaugguaacaucaaagaucaccaaucacagaucaccauaaccgauuuaauaauaauggaaaaguuugaaauauugugagaguuacuaaaaugugacacagagacaugacaugagcccauguuggaaaaauggcaccaauagacuugcacaaccugggguugccacaaaccuucaauuuguaaaaauaauaucugugagguacaauaaagugaagugcagugagguaugucucuaacuauuaaauuauccaaggaaaaaauuauuuugcauuuuauguuucauauuuaaaauuuuguauugaaguuuaggcaauauaauaauaaaccucaaacuauggaagcaagcuguuauauauuuugauuuaugauuuuuaagaguauuauuaagacuauucauacaauuuucaaaguuaccuccuguaguuuuguuuccuguuuaaguaaagguuuugaaauaggugaugaugcauauuuuaggugaagucagucauuugcaacaaaucauauaccacuguuuuauuuuaaauuauuuuaaaaucuaauuauacaaauggcagcuguuguaguagaugggaacauauuuugaauugccuucccuguuauacaccuuauuaauuaucuggguaggcagaaucugagaauuucuucaaaaacuuauaagcaaaggaguccauuuuuguggccuauaagaagaugugcuacuuaguaauuuauaguaaauaauaaacaaauacuucagcagauauugauucauuaaauauuuuaauaaauacuuauugauuacugcaguaauagcaaauauuugacaagcacauacuauugggagggaaaagggcauagugauuaagaucccaggaugaagguaaacugccuggauuuuaauucugacauguuacuuaccauuaauaugaccaugaacaaguuauucauuucacucaaucuugguuucuacauaugcaaagugaagauaguaauagcuccaauaucauaggauuguuauggggauuuaacauguuaauacaagcaaagugcuuaaagcagggccuagcacaugguaaguaguauauaaauguuugcuguugcuuuuauuagcauaugcugaaaacuuugcauccauuauuuuaucaaaaccuuauaauaacaucaugagguagauaccuuuacuuuuaacucauuuuauaaacagggaacuacgagucagaaaaauuaaaugaagaagacaggauucaacuccaaguuuaauugaguccagagaaugagcuuaacuacuauacugcacugugccuuaaugugugcugugccacacgugcaaaggggaagcuaagaugaacuugacauggugucaucuuuucaggaggauaggcaaaaaagaguugagagucguuccuguggguuaacaccuagaacuaaugagaggacauauuuccaucccaaugggauuuuuugagugcuaaugugcuaauuagagcuaauucacauugagggugauaauagcaauaacauuuuaguguuuuuacaaaugucaaauaccauggcaugcacuuuuuuaaaaagcauguuauuuagucaggugcaguggcuccugguacuuugggaggccaagacgggaggaucacuugagcccaggaguucaagaccagcccagacaacauagcaaaacccugcuucuacaaaaaauaaagaaguaaauugggcauggugaugcaugcauguauucccagcuacuugggaggcugaggugggaggauugcuugagcccaggaguuugagguugcagugagcuaugauugcaucauugcacucuagccugggcuggacaaagugacacccugucuaaaaaaaaaaaaaaagaacaaaaacaaaaaacuccaaacauguuauuuaauaaguacaacaggccgggcgugguggcuuauaccuguaaucucagcauuuugggagccugaggugggcggaucaccugaggucaggagcucaagaccagccugaucaacaucgugaaacccccucucuacuaaaaauacaaaaauuagcuggcgggcaccuguaaucccagcuacuugggaggcugaagcaggagaaucacuugaacuugggaggcagaaguugcagugagccgagaucaugucauuacacuccagccugggugacagagugacacucugucucaaaaaaaaaaaaaaagaaaacaaaagaaaaaaaccaauaauaauaacaaacucacaaggaagguaacauuuugguuuuacagaugaugaaacugaaugacagacuaguuacacaacauucuccaacucauacaacuuggaaguguuggaguugggauuugaaaucagaaaguuugacuucauaucuugagauuucaauuaccauucuauagguacuuuguaugcacaagcagucagugugcaaaguuuuaaauaaugguuuugcuuuauuuucuauaugaucaaagaggcuuuaaacgggcagaauuuaauuguacaguucauuucauaugugggcagggucuaagucugggaauaugaaugggacuggagaucuuuaagaguaagccuugcgacaugucaaguugcggguggaggaugcucauuuaucaacagcuugcuauuuuuguucuguuuucaagaugaagaauucuauaaaaaucacaugacaugugauucuuaaaccaauacagaauuuuaucaccagcucaaacaaaagucuguucagauauguuauuccacuugguguucauccauauucagucaucucaggacuuuaaaauaaauaaaagucacaggcucugcaugcuucuuuccagaaaguagaaucuguauucuuuagaugcuggcugaaagggcuaauuucaaugaguaccccaaaaaagaaagcauuuuauugccucaugaacauuauaauuacuuguuuacacgaauauguuuuauucauuuaaccaucucccaaccauacuagcagaauaacuacuuuaagaaaauaccuaguaaaacuguugaaaaaaaugagccaucaauggauuuguccuuaagcgacucuagccaucucuguguugaauuuucacgguuugaagcagcaacugcagaaaagagggcaucugccucagucauugaucagcuggcaugcucuccaugcaggcagagguucaccauuacuucuguugcgaaauguccccaacaacaccguaaagccagucacuucuucaauuuacugaguuaagcugaucaugguggugagugcuuauagucccagcuaaucaaggugcugaggcagugggaccacuugagcuccagaguucaaacccaggcuaagcaaaaccccugucucuuaaaaaaaagauauauauauauauuuuaacuguauauauauaguuuuguauacauauauaaaacuaaaagaaaaaaguaaaacaagaaaaaauuuacugaguuacuacacaguuaagaacacauaaaaggugaccucaaaauguggauauucacaucugucauccuacuuuucauugaauauuuaagcaauaaaguguaaugauuugaaauauaugcauuaaauugagaagcauuguuaauguaccagggaaggcaggagaauauuuuaaugaauuugaaauggcuaaaaggaagcuuuggguccucaaggaaagaugaauuuuaagcaauuucucacagugugaaucguuuauaagugaugcauuuugaugcagaggaagugaaguucccagaauaaaaccacaaaucuccaagaauacccuuagucaccaacauauugcuucuuucucaaaaggcaaaaaucuagcacuuugcuguagccagaucauguaccacacaugaaaaaugcauguauauguuacaccucaucuccaaacuuaccuaugguuauuuguaucuuauacaaauuacaguuucccugacauauaucuaaaauauggaaaacucuucaacuccuuggaaauacauuuuucuuauaauuagacauuucuuuuguccauuaauagcaagagcgucuugucaaggaucauggaagcagaacugauucaagauuaaaaagauccguaaaagucacaugagauguaauucuuagaaccaguauagaguuuuaucaccagcugcuaggaaaagucaguucaaauauggaaugguucaaauauguuauucuacuugguguucguccauacccaguaaucucaguauuuuaaaauaaauaagucauaggaucugcgugcuuguuuccagaaaguaggauuuguauccuuuagauguuggcugaaaggacuaauuucaaugaguacccaaaaaaagaaagcuuuuuauugccucaugaguauuauaauuacuuguuuacauggauauguuuuauucauuuaaccaucucccaagcauauucacggaagcagaacugauucauucaaaagaaaaagccaauuugggauggggguagugggaggagaucucuucagaucucucaguuuuaaagucucugaugguuggauauuuguaguuuuucacugauuuuucucucugcauaaagagcuaauagcucauugucuauaaauauuuuccaacauuuuguuuuccaaaauggacucauuucuacauaaagacgucauggaaagaugguuuuucuuccugaaggguuaggucagcccugggaagaaguauagaccuuggcuccuguuauuccucuuuagauaucccaggguuccaacaggaaguuacaagauaccugcacuaccuguaaaguuuauuuaaaaugauuggaaggcucucauaagcauuggaggggaagaaaaacuuuuuuucuacccucuuaggugaagugccuaggagccugugaauuaaacuuacagcagacagacuagcaggagaaaaagcuuacaaaguuauuuauuuuaaauuuugcuugcacaagggugucauagaaagaaaugaauaccccaaggagugaugagauuugauuuucuguaucauuuuacuacaggaaagggagguggagaaaaggcaauauugagagagcaaaugacuucuuuaaaaaaaaaaaaaaaagauaaauggguccuuaggagaauagaugggagauaugacaguuugugacaaugucuagaagagaagaaagaguugcucccagugggaggaauuugugacagcugaguucuuuugggaaccucugcuuuuagucagauaaaggauuucgggaacucaaaugccuucagcucaaaauaacucuuaugggcuggguaggguggcucaugccuguaauuccagcacuuuuggaggccgaggcaggaggacugcuugaacccaggagcucaagaccagcccaggcaacauagcaagaccucgucucuacuaaaaauaauaauuuuuaaaaauuagccaggcgugguagugcaugccuguagucccacuacucaagaggcugaggugggagggugacuugagcuuaggagguguuugucccacugcacuccagccugggugacagagcaagacccugucucaaaaaacacaaauaaaacaaaaaacaaaaaaacaccucuuauggcaaaguggcauauuuugggguggaaaacgcugauuccuuucagcacgcaucauuugcucauguuuuacccaauauaugaagggcauuaccggaaaggaaaauaccuguuuacucuuggccuacuguguaucugguguggcuucauucauuuauaagauguuccaccaggcucuuguagcccauucucaacaacaguagccuucaaagaaggaaguauauucugagauuaggacuuguaauuuucacgugacaauuuagagaauauguagaaauaagaauacacauucagaacguguuugaaauauuguuacaaauguuucugaauuuuuacaauuuucaaagaaaccugcauguagaaaauaugagggugcuauucaucagucagaagacaugugauuacaucgugcagugcuuaacacaugcacuuuacagguccuccuaccaguaggagaagacaccaagacuccagguccuccuuuacagaagucauuguggcauccacaggguaggaaagccccauacucagcagugagcaauuuuauacauuugcaaagcaaaucuuguacuaaaaaaaaaaacaaaaaaaugggguggguugaguaacaguaaacuaucauaaaauauacaucugaaaagagauucagacauacuuuagaaaagaauuaaagucacaauauauuugccaccucaaauuaaauucauuugauuaugggguuggugacuucuuucauuaagugauggggaaauagaucaguucuaucaagcacugccaguuuaucacuuacuaucucaaaucuuucaguuagacacaaauagaacuuuguaugaccuuugcuaauggagagcaacaguagaaaauuauucaucccacguuuuggguacuuacuauuaaauaugcuuguuugcaaugaccuaggaauucacaacauaugcaaguacaaaaccuaccuuauugugacaucuggccucaggaagagaaagaacuuggugccaguguucuuugacucuugacccaucauaacgggcucaguaaccucuccccucagaugauucccugagacccaccacagggauaucuucucuucuuaguacccucuucucugaguacccucaccccucaaaugauauccugagacucaccucaagggggauccucucuucucaguccccucuccucucaaaugguguccuacaccugccucuguagaacuugcuucuguccuucucagauuuuuuuuuuuuuuuuugagacggagucucgcucuguugcccaggcuggagugcaguggcacaauuuuggcucacugcaagcuccgccucccugguguacaccauucucccaccccagccucccaaguagcugggacuacaggcgcccgccaccacgcccagcuaauuuuuguauuuuuaguagagaugggguuucaccauguuggccaggauggucucgaucucuugaccucaugauccgcccaccucggccuccuaaagugcugggauuaaggccuucugagauuuuuauuuguucuuuuuaucccuucucccauacugagggaaaauaaauguuuugguuuauguaguaggaccuguuauguauguuucaaacauaauggccccauauaauagcuuugaauuuggauuccguuagaguuggaaaaagagaaagucagcacucacuugcaugugggcgcuuucuugcucccucuuucuuugugcccuccccuuccucucucuaccccugcuuuccaccucccuuucucucucucucucaaaguaccaaguccagugcuguauucucagugcucaucuucacugaccuauuagcauaucuuggcgggguugcccacuaucugcuccuuaaagcacuuuguucacuugguuuucaggauacugaacaguucuccuccuucuucucagucuccuuugcuagcugcuggccugccccaaggauccguccuuggccugcuucuucuuucuaucuacacuagcacuguuugccaucucaugacucaugauuuugaauuggauccaugugcuaacaacuccaaaauuuauuuuuccugccuggaccucacuucucaacuucagacugccuacaugauacgucugcaugggugucugaucaacaucuugaacucaacaugucuaacacugaucuccugagcucccuccuccaaaauaucccuaguccuccuaaguucauccucauuucaguuaaugacaacuccauuucaaaugcagaagcccaaaaccuaucauccacgguuuagcuuuguuuucccuccauuauaccccauuuccagucugucaugccagcucuacuuucaagauguagccagaaugggacagcuuccuaccaccucugcugguauugccuuggucccagccuuccuuaucucccaugcgcauuacugcaggagccuccuagcaggccucccugccuugguccuggacugccuucacuccauucucaacauaguaaccagagugauccuuucacucaugguguaucaugacacuccuuccuuugaaguucuccgguaguucuucaauucacacagaauaaagggcaaagaccuuacaguggccuuuccuucuuccucuuuuauuuccuggaccucauuuccuaaugcucucucccuuaauucccuucgcuuccucuuaggaaccuuugaguuuauuaaucccucuucuucaagacgcuuccucagauaucuucugggccugcuuccucacuuucuuugguuuuuuaccuaaauauugcuugucaguacuacccuuagaucuggcaacuggacccagaucuguugggacagacaguuaucucuggguuugucaaguuucugcacaacacguauucugaucaaagguaugaacagcucauuuucccuggacucucuuuuccagguauuugcaugucacucacagcaauagcaguagccacaauaacaucauucuaccaguucucugaggcucaauuccaaaaggaugugacaaggggcagguauugccuauuaaugcagucagguguguuacaggagaguaacacugagguuaggaaacaccgagauuagguuguguaggggcuauuauguagccuagaaaaauagaaauuuuucucuuaggggcagauuuauuuacuauccaggauaauaaaggugauaaagaccagauguugggcagauuugcugguagcucucauauaaaucggaguuuccuaaucucaguguuacucuccaguaacacaccagccugcauuaacaaguaauacccagcccuuguuacaucauccuuuuggaacuggggcucagagaacuaguacaaggauguuucucuggcuacugcuauugcugugaguaauaaauugucuuuugucuaugacccagaagucuugugucuucugccaauauccaugaaacuggcaggccaaugucuuggcuugcaaguaggguaaaauucugacccuucuuauuucuaacaccuguucagagccuuugguuuuagagagccccacuuuagcccucuucuagcugagccuuuguuuagagugagcagcucguaggcucaccuauaaccugugccuccucuucuagaccauguucugguaucugagacuccagaauccccuuuccaaacagcccugagaguguuaccaggcauccaugagccuuucguggguagacuaugcugccagaauguguauuccucaucccaagagaugaccaagggcuggcugauuuuggggguggcaaugagaguagcuugaacacacaggcuaggaaacuaguucucaggugugauuccucgaccagcaucauuagcuucaccugggaacuuguuagaaaugcagauucuuaggccccacccauuucuguuucuaccaaaucggaaacuuugagaaugagccauuuguguuuuaacaugcacucuaggagauucugaugcccacuuauguuugaugauaugauguacacucaacagacuagguuauccacauacaugugcauaaggcgccuaucaaugcuuguggcagacagacccuaaggugacccccagugauuuccagcuucuguuauugauauucuuguauaauuucccuaguuagagcaugggcaagacaguaacuugcuuccaaacaacagaauaugacaaacugaugggauguaacucccaugauuacauuacauuaauaagacuucguuuuagcagacuggagcugaggcccuccuugugggucgaugaaguaaacagucgaguuggagaaacccacauggccaggaacugugggcagcuucuagaaacugggugucuuuuaggacauaaggaaggcaacaaaaaccugguucuuuaguuuugugccuccagaaagugaguucugccaacagucugcaugagccuugaaacaguucuccucugguccagccucuagaugagagugcaguauggccgacacuuugacugcagcuucaugagacccugggcagaggacccagcuaagcugugccuggauuucugauccacagaaacucugagauaauaaauauguguuguuuuaagcagcuaacucuguggucauuuguuaugcugcauuugaaagcuaacacagggcagggcuccgugugagaggagaggaugggauguauauuuuuuuuugugcucuugccuugccuuggguucugcaaguguuggugauggucugucacggcccuucuauuuaaaacgguacccuuccccuacugccuccuucccucccucccucccaccuucuuucucuucuuucuuucuuucuuucucuuucuuucuuucuuucccuuucuuucuuucuuucuuucuuucuuucuuucuuucuuucuuucuuucuuucuuucuuuucuuucuuucuuucuuucuuucuuucuuucuuucuuucuuucuuucuucuuucuuucuuuccuuccuuccucuuuccuuccuuucuuccuuucuuuuccuuccuucuauccauccauccuuccuucuuucuuucuuuccuuuuucuuucuuucuuagacagagucuuucucgucacccagacuagagugcaguggugcaauccugcuaguguuaaacuucuggccucauaugauccucccauggcagccucccaaaguauugggauuauaggcauuagccaccacaccuggccuggauuuuuguguguguguguguguguuuuuuuuuuagcagcuauuucccucuuucaugcuauauauauauauauauauauauauauauauauauauauaauauauauacuauauggcaugaaauuagguauauauauacaauuauauauauaaauauauauaauuauauauauauaacuauauaauaaacuauauaauaaauuagguauauauauauauuuauuuucuucauugucucuucccacuccuucuaaauguaaguucuacaggcccaagauauuuugcuguuggucacugcuuacucuccagcaccuagaacagggcuugacacacaguagagguucaaucagaauuuauugaauaaauaaaguaagcuauaauguuuuugaaagucuacuggcuccugguaaaugcuccacugaaaucaacagguuuuuccuacugucuuuccuuauuauuagguaauugcaugaaugauaaaaauaaaugagaaggaaauaauuucaacaaaggaguaagcaaaugaaaaaauguacuucauucccugcccuucccccauuaaaaauaauacauugacucuggguuugcuguuuuuacaagaccaauugguuuaucgaucaauauugcaauugaauguaacccuuaauuucuaucagccugucucuucucacucccugguggccuggcugcuguguguuugugugugugugagcacauguucacagaaggaauccaagaggaagaaaaguccaacuuccuauaaaucugugccccauuuuccuuucucucuuuucuuaauuacaaggcuguuucuggcucaaucauuuaagccaaagaacuuuccgcuuugagucaggcacacgguccaaggaaugguuuauagagcagcuugguuguccucccuauuguaaaucuaaauuuuugucuggguaauuguuuucuguuguucucugccauuuuucucuugauuaaacccuuuggagaggcagccugaugcagagagugcccuggcccaagagccaggaggugcagcuucugaucuugguuucaccaccacucugccacucccuucucagguccucuguuugcucaccucuuucuuacccaagaggguuggauuagucgcccuuggagauccugcccagcucguucuuaagaagccuguuuaaacuccuucaauaggugaugcuuuuuaaauauauauauaugcguacauacauauauacaaauacauguauuaagcuauuccuuaaacuauguuugcuuuuuuauuuccuaugaggaaagucugcagucaaguuagauauuuucauuuuuuuaaguaaguccuaaaaugcuauucuagaugcugauacuucucguuuaaagaaugacucugcauacucacauaaguaauuucuccaaucugagaugacuguggucauacagaaggaagucaggaugaagaacacagaagaaagcaaacuaaagggccugucacauaaagggauccuagucuagugacaaagagccuacauguugucacaaagauuuggauucauuucccagugcagucccuuauuagcgaugugaccuuuaacuuccucaagucucaguuugcucaucuacaaaaugguggaaauggggggcccucgauggaucuugugaugauugaguggcaugaugcagaugaauugcuuaugacugugcuuggguacuauuauggcaaugaaagagaaaagcgagauucauuuaucaauuucucaugaaauaugcauuuaauauccccugugcugggcccuaaaguaggcacuagugaaacagacacgaaagaaccaaaguccuuuccuuugugaguuuaccacccuauuuucguuauagcaguuaggugucaaguaacuauuuuuaaugcauucuuuuacccaaaaauuuguuguacuuuuguaugcuaccuaccacaaaguuaaaaauagcuuucuggagcuaaggaaagaugaguagguugaagauagaaauaaauauguaaguugacggaauuuggcuaucuggccugcaugcaaaucugaagcaucaauuguaccuacuaaaaaagaccgaaauuuugcuaaugagacaauaaauguuuuaaaugguugcugcuuuugguccuucuuuauuuacuaggaugaaagcuuaaagauuugcauagcagauauacaaagcaauguucauuguuugguuacauuuugaggaagaacagguuaaauguuuugcuuacauuugcauugcugcuuucaaaauaacuuaguagagcauuggggaaaaugccagcagugcuuaccucuucaguuagcagauccuauuuccggucucuuguggcuuggauguugaugauaacaagacaggcuugcugaaaggagugcaaagugcauggggaagggugcauguccuccauggcaggacuuugacaauccuggugucuguugcuuaacaccaugcuucagaccucuaacugaucugauuucagcucuugccauuuuagguauuucaaaaaauaaggcacaaaaugaaagcuuuuaauauguuuguguuuauuuacauauauauguguguguguguguauccuaucauuaucuaucaccuuuacucugccuuauuuuucuucacaaacuaugacauuuuauauuaugcauaaucauuuacuuuuucuccuagcuagcauuuaagcuccuugagggcaggggcuuugauuguuuucuuuauugccguauccccauaucuaaaacaaugacuguucauggagagcacucuauaaauacaugcggggaaaacaaugaaugaaugaauaaaugaaugaauaguauugagugcauauagcauuauauccaaccaagcaggugguagcagcauggacguuucaacuuuuauaagaaaugaauaguuuaaaaauuuuauaaauuauuuuaaaagcuccuaaaauuaaagaaaugcuagggugauagaauuuucaguacucuaccacugguauuaaauguuguucccaacacugaaauccugaagacaauuuuaagcuuaagaguccaagugugucaacauaaagauagaaucuaggguagaacuaaguuacccuucuuaagaaagagaggaaggggaaaauaugggaacuggggaggaaauuauucacaaagagugagcuccagaaggaaaaauaaauagggagagaggacaauaugccuggaggcuggagagauaaacauaggacaagagaugcuucuaauguuuucccaggaaaugcuauaaaccaacuccuagcuuccccuaugaaaugauuaguaaauucugcauugcucauucaaacuuuuaugggauuagaguuuuguuaugggagagguuaaaaggaaagaggucacuggacagcugauguauauuuuacaaagaaauagguauucauuuucucccugucuccacuaaacaaauauugaggaaauucuuacagacuaucagcaugagauaugcagcugagccauauguuuugagugucccuguucuucugcugucuugauuuggagguuccaacauacuagaagagaugaaaggggacaauguagccgaaucccauggggaugaucucuuagauugccauggacucuuaagcuuaaaauugccuucagggugauuuucagggugaucacagaccuuggauuggcaacaccuguucaaauuauuuuaaccuggcaaaucaaagccucauuuauagaaauaaaaaugacaauaauuugguggcauuuucuuuuauaaugcacauguggccugcucuacuuagcuaguucaucgagauuuaugagaaaacauguccguauucuuguugcuuaaaaacauuauucugcauguugcaaguagucacugaacucaacuuguaaaaggcugauuuccuucccugaaugugccaucuccccaaguccucacuuauagccugcuaggguuugaaauauugaugaguacaaauccauucaucuccaaauuucaguggccuuucaauggagaguauuuuuagcuuuguugagaauuuggggcagaggaaaucacuuucagaaauagcagauuauucuuuuaguuuuguagaacucgagauggaaucuguaaaaugaaucuuugaguccuugcuggccuuauacuaauacaguaguauaagaucauuucuguguaaguaacugagagaguaauuuaagagcguauccuuucugcagaaucuaaucuuaauacaaauagauguuaaaauuccgauaaucaacuguuuagguccugugugaauacuaucauauauuauuaaacuaucucuggcagccugauguggugacucacaccuguaaucccagcaacuaugggaagcugagguagguggaucacuugagcccagaaguucgagaccagccugggcaauguggugaaaccccaucucuacaaaaaaauaaaaaaauuagcugggugugauggugugugccugaagucccagcugccugggaggcugaggugggaggaucacuugagccuaggagaaugaggcugcagugagcugugauugugcugcugcacuccagccugggagacagagccagaccuugucucauaaauaaauaaauaaauguaaaaaugaaaaaagaaucucugucaucuuaauggauacaguaacggcugcuacuuagcuuuuugaguuuugagauacauucacccguacauuggugaaguccacucuugaucagacuugauggcuagcucaucauuggccauuuucucagauuucuaaucuuccaaacccguuuucuacguucccuaauuuagagcacuugcucagcugguuuuguccaccugcacugcuguuacccucauuucagcuugucagaucucacccauauuguugacagugaacuccugauuuuuccccuggaagucauccuccuuuuuuuucucaacucucacagcauuuuuaaucuuuuuaauguccuuaaaaagcagcaucauaauuuagaguuggagaggacuuaaugaauguucuaauacaaucuccacauuuuguagcuguaagcacuugagggaugaggagauuggccugagcuaguaucuuauacaugggaaaaccagaaaaagaacugagguuuucuuacuacagcccugugauccuuucucuguauuaucagcccuucaccuucugcagcacauugcaguuauucauccauaugucuuauugaagagacuguuuagaggcuuauuuuuaauuaaaaaguuaacauuuuuaaauuaaaguuucagguuuagaaaauuuccacuuuuaagugaagcuugcaaguguuauacuauuuauaaaauuaacaaaccauuacuuuuaaagcgacuuugauaaauaugauauuuaaauaguaugauauuaacugauauacacauucaauuaauauacucaauuucauauuuaagcacuucaauuuucuauuugacuagccuuccuaaguacuuaaaucuuauaaauuuaaaagcuaaguauauaaaaagugaaucuaaaaauucucuuuagcuguuucaauauuacuuacaaauuuaguaacauuuccacuuaaaaaucccaaguuuaagccauuaaccaaauuaaacauuuaaaauuauaauuauaagccugauagucucucaauagaccauauucuuucgaucauaauauaaaauaacaaauauucaagugccuugucacaaaacgacuaguucuaugauuuugcuuuauuuauuucuucauucaauaauuaucuaaaauauaccugugugccaggcaauacucuaggcucuagauaaacauuagcaaacaaaauaaaaauuucuauucuugugaggcucaaauucuaaggaaggggcaaauaguaagcaacauaaauuaguaaaaaacauaggccaggugugguggcucaugccuguaaucccaccacuuugggaggcugagguaggaggaucacaaggucaggaguucaagaccaaccuggccaauauggugaaaccuugucucuacuaaaaauacaaaacuuagccaggcgugguggcacaugccuguggucccagcuacucaggaggcugaggcaggagaaucgcuucaacccgggaaguggagguuguggugagccaagaucacaccacugcacucccgccugggcgacagagugagacuccaucuaaaaacaaaacaaaacaaaacaaaacaaaacaaaacaaaauauauauauauauauauuuggguaaauguuaaagaaaaaaucaaugaaggcaggaugugaaaugugagggauggguggaauggugguugcagaugaugcuaccuuuuucuaggauuaauacucugcacaaagaccuuauuaauuaauuuaggcuacuucccaauagagagguguuacauucugaguacacuugagguuguacaaggacuggagauuuggcuuguuauguugacuggauucccacuggugacucuggugaauacucugaacuuauuauuguuuguccacaacucccugacuuccaaagggaaacuuguagcccuacauuauuugauuggauuuuguaugucuuuggcucuuaaaauaauguaaacagacuucccacccaaguggaacuaccuuugacacagcccugaaguccuucagauucuucagaccacucagucuuaacagacauaucuggcugaauucugggcaucccucuugguuuuguccugaaauguggacacaauuuucccagucacuuuccugauuaauuuuagcucuccaagaggauggagaacuucaagaggacaaauacuauuaugucuuagcucuguuuuguuucucauuuauuacuguguccugcagaacacaauggguuuacccaaguagucccucaauacauguuguuuaaagcagaauagugcagcucaaugacauagggucaugucccacucagccucuugauugcaggcaacugcucaaaaacuggacuuccucaagugugaaaaggaauuauaagaaucccuaugugucccaaagcacugucuaaacuaagaaccacucuaugaaugcuaguuuuccuuacuauuaaugguuuaaugcuuauuuuaaaaaucccucaaagcauuucacaagcagauagucccuuucccuuuguauuuaggcuucaggauaauaugagcgguaccacuguuuuauuuuuacaauacugaucauuuuaucaugccuguuguauauucagguguaaguucuuuuucacaggauagcuucaauaugucaggaugaacuuucauuuauuuauuuucauucaauagaacuaacuaaauucuuuuucuguucauucaguuaucccacucuaaauaccaggguucucuuuauagauggaaaugugaagaaggcagcucuuacuuaaagggaguuuuuuucugcucucaugcacuauaccauuauuugggcauucuaaggaaaauucaggagugguuuuuuaagagggcuguguugcucuggggagcaucaucuugacaaucuuguuaagggaggguguuugaaagccacuucaacuagaaaacuuacuuucuaccuggagucugagugcaccuguauccaucacuggacggaacucugaugcuguccugacaaugcccuuucaugaccuuaaccuguggcucuggucaucacuguuccucaguucucacucuaucacauggguaacuguuguacucagaggcuuugggaguccucaaaugucucacuuucccucugucauuuuaaaaacugcugcacagcccuuguuuauuucuauguaauuauuacuucaucauauaugauguuauaagccaauuugauucuuuuuuggggagaagguggaagcgaaggaagauaggaaaagaaagucaggcucguacuauuacauuuucacagauuuauuugaaauugagucuuucccagaauuaucuaccaccucuuauggucaguuugacacaguuaaugccaagcacaguuuauaacuuuuuaaaauugaucaaaaauuacccuaacuuugaagguccugaaauuacugacacauauaagaauuugcaaauuaaauguggcacacaguuuuuaaauauacauuuaccauacacacacacacauauauuauauauacacacacacacacacacacacacacucacacacacacagagagggagagcuauuuagccuuuucuugauagaggacguaaaggagaguguuaauuaccccauucuggagaauucaacuuacaauggaaaacaugaaggagagcuguuuaacaucugcauaaaacacuuguuuccugguccuucuaaugaugcauucagguaugaaaaauguuuucuauuuacuuguucagaauuauuuuaaauaaaggaagaaaaucacagcagcuuccugcuucggaggcccacagaguugcagccaaaugacuugcuauuaucauaggucuuuauguuugcugaaugcuuuucaguauaucugauuguauucacagcccuuucugguggcaugaaggaggcugguguugcucuugugcagauuacaaagcuagaaccagaggaaggggaagaaaugauggcuuaaggcauucuuagaaguuggguucgagccuacaguuuguuuuucucuuuaagaucuggaaaggugaagaaucugauggcagugaacccaguaaugaauacgauguuaauauuauaauguuauuuauuuuauuuacuuauauacuauaguaauuaauuuguaguaauuaaguaguaaaccugauaauaucugaucuaaaugauuagcauaaagaacuaugucaagaucaaaauucaggaugacuaagaggucagaacauaagauacucacgcagaaggauguaggaauaaccaagagaacugaaugaccucucuaagagcaccaagaaacauuuacgccaggauacacaaagaacuaagacauuugagggguuuggcgauggugucaagaggugcucgcuguuuuacauuauuauguauaugcuguccauuuucuagagagcauagagauagaggaaacaaaacugagacuuaaucaacaucaugggauuuaaauaucaaacuaugaacagauaaagaaugcauguguuuuacacgaguacugaggaaagaccuaaauugaagcauguguuauuuuacgauaauauuuauuuacucacaaacauuugguaaacaucuuccuugugcuaggccaugcauagauucuggggauacauaguguuuuucugaugaacuagaauggaugcuaaauuguaucagcacagauaacucugaauaucuaggacuugccaguuuacauuggcguggugcaagccauagaucuuuggacauauugucuucucccagaucaucaaaggccaagauuuuccaggauaacugggagcaagucaguauuagauucugcacugacuccacgaaccaagguguuucagggauauuaggauaauuuuagggcaauggaguuugauuuggaaaguuggcuuugcacagccacuccccagauggcccuggucuagaucaccccuucaugucaguuuuuauggacaaggcuuccccucggauaccucuggcauuagggaggcacagauguacuucucugcagcuguacuuucuagaaaccagguaaggauaaugaccaagagccacuugaaaggcagguagguauagaugaugaguaacugccuggggccuuuuaaaagcuaauauuuauaaacauauauuacuuggcugggcaucauacaaaccaauuuaaaccaauucugugcuuucucuagggcagaugugcaaacaucagaagcauguagagcccagggaaagcaugcaaacacugaucaagugcacagcgcugugugacuuuugucacuuuucaugauguauaagcacagcugccuuuuuuaggaaucgugagcuggagucgugagcaaaguguugcaggaguagcauuuuucaggagagugaggugcugaugaguguuacccucucugguagucaggagaggaucauugagggggugguuuuugagaguugguuuaagguagaaagggagggaaccugccaucuggaagugugaugauguuccaggcauuggguacagcuucuuaaaguggccuuugcuucuggaguaaaugaaaaaaggggacauuuaguuaacuugacugagagaagcugagagagccaggcuguugagagcacuugauuagcugucagauaccauucucccuacaguuucuuggccucccagcccugaagaacugucaguaaauauugccauacaggaucgauuccauuuaaucuuuuccaaaccacaacugugcaguaggugauggcaucaucauuucacagacgaguaaacagaggcccagggaacuuaagcagcuugugugccaaguauuuaaaaauuacuguguguuuacauaucacauaugaauucacacacacauagaugguggggauuacgaaugcaaggaauguuauuuuuugaguccuuuauuccagucacaguauuauaaacugugaggacagccaaaagacaaauuccccuuuuuugaggaauuuccaauaugaccagucuuuauacaauaaguaggaaugaaaagaauaaaagcaacauuaaaaaugcaugaagaacacugaagcacccagaagauuucaguguggccagccugggacagggcuaugcaggagaacuuuugagcggugagauuggagccaguuuuuguaguuagaaauggagaccaggugugguggcucacaccuauaaucccagcauuuugggaagccgagguggguggaucacuugaggucaggaguucaagaccagccuagccaacauggcaaaacccugucucuauuaaaaauacaaaagaucagcuggacauaguggugugugccuguaaacccagcuacaugggaggcugaggcagaagaauggccugaacccaggaggcggagguugcagugagcugagauugugccacuucacuccagccugggugacagagcgggacuccaucucaaaaaagaaaaaagaaaagaaaugaaaugaaaugauaggcuauauguauucagaagaagcacagauagaugaagagugcccaguccgugaagggccuugaguagaagcacaugauguaguucauauucucuucaugacucaccagguucuuaagggaaguauuuuuaaugaaaacgaugaacaaaaagcaucacgauuacaugagauuagaacuggaaaacauaaaaucugugaaggugacuaauauaaaacaauaagaaagagaucaacuuuuagcaaccuuuuuuccgcaaaguccaauuccuggcaacaugguugacacugaaauguuggauaaacauaaauggaauaaauggauuaugauagugauugggaauguauacgauaugagcuaaaauauagauucuugauacagaagagacauauugaaagaaaaacuuugucuaaaauuaaaaauauuaaauuauuauugucucaguaaaaucuggagauucuauggggagauagggagagcaucuaucaaucaggguccaguugcagaggauggaauccacccgucuauuuuaaacaagaaggaauuuguuacagagccaugguaagugggccucagaaccauugcacagcugaaguaguagacucuaaacugagcuuucaugaacaacucucaaacucaaagcugcucccagaacuggggccccacauugaugcuaccauagcaacuuauuaagaagcuauuaggaucaggaaggcacugccaucaggaccugccucggcaccaagcaguggauccuuucaucggcuccauaacugcuccugucugcacuagcaaaauggaugggauuuuuuugacaccacauaguuaggggcagaaaacugggaccucagccacagaaaacugaugccuccaagacugugcuugacuguaggaacagcagaaguggcugcucucucacaaaucucuuaggaaggcauuucacugaccaagccaaaguuaccuuuuggucuguggcuccaaagaggccagcuuccagcacuuugcagcaaaggcagguauguccacacagagagggagaagcaauguagcagcaaguaucuggaaggaagaaauaguugguauuuuguuugcauaugauaacaaacacugguuucauuugauuccuaguauuaggcauuuuguuuucagaacauuuuaauacaauuauuugugaagggaagguaacaacuuauagaauugaaaacaaugauggaacguuuacauuaacaagagaaaaaaagguaauaagcugaaacucuaccuagccagcaaauaguagaggaaaagaggagaaaccaacaaaguaaacuaaauuguaaauauaaaauaagaaaaaaaaaugaaaaaaaaucaagugcaccauugcuacauuaaaauguaaaaggacuaaauaccccauguaaagaaagauuaggaauguguuggaucaaaauaaaagcacacaugaguugcuuacaaaaacuauaagcaauauuucuuaaagguuagggaagugaaaagaugaacagaaauauacaagacaaagagcaaacaaaauaaaaacacuaagagcaauuuguauuggaaugaaagcauaaaauaguagaaagaggagcaauuuguaaagucauaaacuuccauguccaaauaacacagcaacuauaaaugcauuuuuaaaaacugucacaaugcaggaagaauugauuaauaauuugguuuuauagugguauauuuuaaugaguagauaguagauaacagguuaggacagagaggcuuugaugauccaauuuagaaacugacuuaguagguauauaucacagaauuuuauauagaauuucauguccuuucucuagcuuucuagugccaugaaacauuuagaaaaauuagucaaguacuuggccuggagaauagcuugaaaaauucaaaagagcguuuacagaccacauucuuuaaguauugcccaauaaaacuagaaauaaguauuaaaauauaaccaaaaauuuuaacaacuuggaaauuaagaaacacacuugggacaaagauaaaaucagaaugaaauucugaacuaucuagaaaacaaugaaaaggagaacacuucaaaaucuaugagacgaagagagacugccaauaauaaaaguugauacauaagaaacuagaaaaaaaauacaccaaaagaaaagauaauuuaaaaagauggaagcagagauuaaugaaauggaaaauagcaacaacuaaaauaguagaauggauaaauaaauucaaaaguuaauuugggguaauauacaaacccccucugaaaccuuucucuagagaaaaguuagaaaugagaaaacaaacauaaccaaaauauugaagaaauucuagaagauagagaauaccauguauaacuuuuuggaaauuugauuuuuuuuuuuuuuuuugagacagagucucacucugucgccccagcuagagugcaguggcaugaucucggcucacugcaaccucugccucccagguucaagcaauucuucugccucagccuccugaguagcugagauuauagaugcgugccaccacgcccggcuaauuuuuguauuuuuaguagagacgguguuucaccaugucgaucaggcuggucucgaacuccugauccaccugccccagccucccaaagugcugggcuuacaagcaugagccaccguggcuggccuggaaacuagauuuuuaaaccuagagcagggaucugcaaacuuucuccguaaagaccagagaguaaacgauuuaggcuuuuuggaucauaccgccucugucacaaccacucaacucugucauuguagcacaaaaggagacuuagacauuguaauaucaaauggguaugacugugauccaacaaacuuuauuuaugaaaauaggccauggguggauuuggccugcaggucauaguuugucaaacccuggaccagaggaacccaguauagcaaaauauaaacuaccaaaauugagcuagggaaaauuuaaaacuugaauagaugaauuaauauuauauuuaguguaauuucaguuaaagucccaacaaagauauuuugaaauuagauugugcucuuagagcaucuauugaagaauaaacugugacacaugacaaaguguuaugauaacuauaagcggaagaaauugccuuaugugcuguuaauauguaccauaaagccaucuuuaucaaaacggugugacguugacaccauagcuaagcacuaugugacaccacauaguuaggggcagaaaacugggaccucagccacagaaaagucaaaaugugacuuuuauuguaugccuuauaaaguuaauuuuauauagauuaaaaucuuaaccaaaaacuauaacacaauguaaauauucacagaaaaaugagaugaucaaguacaacguaguaauuggggugacuguuucagccaagggauuggaaaugcaaagguacaaaagaaaaaaauaggcauuuuauccuuuaugaaaauguuaaauauuugcaagaaaaaauauaucaucaaauuuaauagacaaacaauaggugggagaaaggauugcauugcauauaccaguuaauagauuaauaucaauacaauaugaaaaaaaucuaauaauuugauagagcaauagaaaaauaggcagauaauuugaaugaguaauuuacagagagcaaaaauaacuggccagccguguaugaaaagucuuaacuauauaaggaaaugcagauuuaaguaacaauauggcauuaugcuauaucccuuggacaggcaaaauauuaaaaguaugauaauuccaauugcugacaaggauagagaaagaguaguuucaugucuugcugguagaaaugugaauuacuacacucuuuuuggaaaauaaucaggcaacagcuaauaaaauuuaaauucuucuccuggaacuaaaauuagcuuaaguaaugauacguguacaaaaauuaugcauugcagcacugguuauaguaggguaggcagacccucucuucagaaaaaaauaaaauaaaauaaauauccaucaaaagagcaauguuugaauacaugcgguauuugcuuaccaugaaauauucagcagucuuuuaaaagaaugaauuuuaacuccaacauuuggcacauacauuuaguaugaauggugaagauuaacaagauggagaggaguuuauagaauaugaaaucauuuuugucaaacaguggcaaagacucugguauguguauguauaauuauauauacuguaguguguauguauaauuauguuguaaauguguauguacacacauacacacacacauugccaaagaauaaaugaaaucuuguuuuauuuuaaauccagaaagugucagaugcacuuuuauuuguaauccccccuuaaagagaagauauuaguuaaacuacccucucaaacacugggaaacuaaacugagauuuuuuuuuuuuuaaugaugucgaggaacacagcauuagcugggguaugguggagagugggagagcauuuacauuuaagaauaauuaauagagaucuuguuuuagacguuucuauugagaagagguccugguuuuauggcaucaccuauugaaugggaguaucccauaguuagccaagcauauauuaauuaguacauuccgccaaagccuucagcuucuuagguuuuggaaccaguuaccauauuuggaaaaaaccagugacucaaauggaaacuuuacagugcuucucuccucuguuaagauauccacgucaucagcuuguuauccaaguggaaaggcacauuuuuauccuucaguggaucugucuucuucaccuaguaagagcugauucuuccucccacagcuguguucuuaguguagcuaaaagugggugcacccauccuguuuacuccuacccuuaccuucuugaaaagagggaauagauugguaguaugugaacauuuagauacaaugugaaacaauaaaauuaaauauccuucuuagaagugguuuucagacuucucaaaaacugacacaggguaacaaauacauuuuauaucacauugaguuguguuggugugugcaugccugugugugugugcauauaaaauaaugaacaaaauuuuaugaaauguuacuuguucuuauuauaugcauuccaaacaauuccuacucucuucuagucuacuuuauuuuaucucauuuaaaaaauacugaucacagcacacugaguuggcuuaguaacccacuaaaugggguagugaccugcaguuugaaaacauacugcaucaaaggacuccuaucaaaguggcaugcauggcauuccauggucagaagauuuucacuggacuggagagacaguugcucagugaggucaaauacagaccuaggcauguuuuacuuuauuucacauaugccaauaaggucagcuuaugugaaagaccuucugacagcagguuccuuaagguaguuuuaaguuuaccuugggccaaagccuugcaauacuuuuagagaauuagcuuaagcuagaggcaaauaaauuuuaacugcugugguagaugccuuagcuaacgauuuuucuccuacaguugggacugucaugagaagacuggucaucuugguauaaauagaaggcaucucaguugauuucaacucugcccuaagcuuucuuggauuccucucccauuuaggcuuuaaaagaauaagcuaaaguuggaaaaagaauuuccauaugaaacuaagcaacacuuaaguauauucuuuuauaauaauaaccccaguugggcauauugacuacuuaauucuucauaaucaguagagaucaguuguacacuauucuaaauacaggauuugugugggucauaagaacagaggugacuuauguacaggcauuuaaaguggaaguguuugaaaaucuggcucauacuuugacuacaaaguaaaaugauguguguuauaucuaacuggauuugggagcaaagaauuucaaaaagccaguggaaacuggacucugccuguggccucuuuuacaauauaccuaauuuaagauguguauaagacacauuuuuagauauucacuaggaaaacaaaggcuuuucuauccugucauuuacuuaauuuuuuuaaccuaacuuauuuuucugaaugauuaacauugaugccuuugauuguguggguguugucaaaagagaguucaucacauggggaaagguuggcaaccucucucugcuugguacuuuuccaugagccuccuuucacuauucucauuguuauuuccuuuucacucugaaguaguuccaaaucugauacugaaggaacucgauuuuauuuuacaugaauauuugaaguaaauugagccacuuguguuuuaagguuuguuuaguaugcacuacacagagaagaauauaaaguaaaagcaauagcaauaauaacuuagguuugacaaaacacauaacaaaaaaggguacuuugagacacagaaagucaaauuauagguaacccuaaaacucaccuuuccacuuuccuuucuuuacuagaauucucuaccaacauuggggugucgguggugguuaggacagaaggaaguauagauauagcuaucugcuucuaagacauuugccaugucuuucuauggcugaagacaacuucaaaguaacuaaaagugccacuggaaauaguuucugugaacuauauugaucauaauuugaagaauuucuaccagcugugacuuugugaauggcaggaauucuuaguuuguaggacugucaaaauaugaccccaauuuugugaccagacccaaaugaagccgaccguugucccuggugguccauuuucuguuagguucuaggucauuuuuuucugaaaacaguacugaaguugguagcuugugggagucacugcaacaaccaaacugauaacgggaacccaugagacucagagccaugaagacugucccagcacgcuuuacagcagcagucccuaaccuuuuggguaccagggacugguuuccuggaagacaguuuuuccacagacgaagguugggggaugguuuugggaugacucaaaaacauuacauuuacugagcacuuuauuucuauuauuauuauauuguaauauauaaugaaauaauuaugccacuuacccuaauguagucagugggaguccugagcuuguuuuucugcaucuagauggucucaucugagggugauggaagacagugacaccaucaggcauuagauuuucauagggagugaacaaccuagaucccucaaugugcaguuuacaauaggguucgcacuccuuugagaaucaaaugcugccacugaucccacagguggcagagcucaggcuguaaugcaagcaauggggagccacuguaaauacagaugaagccuugcuggcuugccugccacucaccuccugcugugcggccuuguuccuaaccgccuguauguagcccagggguuggggaccccugcuuuagaguauguuguacugaauauaucauucucuguugcuacaucaagguaacaauggcaccaucuacucuuguugucuugacucuacauauuaacuauagugauuuguauaucguguaacauuauguggaaucuuaauaugauuuuaaauucacuuguccucacaacuacaguuaacauuucucucuuacauggaaucauuccuugcugaucuuggguuuucuuuucuugcuguggaguugcguuguuguuuauuuuguuccagccacgcuuucuuuauucucaguaauacucuuagcccaauuuccugcugaaugauuuugcagaagaacaaauuguccuuuggcauuugcaccuguaugucgcucauuguccacuugcuugauguguuucugugaaagggggcagcuuuuccuuuucuaaaugaagaagggagaguccaaacguuuuuuuccagcucccaucaaaauauggacuuaauuccuuuucuuugauuuugaaaggaaauggugaagggauaaugauguguuuaaaauugggugaauuguguucuuucuucuaacugaaacagugcagaggaaccuacccauugugaaauguuacuugugcagcauuguagaugugcaagaacggcaguguuuucuacuuggcuggcuauccuggcauauaguucaucaaaauagagaaacagggugcagacauucugaguguaagaccaaaugaacucuaagcauguuuaccucccuaucaucugaggagagagagagcugggagugaaggaagaagugaacaacuguggaaugucucccuauccucaguggccuucagauaccucuguuuuuucucccccucccuucuguucauugggcacugacauaccuugucauuacaagcuauuauuauuuuuuaacaagguaaguucaagaagaaaugaaaaagagccaguauucauacuguguaauagcauauggacuuugcuauucuaaagcagaaucuaaguagaaucaaaagauuugaacaaaauuaugaaugaaggacccugacauaucuacuaaauagucaccagcuuucacgauagcuucuguagcaugccaggggggaagaaagccacguucuuuccucacuguucccuuagggccuuuguuguaggagaauagugggaggggcugagguuggcuuugacuacaaguggaaauuuuuguuuuccugaugagccuggcacucaggacacuagacauuuaacuguagguuuaugauugucacccacucugcuuuuaaugccaagaguuucagaacccggcugaccugagcagaauaaaguucuuuggguucaaucugcagcaaucagaauuuugagaacaacaacaaaaaaaaucuuuuuuuuuuuuuuaucugguguugccucagcaggauccccgaauguacuugcugguagcuuagagcauagucuaugcaggggaggagaaacagaguugcagcugugaugugacucauucauacuauguucuuuuaauggagaaaaaccugcagugacaucaucuggccaccagggguugugcuguugccagagagcccuugauuuuaucugcccgcaaguccugaggcaggaaguagcaccuuaacagagagccccaucuucauuccuaagaaaaccagcaucaguuuuuuguucccuuuguugacuuuccaacuagggcugagcccgcuuuucugaauuaauaagaaccaagaaagaaaagggaacauuagucgugguuccaaauaccaaccaagcacuuugcugcauacggucggcuuugguggcgggccugagucugcacccagauggacccauauggacucaccugucucacaucugcaccugacuugcacauauaccuuguugauaaagcccagugacagcuggaucuaucacaaaugucccaccugauuucuuggaagcuuugauuagcauccauguccuccauggcaaacauuuaauuauaagggcugguuguugauaauaaucauugcuaacaucuauuuauuauccuuauguguuaagcauugugcccaacagcuuauacaauuuagucucauuuaauccuccaaguagcuauuugagauaguuacuauuaucuuucuuuugcagaugaggaaagugaagcauagagaagcuaacugugaugacugggaucacucugcugauaauuguguugcuaggacuagauucaggccccucuaacucugaaagccaaccacuuaaaugauacuugauuuucaaguuggggggauggaggcuguggcuaagaccugucccuggugggguauagcagaaggacuucggggcuuuuuuguucaaacugcuuauguuuauguucuccuuuccuuucccucauccuuuccuucucccucuucugauaugcuuucuggguaggguggggugagguguguccguugcugucacacugagucacuguuccucaugggugugccauagccuucaggaguauugggaugggaaaauagcugagaaccaguagacucaagaaugguugcaaaagucccaagcagcuuuucugugaauuauugccuuuggugcucucucugugauggcagaacuucacaggccaccacacugcugugggugcugaggaagggcagaaaauagccauauauauggaaaacauaugccuguuacaaauaugaaaauauauacaugaaaagauaccuaugcaacacacauacagaugaaaaauauaugcauauauuuuaaaaauauaugaaaaacaaauauauuaauucauguguguauauauguccuccucucccaauuccagcaucaguguugguaagagugcaagcuguuauacauucauuaugcaacugguuuucacugagcaacugcuaggagccuugcagagugagcuggggcuuugguggucaugaagcccuggcccggggcuucaaggagcucacaacccaguggguuuuugcuuuucuugaggcuaacacugaugguucaauuuauagaucaagucucuucaaucauaaugauucagauaaauagagaauuuuguggaaaagucuucugaauaguuuuuuuuuuuuuuuuuuuucuaaaaaaacaaaaggcugauaaaaggacaaggccccaugcuuuuuaguuucuaauaguaguggacuggaacuacuuguggauuuugaguuuuuguuuuuguuuuacuuaauuauaggauuaguuuuaggugugacuuuuuccauuuccuuuggaagcgucuaguuugcaauaaauuagaaaugccagcugacagcaggcuaagauccagaagaaccauuaacucaccauuaacucuacagucucagcauuacugagcuuucuguuuaaagguuaaggccguuuauaacucaacaaccccucaggucauucaugaaauacaucgcagcaccaagaaaguaguguuuucuuccuuaaacacaucucuuaucccaucauucuucugcucaaaaaucugugcuucucuacugcuuccagacuccuuaccauggaauucaacguccucuaugaucuggaccaaauguccuuuuuggcguauuucauacuauccuuagguuccccuggaacccugaccccaggcaaucaagcagcucuugguucuuucaauguaccugauacuuugccaaugaucuuccauauaagaugcccucucuaccucugucuaaaucuuauuuuaauauaugugcugccgaaacgagaaugaaaucuuccuacuuuguaagaccaaacucagacaauauuaccucuaugaagaucuuuggugucagcuauuggaauuaaauauuccuuauuuguguuaauagcacguaguuuaaaccuugguuaaagcauuuaauguuuucuuuucuuauuuauaguuaguuggugucaaccuaaaauaaucaaaagggucagaaucugacuuagagagaguuuauucaagggcaaaguuugaggauagcccaccuauaaacaccagcuccaaaggaauggagucaguguucugaaguagggaaguuaaaguuucauuuauauauagucagagaccagggaguuuuuagcaggauuacaacauuuuucugacaaaguuggcacacaauugcagcaauuugauugguuguauaggcuguguuucuuuuugggaaggauacauauaacauuuguuacagaggguauagugguuauggguuuucugucaacuggccuaagcaaagcaggacaagaaaggggaaguuaaucuguaacaagggucauuaagauggcagcagguuuuugucccuguuguuguuugagucucucuagucacuguacagaacaagaacaauaagaaacaaguuguucuauaaucugagaaacagaagucacaacccuguguggcucagaucacaaucacaucucucucaaggcuuaaagugucuucaggguuccaacagguuuuaaaucauauuuauuuucacacuggguacauuguggaccgcuaaguccuuugagaguaagaagcaugucuucugcauuuugugucacccauccaugagagaaagguuuuauauaaaaugaguaaauuuuugagugguauaagauuaaguaaauuuuagaucuauggaaaaggcacuuacgugaaauucucugaugauacugaacaaauugcauuguugucuugguccagucaacaggcaucuuuuugauccuuugagguaccaagcagguuuuacccuuagggcaucugaccuagcuguuaccucucccuggaaaucucuuuuauucuggaaugucacauagcaacuccuucuuaaggccaagugcacugacccaucuuagagaggcuuucugcaacuucucagaccauuguugguuuugcauggugacaaagccugucuccagucacuccaucacagugcccuguucgcgcuaucacagccaggccaguuguugcccacuugcucaucauaugcaucucuuaagcuucaggagagcagaggcccugucugcucugauaaucauuguaucuccaggaccuagaauagugcugagcucacaguaaugccccuuacaucauacuauauuauuuaaaaucaguggguuuugacauuggcugcccaucagugucaccaguggggauuaacaaaacacagaugugcaagguuaaccucaaagauucuaauucaguaggacuugagugaugcccuuaaauuuggcucuaaauguauuaaucaucaaagacucaggaaaacaaggaaagauaagcuuucuguagcuuccaaaguuguagcuguuuuuaaaauuguuuauauuuucuuuuaaacucucaucccauauccuuaagccuugugacugccacagagagaaaauaagaucaagcaugagcuuacauuagccacagaaacaccuggggcaguuccaaaguuuuaauuacugcuucauuaauguaaaagcuuaacuauaguuguaauguauaaacaacuuuuggcaugugcccugcaaaugcaaaaaagucuaaauaauuauugucguggcuccugucucaacgcaagaccaaugaucgccaaauuauuuuuaagacauggacuacauuaaaaaguuauugaauuauguuuucuguuagcuuauauaaagcacaugacauuuaauaacuugcaaagaaaugcuuauuuuaucuguaauauauacuuugguguuuaucagauucuguucaaacuguguagcaaauuuccuugaaaauagaacuuucuuuuuuccucacaucccuguauuugauaucagacuauucuuagacucuccaccucacucaucaccauggugucuacggacuuauaaguaugacaugcugucacccuuauuuauacaugagguauggaggugagcgugaauaagaaucuugcucagagccaauuaguugcagauccagcauuggaauuccucucccauaguaucaaaaguguagucauauuccuagaucauuaggcaggaagaaaaagaaaauaaaagaaaaacuacucagagacaucuggccggaucugugccuuucaucagaauaaucauguccugaaucucccacugggguugucagaaaagauuuuucccaagcuuuucuauaccacggagagcuacauuuaauuuauaaccugaaaguauccccuaaaacagacucauaaucaugcuugcugaaauuuuagcccagccuucuugcuugcugagaaaagagcuggcuguccuuucucuuugaauaagccuccuuguaugaacagucucuagagaugucccuuuuccagaugaaaaucuguuuuauguguuaucauguugaccuuccaaucccuugaaugauuuuacguuuucaucuugguaggucuguucucucuauaaucuaauuuaauaguucuaaucugcacauauccaccacauaucuaguucaauaucaagcagguauccagugaguucacaaacucagaagggcaagaaauauaacuuuucuuauuuuucggcaacucauuuucacuucuauuuugaguucuuuuucuaccaggagaauuuuagggaaauguuugcccccagaucaagagacacucuccucuuucugcuugcuaggcccaaaagaacagacucuuuugaaaagugcagaguuuagaacucuaagaggaagaacagucagaaggauuuuuuuuuaagcaaagucuauuuuucacccaagguggaauauaauauaaaguacuaaucaguuauacaaacauguuauuuauaaaauaacagcccacuaagcgucagaggugagggguugccccauccaauuuucagagucuaaaagaggcaucuggguguccauuaccugaaacagcacaggcgcuagugucuccagagaaaaggaaauggaagagggaggcaggggauguuacaacagggugugauuaauagcagcucacugcuggaguucacucaggaaaggcuggguaaaugcugcagcucaaggucagugugaggcaggccaagggaucgguuagcccuggaacuucugagugaguccuuggcuccaguuaaauaagaagcagccaagaucugggaaggucaacacagucaaagcccuaccaggaacuaggauuauacccugggcuucaagccaagaccagggcacucuggcugaucugagugugaucuugaacucugcuuugcccucugagagaaggagccgaagcucugucuaccuucagggacagaggucuggaguuaguuuccugauuacagcaggaacaacccaagaggccaucagauacugggagguucuuacagugcucuaaacccuuucaggcaauuugagucuucugugucuauugucuucacaggcaucuuguauaguguuggaaaccuauagugauaagugauuuucagcuacuuacuagagaugggagaauuucaaaguccuuuccuucauuguccaucuuuacucauuuggguagaguuauacccaguucuaucccugcauacauacuugcaugcaugggguaagagagaucuauuuacaaacacgugaccacaaacacaugaccagcuuccaaagcugagaaugccaaggacacauggaaguuauuggucaccugaguauagaaaaagcagggaaacccagcucaaccacuuucugucuaugaacgucaauuuuccucuuuauaaauuagggauguguauaaaauaaugugcauaaaaucuuuggcacagugccuaacacauugugaacacaagugucagccaaaauuaugagcaugcagcugucucugugucuguugagcagagcuuccucaauguguugucaauggcucaauuuuggaaacgggcaaugucucgagacagugcugauugccacaacuuacgggaugaguacuacucguaucuaguuggcagaggccagauauacugcugagcauccugcagugaacacacaguucccuacaaucacaacaaugaguuccccuaccugaaauuccauagugcugaggcugagaaauccggcgaaauggucauagcaagaugagaugaguuuagcugauuuccuucauccuuaggaauaagaacauguuaacauauuaacauuauugaccucuaccagcacuuaaaggacaaaaagccuaucaaaucuaaaccuugcuaugaaacaaaaucugauucuugugagagaaaagucuuccuugauucucaagagaaaguaaaagguuuuugugguuuugacuuaaauaauucuaaugacucgauuuguuuauuggacaauagauugaaggagcuaagcuggauuuuguugauuuuaauuuuuaccaguaauguaguauaaaaaauguuuugcuagacuuguaugauuuacuaaauaauuauugauauuugcauaucauguaggaucaagaaaaagucacauguuaaauucuguguacagagauaauuauuuucagucaaaugaaaguaaaagaggccaggcgcaguggcucacgccuguaaucccaacacuuugggaggcugcggcgggcagaaucaccugaggucaggaguucaagaccagccugaccaacaugguaaaaccucaucucuacuaaaaauacaaaauuagccaggcguggugcuacaugccuguaaucccagcuacuugggaggcugaggcuggagaaucacuugaaccugggaggcggagguugcagugagccaagauugcaccauugcacuccagccugggcaacaaaagcaaaaccccaucucaaaaaaaaucaaaauaaaaguaaaggagauauuaaguuuagcuugccugcaauauacaaauuaaaugugcuagaauugagcacuuauagcacaaauuauaggaaauaagauagugaaaaauuaaaaauuacuuaggucauaaaaaugcagaaaauacauaaagaugcuuuggagccauagagcaccuguuaaagcuugacuuucauuguauuuccauguuguuccauuacauuaggggaagccuccuuaguggcucaucaccucauugccuagacuggguaagcagggacacagggucauugcuaccuuucacaggugcuuuacugugcuaaacuucugaaaagccaccuuuuaaaaagggaacaugcauuuucaaagccacugauuauuaaaccccucuuucagucaucuuauuugcagacuuucauuuuugagcuuuguuugccaucugggaaggauuuugaaagagaacauaggccucuuccugcuuuuauguucagcaugccaugaauugcauuaaugaauucuuaagaucguuugaucuauuuaaaaaaauagcucuagauucagucaguuguuaaaaaaauguguucaagauugucuauaauugcacuagccacaaacagauuuucguagguauuuucuuuguaaagaaucuauuugaaauauuggaaauguuuucaggaacuagagacaaaagauauacaugguuuuuugaauaauuuagcauguccuaauuuuuaaaugucccucaguagucauuuaucugcagagcaaguaaauacaaauuuuaaaaaaauuaacaguuauauacgugcuuauuguaaacagucaaguaauacagaggaauauaaaacagagugaaucaucuucucccuguccaaccucacccuuuugcagcagccaacauuaacaauuugguacauauccuuucucaacuuucucaaugcucauacaaaugcauggauguucauguucacauaaaaaugguguuuuauuccucccccaaauggugcagaugcaaauaugaugcaguaacuugauuuuugcauucaacaauauacaaugaaaauuccuccuagucaauacaugucaauccaauucauuauuuugucaaccuaagguagucauaagggucagaauccaauuuaaggagagguuauuuaagugcauauugugaggguggccaacucaaacaugccaacuccaaaggaauggagucagcguucuaaaguagggaaauuaagguuucauuuauguagucagggacagggaaguuuuuagcauauuucauuuuucagacaggguuggcacauuguuacagcaauuugauugguuuauaggcagcguuucuuuuuggaaaaguuacauuuaacauucauuacagagggcauaguagucauggguuuucugucauguggucuuagcaaagcaagguaccaaagaggaagucaaucuauagcaagggucauuaagaaggcaggagauuuuuguccuggacauuuaauuaucucuagccauuguagagaacgagaaaaauaagaaagugaguuaauguauaaucugagaaacagaaauuauaaccauaugugacucagaucacagucacaucuuucucaagacuuaaagugcuuugggggucgcaacaacuuuugcauuauauuuauuuucacaaauuuuaauaacugaaaaauaguauacaguguggguauauuauacuugaauacuggugcccuacugauggacguuuagguuuuuguaguuuucuaccacuaccaacaaugauuuauacucucuccuuagguuugcaccuuuuuuucuguaagauugauucucaaaagugggauggcagugucaaaggcucucccaaucaggugucacagugcaaaagccaacaaugugugguuaaaggauccauuuuuucacaaucuugccaacacaggcucuuaucccauuuuggcuucuuugcaaauaucuuagaugaaaaacaguaucucugugauucuaauuugugcuuucccuauugcuagugaggauaagugucuuuucauauuucaucucaccauugcauuuucuugucugugacuugagugaaacuuuucuaauucuugcauauuuuauucuugcucaacaugucacgacucagaaacacauauuuccaucuccuuuagcauuuauuuugcuacucagauuucagaaggaaaaaggauuuuuuuccugggcauugucaguaguagcuauuuggaaugcuaaagauuugauaagagacauugaagaaaugugaauguuacugaaccgauuugcuuaaaguaaagggaagacugucuauacgucugaccaaugcuuuuugaauguucaggccccugaaucuggcugcagucccaguaggcauggguccaggcgugauguguuugugguugcaucauggcaucgcugucuaacccucgccuuugcauugaaguugugcaaagauuagagaacuguaaaaaucucaggccugucugaggaagucuuucuuacuaucuaucccuuucuuuaaacaugccuugaaaaaaaaagcuacauuuuguccugcuuuguguucauagugaauaucuuucauugucaagaaaauuuuuuccugaacuagcucugaaagaugacucagcacuuuauaagaucagugagccuuuaaggaaugaccuaagauggaauguauccuguccagugaagcucaaggcaugcacaggucguguucaccucacucccucaggaguugaaggagauaagaaacuggucccacagcccucaacucuagcuugggugccucgcagcuacucagcuaaccaaagaaaugaguggaaaaucaguucucuggucuauuuuugauggugugagaagaaggaggaugaggaggagaaggagaagaagaagagauuacuucucauuuuaauugaaaugagugacuuuuuauuaaugagcuugaauucagaauaauuuauuacccuggaguuuucuuauaauauaauaagugagacuguuuuccuuuuugcuuagggcaaaaaauguaaggaggcugaguguuacauuuggagguuuaucuuuuuuuuuuuuuuuugagacggagccuugcucuugucacccaggcuggagugcaguggcccaaucucagcucacugcaaacucugccuccccgguucaagcaauucuccugccucagcuuccugaguagcugggauuacaggcacccaccaccacaccuggcuaauuuuuguacuuuuaguagagaugggguuucaccauguuggccaggcugguuucaaacuccugaccucaggugauccacccaccuuggcuucucaguggagguuuaucuugucagguuuggcuuccuuuucccaguuccaugaaaugugaauuugaauauguguuuguguggucagggagaguguugggaaaugagggugggauacagagagaaggaugauuuaaagguuuagauggucugguuauuuuuaguuuuucuauucccauuucugcaauaguuuuuauuuuuccucauacacuaugggaguuuguucacagaaggaaguuccuggagccuauccaucaggaacauuaacuauauuuuuguuuguuuuuuugcauaacuauuuguuuaguuuuuccuucccaaauuuguggcugcuguguucuugugacuuuuugucggggguguuuuuuucuugcuugcaguguuacccacaaugcaucuauuuuguguguauuaaacagucccuuucaagaguacaaauaaugguuugaaauaggaagaguaucccaaaugcuuuaaucuuauauuugaaauguaggaaauuggaggagcugaggauauuugugacacauauuuuacaucuucucauugaaaguagagcuguuguuugucugcaugguuuugaguuuggucacugaaaugcuaaugacacagcagaaacccuuggugugugcauaaggccacaugaccucaggucaggaauaaaagcuuagggcugagcagcucacucuuugguugagaauccaguuggcuccccuggagugaaguucuacacagacccuggaggaaccaccccaucuguaaggaaccuaaguuucuguauuucuggcuuucauuguagaaaaccugaugucuucuauacuuguucccuugaccuacuucuaaaacaguuuauaaacaauuucaauaauauucacagucaaguagagcugucuuuuacugauauauucuaaacaacauaaauuaagguggagcuuagaacauauaacacaacuauguccuaaugacaugaggagacaccuuucuccugcaaauagucccagauauacaucaguuuucaacuugucaggauggcggauaagauucugcuguaggugucuuuaauuaccaaguggaacuaacauucuaguguuaccugcaauguaaugaagagccugauucaucuugaucuuuuucacuguacuuacuuaucguuuuccugagaaaguguggcuuuagcauuuguuuuaccugagcauauaaagguauaaacucaagcagaacauugauagaaugaaagcuagacccuggcuuaauguaguccuugaaggaacaagaugcauuaacaaaaauggagugaugguucuaguagagcugguauacugaugcgugcugauuguuacuucucuagcacauguuauuugcuacccuuguuaauggucauugcauugguugcaagucuugguuauuuuauauucaacacuuuaagaagaaaugugcuucccuggcuaguuaucagauuuuuuauuuuuauuuuuuuuucgacggagucucacucugucgcccaggcuggagugcaguggggcgaucucggcucacugcaagcuccgccuccuggguucacgccauucuccugccucagccucccuaguagcugggacuacaggcgcccgccgucacgcccggguaacuuuuuguauuuuuaauagagacgggguuucaccguguuagccaggauggucucgaucuccugaccucgugauccgcccaccucggccucccaaagugcuggaauuacaggcgugagccacugcgccaggccuaucagauuuaauuuauaggcauuugaauaguacaaauguaagggcaugauagcuaauuaaauuauuccccaaauauuuauugaacaccuagugugaacaaggaagcagugauacgaagaauggggcaucuaacaaucuagaggaagaaaaagacaaugaauuguggaauuaaaauacagcauaguaagugcuucaauauuaagucaccuaacucuuuauucuccacaauguuuagcaaauaaucuuuugcuguucauuugguuuuucaaguagauuuuguucugaggaaggaaagagagcacagaauuuaccuuaagguauuuggucuacuagucaaaccagucucccagcagauuuguuaguagaaauuaucucccaagaggcuaaucaccauuguguaaacugauggaauacaauuucuggaccuaagaaaacacaggugaagccuuggaauaugauaugucucaaauaugcagcaaacuuggugaccccgaccugaaaggccggcugaucuuaugugguaaugaaagcugggucuuaaugcagggacauuuucuguaguuagcccagugaaaugaugucccaagccagccacucccacgcuucugagcagugucaccuuagaugguccuucccaucacuccaaauuuccacagcuuccagugccuucaagagcauacuguauaggcacaagcuagggaugggaccagggaggccuuggguaaaagcagccaguucaggcucucugagauucuugucucuggaggugaauaggaguccuugcuuaggucuuggccacagagauaauaauuuaggcuuauguauauuccugaaaccuuuaauugguuugagcuccuggaagauucuccacccuuuaggaccaugugguacuugguuaacuguuggguaccauauacuuucugcuaucuuuaguauuacauugaauuuuggugacuuaauaauacaugguuaaccugagauuauuguaucaaugguauauuuuuccuggcagucagaagauggccaccuuguacauauggaagaaugagaaagggaaggaaagaguuccauguauuuguugaccucuauauguaauagcacgucacuuccauuuuuagcccaaguuagguuuuggacagccacaaauguuucuuuugagacuagaguccauuuuaaucagcaucuaacuauuuggauugucaccuaagcagcauauuuaacaacaacaaaaaaggaauagauguuuaauguggucggcuacaacuucagaagcaucuucuaagcucuuucuauagucaacugauuaguacauucucaggcugagcauugcagacauaauuucuuuuuuuagccacauuauuaaugaaaccaaagcuuuagacaacaguacuauuaauaguggugacucauguguucuuuauauuuucagaaggacaauaaauguuuagaggacgaugucugaaauauuuucuucauaaaguguuuaaccauaacuauaguaauagguaauauuaugugucuuagugcaauuuauaaugcaauuuguaaugucauuuauacuguauauaguauauagugguaagguaucuaguaauguauauaauauuuuguauauauauaaugagaugaaaaaauauuuuagaucaaaugaaggcacagaacaugauacucauuauucuagugcuguuggcaauuugguaggauucuuacaagagaaacagaggaaaaagagguuuucuagagugacagauggcacuaaaagcuaggacugaauagaacaugacugaggaaugcugugugugacagccuacauggcuuagaggcuuugguagggacaucacaggcagucuagguggaaucaccacuuacagccagcuauggaggacuuugaaugauuauauaagaauuuucaaaucuacgccagaagcaauggagaauccauccauugaauguuuuuugaacaggguuuuggcauguugaaagcaauguguucaaaauauucaguguuguguagauugggugguggagaaagagaauacaagcaggaagaugaaauuuggcuaagacuucaguagugugaguauguagugaugaaaccccuaaaucacugucauauagcgaugaaaauuaaaggguuauuuauuuuuccucaugcagucugguaguuugcucagugaaggaaguuccuggagucaaugcaucaagaacauuaacuauuuuuugcuauugacaaacaaacaucacagauauuaugaaaagagcaucaagaagacuugauuguuuuugucuuaggggauuaauucaacaaacauugguugaucaaguccuaucagaaagaguuugggagacauaagccacccuggaccuuuccuaguggucgauguggggaaacugcagcuauuaaagcucaggcuuaggcauucaguaagcccagauggagucuugagugggauugggagauuucaguuccugucaaauuucugcaugagguguugugguaaagucaaaauagcaugaauucuguaaccuaacagauuugcauuaaaaucucaaguucaccacucaucaguuaugugaguuugggcaauuuauuuaacuuucugaaccaucauuuccuuuuuggaaaaugaggaaaugccaccuauggaagacgauucuccauagaucucuucuguuucuacacauuuuguaagcagagacacugauggucuuuuuucuggacuauccauucaaauuucuuaauagugaaaaacguuggaagacagagacagugucucuuucuagagcagaagucaguuuugcuucuuccuccagagcaaagguuugcuuacugccuauuagaaaagauucagauucccugagcucaaguuucuucagcugagaugcaaacccauugcuugugcaguauccaccuaggucccuccauuucacccuccaugggacuugguagcaaggggaacccacuggaacacaauguucaugcuauuugcugugccaugagucucugaucuaggagucuggaaucugccagaauccauggcacuguuguggacuaacuuguuagcuugcaagcugagcaaaaucucagacccuuuauagugcuugaugccaccugccuaauguguuucuagggaggacgaggcaagauaagauauguaacacaccuggagcauagcaugcaguuaaaaagaaacacacacauuuauuccacuucuucccuuaagagaaguaacugagcagcugcuucgagaaaguuccugcagugguagcagcaguuaucccuuuuucaauauaguuucagagucagggcaguuccuuugucugaguuucaggauacauuugggcaugacucauagagaagaacucaacaaaguuuaagaacaguagauuauuauacugcuugguugcaauugaaguucuugagucccucauuaacuucucucaaggccaagauaucauuagagagcaacaaagaguagccugauagcaauucuuuauccauguuacuaggauucagcuggggauaaggaggaauaaacacagucaucuaagauaguuuccuaggacagaggaaaaaggauuagggccuggggaagaggaguaaaacugcuaucugucagaggacaucaaucugaaagagaaggugcaagcaacucuuccuauaagaaggauggauaguucccagaagggauugguggaggagggagcaucacccuugcagucucgugacauuuguuaucaacuaaugccuuuuuuuuuuggcacacuuuaguaugacagucagguggcugauccuggguuacuguuuuuagagacauuuucuuauugguggcuccaggcacaguaaguacguuugccuuuagcuguggucugcccuuacacccucaugcuaggacauguggagguuucaaggugaacaaaacugauuuucuaucauucaguugcuaacauuguaguaagggagguaagacacguaaucaaauagacauaacccgggagaaaaaguagcaaaugccugagagugggccaggugcugagagagugcuguguggugacagcacucccagggagagucuggguccugagcccucacaccagugaagagaaccuuucaaucccuagggcaggaauaagccagcaggcccaagguguagcucaaagcuguagaagccugugcugagcuguugaggcaagcaaugcugagcacugucuucagagucucaaaaucuuaucucuaccaugugccucugacacagcuuuauuuauuucccauacacagccuugaucucugauacuggccgcccaacuuguuuuagauccuugacuucaggcuuaaucccuagugacuacuaucaucaacuuggagacauauaacccuuggcugccaucuauggccacaugacccaaaugaaaccauagguuccagcguggccuaugcucucaggaggcccuagccaugaagggccaggcacauugaacccagccucaaacauuggaguagagaacgcccaucuggcauuucucagggcagaggaagacgaacauagcuuaaagacaagcccacagucaugaggucuaugccaagcuucaggagacuccgggaaaccaguccuguacccucaccuccaggaaauuccugauuggucucuccagggauauucacuauagucccagaagggucucuggcucuugugguugagccagcaucccugaacuucucucuaugcauguagagaauguuuccagguaaacuauugaaaggccacaucuuaauuaccagaccuaucuucagaauccaaauagagaccacagaccaacaacugguagcuacaguuccaucugucucagagaguccaaaugccuuaacaaugccgcuguguugaggugugcugggggcacuguguggccuguucacuagugccccacaccuggcucucuucagagugaagggggcugggcucagggaaagcaaagaaggaaauugucauauuguucagguaugguuuagacuccuagaccauuuauugcagacaagaucuuaaaaacuguacagaagacaaagugaccucugcaggcuuagaggaagccagauuggggcaacaaauaauuuauugaauuuuuaauuaauuuaauuuggggucauggcaagucauugaagacauagagaugaaacuugauagagaguucauaaugaucucucuuuugccugaauucuaugauauuauuagucucuguuuaacucagagcucuucuuugaaaaaaagaacaugacauucagacuagugccaaugaaaaaugaggcuuauuuuuaggauaaagagaaagcuuauggacguucaggagaagucaaauaaucaggccucaggccaggccgaauuauaaauuccaaugagcucagagaccuguauagcacuuacuagauucuuaauaaguguucguuaaaagaaugaaugaaugaaugaaugaacaaaugaacucacaaaugaccuaagggagcucagaggaauacugaggacuacacuacuguccuaccaauaacugacuuaaucuuacugcacuuaacucuccugugucucuuggcccaaaaucccaacagaggaauccagagaauaccccugggucagaugcccaucucaguccauuaagcaauagccagagaagguaaugccaaaugaccauagggcucccuucuaaggaucagacagauuaagccagaauaagaaacugaacauggccuguggguuuguauuucuccagggcauucauuuuguauguaauuacagacugccauguacugguguauaugcauguaagguauauaugcggguggcaccacagugaaauauuuuugcuucuugaggacagaauaauagcuucuguucuuucuucuauagggcuucaauuuuauaaauaauucugaucaaggaagaauguucaaguaugaccagauugggagcuaaugugcuaacugauuauuauaugccagacacuguguuaggcauuuuacaaaacuguaaucucucacaauuuauucuuguggguaggcauuauuauccccauuuuacagaugaaaagacugagauuucaacuaucacaguuacaaaguugaaaagggguggagcuggaauucuuccugagauugguuuguuccccaaaguuauacccuuuccaauaucacuauacuaucuugcaaucgacggaucauuaagcaaaauaucgggaugaauucugcaggacagagccaggacucuuccaugagucauuagucagguaaagacacuuaaggcacauaauuaggcaaguauguaguuuuuuauuuaauauugguuugaggaaacuagcucuaaauaaauuaggggaccaauugggaaccuuugauauggucagguuuuagaggagaugagaaggauaaaaggagaaaguuguuugaaaaaaaucaaguuacaaaauacugcgauuucauuuuuagauauauggaucugucuaucuaucuaucuaucuaucuaucuaucuaucuaucuaucuaucguguaacacauauguuaaagauguaaaauacccauuguuuuauauaucuguaagaaagaaaaagugcugucaauuaauugcaagacauaauugauuaugaaagccauccugauuucaaagauguuaaaugugagaaaaaaaaagucugugcugcaauauguaggaaaagauccagagaaaugugcccgaauguugcaguggugauuuccgggaggugacaguaugacuugcguuuuaugauugcucgucuguguaugcagauuucccugauccacucucaucccacucucaaagguucaaguaggugauccccagccccaggagaaccacuuuuaaacucuuucagcaugucacgcauuagaguucacacauuagauuucaagcauuggcuuuaggauuuggggauauacaucucccgugguauugaucuuagcauuugaagccucugccaaaacuucacggcaacaggaauaaaacacacuuaagagacuuuucuacuacacaccugauucaauaauaggcgagauacgaguuguuagcaaaugaaggaaaagcaugcuguucaaugaugaacguucuuaagaaauaauaucuagguuaauguaguacuuuuaguaaaugcacagaaaguacaauucuaauaaauaaacuuguuuuauaucuuuaauuuccaucuagaauugacucguguuagauuuuuuguggucuuaaagauaaucauaaauccaacaguaauaugauuagcucaauaauuuuucacuuggggaauacauguagauauuuugaaguuuuauguuaaggaaugcuugagguuauuuuuaccaaacaucaugaagaaaauauaauuaauuaauaaauauuacagucuuaaaucuauuauuuaaaacauggaaaauuuucauauaagcuacuuuauugcauuccuucuuuuauuaaguccuaggauaauuuuguauucuuuuugaaaguguaugcuuuccucccuuugcuugguuacacaguuggacuuauuuaauuuucuaauacagugcaagauuauuuuacuauucaaaagcgauucugcaacuuuuacauauuugccaacaaugcaggauauggcuacugauccaaaaucauaguuuguaaucauuuuaacucccgguccucuguauuguuucaaucauggccaugaagccaccaccuacuccacaggagagcuugccagcaugcgcuggaaguguguggaugccaaugagugauuucauugcaagguugaaggaggcacuuuaaucuaaagcugaucucuugauucauacuugccaagauuuugccuacauucuucagauggcuuaagacagggaagggcauaagcuuuggugccagacuagcuuuaguuaaagcccagcaacuugggacugagccccaggucccaugaaugcaggucuucaucagcaaggcugggagcagaccacagugaacauugugacuucucaguuggagcugguuuaauuugugguguuguucagcucugcaugggagacuuaaauggagucaucacuggcuaacuguagguauagugaaaacaggcacauaguaacauuugacaaauauuuuaaagccuaccuguuuuccacagaccucaccuggccaacggagaagugcaauuacuagauuauaaucagaucuaugauuauuuguuaccuuuauuaaaacaauucuauauauuuuauugcauguaaaagaguaaaauggcuaucuuuaaguaccaaauacuccaauagcaggguagcaacauuuauuuacacuacagcuugguauguauaugugcucaauuuuuuuuaaccuauacuuggugugaguaugagcaccuaggcuuugaguagugggggaaaaaauauuaggccuaguccauuccaaugcaauuauuuuaaaaaccucuuuaaauauuacucauuuccuucagcaaaguuaucuucuaguucagauuucuccuuuuucagaucccauuuuccuguguccuagcuagggaggcaucuggugugccugguguauggaagccugaaggacuaugcagugccuuguguucugcuuguauggcucuucagguagcugggaacaugauguccccuggugcugaaguuuuuugcagauacuacucaugaucuugucucccucagcugaguuucaguucaguagccccuccgagcugauucagcuuugccuuggcucucauuggagggagauucuuuccacuuccuccauuuguccucuggccagggcugguaaccccagccccugaugcaggagcaccaacuucuugccaaguuggugaguuucucccuaagaaccaugagaaguucugaauccuauccaugguuaacugacugcagaagagugaguuggagaauuaaacacgaggggccucucuguccaacaccccuggaccugccaagguuacagugauguggcuguguaccagguuggugugggauagccugaaggauauuccuuccuagaguucaaaaaggaaauuggggcaggcuuccuauaccauucaaggaccaggaaagauguaaauggguggcaugcccaaaagggaugccugauuccagaaagcuuagugaaugggccaucagaaaaaugacaagaguuaagggcaucaaacaguguugaagcaccuuggaacagccgcaguaggaagucaauacaguccuuaggccagaggagaguucuuggaaccagacgauggcugagcuguagaagggagcuaccuaaugggagcuuuggccugugguaguugaaagcugaaacugcaagaugcagccuggcagggagggagacaggcaggacuagacauuugcuaaccacucgcuucugcccuccaguguccugcaggggcuucccauuggccaagggcaugggaaucauauugauauaauccuuaggucaucuccugggcacagagaaggguagaggaggguagagagugggucugaaggagugaacagaaucuccagcagauucuucucuaaguguaacccauuucauacuuucugggccaaugcccagagagaaaggugggacauacacaucucagggcuuagcucuccucauucucuccuccuuuccucuucccacaaucuaccagggauagagccagaggcacauaccuccucgguaaguccuagauaucuaagggguaucuaaggggaacugcuugggcuggauguccugggcuuggcuuuugcuaugccaagagagaaauaaugauauguagaacauugccucaaaaaaaacuuuuuucugcauaucucuuuucuugcugguaaauccaauuucaaaugccaaaauccuaaauauuaaccuuuucuuuguguuucuuuaacuucucuguccugccacuggcagauggaugccuuagaccagcuaggaaaauauuacauuuugggagaggcaaagagaauacuuuuaaaaacuauuacuccccaauuucaugcugcuguaguuuguuuggaaauuuuaaaauuuuauagcauuuucaaguauauuaucugauuuaacaucauuuaaccuuagcaacaauccuacaagguauccauuuuacagaugagauaauugaggucaaacguacucugcuaguuaauagcaaacccacaacuagaauuccagaucuccugacucccauuagagugcuccuucuucugugccagacagggggccacaguuugcacauuuggaaaagagaaccaaguucaugaaauugguucauaauauacugguacuugcuaaaaguggugacuugagcauuugcccagugauaauugcuuucacugaaaaauuuuuuuuaacuuuuucuaauaucugcuuccaugguaacuagguaauuuuauacuuauuuuauugcccuucuugcauuaucaucugucauuugguaucuuucaccauuugcuuuuuucauuccugguuuugacuucauuucacuaguuaauuaccuuuuuaauccaacuccucuuuuuaacuacuucuugauucuugaauuauccuuugaccucaucauuugauugcugcuuuccuaacucagugaguugaacauauucugcuaaaaauagcagaucuuguuuucauuuugucucuguuuaugugacacccuguguauaacucagagagcaccacugggacaagauguaacagggaaaaauaugugccuagguagagaaaggaugaggagagcuuaaaccuagacuaacuagcaaccuggucucugggcagauuucuugaaugggugguuucuggcagugagacuuugaaagauucgugaugucucugaggagugggauguuuggcccaucagagcugaaggccaguucagaguuucucacuuuguaagguuuaugcgcucccccucugaaaaguggaagcuaccggcuggguacugggucugucuuucccuagauucacucgaaguuucccaauucauguauuaccaguuaaacaggguuuugaacuuucuuuucuuacuagaauauagaagguacuaaagauguuugaugucuugaaaagucuaaggaccuggaacuguuguuuauucccuggagcaugucuucucacguuaugaagauagggaagacugagaauuuggguuccagcuaaguuugagcaguaucuguaaguccuugggccaggcugaguggggagaaguccacaguguguugcaguacccccaggacugucugcugacccccacugcaggggugggguggagcuuacuuucugggucuaucucucauagcugugcuuggaauugcugcugauuccugguuuagaucguuauccuagagcauugacuaaaauguuaaaugaccuguaaguuacauuguuuuaccaagaggcuguucccuacauucucuugagucuguagucucauagguugcugauguugcauaaaacugguacagccucucugggugauaguuuagcaguagguuacaaaauguccaugccauuugacugagaaauccaauggauaggaagucaucgugaagcaccuaaugacuuagcuaggagauguucacugcagcuucccagcaaacaggguaaauuauuaaucauccauaagacaaaauaaagcacaaccauugaaaauauauaaauguauaugugugucuuuacacacgaaaagauauucauaauauccuauugaauaaauaaaccaaguuugcaacaguaaauucaguauguguguguauauauauauauauauauauauauauauauauauauauauaugaaaauauuaauacaccuaugcucagaagaaauaccagaaaggaaggaucaaaauaccaauuuuuggguaauaugauuaauguugauuuuaauuaauaguggauaauuuuacugucuucuaggaugaucagauauuacuuaugaaaaaggaaauuacuuagcauugaaacuggcuucuggcauagagagaagggaugaggaucugaugaacguggaucagcaauaugccacguuuacuaauguuuguuaccguguuggcagugacaucagggugccaauggcacacuauugauucagacauaaggaugugaauaccagggacucaagagaagggacagcuucagaacuauacacacuugagccauauuuuuauucucuuuaucuaaaauguucugauuuuguaggauaauuauuugccuuuuucuuuuuacuuuagacaaaauccauuuucauuuguuuauuaaauaauuauaaguacacaaaagaauauuuacaauauaaagguaaaguggagaaaauacucaugaacagaaagucaguguccagaaauggaguaugaccauugauccuguaagaguucccuaaggcagcaguccccaaccuuuuuggcaccaggaacugguuucguggaagauaauuuuuccacagacaaaggguggcggugauguuuuugggaugauucaagcacauuacuuucauuguguauuuuauuucuauuauuauuacauuguaauauauaaugaaauaauuauacaacucaccauaauguaaaaucagugggagcccugagcuuguuuucuuacaacuagacggucccaucugggggaaacgggagacagugacagaucaucaggcacuagauucucauaaggagcacgcaagcuagaucccucgcaugugcaguucacaauaggguuugcgguccuaugagaaucuaauguugcuacugaccugaugggaggcagagcucaggugguaaugcaagcaguggggaguggccauaaauagagaugaagcuuugccagcucgcacaccucucaccucccguggugugaucugguuccuaacagguaacagaccgguacugguccauggcgcgggaguuggggaccucugcccuaugggauccuccauuccuuucuccuuuccucucuggcuugagaaaaccacaguccuaaauuuuuuauuauugcuuugcuuuucuuuauaauuuaauuccuaagugauauuuuaguuuugugugcuuuuguacuucauuaaguagaauuauacuuauucuucugcaacuugcauuuuucacucgauaucuuauuuccaaguuuuauccaugugguguguauagugauaguucauucauuuugcuauuguccagucuuuaucauggaaaugcaccacaguaugcuuauguauuguccuguuuaugaacuuuugugugacuuacaguuuguugacacuaugaaagcuuuuauuaauggcgucugaugugcauguauaacaucuaaugcucauguagguugucucaggucuauacacaguggaauugcuagguuauaggguaugugaauguccaauuuuaauauacaauguagaccaugcuaaaucauuuuccaauuauuuuuaucuauuuauauucuugccagcaguauaugagagcuucuaucuuugcacagucaccaacauuuaguaaugucagacuuguaaauuuuugcuaaucuacugagcgugaacuaauuuaauuuguauuucccugagcaucagugaagucaagcauguuugcuucagugaagucaagcaugcuuuccuggguuuauuaacauuugugauuucugucuauaaaucaucuguucaggucuuuugacccauauuucuauuggauuauuucugguuuuaaagugggucuguaggaauucuguauauaucgggaacaaaucuuuuuaguuauauaugugagagauaucuucuuccaauuaguggcuugucuuuucauuuuccauauagcgucuuugauaaagagccauuauuaaucuuguucguccguuuuucaugguuugccuuuuugugucuuaagaagucccuuccuaaccagagguucauaaacacaaacuucuagauugucuucuaaaauguuuauaguuuugucccugugaaugguuuaaagguguccaauguguuuuuucuauagagauaacuguucuaggacaaucuauuaaaaacucuucuguuguaggacuuucuccuuaguucagcuaaaaacggguccuugucacacgaccaugaaagauuaggcuugcagacacuuugaagggugagaaaaauggaauuuauugggugaaaaggaaaaaaacucagcaaagcaagagagcuuccuguuaacagauccccaucucacagauagaauucccaguuaccaccccggaaaaagaaaggacagacuccuacccccuaaaaccggcagaaacuuccauggcucaaccuguucucccagugcucaggccggugggaguuucuccagggaccccuuuguauuugaauguuucauuuucuuucccuacagagguguaaaugccagcugacuggaaucaugucauagaugaaguuucucucugaguguggaccuguuuccuggguucccuggagaacacaggcauuugagucagccagauguugaggggcccuaccagggaacuucuuuauauuuuaaauaagaagucauuuaucucacauaacaaguuagaagcuauucuggguuaacccaaggcacaaugauggcaucaagaaccccggcucuucccauauuuuccucugccagagucaguuugucagugaugauuccucacagcuccaacugcuucgagccacaucugcaguggaaaaaaggcuucauauuuuaaauucuaaccucaagguuguuguggacgacccagguggugugcauucaaguugcaagcugcuuucccaugcagucccacucagggucacgaguucucaggggaggauuuuuuucucuguccauucaguccugaguuucaagaugggcaacuugccuuucagaucccuguguaaagaaugaagguauuuauuucuaguucaccugacucucagggugcagcccuuggggccuacaauuuacacaggaaucucacauuaaaccccucuccaugggcgggccuugggcuuuguccucugcccuuacgccucaugagacagugaagagcuaagcuggaauucaccaaggugguaaauguagaccucccugaaagcuuguccuguuuacaucucugccuucucauuuucucuuaauuuuuuucuuuuuuuggcuucuugguauucuuugcuuucuuggagcucgucacacauuuaggaggauuuuugucuuuucuggaauuuuuaguuguuuuuuggugggagggucugucagugcaucuaguccuccacacuauggaagcagaaguugguuuaaauucacuuuaaaaauugccuucuguuuuaucaauucugccuaaagguuuguuggagacugaaccguugcaaggaacagacgaagaugcaguagccagugcugacuucucuagcaugcucucugaggaggaaaaggaagaguuaaaagcagaguuaguucagguauguuuaguaaucuuauuguugcuauuucuaucucuggaucuuaagaguuauuauuaguuugauauaauaauuguaaugauguuguauuguaaugauguugucuuucauuuaauaaaauuuauaaaugaauacauuacaagaugauucauuuuuccaggguauuuuucuacuguuacauauuacuuauuaguuacaguuguagaaugaaucauugugcugcuuaagcaacaauaauaaccaguuuuaaauauacacuucuuauucuuuuuacugucagaauacuaugggaauaauaaauuacuuacaaaccugauagaauucauuccagaccauguuauaggugcaagauccuuuugaagauggguucugguuuuaggucagcaacuuagcucaacaauuacuuugaaaugauuuuuuuaaaugaaaaagucaaucauagaagcaacugaauuuauaaguuguguacuuuuuggcagaaaaauaaagcucuagggguagagaggaaagcaaugcuucaucgaggccuaauuagaucuuguggagcugcuguggggauccggaccuagggaggaggaggaugucaggcucauuaugaauacacaucuuuguucaagucuuuugcuugcaauacccacuuuagacacuuugcugacaagccuuuacuuucuaggaggagaguguuguaaaaagggcuccuugaguaggaggaagcagcagagccagaggagcugaggccaacauucccucugcauucuguguccuggcucauaggccaggaagauccuguucccacagaagcaaggcuuggccuuccugcuuuggccucuccacaggcugaggacacagcucugagcuccaccuuacccucuccccacuuuguccacucugaacucugaguucuagccuccugauaguguuugucuaugacagcucagaauaauauuaaagauuuucaggugcuuuuacaagacacaccuccaaguuaauuucauuucaaaaugaaagagcagcacguuccucugguauaaccaaaaaugauuucaguaagcacagugccucaaaucuuuagcugggucugucuguggccacugaguggcugcacguaccagagugcacagaccaaaguuagcauuaacagauaauggacugacuccacauauucuuauggccugaaauucuggcucaugacuaguucaugucaacugcaggguccaaaugucauguucugcagagugggguaagccaacugagucuaagcuaaaacuucacuccaucauggugauaaugcuaguuuaaguuuaggcacaaugucuguaacugaccaauuucuauaaaaugccucgauuuuuauuuuucugggcuguaggauuacugggguauacauacauacauauacuaauacaugcugauuuuuguacauuauuuucuaaaugucaacagugagcaugauacuacuuuuauaaucaagaaaaaaguaaguauugguuuuaaauggaugccccaugaauaugaaaaaauagaaguguuuucagaaauuccugucucauuuggccacaguaauacacuuccagaacauuucacuccuaagaguuuuugagccugacuucuggaaauaacaccagacucuuuguuacuguguucaaguuaccaggauucauguuuugcacuagccuccaugcuuccuggcucuuauuucuggguucuucggagaugaagaaguaccgcaugcugccaaagguagcgucgugacuuccaggggcacaugagcacagcucucugccccaggccuggugaaaagcagagaaaguguaucuuugcgauuuuucuucuucacauuucucuuucuccuccuccacgucaggccaccucugcuuuaugcucauucuguuuuuaaaacagcuuuccuuacucuuuuacaagugugcaugcggauguguggacacaggaacucaaguucccugauagcacguaugcauucggauuuuaccuucaaugcuaggauucaauuuuaacaaggacacauagaaagccaucucugcagucucacugcuggccuuaugaagaacugaggccuccuauagagucagccccucugccccaauucuccacagagauucuuuaugggccccuggucacagacaacuccucuuucugucugaggagagauccuacugggucuguuagcuccuuggguaccaaagauaccucagagaccagccuauuagaugacggccuuggagucaggcacucaguuguggucaugauccaaagcaagaccuguguguacaaggacuucugaccccugacugcuuugcugaaaagaggucuugagugugccagguguccagccuccucuuuguuuccuuccucucccuacuuuccucgucucuucugugaaauaaauaauucaaaauaaaagcuguugggacuuuaaauuauuuugagccuugaaggaaugugaauaugggaccugagucacauaacaggcagcugugaccuaggcagcuguaaccuguuucucugauuauagacuagccuuuucauuaccuacauuguuuuguaaaaugcuauaaaagacuaaagggcaccagagaagaccucuuuuauuauagauuaacuucccucuuuauucucuuacacaaacgccuuagauugucuaagauggaauguuaaacauauacuuuuaaacuggaaaagaaaaagaaaacaaacuguaacuaaucaaauugcuguaacucauaaaccagcaauauaugaaaaaugcuguaauccuauuaaauuucuuuguuuucugccuguguaaauaagaccuuaacuuuucagcuucauagcacuaaccacauuccuuuagagucuguguuucccagaugucuauccuuagcuuuucacuugaauuaacucuuaaacuggauucugauccauuuuauuauuucagguugacaccuccuacugcuuucuggcuaugcuggauuccuuccucccagcucucuuucucuucccuccccucugucuuauccugcauuaucuuguugauaauauucccaugagguugcccuuagacuucaaccaaucucauaaccccauucucucacacagccaacauauuuuugugugcuuaccaagugcuggcaagaggaagacuucuuuugguaggaaacguaaacuaagccaguaguguccaaaaggcuuacaucuuggacaaauucagcauuuuaaaagaggaaucucuuggccagcugugguggcucacgccuguaaucccagcacuuugggaggccgagguggggggaucaccagaggucaggaguucgagaccagccuguccaacauggugaaacccugucucuauuaaaaauacaaaaauuagucaggcaugguggcaugcgccuauaaucccagcuacuugggaggcugaggcacaagaauugcuugaacccaggagguggagguugcagugagccaagaucaugccacugcacuccagccuaggcaacagagugagauuccaucucaaaaaaaaaaaaaaaaaaaaaaaggaaucucuuuuaacauaacuugaucuuuaauuuauuguuguggucaugcaauauguaucuuuuuuaaaguucaucaagugugaggccaauaucaccucugaucuggugcagugguucaugcauagaaggaauguaauuaauauuuauaauuagcuugaguuauuuuauauuuuaagcaaauauuuauauuuguaaauuccaaaaguagaauaugcucuuuuuuuuacaaaccuugucaguaaauaaagaauuaaucuuuuguuucagauauuuauucucauuggucuuauuaccagacaccuuuucugaagucuuuacacaccuguuuuuuuuuucucucucucucucuuuaaguacacuugcccaauaauucugugccacuaucaucccacucccacuuuaauuucacuaagcugcauuuuauguuuaguauuucauaaugugucuugccuuuugaaaaggauaaaguuuuggcauuaguacuguaaauuugugauuauauaacaaucaaguacugccaaugucccugagauaagaugacuuaagagaaauaggcauuaauaggaauaggaaaaauaccagacagcauuaucaaguaaguaaagccuauuuucaugcucucucaaucucuccuuuggcucuuuccucuuccucuggucugugcaguccccaagaacacacagugcucucaagcuaacggugucuuacacuugcaaagaagugccuuaggcucugggccucucucucucucucucucucucucucagcuccuuccugaagaccuuaacucuuucuggacugagcuagugaacagcuaaugucuucauaaccauaauaucuuauuguuuugcaccucuuagucaguaucugcauuuuaaucuugggucucuuagccaaaggcaagaguagcccagagaggcaggccuugaagccacgugcacgugagaccaaaugugguuacuccuaaauaacauacugaugaugccuaguuuaugaaaauaguuuuccuucuggguugcaguuagaaauuuuauguaaucuagcagauaaaacugaaaaacaaauuuuauaaauuucauacugaagcuaauucauuagcuaauucagacuaguuaguucacuuuuuugcauuuuucuuuagauaaauuuauauaacauaaacuuauccauuuuaaagugaccaauucaguggcauuuagugcacucacaguguuguguuguguaaccaccacaucugaaaggaaacuuguacucauuaagcaguugcuuccauuucccacuucccagccucuggcagccgccagucuucauucuaucucuaugggcuuaccuauucuugauauuucauauaaauggaaucauacaauaugggaccuuuugugucuggcuucuuucacuuagccugauguuuuugagguucauccauguuguagcauguuuuaguacuucauuguuuuuauggcugaauaauauuccauuuuauuuaucuacuacaauuuguuuauccauucaucucuugauggacauuugggcuguagucaccuuuggucuacugugaauagugcugcuaugaacauguguguccauguauuuguuugaguaccaguucucaauucuuugggguauauaccuaacaguggaauugcugaguccuggggaaauuaauucuguguuuaacuuucugagaaacuguacgacuguuuuccacaguggcggaacuauuuuacauuccugccaguaauguacaaagguuccaacgccuccacaucuuugucaacacuuguuauuuuccuguuaauucauauuuaaauaaucaaguuuaaauaucuaauauugggcauaaauauucauccuacaaggagaucuucuagggagucaagaaaccaaagaacuagaccauuaauuugcaaugcagaaauaauuaaaauuaaaaggaaaagauauauuaaauacuuuaauucauuaacaugauuuacuugcacuucaucucauuccaaauuggauguggcuuacagaaguacuuacaguuuagaguuuccauacuccuuguaucagaaucucugaggaugcuugcugauaacacaagcagucuggcuccaccaaaucuaaggccuugaacucucagggcauuaaaaggcagcagaugccugggaaucugcauuuuaaauaugcuuucuuauuuaaacugaaguugagaaccacugagauaacuagaccaaacgaucgcagucaaauaaaggauugaaguucaucagcagcagccuuuaagguauuuguaaguaaagaccucauuguggcaggacucuugguucuguacaaagagagguuguuggccuuuuggaaccuuacacguuaauguaauuaaagauugucugucuuuccaacuuuugcgauuaguuuuuggcauauauuuagaucucugauaaauauucugaacguuuugaaaagugugagucuuuauauugcauugaaaugguuagaauuuuauuauagaaucugagaauacacccaacuuaaauagcugacuucaugucuucauuauuagaggucucuuccccauaugugucuuugaaagugugccugaauuuuugaauuauuaagugugggacuuuauauuucuuuuuuuuaagaaugauuuuuguuaaauuggucacuuuaauguuucuaucgcuuuugggggaugaagauuuuauuaaaaauuuaauggcagcucugaauccuuuccucacuccccaccuccagauaacaaaugaauaauccacagccccucgugguuuuuaauacacuuauggggcuccauggcuaugagguugagaauauuaagguguucaagccucuuucuccuuguguacaucuguaauuuauuucagcaaguuaaaauuuuccccuuauuuuuuuacacaguggaaaauacuguaacacucaauauacccccacccccgccgagaaaaaacccagacucccaguaauuucagucacucuaaaugaaagaaagcagaaauggccuuuuuaauagagaauaaaaggcugacaugaaccccaagcauuuucugugguaaaagagcaagagauacaaccaugagaaauauugggcagcagauuaaauggaggaggacacauugacaaagaugaaaaagagaaauaugacaugauaacaaaagaauagaagggcuuaauuuuaaaauaacaguguauucucauuuaauggagagacuaaaagcauuauucucuuuacuggucccuaaacauacuccuuuuacaguaaucaguguauguaugcacacugaagacucuugcucaucaaggaaagacaggguucuauugauuauacuauguuuguagaauauguaauucacuuuagauuuuagaaagauguccauguacauauaaaaaauguucugugaacauaaagaaauggauaauguuaaauugccaggacauuuugcugauauuaaaaaccccaagauauugcuacuucuuacugugguauuuaagaugcuugugauucaguauuucugcuuguuuugcuuacgugauuauuuguguauauaaagguucgcaaaaccauuucugucuguucacuauuggcgcuagugaaagacugggggguuuuauugcauguuuugcuuuugcaaaggcagaugcccuucuugagcugcuuucccaggagcugugacucuggugauccaaggaacgcauuugcaagaugacugacagccugacaggguuggugugaugcagcuugugguccgaaguagagugacacuuuacaguaaaugagccacaguugcuccuuuuuaaaaaaaauuuaguaagaaauccacuaaagugacagaguuuuauuaccuccaugcaugugggauacuaagguaguucuaaugauucuuuuccggcuuaacaaggaaaagucacaaaauuuguuuuccauauuucagaaaacaaagauguaaauguaagcacugauaccagagcaauauguuauagaguaugacaacuaauuaaaaucaaagacuuugugauuuauucagauuuauuuucacaggauagaacagcacuuuccaaaaucugaguacuuuacagagcucuuuuguuagaaauugcauuugcaagagcaauuuuauagugcugaagagaucugcuuuucuguagcacaggggaaagaggaaauauguccauacgaagccuuguacaugaauguucauagcagcuuuauuugcauuagccuaaccuaaaugcccuucaacaggcaaauaaacaacacacuuuggcauauucauucaauagaauacuacucugcaaaaaaaggggaagaaccauugauaaugcagcaacauagaugaauauaaaauaacuaucugcaaagccaagcaaaaaugaguguauacucuaugauucaauuuguauaaaauucuaguaaauaucugcaaacuaaacccuagggaaagaaagucagucaguggcugucuggugagaguggauugggggaaaggaaagaagagggagggaggaagaagaagaagcaaguaaaaggugaugaauauguucacuuccuugauugugauaauggcuucacggguagauacauauguuaaaacuuacaaauuauacauauacacuuuaaaugucugcagcuuauuguaugacaguuacaggucaaugaaacuguuaaaaagaaaaaucaacacaaaucacucuuuuacauacauccucuaaucccuuguuccuuccuuucuuaaggcauuagcuuggcaaaaccccauugucugccaauuccauuccugcaccuaugcaacugugugugguuggcaaaaaauaaacuacacugagaccaggcgugguggcucacgucuguaaucccaacacuuugggaggccaagacaggagaaucccuugaggccaagaguuugagaccagccuggucaacauagugagacccugucucuuuaaaauaaauaaauaaaguggcacuugagaagaaguuauauaaaauaaggguacaguagaaaaccaauuuuuguucaaaaauuaugucuauauacaacuuauagaaagaacauuuggaaguuuagaaaccaaaaaauaagcaguggcuauuuccuagcaggauacaggugauuuuuauuuucuuguuuauguuuuucuguacaaucucacuuuuuuuuuuaacaagcagcauaaauuacuucuauaaucauuaaaaugaaaaauucuguuucuacuuugagauauuagacuaucaucuguaugggguguauuuggcaaaccuacacaugggauuguauaaauaggagggucagaggcugcuuuggaauacccagagcuucuguaaguauccuuuuuugcuggucugacauuuucccccaccauuuccccuccgccuuguagcuagaagacgaaauuacaacacuacgacaaguuuugucagcgaaagaaaggcaucuaguugagauaaaacaaaaacucggcaugaaccugaugaaugaauuaaaacagaacuucagcaaaagcuggcaugacaugcagacuaccacugcguaaguaucauaugaacaguguuuuauuaacucagccugaugucuccucacucuguuguguuuuguuucauuuuuccuacaaggcugauuuggugcaugaagcuaggaaaaaaaaauacuuucucuaaaagcaaagcaaagaaaugugaauaaucauuaaguaugcugcaugugaagcagauucuauaaaguagcuucaugaaauaaaacucuguucacugaaacucuauuuucacucagacuacuuucauuagguuuuauuguuuaaauguuuuucucuuuauauuuuuaacauuugucaaauauacuuuuuuuaaaacuuuuucucauaaaaacuauaaaugggaagguguuuucuccucagcacacuugacacucacuauguaugucuuccaaaagugguuggcaguuucaauacugacuugcuggcaauugauuuacaaagaaaaccuuguacuuuucaucuuuuguuuugcacuuuucauucucacuauucuagggaauauuuagagcuggguuuagaccaguuuuagagcuugguuuagauuacaguuuuggcccuguaaucccagcacuuugggaagcugaggcggguggaucacaaggucaggagaucaagaccauccuggcuaacauggugaaaccucgucccuacuaaaaaauacaaaaaaucagcugggugugauggcaugccccuguaaucccagcuacucgggaggcugaggcaggggaauugcuugaacccaggaggcagagguugcaaugagucgagauggcgccacuccacuccagccuggcgacagagggagacucugucucaaaaaaaagaaaggaagaaaugguuuuugcuuugccauuaucguccugucuugugcuagguaagguacagaauaaucucaguuauucuacaaucacacuuuuuuuauuagauuauucuuaaguugcaugaaauauuuaaugaugaugguacuuuucuaauguugcaaaguauuuuaccugcugggggucuuguaccaaaggggaguacuccacauaugugaugugauuuuucuucuuuuuguguauuggggguuaggggcugaugaggaaaucacagaggcuuuaucccuagccguaacuuuagucccaaauuucaccauuaagaaauugucuuuggguuaugcauuuucuucucuacuaucacacuuuggaagguaaagauauugcauuccuaauaccuaagugggagucaauuuuucuuucuccuaggcauagaaaggccugaugguaggaagagguaccaauaauugacagcaauuauuucaguuuugccagcagccaaauuugccugcugguuccuaagaacuaagauguaagccuuuuugcuccuaugagaagauguccuuuguaugaggaauugggucuaaaacgagcaugacaucuccccaacuuccuuaguuuccauaagaaugagaauguuuuucucccucuaaauauggccuagcaguccuauugggcucuaugcuugugcacccuaaggacucaaucagauagguucagggcacagcccagagucaggcagaauguagccagggagcuugucaguuuaucuccagaaguuaaccaacauuccccaaccuaaugaugacaauuacgggaaaaaauaagaaaccacacauugaugugcagcaauuuaaaagauaaguugcaacaccauaugaacaaucuccugaaaggauaacuggauuuuaggcauuaaauuaaaugagcuuaucugucaguaguuuuggccucugucuuuccacuuucguggccaauaccaauuaauggcccugacaguguaaaguugaacaagcucuaauucucuggguuuggucaccucuguauuuaauccaggccugaggguuucguauaacacuggucugaacuucccugugggguauaaguaccaggaagaccuuccugcauggccuuccuaaucacauugcauagguaaacuaaccaaauggaagguggggcaaugcuggcaguuuuguugcugaaggagagaggugccuggcagggaggugggaaugucugagcagagggagugucaaguuugugcaaggucugccaggggaagggaggggagagacucauauuccuccugggacuggaaauagagcuggcaaguucaaggaaggcuucuagccucuucccacaggggauaaugucuaauuuguguuuuuccauguuugaaaaacuaauagguuuuauagccagguagucuacuuaauguaaagcauuuugcuggaugaauagccuagauuuauucccugggguuauggaguuuagagucuaguuaggaagacagaguuugaguuuuuguuguuguuguuguuguuguuguuuguuuguuuguuuauacgacaaaaucauggacaagggggauagaaaggauuuggagaacagaucaacagugguuugcagguggaugaugaaggaaauaggaccaagugugaugucuaggccuuugacuugggcuacugagugaguguuggaacuguuuacgagcauugugguuaggcucaugguugcuuggguugaaaucuaggccuugcugcauucaugaagugagaucaucuuaaugccgaucccauagguagugaagauucaguaaguuaauguucguaaaggcugcaggacagcaucugacacuuuguaggcaugaaaugauuauuugcugcugugagaaagacugagaaacaagucuggaggagaggcacaauaauucguuuuggcuccguaaagucugaaaugcccaauagauaaacagauuuauaggcugagaggacaacucaguguaaaaguuuaaggcagagauggacauuugggauucaacugcauauagauaacaucgaaaacuagaugacuagaugagauuucccuggggauuacuuaauaaauacaaauggucaugaacucacuaaccuuuaggaaugaagugaacuuuccuuuguagggaagaaccagucccucucuuuaggaggaggcauaagucuaucaaccauauaauuuggggaaagggucuguccccaacccuuucuucuugguuguugagggaaggcagcggaucuuaaucauauguuuggaggagcgauaaaaucuguaucccucugaauuaauuaaaccccugcucuuagugcuguuuaugauacccauuccaggacaaaaucugcaccucaucugaugaaaaauuugaugugaagaaaugaugagcuaugaucagguuagguuagguagaauuagauuucaaagcacuaaaaaaaauuuuuagcugucagaggaugugugugauucccagaggcaauacuuugcauacugauuaagcaaucaugaccuauuuaguuugauuuauaaugaaaagaaaaucuaugguauguuaaugaaagaucuuggcauauuucagucugcaguaggauucaaauugaaauaggccuugauaaguaggaauaauuacacagcagacugaaauuaccuccuuuacagaaagauuccaggaauacaggaaaaggucaagggaucaucgguauccaggguuucuuguugcuguuguucuugucauaguuuuuuacuugccuagauuuguaucuaagaacauacaaaaaaguccucuccauuuuuugguuuucugcugccuuuuuauguugucuuuagacuucaaggagacaugggagaggugggugacuuugggguaaaggaggagaaauugaaucucuucuguaggcagaaguagaaucaggaaauacaacuuuauggugggcuauucaaagcagugggcuucauguauucaacaaguauucugcuuugcuaacccaugaaacaugaaauccccccacuaauaaaccccucugaaucgugccacaaucuaaaugguaagucgacagagggcagagguuuuggaaaggaauuuaaacuauuccaucuuuuugaaagcuuaauaauuuuauccuacauaaagaggacgaaaagccucacauucagcauuuuaaaaacgcacagugcucaaaaauugaacguuaguuuaugauuuauuuacucuuugauuuuguucuucuaagacuuccaggccauuaauggucaggaauucuuauuaucucuuuuuaugagggagccugguuguagcacuauugaguucaggagugccagugaagauuaaagaccuaauuuuaaaagauguacacacccaaucucucacaugguuguucauucuuuuuaccuucaggcuuucaucuuauuacacaaggcaggaaguagauucuuuucuucuagauucaagugguaaauuuauguucugauaacauauuuagggagccuuuggaauaaaauaaucuuaaauguuuuuuuguaucuuuggugaaaugcugcauauucaaccauuaaaggaacacuuucuuuuaaaucucauaagaggaaauauauucgugcuguaaaauaucuucuucuaaaaagaugaauuuuuuauuucuucuaguuguauguagaaaaaugcuuuauuuaagucaaaacaauuuagaaaacaacaugcuuucuccuuuugauuauuaacaccaauguucaaauuaguaaaacaugucaaguggacuuugcaugaaaagucaacagaaugcuuuuuauuuggcuugcagagacccuuaccucacacuacugaagauccccuguuggcgugcuggucaaacagcuaaccuguccuugccaauaaaugcuauccauuccagccaaauugaguuucugaaaaguagagcccacuuuccuguugacuuucauugaaaaacaggaaguuuacauguacucaacaccaaacaucucucaguaaacagucuuaaaggacuuaaugcauaucaggugcucuauaaacauuagcugccauugcuuuaaaaaacauuagcugcuauugccauugcugccaaagaaaggcaaauguuuaacuaugaaaguaauggcagcuaauguucagcccuagaccagauuugagccuuguugggaagugcaggucccuaaagcaguguuuucugcuagaauggcuuuagaacacacaagggcaaauuucucuucacucaccugaaagcuucaguuguucucuugaguuagaagcuucacauuggaaacuccugauuccgcuccuguagcugaagugaggacaggcacagaacacagacuugaagcauauacuuucaacguuucugccaccuaaugcacaacugacggcaacucaaagauaucuuacacauuccugcuuuuacuuaaggaaaacauauuguuccucugcucuaucaauuauguaagucagcaauggugaaccuauauuuagcuuaaaguaagagaccuagcaaucugaaaugcuaaauacuauuucuauuuaaguuacaagauugucaagucaaucaagguauuaguauuuaaguuguuuuucauuauuugaauauuauugcacauaguuuuauaugauaggguugaaaaacaaucuuaaguauuaaagaugugccagauucuauggcauaauaaagggaguaaaaugcaauacaucauugagugccauggcucacaccuauaauccuagcccuucaggaggccgaggugaaagaaucacuugagcucacgaguucaagaucagccugagcagcguggugaaacugcaucuuuacaaaaagugcaaaaaaucagccaaauaugguggcgugcaccuguagucccagccauuuagggggcugaggugggaggauugcuagagcccaggagauggaggcugcaaugagccauguucacuccacugcacuccagccugggugaccaagugauacccugucuacaaauaacaauaauaauaauaauaauaauaauaauaauaaaacaccaacuucuuuuggcugauaggagggguuuuuuuccccaagacucaggcuccuagcuucuggauggggaccuaucuuacucaugcaacuuuaagaucaaguucaaucaggaugcagcauaagguuacagggccugugcaauacguaacuccugagguaccauuugcuuagaccaggcauguccaauaucugggcuucccugggccacacuggaaggagaauugucuugggccacacauaaaauacgcuaaggauagcugaucagcuaaaaagaaaaaaaaguugcaaaaaauaaaaauaaaaacucauaaugauuuaaggaaguuuaugaguuuguguugggcugcuuucaaagcuguccugggccacaugugacccauaggccgcagguuggacaagcuuggccuaggcuauggugugagugcugcuccuuggugcuuuuaaguacuuggagcccaauggccuauuucucauggggucucugauuacuuuguucuugaaaaucauuucccgacauauaacccuuucucacuguuuacccuuuugaaaucucuuucaauuguugauuuccaaguaauguauauaaaauagcaacuaacuguuuucaagaaauaugaugguuagcugggcucaguggcgcuugccuauaaucccagcugcuggggaggcuaaggcagaaggauugccagagucuaggaauucgaggccagcuuggauaacauagugggaucccaagucuauauauauauaaaaggaauaugauguuuagccuaaggaagagguguaaaaauguggggggaaaaugugcauuuuagcauucuugaaauacaguauuauuucucucucugaacacugguacuguagaaagcugacccaacucaccuuuaaaugucuaucaucuucaaggcagcaagacauuuuaauggaaagcaggcacccuggacuaggcccuagacuuaccugugucacuaagauucacauaacucuuuugggccucaguuucaucaucuguaaucugaagggauuuagcuccagugcccuucagauuuaacauuaaauaauucuuggaaauaaggaguccuaaaaucuuuaacacugcauuaaacuaccuguauagcugaauuuuaaccauaaaauuucauauagaaauagacuugcauuuuucaugguggggacauaaauaauauuaauaccacacuaaaguaaucagaucacugcauaugcucaccucccauuuugcuauagaaauguguuuaaaacacaauguagcuaucaccuauuuucaauauauacuucucucuagcuagcuauauuuaaauuaugcauuaaauucagaaugucacacacacacaaacaaguguuuaaaaaaucauaucuuaguucaaaacauucucaaauauauaaaguuaaacuacauggaaaagcuuaaaagaaaauuaaauauugggucuaauuguaagaauucuugaagaaauguggaaccaacacaagaaugaauucucuaacuaguagccagucccaacuucaugcaaaagccacagauauugcagaauauuuauuuacuuuucccuugagucacguuucaggccacacagagucaguggcaggugguugcucaauagacuuucuuccuuuccuccacccuucccugguuuccuuuuuacccuuaucacucccuucucccuagggcucaguccauucugcaggcaccccaaguggccaaggccccagggaccucuggccuugacuagacagaaagagguugcuuuuacagucuucucaagggugcaggcuuaagucuuuuuaauucuucaaaaugggacauuuaaaauacagcacaacccuuuucgugccauauuugauagcaucacaaagcagaacagcuagagcagagacccuaagguaggagggggccugguauguuccagggacagugaggaggcuggaaggucuggagcagaguaagaagaaaugagaggggaccagacuguguagggccaucagaaggcccaccagguggacuuuggcuuuucaccgugaguauuaugaggagauagugcaagguuuugagcagagaccugcuccaauuuaaugcuuuaaugggucccucuggcugcgguguugaaaagggacuguagaaggauaagguggaaguauggaguuuaguuaggugauugcaagagccccggugagugaugauggcggcuugaacuaagguggagaguaguggaagcagugagaaaguagacuccacaucuauucugaaaguugaaaugaaccaacagggcuuuccugaugaauuugauuuggagaaugaaagaaacagaaagguuaaagaugaugcuagucuccuauuuugggcauucaauagauuguucuauuuucuuaccaaaacacauaaguuuuugcacaggaaaguuuuucuugauguuuuucagaauuaugaugucaguagaguccuggauugagccuaauucugaaucacaguccauaguguaauaauguuucaucagcauauaauacuguacuuuccucacuuccaacuccuuuauuuauuuaauuuauggcgcaauuucagcucacugcagccucugccuccuggguucaagcaauucuccugccucagccucccgaguugcugggaucacaggcaugugccacccagcccugauuuuguuuuguuuuguuuuguuuugcuuuuuuaguagagacaggguuucaccauguuugccaggcugaucucuaacuccugaccucaggugauccacccuccucagccucccaaagugcugagauugcaggcgugagccacgacgcccaggcuugaacuccauuuuuaaugcccuuuucacagaucugauuucauuacccaguuacuacuuacugaaaccuucaucagcauccuaaaaauauaacugugguaggaaguccagauuuuucuuuauuuauuuguaaguaagucauuuuguucuuaaggccaagacacuacauuuacaucuugcuuucugagucuaguuaauccaaguguucaagacacugcuuuggaaaacuauuuaguagcaggcuucuucugaagaauucuuagcacaugacauuucaagaucacaccucacuaaaaucuucuaaugaugauugguguuuuuauuucuagucuuuaacauuuuuaguauuuuuaacugucuuaucacuaaugacaauuuagauaauaauuuuuuaucuuuuuaaauuuuauuucaauagucuuugggaaacagguggcuuuugguuacauggauaaguuuuucgggggugauuucugaaauuuugaugcacccaucacccaaacaguguacauuguacccaagguguagucuuuuaucccucaccccccucgaacccuuucccccgaguccccaaaguccauuauaucguucuuaugccuuugcauccucacggcuuaguucccacuuagaaaugagaacauacaauguuugguuuuccauuccugaguuacuucggucuccaacuccauccagauugcugcaaaugucauuauuucauucucuuuuauggcugaguaguauuccaugguauguaggaauauauauuaacuagacucagaaagcaagauuuaaaagcaagauuuaaauguaguaguuuuggccuuaaaaacaagaggacuuuuuacaaauaaauaaagaaaaauuuggacuuccuaccacaguuauauuuuauaucacauuuucuuuauccagucaucaguugaugggcauguaagcugguuccauauuuuugcaauugcaaauugugcugcuauaaauaugcauguguaagugucuuuuucauauaaugacuucuuucccuuugggggaaaucccaauagugggauugcuggauugaauaguaguuaugcuucuaguucuuuaaggacucuucauacuguuuucuguagugguuguaguuuacauucccaccagcaguguaaaaguauucacuuuucaccacaucaacgccaaugucuauuuuuuuuaauuuuuaaauuauggucauuuuugcaggaguaaggugguauuucauuguaguuuuaacuugcauuucucugauaauuagugaugugaggcauuuuuucacguuuguuggccauuuguauaucugcuuuugagaauugucuauucacgucuguauuagucuguuaaugcugcugauaaagacauacccaagauuggguaauuuauaaagaaaaagguuuaauggauucacaguuccacauggcugggaaugccucacaauuauggcagaagguggaaggcacaucuuacauggcagcaggaaagagagaaugagagccaagcgauaggggaaccccuuauaaaaccaucagaucucaugagacuuauuuacuaccacaaaaauaguaugugggaaaccauccccaugauucaauuaucucccaccaggucccucccacaacacguagaacuuaugggagcuacaauucaagaugagauuuggguggggacccaggcaaaccauaucaauguuuuuuacccacuuuuugaugggguuguuuuguucuugcugauuuguuugaguuuugaguuucuuguagguucuggauauuagucguuugucagaugcauaguuugcaaagauuuucucccacucugguuugucuguuugcugauuauuucuucugcugugcagaagcuuuuuaguuuaauuaggucccauauauuuauuuauguugcauuugcuuuuguguucuuggucaugaacucuuugccuaagccaaggucuagaagaguuuuucugauguuauccucuagaauuuuuauaguuucaggucuuagauuuaagucucacauucaucuugaguugauuuuuguguaaagugagagaugaggauccaguuucguucuucuacaugugacuuuccaauuaucccagugccauuuguugaauaggguguccuuuccccacuuuauguuuuuguuugcuuugccaaagaucaguuuauguaaguauuggcuucauuucuggauucucuguucucuuccauuguucuacgugccuauuuuuauaccaguaccaugcuauuuugguaacuacagccuuguaguauaguuugaagucugguaaugugauaccuccagauuuguucuuuuugcuuaguauuguuuuggcuaugugggcuuuuuuggggguuccaugugaauuuuagaauuguuuuuucuaguucagugaagagugauaaugauauuuugaugggaauugcauugaaucuguagauugcuauuggcaguauggucauuuuuacaauacugauucuacccauucaugagcaugaguuuucauuuguuuguguuaucuuugguuucuuucagcaguguuuugucauuuuccuugcagguaucuuucaccuacuugguuaaguauauuccuaaguauuuuauuuuuuauuuuuugcagcuaucguaaaagggauugaguucuuuauuugauucucaguuuggucacuguugguguacagcagugcuacugauuuguguacauugauuuuguauccugaaacuuuacugaauucauucaucagaucuaguagcuuuuuggaugaguuuuuaggguuuucuagguaugcagucauaucaucagugaacagcaacaguuugacuuccucuuuucuaauuuagauggcuuuuauuucuuuuucuugucugauugcucuggcuaagacuuccuguacuauauugaauagaaguggugaaagugggcauccuuaucuucuuccaguucuugagggaaugcuuucaacuuuucucccauuuaguaugaagcuggcuguggguuugucauagauggauuuuauuaucuugaaauaugucccuucuaugcugauuaugcagagaucuuuaaucauaaagggaugccauauuuugucaaauaacuuuucugugucuauugagaugaucauaugauuuuuguuuuuaauucuguuuauguaauguaucacauuuauugacuugcauauguuaaagcaucccugagucccugguaugaaauccacuugaucaugguggauuauauuuuugauaugcuguuggauucaguuagcuaguauuuuguugaggauuuuugugucuauguucaucagggauauguuuucuuuucuuguuauguccuuuccugguuuuggcauuacauuuggugauaccagcuucauagaaugaucugggaggauuuccucuuucucugucuuuuggaauaguucugguaggauugguaccaauucuucuuuaaaugucugauagaauuagcugugaauguauauggcccuggacuuuuuuuuauugucaauuuuuuuauuacuguuucaaucucgcuacauauuauuggucuguucagaguuucuauuucuuccugauuucaucuaggaggguuguauugauauauuuccaggaacuuauccaucuccucuagauuuucuaguuugugugcaugaagguauuuguaguagccuugaauguuuguauuucugugguaucaguugugauaucucccauuucauuucuaauugagcuucuuuggauucucucucuuguuuucuugguuaaucuugcuaauggucuaucaauuuuguuuaucuuuuugaagaaucagcuuuuuguuucauuuaacuuuuauaucuuuuuuuugucaguuucauuuaguucuacucugaucuuuguuauuuuuuuuuuucuucugcuggguuuggguuugguuugcuucuguuucucuaguuccuugagaugugacauuagguugucuauuuggggucuuucagacuuuuugauguagucauuuaaugcuaugaaauuuccucuuagcacugcuuuuguuguaucccagagguuuugauaaguugucucacuauuaucauucaguucaaagaauuuuuuaauuuccaucuugauuucauuguugaccaaagauuauucaagagcagauuguuuaauaucuauauauuuguauaguuuugaggcuuccuuuuggagucaggauacuugauaugaauuugguuuucuuaaauuuauugagacuuguuuuguggccuaucauauggucuaucuuagagaauguuucaugugcugaugaaaagaguguauacugcaauuguuugguagaauguucuguaaauauauguuaaguccauuaguucuaguguagaguuuaaguccauuguuucauuguugauuuuccaucuugaugacaugucuagugcugucauuguaguauuaaagucccccacuauuauugcauugccaucuaucucauuucucaggccugguaguaauuguuuuaugaauuuuggagcuccaguauucggugcauauguauuuaggauugugauauuuucuuauuggacuaauccuuucaucauuacauaaugucccucuuggucuuuuuuaguguuguugcuuuaaagucuguuuugcuugauauaagaauagcuacuccugcucacuuuuaguuuccauuuguguggaauaucuuuuuccaccucuuuaccuuaaguugaugugauuccuuuuguguuacgugagucucuugaagacagcagauacuugguuggugguuuuuaauccauuuugccaucaugcgucuuuuaaguggagcauuuaggccauuuacguucaaaguuaguauugagaugugagguacuguucuauucauuaugcuaguuguugccuaaauacuguuuuguuuuguuucauuuuguucuuguuuuauagguccugugagauuuacgcuuugaugaaguucuauuuugguguauuucaagguuuuguuucaagauuuagaacucccuugagcauuucuugucaggcuggcuugguaguggcaauuucucucagcauuuguuugucugcaaaagacuuucucucucuuucauuuaugaagcuuaguuuugcuggauacaaaauucuuggcuaauugucugccaauuauuuuguuuaaggaggcuaaugaugggacccuaaucccuucuggcuuguaagauuucugcugauaaaccagcuguuaaucugauagguuuuccuuaauagguuaccugaugcuuuuuccucauugcucuuaagauucuuuucuuugucuugauuuuagauaaccugaugacugugugccuaugugaugaucuuuuugugaauaauuucacaggaguucuuugagcuucuuguauuucauugucuagaucucuggcaaggccagggaaguuuuccccaauuauuuccucaaauaaguuuuccaaacuaaaauuuuucuucuuccucagaaacagcaauuauucuuagguuuggccauuuaacauaaucccaaauuucuuggaggaggcuuuguucauuuuuuuucuuugucuuuguuggauuguguuaauuugaaagccuugucuuugaccucugaaguuuuuuucuacuuguucuagucuauuguugaaacuuuccacugcauuuuuuauuuuccuaagcaagucuuucauuuccagaaguuaugauuguuuuuuccuuaugauauauauuucucuggaaaauuuuuuauugauguccuauauuuguuuuaaguuucuuuaaguuaguuuucagccaacuuaccuuucucuuguaucuccuugaguagcacaauucugaauucuuuaucuggcaauucagagauuucgucuugguuuggauccauuccuagggaguuagugugaccuuucauggguguuauagaacccugguuuguuuuauuacuagaauuacuuuucugguuucuucucauuuggguagacuauuucuuaaaauuguucuugaauuuauuuuugcuuaaaauuuuuuuuaacuuaaauuuauuuauucccucuuaaggauuagacuuuaauguuuauuuuagccuaauuuaauucuuggugcuuguaggguugaagacucaguaugagauccuuaguuacagaaaguuuuuuugugugcuggcuuucccuuaugcuguuuguaguuguuacauucuuggugagugggugaguucacugccucuuauggaguuggaauggcagguaucucuugaagcuuaucuuguucucucaugguguacccuuuauuuauuuauuuaacuuuuuucccacuguuuuauuuacugaguugacuuuaggccauuaggagagguaucccugguuaggcacugguuguggcuaaggcagguggguagauguaauacccaauggugggcugaggucccagccuugaugaaguuggcuggaggaccucucaauuagaugugcugagguuucaucaaggugaggagugggagcuaccucagcucuccugccaggucagcaggaaagcuacucaccucacagccuuauuccugucccaguguucuggcuauucggauaagacaggcaccucuuuucaucuauggaaauguugauguuccaaguagggaagaauugugacuuugccucucaugcaggcuugaaucuggaguguguuccuccuguggggcugcacucacccuggauuguuccagaaaggcugucuauaggugccuccauucuucugggggaagcccaacugugucugcaguagagugccaggggaaacaaggaccccuucuuuaagguccuacacaaucacaggggaugccugccguuugggguagagguacagacuuucccuacugugcccagcacugcaauugugucucugcuaugagaaacuucccaccacuggaaagauuuggaacucaaggccugcuguucacauucuuuuguaccauagggugauccuuugauguagugcucgcccccuucccuuagaaaugggacauccugagagcuggacugcagugauuguuauuucucuucuuagucuaaccacccagcaggacuaccaggcuccaggcuggugcuggcaaaugucugcaaaaaguccugugauaugaccagucuucaggucucccagcuguggauaccaguacuugcucugguggagguggcaggggagugaaguagacucuaugagaauccuuggguuuaacgugccggcuuucucagaugcugguuaugcuagcagugaagucgucauguggacagacucaggaccucugguuagccaggauguuacaggcagcaguauuagcuguucuuuucuucuuccugggaucaggguuauucugucaugaguugcaguaauggccugaguuggucugccuccagccaggaggugguguuuucaagaaggcaccagcugcaguaguaacagugggauuuaagcuugcacuaaauuguccaagggagguauucugguuucucaggcaauagguggguccauaaagcucucaagaguuuaugucuucuguguucugcuaccacggcagguagagaaauaccaucaagugggggcagggauagacucuccuugggcgggucagacucuccuuggguagggcuugcugcagccacuguggggguuggggggugugguucucaggccagugagguuaccuuccaaaggggauuauggcugccucugcugugucauauaguuuaucaaggaagugggggauaccugguagcaaaaggccccacccagcucccacgcaguuggcgaggccagucucacuccugcagugcucugcuaauagagccgaguuuccauccaggcagccugugcacaaugaacucagaccugccccaggccauaggcuucccugcugagaaagcaagcacagcuuucaggccucgccccuaccugucugcccacaguguugguagcuccugcccucauaucugcagcaguuuccacucaccccccagauucugcuuaagaaaguucacgcccaguggcaauuauuauaaaauucaguuggaagcuucuuucaccccaugaccccucccuaauuccacuggcugccuuccuggaggcgcucugugagauacaguuauauaccuucccugggcucaagcuagagaaacugggagugccuauaaggcuuuucccauugcugcuacuauuguauuucacccagaucccugaauccauuccagcucuaauuuagguuaaaucccucuccugugaucuggauuuucagauucccuaguggaauucagaggcaggugguucagaggcaguggguucagaggcagguuuucucuccucucgcacucuaggaacucaguuuuucacccgucucucagaauuugcaguggugugccacuccuuucaaaggaucugugaauucuuucgguguuccugguaaguuccuauggugguucuuggaacaaaaguucaugaugugagucuccacacacuauucugucugagcaagugcaagaugcacauuagcccugucuccuaucugccaucuucugccugucuccuugauaauaauauuugauuucauguauaaacugccugaaauuccaugguuucauguagucaaaaaauguuuuuccaaaauuaaaagcuaaaaucauguagcaaaauguaaaaauaaaauuuaauuugaaugagcugacauuuuuuggaccuucagagaaaaaaagaaauuaagcaaacuuccuaaaagcuguucauuucuuucaucuugucucauuugcuguuugacccagugccaucuggcauccacauuccuuguucuccucacacaguccucuccagagacacaaauuacccccuagucaccagauucuuccuugacccuuauucugcuuggucuuuucauuuuugauaggaaaugucuguucaguaaaugaacauuugguuuuaugaucuaguuaauguauguuuuuauacuuccuaaaaaaacauuguguuaauaaauaacauauaaugcuaacaauauuauagacagauuccauucugcucacaaaaagaauaccacauuaauaaaguuauuucuguccuagggaagaccaaggcacauauuugaaaauauucacuagagccugagaucauacuuaggacuggaugacuugugggagauggaagggguagaggaaaaagggcaguuccuacauagcugauuucauaggguauaauguuuucuuacagauaccauaugcaugcaaguauaacaggguuuugggagaacuuaccugggagcagcauaaaucagaagaagacagcauaugcauuuuaagauuugaggguuuuuuuuaauguguauaaaaauuuuguugauuuacuauuauuccucaaguuauguaccuuuuauuucccacuuucauaaccaacucagaaauuucucaucccuauagguagcaucacuguccuuccugucaugaugcucacagccucaggacaaccuuuggucuugcucuuauuuaucacuuaccaucuccuguugaaucuguccauucuaucccuguaauccaucauaccucuuucuuuuccuagugccacuacucccaguucagagucacaaaagguugucccuuuugauaucacccacucguucaucuacuauuuauugaguuucuucuuuaucccuuugucagagaccagggacacaaagaugaauggcuuccuugcccucaaguagucaagucuaguaugacauaggcuuaucaacaaauauucacaguauauauuccuaaaacuguuuugaaaaaaagucacuauauuaucuucagauaaugugcuuuuauuauucccagcuauaaauacuagaaaaguaagcuaaauaacuagcuguguuuugccuuuuucuggcuuauuuuacccaaauuaacaguguaagcuuagauguaccuucaaaaccuaaaccugcauucucuaauuucugugucauccuugaugccuagagcugucauugacaagugucuguuuuagaacuaauacacuucaagaacaacauucugcucacugagcaguuccauuauuugucaugaaagagcugcacauucagaucuguauuuguauuuguaucuguauauacuuccuaaauucagauuuaauggucugacuuuccuucugaugaacagcagccaacccaucauccccagacaaugaauggaaacagugguuuuguggaucuucuuccuaaaucuguugaggaaaggacauuuucaaaguaaggagugagaaggaagaugaauuguuuaugggagaucaugauauaaaaaccauguuguucuguuuuauuucuagcuacaagaaaacacaugaaacccugagucacgcagggcaaaaggcaacugcagcuuucagcaacguuggaacggccaucagcaagaaguucggagacaugagguacugugggaaaauaccaugggaacggcgcuaagcccuuggcuuuccgauugaagggagcacuagcuauuagcugcucaucucaacauauguauuuuuuuauuuuaauggauaaaaauguuauauggcugauaugauugaugacuaagauaaauuuucacacugggacauuuucugccugaaggucaggcuuagguggccuggucccagaguugcuguuucuacuaggacccgaccugguaaaaauagaagauacaggguagugaggcagauuugaaaagaaugcagcaugugcaaauucuuacuagcuguaauauaaaugauaaauuaaaacaugcauuuaguggaaugcacucccauaaacuauucuagauugcauauuuguauacauccaucuaguauauuuuuucuguguuaaauagguacauauuuauccuuuuauuccauaaagguaccacacauauacacuucugguaguuuucuuucuucauuuucuaacuauuuugugaguauguuaaauauuuauugcaccuucauuuuuaaugaauuuaucucccagugcguagcuauagcaaugcuuuuagauaaguaaccuugcacauuuucauuauuuucaauauuucacuguuacauaaaauaagggugaccaucaagguugauuuugacuugagaaccaaaaguucucacuggaggcaccaggaaaaaaaaaauguaguauugcccauaguuuuucauauuauauacaauauuauauacaauauauuauauaccauauuauauagagguauuacucuuaguuuuugcuuauuuaaauaccagucauaguuuuauuuugcauuuggcugauaugccuuggaggauuuuucuuuagaaaucaguuucauuuuucccucuauucuuuaaaaacuuuucgagcacauuuuacauuucuucuuuaaaaaaaaaaaaucucugcguauuuauuuuacuggauucuuaaacuguuacuuuuuuauuaaaaagaaaaagcuuugggcugggcacaguggcucaugccuguaaucccgucauuuugggagacugaggcagguggaucccuugaggucaggaguuagagaccagccugaccaacauggugagacccugucuccauuaaaaaauauauauauauacacaaaaauuagccaggcaugguugugugugccuguagucccagcugcugaggaggcugaggcaggagaaucacuugaacccaggaggcagagguugcagugagcccagaucacgccacugcacuccagccuaggcaauagagugagacucugucucaaaaaaaaaaaaaaaaaaagaaggaaaagcuuugacacugagaggcaaauaucuuccuaacuuuacacuuauagauacaucuuuauaaauuauauuauuaaauuuuauuuacuucaaaaauugcuggacuguccacaauauucauucacuauuuuaacaacuaggcauucacaaggacaugugcaugaaucugaguacauuguuuuaucuucauuuuuacuaaugccacaauaauaaaaaguaauugaaauucuucagaagcaggugugauaaacagguaaaccuucuggauuauuaauuaccccuaauuuuauuacaaauaaaauuuguaauaauuuuaacggcguuauaacauuuaucuaaacuaauuaaauaauccuuuaaaauaggaaacccucuauaaccuguuauacccaagaaaacauauuuucccauguuuauaaaauugauucucuucauacuguguugaaaucuuucacuugaacccugggaacuccagcaugacacugcuaacuagaauagugcuucugcaucuuuaggagaucuuacaaacaccucugaagcuuguuuagaauacauauucuuagguugcaccucucagagguugugcucaguaagucugagguggagucuaggaaucugcauuuauaacaagcuuccagauaauuuggcuucagagggucaguuuaugaggaagacagacauagcuuagcucaccuguaucugggguuuucacuaauaaaauggagauaagaauaacaaugucacuggacuguuauaaaaguagcagaagaaagucugacauguauuaugcacucaaaaaauugcaguuuuuuaucuuuaagugaccagcucaguuacaagauggccccacaugguagaaauuagggagaguacauuaacaggagcccacuguauuucauaaaggcccugcucauuguuuuucccaauagugaagaaugaagacuguguuucacauaugcaauauguuggcauucauauucaaacacuaauuggguacaaugucaagguuguauugacugccuuuccucccguuucaauguggcuuugucuaguauaguggauggccuauuuuccaggacuuccaaacuuuccauuuguuauuaucccauguagaggguacaacauuuucauuauaaacuguggcuaaaaauauuggaaaauacaaucuguguugcuagauaaucaaauacaauccugaaauauuuugaagaguuugaaaauuucagagcuuuauuuauauaauauuuuauguguauauuucucucaaacuauaucuaacauuuguauauaaaugagaauaacucuuugugaaagcaacaaguuuuacaaagauuuuuacuuuuaaauuaugcccaaacaaguaauauaaauaaaagucauuuugaaaguguuuaaacuuaauaaaagaccuuaaaugggaaaaaauaguaagcuuugauuguuuguucaaaaacuaaugugccaauuuguaaauauggggaauauguuaaaauuuggucacagaccuuuuauuuuaaacuucuuuuugguuaaaagugucauauuagucuacauuuuuauuaguuacacuauaacauuuuugugcauucugguaacaaauuucugaauguauucaaaaacauuaccagcaaaauucagauagcuuggaagaacaacaguaccucucaguuuuucuuuaaaauaacuccaaauuaauauuuacagauuuuguaaaaccuagaauuugggccuuuuaauagcugaaaaaaaagcuuuauguuaagauuuaauuuguauguuuuguaaaaauaaguuauauuuuucugagcuaaguaagauucucauuuuaaccugauugucauggaauugcccacucucuuucuccauccauaaaauaacauuguuaauacccacuuaaccaaaauauuuccugugaaguuaaaaugaggucacacuuaggaaaguacucagaagaaauccaagcgguuggaaucauuuuucuaauaacauuggcaucuucugggaacuucucaguuaauuuguucaaacugauccacuggggacaaaauguuuggagaaggcaugucauuuuauuacaguccaaucauuguuauauacuuauaggaauaacagaagcaaaacuugaguugguaaaaugauuugucagagacauuaaaaagucaguguaaucaagagugguaaaugaagcuacccugucugugcucuggggcccuugaaaggggaccaccaagggcagugcaguguuucucugccuccuguuugcuaacucugcuccugcucuucucuccugugcuuccgggcugcaggucucacuccaucggguaagcgccacagggcugcguguggggcuuuccccacucccuugcugccccuuugcuuuccagggcucccuguuucuuucacacugugccugaaccaacaaaacuacacucuguuuuccagacaguucccgugaccaggaagauaguuuauagggcacuuaauacauuugaacuuauugaaguacaucucuaucucauuucugaaucauuuacaccauuucacuugcugagcucucucucaggagucucuuucucugcaccauuucuuccgguguugacagagcuucuuagaauugaaaagaagaagaaaaaaaaacaaaguggagauugaaaguuauauauguuuucugaaacuucuagaaaguaaaguugagaaacaaaaacagauuuucucuagauugucauguuucucugaauuucuuguacccauaauuuguguugauguuucaccuucaacuuucugugccuucugaaguugaagggaagaaagguaccggaaaagcacguacguauguuaagaaguuugugauuuuuaaucccaagcccccgaauuaaaacuucuuuuagccggaaucuuauuauauacuuuuauuuuuuuaauuuuuuccuaagaaagcggucuauauuuacagagauacaccaauugguaaugcagaugaggcucuuuuagugaugcuuuugaaguguaauuucugaggaaauaucugccuaauaguuucuaaaucaagugucuaggguaagaccguaaguaucccaugaauuuguuuguccuuuucuuucuguguucuagcaaagugcuacccauacuaaugcccucaguggauauuaugagggaagggugacagauuuggucccugaacuauuagcuccuugagagaagagaaagcagggacgcuguugaaaagugugaggugggagcaagcacuaggccaggaaaauggacccauugugcuccuccccaugcccagccugauuucugaguggaacucaauagaaaguaacaggcaaccaaccagagggaagaugaaucagcuacuaggauuaaugggaugagaaguuuaaaucucuuaaaauucucaggaauguuuguguuuguaccagauguucuugacagucaucuaguacaaaucaaucaucuugacaaucaaaccagaauggaugcagaagucccuauggccuaugagaacuguguuugccuggcaugugcuuccuugaaagucuuauguuaacuucuugcuuuccucuggccaguuucucuaccauggaaugauuagcuucuaccugccuggcucuauuuccuggauacugccuuuugcuccuuacuguuuuccugagcagaagggaguagagaccuaaguugggccuggagaagaugcccaugggcuacugggcucaccugggagaaaccagacauucucagauuuccuggcaaaaggaggcugcagaaaguaaaauaauaugcaaccacggauccaccaucuacuuuucauuuauacccuugaaagcugacuauacccauuauacccaacaaaaacaaaugucaucuugguuagaugggcagggaauauuucagauauuuggaauugcuguuuuagaacuacgaauagggaguuuuucauguacuuaugugugcucucuucuuuuuucuuuuuuccccuuuaaucugcuuuugcucugaaguuacuccauucgccauuccauaaguaugccugcuaugagguaauguguguaaaauauuuuauguaauauuaauaugaaauguguuuaagguguuauuuuauuuauauuuacuuaugggguuccucugcuuuaugugaaaggaaauugcugauggucuucaaaagaaaaggcugacaauucuguggaagaauugcguagcuugggcuuuugaccagacauccuggcuuaaaucuagucuuuccugugugauccaagacaagugacuuaaccucaauucuuuuauccauauauugcaagaaauaagaccuacuucauaugguguuugugaggcauaaacaaaggaaccuacauaaagcauuuagcacagugucugaacaugccaagcaaucuugcaaagguaaacuuggguuucuuauuuccgcagaauuaaaugcuagccugggggcaaguuuaaaugcaaggcuaaaguucuagagaggauaucauuaggauuuuuaagguggauauuaaggugagauguuuguuaaauaauaaaaugucaguauaauuacugaccagauaaaaacuggugagaaagacauucuuaacuucaaguuugcauggcauagugaugcaaucagauaaaauuaaacuaauagcaagacaggaaugaguguuaaauugaaaaucagaaaaugcaggcucuagcccagcucugccaaggauuaacuuugcacucuugggaaaaucaccucaaugguaucagcuucaucauauuuaaaauaagaggcuagaaccagauuagcugcuugucaaagaugccccuccacccaccgagcccuaaggcugccuagagaugaagccuuugggaucuucccccacuucagucagagcuaugccucuucuaccugcuuuauauugauguuguuguuugaaggcauuauagaaggaguuuaguuacuuucaauaguuugagaccgccgaagccaaauucuucauauauauaaucuuuuccucuguuuuuuaacugucaugaagagaaauucuuccuagggucauuugcagugcuaaaaaaguuuguacaucugauuaaaucuuauuaaaguuguacaucugauuaaaucugauuaaagagcuucucccuguucuccagcauguauucuaguauaauuuaauuagauaaaugucuguucuauuauauuuuaugaaggaaggcucuucuacacugggguuaugugguuaauugguugauuuggaaauucacccucaguauuuaguucucuguauuuggugguaaacagagaguacagauucaagauugcuuaauucaucuuugaauggcuugcucucccuagaauaagaaugccccaguuggguaguggaaccuaaggcucuguuccccuuuacuugucaaauuuuaaaucugggugucagaagaaggcuaguaaaaauuaacaugguuuuccccugugaaccaggaauucaucuaguaguggcuaaugggucaaauguagucugcaugagcuugccugaaacuaacuuaaaaaaaaauuauuuugcuugucuaacauauacccaugaaccauuuccucacugugggccuguguaacugauggaugacaggcagucaugugugcaggcuuggccaaauaaaaccugcaauggaaaugaagugccaauaacuauauacuuuuugagucaugcaaguauaauuuuacuaacauuucaucaugaaacagcauuacggaggaucacucauaggaauuugacucguguuugagucguacacaaaaugugaugccaugucagggcccucugaauucaccauuguuaaucuguacagccugaaugcagguacauuucugaccauguggagcaccaaggacucaggagacaauccccaaauucacucauaaacaucuauguucauugccuuuuaguaguauaaaagugauacuucauucugcaccacauaaugaaaccuauauucuauagcuguucuccuuuauaaaguuuuucuaggccauuccucuuauuuuacuuuuuuuuuuuugcacucaagagagaauaacaagugccuuauuaauucaacauuuaguugaauuauuugaucugaaaaugauggcaguuguugcugcugaaagcugacauggauacaagauuuaaaauacacuuaguucaguuccuguuucuuuaguaggagcuggugguauuuuuaaugguggugaugucauuaaauuauaauaucauggggccaaauccaauacagaaaaccagaaagcaccaaaugaaguuuuuagugcuuaaagcaacaaaauuauguauagauuauuuaauacaaugaaugagucacaaauaaaaugccauuaggggccaggcacgguggcucacgccuguaaucccagcacuuuuggaggccgaggcagguggaccaccugaggucagaauucgagaccagccuggccaacauggugaaaccccaucucuacuaaaaauucaaaaaaaauagcuggaugugguggugggcaccugcagucccagcuacucaggaggcugaggcaggagaaucgcuugaaccugggaggcagagguugcagugagucaagaucaguucacuguauuccagccugggugacagaacgagacuaucaaaaaaaagaaaaaaaaagccauuaggcugcaaagguucuauuugguaagagaacaaguagguauaucuauuugagaggaaaaauaacgcaugcuaauaaccuccauuuugauugggcauuagguagguaauggguauguuucaucuuaaaauaaugaaagcauuaacuuuccaaaacaccacuucauguaaguugucaaaaugauuauuuuuuuaaggcauggaaaagaaaaaauauaugaacauuuuuuuccuugcacuauuucugaauugucucacauuugcugaaauaaauaacuuuaaaaaaugccaaguggcaaaacucaaacaugacauucaucauauggauuuuccauugcuuacuaaaaaaccugagucaggaagaggaguguugugauagaaacaauaaaugcuaaaugaaaacuuaagcuacccauugcuccacuggcucauuggaaaugauuuacaguguaccauggaauuauuacaguugugucauugccaaauaccauauuauuuacuguauuguguacugaucauuuuaccuagaaaaauuccaugucagguuaugguuucugaaccuaaccuaacagaagugacauacauuuuaaaacgugguuggugcagguggcaagcugacagguagcucuguggcagaggccguguuuacagauaugagcagaaaaccaaacagcaugguugcuaagacagcuaggccuuuggagcugaccucucucuuuuuguuauuuuaggaauucuccuacuuucaaaucauuugaggagaggguugagacaacugucacaagccucaagguacagaugaagugaauucugugugaguggguccauugacucaggacagcuuagccauugcugcgguuaguuuaaagucgaggcagggccaagaaggcaggcuugcaucaagucagaccuuuucuuucacauauaaaucuaugaauaaaaccacuauugaauaguguuacuauauccuuagaguuguuuguauaaaccauucaggggugaauuguucauuaaagugaauugggguaugcguuuaccacuuaaucucuuaaugcuaucccuccaaaaguagauaugugagagaugacuguggauaggauaaaggcuauaugaauucugaauuuagagugugagugaaaguucaauaacagcucagagcugcucugguuuggacauggaccagcaaaaacaaacuggggacuacguauccacuacccgucagcuaccuagacuuguuuauaaauucagguacugagcacagcacaguauggcuaucauagagggaaaauuaaacugagucacaaaaugcauuuuauaauaacacaguaaugcauuucaucccuggguauaaauugaaaaugugccuauuacagaguguuuuaaaaauucacuggaauuauuguucuagcauagguaaguuugaauaaaaagaguaaaaugaaaucagucuagucuuaaaauugaacuuuuaaaacaagaaaaaucauuacaacuacuaagauuauuuuuaaagguaucacuuaaugacuuaauuacaucuugcuaucauuaucucuauuuuguauacaauccauuucuguauuuuaccauaacugggaaaauuaagaauauacgugaucuuuaaccagaucaaaaaccuucauaucccaugcugauuauucagcugccucugaauccuguaucuucacgcugcucucacgugugcugccugauaaguauaugugagguuguaaguuauuccuuacucgcgguuccaggugcucuuguggauuuugaccuggagagucuuuucuuagggcagggucuuucacauggucuacuucuacuuuauuagacccauaauuagguguuuaaggcccaggaaugaaauuauuacucagcauuuaccaugccuucaucaguuucauucaccagaaguuuccaguugugcaguuucaccgcucugcaugccaacaucaucgcuuauugagcguacaggaaccaaugggagccguuaaacagccccaugaguaggaaaauuuuuuuaaagggaagagcauccaauguugugaacauuugaucuucuugcuagaagaucaaaaugaaaggcucaaaaaucccaggauucaguuucuaaacauuugguuuucagccuuagacgacccaaugaggauggguuccauugcuuguuagacaaguucugacaaaggacaaguuguacuuuuuagguuuucuuuagaagaaggagauaugaagaagcaaaagaagaauaaagaacaacccauuuucauuugcuuuuaggaaacucugguaagcucauggcucacauaggauuuaaguguuugauccacauguucagcuucucacuuuucucaccucacuuggauagaagguauagccugccgucuccuucagacaugcacauaacuaacccagcccacuagauacuagccuuugugaagaccuccugaaagugauucuaugcuuguaugacuguucaugguuuaacaagacucacaugccacauacuuccuauuucauggccaaagccuaauuccucuuuuucuguccacacaggcaaugcagaauagcugauaauuaugcuuugugucaaaccucccacuuccuaaauaauuacaaauuucucuguccuuuuuuuucccacuagacuaaauaauagauauguauaacccuuuuuuauauagcuuauuuucugcaguuuacuuuuguguucuaagucuucuccaaaaugucuauauuguucauuaguuaaggauccuuagacuguuuucugcugagggaaugacucaugagucgguaaagaugaguggaauuucuugcaggucuaugugcugcauuuccauucacaugcccugcuuucaauuugauuuuugaaaacacugcugauaagaaaucauagucauauuuauguccugugagaaaauaagguucugcuauaaagguccacuccugccaucuucucacacaaucugucauguaccauguggcacuuguaccaaauccaugggucuuucuuuacaccaaauucuguaguuuguuuuuccaugaaacacuuuuccaauccuauaaaauuuaguucugccuacgcccuuacaauguauuacuugacacugcagcugaugucaccuguacagucacugagcaugcuuccuauuucauccaaaacaaacaaguaaaugcagaacgaacuccugugaagccacuuuugguaucuucugccaucucccaaugagucaugaguaacuacaucucuuccaaccauuuugcauccaugucaagcagaccauauuuuuagugcaccuacuuuuugauaaauacauuauauggccuggaccaaaaccuuaaaaagaaaaggggggcaaguugcauuacauguuuuguuucuuuuuguauuaugagagauuaggaagcccaacucagcgauucaaaugaaauucuaugcaaagaacgauuauaauuugggggacaaagugacaaauacuuggaugaaaaacaauuauguagagaaggguccaggagaauuuuaucauucacaucuuugcuuaaggagguccuuaccuaagauauugcaguaggcagucauuaaaccuacgugguuaggaauaucuuugauuccauaccuucuuugccaaauugauuucuuacaaagccauuccuucuuuauuuuacuacucuguuuagaggaaaucaagaaacaggagagaauaaugaaacaaagcacagaagaaaacgucagugauuuguauucacugaauucaauauuguguguuacuucuauugcaaaagagaaugugaauggaagaaaaaagaggagagagggaacuauuaauagaguagauuacauugaauuaaucuuauuuguuucucucagggaagaaauaagcauagugaaaaaucacacaauggaaaccaucccuuccccugaccuguucccaguguuaagauaacagagggaaggaagaucaaugcucugccagagguccacaaacuaagcugaccacuuucuuuugaaugguacauaagcugagaauggcuuuacauuuuuuaaugguugaaaaaaucaaaauaaaaauaauauuucgugacauuugaaaauuaaauuacauaaguucacauuucaguguccauacauuaagucuuacugaaacacagccuuggccaggccugguggcucacgccuguaaucccagcacuuugggaggccgaggcgggcagaucacuagaggucaagaguucgagaccagccuggccaacguguugaaaccccaucucuacuaaaaauacaaaaauuugcugggcauaauggugggugccuguaauaucagcuacuugggaggaugagacagacagaauugcuugaacccaggaggcagagguuggaguaagccgagauugcaccacugcacuccagccugggccacagagcaagacuccgucucaaaaaaagaaagaaagaagaaaggaagaaaggaagagaaagaaagugagagagagaaagaaagaaaagaaagaaagaaaaagaaaagagagggagaaagaaaggaaagaaagaaagaagaaagaaagaaagaaagaaagaaagaaagaaagaaagaaagaaagaaagaaagaaaagaaaagaaagaaagaaagaaagaaagaaagaaagaaagaaaagaaaagaaagaaagaaagaaagaaagaaaaggggaaggggaaggggaagggaagccacgcucauucacuuagguauucgcuguggcuacuuccuacaagaacugauuugaguaucugugagagcaacaaugugguucccaagccuaaaguauuuacugucuggcccuuuacagguagaguuuucugacaccaagcagaguacaaaaauucaauuuaauaaauaaauuuaagaggcagagagagauuuuagugacaauuagagcgaaguguguuuuguaaugauggaacugcuuuugaacccugguuacauuuuuaaaaggucaggccaggcagcacagacacaauccccaguguugcugaugucugugagugaucacuuuggugacagugaggcaucaacaaucaguuuggcaauagcaacauuauuuauucuauaucuucuuuuuccuucaaaguguuuuuucuacauuaugaaaaacaaugggagggaaggccagugugacuauuaauaagacuugcacuaagcauuuugcaucuugucaagcagaccauauuuuuagugcaucuacuuuuugauaaauacauuacauggccuggaccaaaaccuuaaaaaaaaaaaaaaagggcaaguugcauuacauguuuuuuuuccuuuuuguauuaugagagauuaggaagccaguuuuaauaagggauuuuuagcaguuuuaauaaggaauuuuucaaaauacuuagccuuauuuuuaaauuguaaguuaauuccuucauguuucuaugcuuagucaauaacaaauacacaagaaaaaagccucauaaaccaucauaacugcauuguaaggaauauucauacuguaaggguguauuaauuccauuucacgcugcugugaagaaauaccugagacuggguaauuuauaaaggaaagagauuuaauugacucacaguuccacagggcugagggggccucaggaaacuuacaaucauggcagaaggggaaguaaauauguccuucuucacaugguggcaggaaggagaagugcugaacaaaaggaggaaagccccuuguagaagcaucagaucuugugagaacucacucacuaucacgagaacaguauggaggucaccgcccccaugauucaauuaccuccuaccagguuccuccuugcuaggauuaugaggacuaugggaacuaccauucaagaugagauuugggugaggacacagccaaaccauaucaaaaggcaguugccuaagaugaugugaaaucaccagugauuaagacuugauccaucuucaauuuucaaagcagaaaccagaaaucauuuuccauugagccacucugacuuuucaaaagacauuugucagaaauccaguuugcccugcuaacucccaaguagaaaaaucuaaguuuaggucauguaaggauguuuauacauuuguacaauuggaggaauuaauaaaaaaucuaauuccauuuugauuagaucaguucucugggugaguggagauagcuguuccaaguccauggauccgauuaugcuccugaagggauuaaaaucuuagauacaggagagauaaagagaggguugcuaaaagugugcaaaauuaaaguuuggaauccuauccgagaacccaaguaugaauaauauucuagcacucuacuaaaggaaacaaacuucugugcauucuuuugucucuaaagauagaaaguauuucugaauuugaaaguaauccagcuuuugguauucuuauaaaaacauuacaaaaaugauaguaacaacuaacugcauuuuuguggaucugcucauuucagacgaaaguaggcgguacgaacccuaauggaggcaguuuugaggagguccucagcuccacggcccaugccagugcccagagcuuggcaggaggcucccggcggaccaaggaggaggagcugcagugcuaaguccagccagcgugcagcugcauccagaaaccggccacuacccagcccaucucugccugugcuuauccagauaagaagaccaaaaucccgcugggaaaaacccaggccuugacauuguuauucaaauggccccuccagaaaguuuaaugauuuccauuuguauuuguguugaugauggaccacuugaccaucacauuucaguauucauagaugacugucacauuuuaaaauguucccacuugagcagguacacaacuggucauaauuccugucuguguaauucgauguauauuuuuccaaacauguagcuauuguuugcuuugauuuuugcuuggccuccuuuaugaugugcauguccuugaaggcugaaugaacagucccuuucaguucagcagaucaacaggauggagcucuucaugacugucuccagcaauaggaugauuuacuauaaauuucauccaacuacuugugaucucucucaccuacaucaauuauguauguuaauuucagcaauuaaaagaauugauuuuaaugac

SEQ ID NO: 192128 - RNA, 33193 nt, Homo sapiens
auucugggauuacuucuuuuccgugggaguaaggaagugcuuuugaaugagguacugagggccaagguguuggaaguuccuaauucuuuccucgguuaacugugaaacucugcguauugggaaggccuggccucagucaucaggccaggagagguacuggacgccgcgcacgcacucgucugccagcgaggcccaaaggggaagccuagcggagcucaguguggcagcugcuggccucugggccgguaagaauugaugguccccucccuuauuccccaggcccaaagcuuugacccaguuagugccugcuaguuucgugugccuggcuugugccuuuggcgcggaacguuugggagacucggccuugcggucuucugaccucacccaccacguaccuagcuuggcacuggguccuucaugccucucacucgcuuccucugaggcaccuggguacucucuugucucuuacccgcuuaaucugaguccauguccaaguucaucauucugugucugaccgugucccagccaccggaagagaagaaacuccgggugugacauuaaucccacugggggcucgggagaacugccuucuaaaaucagagacuguauccauuugucuggagagaaaugaaaaaaauaaggacaauguagggagguauuuuaaagguaaauuuauuuaaaugaagugauagugucauuacuuuuccuguuugauuuuaaauagucuuuagcugaacgaugaccuguaguaggaaggugguggcgaagugauugcuuuuuuuaaaauuauuuuuuuaacacuuuuaugucaguagucaguacuuuauuuguccauaaaauccaaaaauaacuaccuuuggauuuuacaguagucuuugacugaaccucagagagaugagauuccuuacccaaaaugaugaaucugaaauuauuacccaguucucuugacucuggaauaagugcuuuuuucuacuauaccacuucugcuuuuauucuuggggcugagaguacaggcuguggagcacgacgggguuggcauuuuggcuuccaccuuuuucugcuuguggugaccugucugagccagaauuucuuuauguguagagcgauaauaauaguacuuaaauuacaauaauagcacuuaaauagcacuugauacauguaagacucuaaguuuacaguguuaaacucuacuuguaagauguguuuauuuaccuccucaauauaaucagcuucaguauucaguauuuagauauaucaguugauaaauagguuucuucucuucauuuuuuucuuaccugauuuaucuuaccuggacaauuuuuuaaacguuauuuuuucuccaccuugggccagagacauuuuuugaaauauuuuauuuuuaaaauuacuuguauucauuauuauugccuuuuuuuaaaaaaaaauaaaugaaauuuugguugauauuuauaaauaaguuuuuguauuugaggaacaguaaguacauugaaaacuucuucaucaaaauaauccagcguuaaagaccaaguaauugucucaaaucauuuuaugaaacacauuuuuucuucaaaucuuugaaaccuaauguuauguucuuuucuagcuacuugucaauaccaugcuuuccuguaauauuuguggugaaacaguaaccucagaaccagacaugaaagcucaccuaauuguucacauggaaagugaaauuauauguccauuuugcaaguugucaggugugaauuaugaugaaauguguuuucauaucgaaacagcucauuuugagcagaauacacuugaaagaaacuuugagaggauaaauacaguacaauauggaacuucagauaacaagaaagacaacacccuacaguguggaauggaaguuaauucaaguauucuuucagguugugcaucuaaucauccaaaaaauucagcucaaaaccugacuaaagauaguacuuuaaaacaugaaggcuucuauucagagaacuuaacugaaucuagaaaauuccugaaaaguagggaaaaacaguccagccugaccgaaauaaaaggaucuguuuaugaaacaacauacaguccuccugaauguccauucuguggaaaaauagaggagcacagugaagauauggaaacucaugugaaaacaaagcaugccaaucuuuuagacauuccauuggaagguaaaguuuucauuucauuauaaauuauaaguuuacagccucaauuuaauaugugguauuuuaaaaguugguuuguaagucagcuuacuacagauguguuuugaaauccauuuuaugucuauaacauuuuucauuugcuguuacugaaauauaaaaguacauuauggaaaagaauuuuaaugcagauauaaaauguuucagcuacauugagaguaguuuuggaacuuucugucuaguuuccagaggguauucuuuuuauugucacuaacccaguagcaucuggacuguccuggacucucugacuuugcauugaguucuauuuugacuccauuauucuguuaugauuggagaacaaacucucugugauaucaguucuuuuaaauuuguugaggccuguuuuauggcucaagacacgagcuaucuuggucauguucuguggauacuugggaaaaaaaaguguauucugcuuuguuggguggaauguuauauguaugucacuagauccuguuguuuauguucagauuauuuauauccuugcuuguuuucuauaguaguacugucuaguaguucuaucaauuuuugagaagggguuguugaaaucccugauuauaauuguaaauuuaucuauuuuuccuuucagcucugucagguuuuguuucauguauuuugagacucuauuguugguguguacacauuuaggaucuuaugucuuuuucuuauuguugaacuuuaagaauuuguggagccagguguuguggcucaugccuguaaucccagcaaguugagaguccgaggugggcagaucccuugaguccaggaguucgagacgauccugggcaauguggcaaaagcucgucucuucaaaaaaaaaaaaaaaaaccaaaaaacuagccaggccuaguggcuugcgucuguagccccagcuauuugggaggcugaaauaggaggaucaccugagccugggaaguggacgcugcagugagccaugaucacacuacugcacuccgcacuccacucugggugacugaauaagacccugucuccaaaaaaaaaaaaaaaaaaaagaaaaauuuuucuguauuuuggauacaaguucuuuuuuggauguguauuuugcagauauuuucucuuagucuguggcuugucuuuuuauucuuuuaacagugucuuucaugaaguagaaguuuuuaauuuuaaugaagugcaacuugacaauuucuucuuucauggaucaugcuuuuggugugucuaaaaacucuuugccaacuucuagaaguuugauaguuuuguauuuuacauuuagaucugugauacauuugaauuacucuauguaaaagguaugaagucagugucuacauucuuuuuuaaugcauuucucugauuaugaaaucaaucuuuuuuuguauaguuauuuuaauuuccucuauuaugaacugcauauuacauuuuuuguacacuugaguuacaugcauuuuucaacuguauauugucaaauauuuuuugaguuuuuuucaguugcuuuuaaaauauauuuucaauacuaauccuucagcuguauuccauaagauguugcuuauccuugaauuuugugcaguauuugaauuuuauuuuuguuuucuauguauugucuaaaaaaguauucuuuacucugaauucaaaaagcuauucucauauauucuaaaaacuuuaauguuuuauauuuucacuuuuuaaaauuuuuucuggauugugugugugugugugugugugugugucuguacuuguguacauguguauauuuugugaacuugggaucuaauuuuuaguuuuucccuguacagaaaccagauauaucucugauuuauaauaugguuucuguuuuuuauuacauuuucauaucugugugggccaguuucuggucucuuacuucugcuguauuuaucuaugugacuuuuguucccuuauuacaccaccacuuuaauagcuauuuuguaaaaugucaucaacaucagauaggacaguuuuucccucguucuucauuuucaucaucaacuuagaccuucucauucuuucuuuucuuugaguuuuaaagccauauuaucaaguuucauaaaaacucuguugucauuuuguuuuaaauuagaucaaaguacaucuccccauuaauucaggucaucuuuuguauccuuuaauacaauuuuguguguguguguuuuuuuuuuuuuugauggacuuuugcccugucacccaggcuggaguguaauggcacgaucucugcucacugcaaccucugccucccagguucaagcaauucuccugucucagccucccaaguagcugggauuaccacugcccaccaccaggcccaguuaauuuuuguacuuuuaguagagacaggguuucgccauguuggccaggcuggucuggaacuccuaaccucagaugauccaccuaccucagccccccaaaaugcugggauuacaggcguaagccaccgcgcccaggcuuguguuguuuuuucauugcacauuuguguuagcuuuauuucuguauaguuuauauuuucuguugcuuuuguaaauuagauuuuuuucccucucaucuaagaaacuuuugcaguuuuauagaaacacuaucaauuuuuauagauaguugagguaucuagucuuauucaacuauuacuaauauuauuuuauuuuauauuuuuugagacaaggucuuacuaugucacccaggcuggaguucaguggcaugaucauggcucacugcagccuugaucuccugggcucaagugguucuccugccucagccucccaaggggcugggacuacaggccugcaccaccacgcccagcuaauuuuuuuuuuuuaauauuuaauagaaaugagguccugcuauguuacucaggcuggucuugaacuccugugcucaagcagucuuccuuccucagccucccaaagcauuaggauugcaggugggagccacugcgucuggccuguuaacgaauuuuaauaauucuacauuaauucccuugaguauucuaaguagaucauuuuauuaucugcuaauaaugaaaauuuauggacugcugcaaggaaaaaaaacaaguguauugaaaaaugccugacaauccuuugcugacacaacauuuccuguaaguuucucaggaccaguaaacuggugaauuuugguagucuuaggagucugaauguuuaguugcgguuaaaaaagaccuguugucauuagaaguacagaagugaaauagguaaauagcuagauuuaaccaauguucaguuauaguaaauggaacagguggauuugcagguguuuuuaagggaaugauuaucauauagagaagauauguggaaucugggcuggaaaguaaagaaaaacaugagggggguaaugaaugacagaaaaauaggguuuguauauucuauauaggagguuuuaguuaggucaaacacuuuuuagagugguagaauuaaaagaagugagguagaaggauagguguuugggagugauauuugaaauugagauuucagagauucacuuagugauaaauuaaggguauaauuuuugucauucgguugguaaauuaggguaaaggaaaagauuguuggaaaugaaggcauagaacuauuucuauggauauugaaguugcuaagaaugaucauaguauaggggcuaggaaaagaagguuuugauccagguguuaacauuuuuaguaaaugaaaggagugucuaagacuucagaaaauauuaggcacuaagaaagguagaugaugccauauuauggugacaugaguuauuacaaaaauggggcuuaaaacagguuugacaguggugaaagggagcaaaggggaugccucuucuacuucuagggcccugaauugugaaagaaaaguugccuguguguuagggggcuguagagaaaauggggugucaugaaccaaccagauuuuaguuaagucaagaaggugaagugaauauccagagaaagauuuuguguauagagaagcugacugaugaccgaugguauuucugagggcauugugguagguauugggagaauaggagggguaauagcuugggucagauuagcagauguccuucagguauuuaaagauuguuaagacacugccacugaacaauuagauuggauucauugacacaacaguguuggugguuacaucagcccuagaugacuccauuggaugaugauggcuaaccucugaggcuuaguuuagauucuggugguaaaaaauguauacugggauaugagguguaguguggucuaauguugaggaagguugguuaucacuuaaaacuagaagggguggagggauuggcuugcaguagugugaugaucaaagcgauaagcaaaggccuccuuggcauuggcucuggcucuaaggcauuuuaugguagagaacuggcugaaagacuucucuuacauccgccagcauuacuuauggaagcuguauaccauuauuucuuacugcugcuuuuggaaauauuuucugaguacuuaauacuucauuuucucuugagcuuugccauugaauuuuuuauuccaaugauuacaucuuaauauuuucauuuucuucaucuuucuauuuuuucuuaguaacuuucuguccugguuucaaagauucaguucccuccuuuauuucagugagcauuuugaacauacuuauuuuacaguuuauuauggauuacuguagcuccauuucuucacagguaacuuuuucaguuuguagauuucuuagcuguuuuucuuggcauugcagcccccagugaguuuagcaauucaaauuuuaguguucaucuguuaugggaguuuuauaugaucccuucccugugaagcaguuucaugguuccuucacacuggcuguucacagucucugcuuucagaccaggccuuacauauacagauugcucuaugcuuucacucuguguauaugcacaauucugggucccucuucuaugucccuuaucugcuaggucuuggucuuauagaggaacaauuucuguuuuuggcaagcuagaccugucugccugcagugcuaugugauggaugcagcucuuuaaucuccugcuccuguguagacaguauuaccccaauucccagcuuuaugcuggauguuuaaguucagcaccuuaccacucuguugggugcugagaauuuaguccuaaaaacccauauccagacugggcccuacuuaccacuuugguuuuccuuucugcuucucuuguuuugacuacagaucugaauauuuauuauuaauauuuccuuuuuuuuuggagugguaugagagguuugugcuaugcucagccuucuaucucgacccuagaaguagaaaaauagcuuuuaaauccacuacaaagagcuuuuacuuauauaagguuaauaggugguagacagucuuugacauggggugaaaaaaucuaaaaguuauaaaaauaaaaccaacuuggcugggcaugguggcucaugccuguaaucccagcacuuugggaugcugaggcagaaggaucacuugaguccaggaguuugagaccagccuggacgacauagugagaucucaucucuaaaaaaaaaaaaauuagcugggcgugguggcgcaugccuuuagccccaucuacuugggaggcugagaugggaggauugcugcagugagccgugauggugccacugcacgccagccugggcaacagagugagacccugucucaaaaaaaaaaaaagcaaagaaaaaaauuaaaauaaaaaaauaaaaacaacuuaauuauaucucugauacagacugugaucaaccacucuaugauuguccuaugugugggcucauauguacaaauuaccauauucuucaggaacauguugacuugcauuuggaagaaaacagcuuucagcaagguauguuuauauguuugaagauaaaaauaucauuuaauuucuacuuucuaggacacauaucuaauuuuuagauuugugauauggaaaaaauauuuuaaaauacaucuuuuccuuuaaaaguguuuuauuuacaaguugaggccauuucuuuagcagcuagaaguaucugaauauuguauuuggucagcgaaaauuguugaacuagaaaacugccauauggcacauaaaauuuuacaaaugaaugugaacuauauaaccaaaacaucuuucagugcaucuugagcugcuugaauagcuucuaaaugacuuacugguuuuauugugauucuauaaaaguuuuccuuucuccccuauguuuuuuaauaguggcauuguuuaaauaaucauuaugguggcuuagaaguggaaaaauccuauaugaauguuagaagcccacugaacgaaaauaaaaaguagaucccaagagaaaccaauuguguuuuacccuauuucaguuuuuuaagguacguagauagcuucuguuaaggcagaggucuuuaguguccaguaucaaugauccuaguaccaguaucgguguucauggacaauguuacugcucacucacccuaagccaaauaugagauuauuggggcaaagauggaaaaguucccugcucuggugguuucugaaugucugcuaauucuuacucuuauuuaugauaggcuuuguaugagcacguauauuacaguguaaaccuauaguggguaauaagaaaaagauauggucuaaguaaaucacuguagauaaccucaggggacacuaaacauugagugugacuuguauauccccaagaauggaagggugaccaaauaggaagauguagcagcagcugagaacuuugaaaggaaaggaagaauagucagugauauaauuaaaccaucaggucaugggguuaaggagacaagauaguggccagaagccacugacaaauggaucugggggacaccgaguagagaagaugcaggaugagauguugcaaaguuuuaccauuuuugggggccaaacuguaauuaaauuauuaucuaacaccugcacuuuguaaauguguauuuuuaugcucuuuauuuuuuuuuuuuucuccccuaguauuucuuugaaaaaucaaucugccuuaguuauguuaaggaguaucaaugcaggauguuacuuaacguuuuaaaauucugguuuccucaguaaauaauaauaacuacuucauaagauuguuacaaagaucaaaugauauaauuaaugaaaagugcuugucacagcuuuaaacacuuagugaggcugggcaugguagcucacgccuguaaucucagcacuuugggaggccgaggcugguggaucaccugagguuaggaguuugagaccagccugaccaacauggcgaaacuccaucucuacuaaaaauacaaaaauuagcugggcaugguggcaggcaccuguaaucccagcuacucaggaggcugcagcaggagaaucacuugaaccuggcaggcagagguugcagugagcugagaucgcaccauuguacuccagccugggcaauaagagcgaaacuccgucucaaaaaacaaaaaacagugacuguuaguugucauuuagauggagguuauuccuuaccaaagcaguucuaaguuuugcuaaauuuguacucaguuccauaucaucacagucaugaauaaauggcaaauaacagcauuuacucuauuuuaaaaacauauauuaaauaauaaauaaucuuugauugcaacaguuauuuuauucugaacauuaacaauaccuaacaggcauggauagaguccaguguucuggugaucuacaauuggcucaccagcuucagcaagaagaagacagaaagaggagaucugaagaaucaagacaagaaauagaagaauuucagaagcugcagguacaaagauuaauaacaauuauaauauuuugauuugguaaaguuauuuuucaaauaugcuuuccaguguauuauuuuuguccuuguuauuauucaaaaaaaauuuauacauguuuguaacagacaccauuuauaaauauucauucuagugaggcacagggguaaucacuucacauacaauaucucaaaaucuuugcaacauauucaugaagaaguuacuuuaggcccucccacgcccccuuuuuuuucagaugaagaaauggagacagagaaugguuaaguaauuugcucagugucaggcagcuaauuagugauaaagcuugcauucaaaccuguguaaguugaugggacaaauuaggaaaccaagacucagaauuuaaguguuuguauagaugcuuggaagcgaaauuuauacuuagaauuaaugucuccugagucuuaaauuauuuuacagauugcaauuucaaacauuuacaacuauuuuaugggaaaaugcuuuuuuuaaaugauauuugaggcuucauuuaucuuaggugggugguuuuaccuguuggacuaaacugguagcaucuguuauauuuuuaaugcauuuaaaauuuuaaugucuguuuuuccuuuuuucaguccuaauuuguagacuguaguguuaucugugcuaauaaugcucauagauucauagauuuuguuguuguuguuuguuuguuuguuugagacggaguuucacucuugucgcccaggcuggaaugcaauggugcaaucuugguucacugcaaccuccgccuucuagggucaagugauucuccugccucagccucccaaguagcugggauuacaggugugcaccaccaugccuggcucauuuuuuuguauuauuaguagagacaggguuucaccguguuggccaaacuggucuugaacuccuaaacucaggugauccaccugccuuggccucccaaagugcugggauuauaggcaugagccaccgugccuggccuauugcuuauaguuuuuaaauguucuuuuuuuagugaugauaggauagugcauacauaaaaaggguuuacaguugaauagguuugaaaguguucaguuaaacagguuuguauacuuugggacuucucaaagccuuuaauauacuaaugugcauguacauaucacaauuuccccagacuuguuugaccucucuuuuuuucucagacaucucacaugaguauuguugcuuagaaugugcuuuggaagaccuaauguaggauuuuuuucucacuggugacucacaauacuugcaaaauaggaaagaaaauuggcuuuucuuaagacuuuuaugccuuauguaauuuaaaacaugaucaauacaaaaaguuuccaauauuuaaggagguuauguaauuuugcaaguuaguuguuuagaucucagaaaauuuuucuguagaaaaguuuccgugaaaacuuuuccauagacaauuuuuccauaguuuuauacauacuauuugagauuucuguccaguguacaaaacauaguucauuuacuguguaacaugacugacuaaaugaauuauggauuaaguaggccuuuauggacuagacugggaaccaaauaacaaggacugacaaguuuccuugaaaaaaucagcaaugcauucagaacucuucugcaucucccaauaccugagguagaaagacaggauccucugcuuucccuacuacaggaaaagcaagucucuugcccuggagauugauuauaaagaagugguugcuuauuaagucaauaauuuuuuuuuguguguguguguguguguguuauuaguuuuuguaaaaaucuuuaaguuaacuuguauaaagucuauaaaccagaauguuucaacauguuuccaaauaaaauuuuaauaaguuuccauccucauagaguuacagggauguaaaaauuaagucauuuauuuuuauguucaauagagacaauaugguuuagauaauucuggaggauacaaacaacaacaacuacgaaauauggagauagaaguaaauaggggaagaaugccuccaucugaauuucauaggagaaaagcugauaugauggaaucauuagcucuugguuuugacgauggaaaaacaaaaacuuccggugaguauuuaaacaucagagucauuguuuuaauauugcuuauaccacugaaguaauaaucagaaucauuuuaauuuugcuuaauuuucauaaucugugcacaaauauuuuuuuaaaaauguauuguuuuaaaacuucugaauuauuuuuaugauaaauaauucacuuaaaaauuuacuuuuauauuauguuacuugacauuuaaaaagcuaugcucuagagagugcuaagagaaauauaaugugagccacauauauaauuuuaaauuuccuggcuccacauuaacaaaagugaaaaggaggcugggcgcgguggcucaugccuguaaucccagcacuuugggaggcugagacaggcggaucaccugaggucgggaguucgagacuagccuaaccaacauggagaaaucccaucucuacuaaaaaaaaauuacaaaauuagcugggcgugguggcacaugccuguaaucccagcuacuagggaggcugaggcaggagaaucgcuugaacccgggaggcggagguugcggugagccgagauugcgccauugcacuccagccugggcaacaagagcgaaacuccaucucaaaaaaaacaaaaaaaaaacaaaaaaaagugaaaaggaacaggggaaguuaauuuaaauaguuuaaaccaguguauccaugauauuauuauuucaacauguaaucaacauuaaaacuauuacugagacauuuuacauuguuuauacauucuucaaaauccauuguguauuuucuacuucacagcacaacucaauugggcagccacauuucaaauucucgauagccacaaauggcuauuggcuauuuuauuguuuguacauuuuuagacacuaacaacucuauauacauuguaucauuuaacucaaaacauccucuccuguacuguuauauauuccaaaugaggucacuguugcuuagagaaguuacagugacuuugccaaagcaagguuacacagcugguuauuccuaaucaaaucuuccuugccccauaauauggcuuuuuucugaugaguauuaaaauuuuuuucuuuguauauauuaguauauuaacagacuuuuuauggaaacaacuuuguuacugucacccagauuuuuugaaucuuaauguuuugccauauuuacuuaaaaguuuuuaaagcuucaacaccuuugauagguauucaaagcccuuuauguacacuuuuucuaauucuaauuugcccuccccacaagggaacuauuaucccaaguuugauauuuaucagucucauacaugcuuuaguacucuuaccauguauguacauuuccauaaaauauuuugcagguguuuauauauaaaugggauacaacauguaugcuauaaauuguuuugcucaaauauauugguucuuacaguucuacuucauucauuuuagcugcuguguaguauuuccuuguaugaauuguagcuaacuuaucuuguuuucauauugauaaacauuuagauuguuuccaguuuucuacucuuauaauuuaugaacaugucuacuucaggaguuucucuaguauuacauccagaacuggauguagcuaauuauagcuaacuuaucuuguuuucauauugauaaacauuuagauugcuuccaguuuucuacucuuauaauuuaugaacaugucuacuucaggcguuucucuaguauuacauccagaacuggaaugcuaaguuaaagggcgugcaaaucuucaacguuguuaagguuauuauagaauuguuuuccaaagugcuuguaaucuacauucacaccaguguauuucacacauaguauggugacacuuuuaaauuuuugcuauuuaacagguuaugagaugauacauguuuuaauuugcauuuucuggauuacuccugaguuaguuuccucuugaacgaauuaccuguucucuuccuuucucuauucucuauugaguuguuuguucuuacugauuuauaggagacuguuaaguauucagaacacuauucuuucauuaguuauaugaaauccaaauaucuuuuucaggccugugguuuguguuuaaauguuauauauagugccuuuaauuagacagaaguuuugaauuugaauguaaucaaaguucucaaucuuucuauuuauuauuugugucuuaaguaacucccccaucuuuaagaucacaaauauauaccuuuauguuuucuucaaauauuuauauuuugcauuucauauuuugauuuuaaauccacccagaauuuauuugcauguguauguuggagggaggagggagaagauaggaaucugauuauuuucuccuuguuuauaacaguccuuauagcaaguacauauuaugcuuauuuauuucacuaccauuuauugaaucugcauuuucuccaccuauuugugauacuauauauuauagauuuucauauauccaugauucuguuucuaaaggcugccuuuauauuucuucaggggucuccauguaaaaaaguucucacuauagcauagagcauccuccagaugugugauaugauucauuaggauacaggaagaaaauauuaaauaugucuguaaaaaagcacacuguccuguaauauagaagugauuuaguggcagagauuuuuauuuuucguuaauuaugcaaguguuaauuuaagcagcuaucauuuaaagagucuucacuuauauacugcaaucuuguuauaauuuuaacaacagaauauaauuuaacugaagauaaauuuacuguggaaaauaucuaaagacauuuaggugcuaaggaauaaaaaguauaaggaaauuucccccuaaagcaguugcaugauguugcuaagacaguguugcucuccaucugauauguaacauauauacuaaaauguacuagaauguuuauuacuuuccuuucuauuuuuucuguccccuacuccaccucauucuuaaagggcugccucaaaucuugaucucuucaucaaagucuaugauauuaaaaucuacauuuagcuuucuuucucugaauuccuaggguacccauucauuccaugcuacaacauuuaguacucaguuauauacuauuuuaauuguuguuuuucuugaauucaagucuuucuaaguucuuuggaagugguuacagugaucaguauuucaccuuuucauggugcaaggcacagcuacaacuauugguucauuuaacuguuuuuauuuauugaucuuuuauugucuuuauuaaagacaaaaacccauuuucuucuaggaaacccuucauucaagcaaaaagaauuuaguuauugucuuuggugccacaugcuaugagaaaguuauggggcauauaauaagaucucccuacccauaggcuucacagagucuguagaguauguaaauauacacaaagaauuauaguauucugugacugaauguugcugguaccuuggggacacaaaaauaggguagaaucagaaaaagggucuaugaagacaguagcaugugaaggaucuauaauuuugaaacauaaggagaauauacuaaaagcaggaaaggggccgagucagaugucccuuguccuaacaccuuguuuuuccauauuauagcacuuguuauaguuggggucgaugacauuuuaaaggauauuaucauauuuaucuuuuuguacuuagcauuuagauagugccagguguauuaaaaaguacuuagcaaauacugaauuugaaaauuuaauaaaacucuaugggccaaauuauguuuaauguguucaguuaggccacagccaaaauuacagcaagaagaguagugugaaauaaagauaagacaguggauagcuuucuguagacuucauauaacauagauuagaacuauucuaauuagguuuauaaggcuauuaauaagauuccuaaaccuauuguucugccuuaagaaaaguugucuucuguugucucaaacaaauuaauuaaucuccccaaauagcaaaauggaauauguuacuaaaggguugaaauuuagcguauuggaguaugagauauguuuauuauucaugaagucaagaguuuuuaaaugaaaacauuuguguauucucaugcuucgaaaauugcaaaaucugcaaaauaaaaucuuaaauuacaaaaaaauuaaaacuauugguaauagggagcuauuaauauuuuuugauugggagcaaauugauuaagacugagugaucuccaguagucuauacaauaaaauggagacacaagaagaacauucauucaacaguuguacuuuaugugcugggcccugcagaugcagaaaauuucaaugaacuguaauaaauaauaugcuaguguuaggaaacuuggacuguaguaacaagcaaggacacaaacuaagguuauagcaagaagaaggugaagaagauggaauuaacaggauuuagguauggugcgugaaggagagguugauauuaaaaauguaugagauagcaauauaaaggugauaaugacugcuucugaaucucuuuucuacuuuaggaauuauugaagcacuucauagguauuaucagaaugcugccacagaugugagacggguguggcuuucuucagugguggaucacuuucauucaucuuuaggcgacaaagguugggguugugguuacagaaauuuccaaaugcuacuuucaucauuauuacaaaaugaugcuuacaacgauugcuuaaaagguaugugaaaucuaguacucugaacuugucaucugauaaaauacauaugauauagaaugauauagcauacacaauuaauagcuuuaacaguuaguggauauuuauauaagaaaccugaauucugguuagaggaagagaaaaugauagaagaugucaggaauaacugucuuaaaaaccguaaaguuccccgaguacauaauacacugcuaaauauuauucaguacuuuauuaacagucauguaacauguuugcuuguguaauuuuagguauguugauuccuugcauuccaaaaauucaaucuaugauugaagaugcauggaaggaagguuuugauccucagggggccucucaacuuaauaacagguuacagggaacaaaggccuggauuggagcaugugaaguauauauacuccugaccucccuaaggguaaaguauguaccuuaaaaccuaaauaaauguuauuuccuuaucggggagcuuuguuuuguaaaauuuuauuuuuuagcaaagagauaguuuaaaaauaaaauuaaguagcacuaaauuaaguagcaaugaaaaucagcagccuauucacuaucuugugcucuucucuacccucaaguucugucucucagaggcaacugucacuuccauuguuuuuaaaugguaugcuuucauagcuguuucuugguuuaugaguuucagauagucuguuuuaauaucuuauaccuguuuaccuucaauccuucugauaugauuaaaucuugguuuuuauuaaaaucagaguuuacaucauuuuauaaagucagauuuuauuauacaauuguguaaauauugcuuguugcugauuuuuucuaaaaucauuuauaauuuuucuugaguuaauaauuguguuuccuuuucucuuuuacuauaauaugugacgacaucauggccucaaguuuuugcacucuaccugucauguaaucugaggcucuccuuauucucggacacauccuucuugagcauucuguccucuuugcuccaaucuggacuuuuugccuucuagaucuacagcuauugucauguagcauuuuuucacuguuuuguguguguguguguguguguagucucauuuuuaaaauguauaaccuauuuauuuucuguggaaguuauuccaaccuucucuuagcccaucauaauuucacgauauuaugaaauuucaccaugggguguggggcuuugauucauuguguugggcauuuguuuuucucuuugaaucuggaauugugaguugucuaagaucuuaguuccaucuaggauaguagguaagagcuugaacuuuggagcgagacugccuaaccuugauucauagcuuuccuacuuaauagcugaaugaaugaacuugucuguacuuaggucuacuauugauaaaagaagguauuaauaguaguuagacaauuaaaugggauaauaaaguacuuagaacugugacuggcauacagcaugacuucagagguuaacuauuguuguuugauaauuauaaugucucuguuuucuuuguggaacuauugauaguuggccacugaacuaaucuuuuuuuuuuuuuuuuuuuuuuugagacggaguuuuugcuguguugcccaggcuggagugcaguggcgugaucuuggcucacugcaagcuccgccuccuggguucaagcgauuccccugccucagccucccuaguagcugggauuacaggcuuccgcuaccacgccuggcuaauuuuuguauuuuuaguggagacgagguuucaccauguuggccaggcuggucucaacucuugaccacaggugauccacccgccucggcuucccgaagugcuaggauuacaggcuugagccacggcgcccggccugcuucuuuaccuucuaaguuuaucaugucucuuuuuuaaaaaucuuugcuuuuucucuauuuucuagauuuacucaacuuuaucccccaauuacuguauugaaauuuuuauuuuacccauuauguuaagggguaauuucauagcaucauuuucuuuaugguugcaaaauuucuuccaauguuuucuuucuauugccugcauuuuguuuguucgauauuaguauuuuuucauaucuguuuguuuuagucuuuucuauuuugaaggcuuucuuuuaauuuuggaaauccuuaguuguccauucagagagugaagaaugaaacauuaaaaagcugauuagagugcuguaggacugcacagagcuugcagauuagcagacuuauuuaaaagucuuagguggaaggcggaagguuacuauuugguuggggaacucucaaauaucguuauauagagagaucuuuucccagaaguuauccagagaagaguuuuucacucucuuaccuagaguuccuacauuaguggaggggagaguuaaggugugauuugccuucuaagcaaacuuuuaauuaaucucauauuuuuagccucacuguucucaaaccuuaugcuucuaagcuuucagccucucucugauuuugaaacauacggucuccauuuucuuuuauuuacuuuuauauguucucuguggugcuuuccauuuucugaagaugugagcucuuuuccugucuauucccauucucuuuguccuuggguguuuaaaucauuuuuuccuucaguauuaugucauuggguuuuuaagaggaaauagagauagaugucugugaucguguuuaauggaauguuugcguuaagcuuuauggcuuuauauuuucuuuuauguuuguuucuaaguuauuuaaccaguguaucacauucuuuuuaccacauugauugauuagauucagaaauaaaaauauuucuuucauuaacauagaaaaacuaauguuguguguauguauaauaacuuucuugaauuauuuaaagaacuauuuuaaugcccucuaaauuuauuccugcuuuucuccuuuuucuuuuugccaauguguucacacuuugagauuauuuauacucuaucauguuuugaguuuuaaaguaauuuuuuucuuuuucuuuuucuuuuuuuuuuuuugagacagagucugucuccagucugucacccagaccagagugcaguggcgcgaucuuggcucacugcaaccccugccucccaggcuuaagugauucuugugccuuugccuccugaguagcugggauuacaggcaugugccaccaugccuggcuaauuuuuuuuuuucugcauuuuuaguagagaugggguuucgccauguuguccaggcuggucuugaacuccuaggcucaagcgauccacccgccuuggccucucaaaguacugggaucacaggcgugagccacugcacccagccguaauuuuuguccagcuucuuucuugguaccuuaaauaauuuagaaagcuuuuuuauuaauauauccugaguguguuuaguaguuauuuacaugucuuucuguugcucucucuaugaguuauauccuguaggguacuguuuaauuaguauucuaaauguaaauaugcaaacugcuaaccccaaaacauucuuuuuaaacgguuuauccagaaguuuauuugagcacuuaaaacccaguaaccaacuguaaguuaccagcauuaaauuugcugaggcugagguuagcaauucggauguuuuagagauuuuauugccaagagaaacaagaacaggauaucugugcuguaguuuaaagugaugauaaagcuaucaaaugcuuuuaguuauacccgaccuuuuaaaaacaguuguugaguaguauaaacaguguuucugguuaaaaaaauguuuauucaagggugacuuccucuugaaggaagaauaccacggugguccgguggcaaauaggagauagauguauagauugaguacacacacauuuuucuaugauuuacaaguauuuucuguuauagagauuugagagaccgacaggaaaaguauuuaggaucuauuuuauauauaccaauggcuacugaggaauuaaaaucagaaaucagcuucugaucaucaggguuagaaacuagaauaaaagcugugaaaaaauuauguguagaugacuuuuuaaaaaucaaguauggucauuauuuacuauucauggagauuuuauauaucagagaauguuuguaaccuuuagguuagucagcagacuuauuaugaaguuauuuaaauaguuagcuaguuagaggaauaguuaaauaguuaaauagggagaauuguuaaauaguuaucccccacaaaaaggaguuuuuuagauaaguaauaaaaauuuauauuuacuuuucuucuuuuauaggaaaguaauggcuagaaacaguuaguucuaaacuaagaauuuguuguauuugauaacuccaucgaugaaaauauuuuaaaaugcccuuuaaaugugcauuuugucaauuuuuaauaggugucauauuguugauuuucacaaaucaacugguccuuuggguacacacccucgcuuauuugaauggauauugaacuauuauucuucagagggagaagggaguccaaagguaguguguacaucuaaaccuccuaucuaucuucagcaucaagguuaguauuaauauaacucauauuugacaauguuguuuauaagauaacaaauuguugcuuucagacagguuaagguuuuuuguuuguuuguuuguuuuuuuagacagaaucucacucuguugcucaggcuggagugcaguggugcaaucuuggcucgcugcaaccuccaccuuccagguucaagugauucuccugccucagccuccugaguagcugggauuacaggcgccugccaccauaccuggcuaauuuuuguauuuuuaguagaaacgggguuucaccauguuggccaggcuggucugauaauagcagggaguauuaugacauuaaucuguuuaauuuuucagagcuccuuugacaguacaauacuuucuuagguaauuaagauugauauuucuacaauacuucauuggguaauuaagacugauauuccugacaucuucaggaccuuuugcacuucuuguuuucuguguuuaguucacuuguccuucauuguucaucccuuaccuucuugggucuuuacccacaugucacuugagugaggccuucccugaccuuaccuuaccuuaaaaguagaacucaaggccaggcaugguaacucaugccuguaauccuagcacuuucagaggccaaagcaggaggauugcuugagcccagcaguuugagaccagccugagugacauagugagacccugucucuacaaaaacauaagaaaauuagccaggugugguggcacaugccuguaguccuagcuacucaggaggcugaggugggagggucacuugagccuuggaguugggggcuauagugagccaugauucugccacugcacuccagccugggcggcggagugaggcugugucaaaaacacguacaacucaucccagcaucccaccgcuggcauuuucuucacuuauuuaccucauuuauagaguaucucuuccuauuagaauauaaguuccaagaacacaggcacguuugucuguuuuguuugcuguuauauaccuucgugcuuggaguaguacccggcacauagauacuugguaaauuaugaaugaugguuuggauugacaggaauaaacagaaguaaauguuaggaauuucauuguuuaggaauauaaacuauaagagauuaagcucccuccacugauauucuagcauuuauggguuuacuuuuguuuaccuuuuggaaucaugagaguuuuguucuagaacaguuuuuguucuuucauuugagauaauuugaauaagaaggaucaaaggauugggaaaggaaaaguaaaauauuuggcagaauaaaaauguuuuuuuugguaaugaagccuuuagaaaacuaaaguuaaaugaaaaaacugaaguagaacuaaacucuuacgucuuaggagaacuuagauacauaugugucagagucugacuguauuuauauucuaaacacacauaugaucacacaacauacauacagagacuauuuguauaacuguaaauagaugugacguauguauaacuuaaaaaucuuuugauaggucacagucgaacuguuauuggaauugaagagaaaaaaaaccgaacauuaugcuuacuaauacuugauccuggauguccuucucgagaaaugcagaaauuauuaaagcaagacauagaggcuagcagucucaagcaacuucggaaaucuaugggaaauuuaaaacauaagcaauaccagauauuggcaguagagggugcucuuucucuagaggagaaacuuguaaguaucuaaauauuuauaugugaaguuugaaugagaugaacuuaaaaguuuaaaacuuuuaguuuaaaaucaguguuaucacuuuuuucuuuuuuuucuauucuuuuucuuuuuuuuuuuuuuuuuuggagacagggucucacucuguugaccaggccugagugcaguggcaugcaaucaugacucacuacagccuugaccucccaggcucaagcgauccuccugccucagccucccaaguagcugggacuacaggcacaugccaccacaccuggcuaauuuuuguauuuuuuguagagacgggguuucaccauggugcccaggcuggucucaaacuccuaggcucaagcgaucugcccaccucagccucccaaaguguugggauuacaggcgugagccaccgugccuagcccacuuuguauuccuuagcaccuuauucuguuucauuaacuuggaaaagccauuugguuuuauauguuuuuaauuucuggaaugaacauauuuauauuugaaaugguacuuuaaugacuuuuuauacuuagagcuucauaaaaguguuuaauuuaauuuaauuuaauuuaauuuuuuugcauuuuaaauaugugcaguuuacuguauguuaauuaaaacuuaauaaagcuuucaaaaguacuuuuguacaaauaauuaugauaggcuacaucuuaaaugauguuuucaucaaccuuacaauuuagccuuguaggagugucugaaucccuugcaaaacaguagucauuaaaugcccguuuccugucuugauaucauucaugagcugauuuuuucuuuucaccuccuccuccucuuucuucuucuucuucuucuuuuuuuauuauuuauuauuauuauuauuaucauacuuuaaguuuuaggguacaugugcacaaugugcagguuaguuacauauguauacaugugccaugauggugugcuacacccauuaaaucgucauuuagcauuagguauauuuccuaaugcuaucccuccccacuccccccaccccacaacaguccccagagugugauguuccccuuccuguguccauguguucucauuguucaauucccaucuaugagugagaacaugcgguguuugguguuuuguucuugcgauaguuuacugagaaugaugauuuccaauuucauccaugucccuacaaaggacaugaacucaucauuuuuuauggcugcauaguauuccaugguauauaugugccacauuuucuuaauccagucuaucacuguuggacauuuggguugguuccaagucuuugcuauugugaauagugcagcaauaaacauacgugugcaugugucuuuauagcagcaugauuuauaguccuuuggguauauacccaguaauaggauggcugggucaaaugguauuucuaguucuagaucccugaggaaucaccacacugacuuccacaaugguugaacuaguuuauagucccaccaauaguguaaaaguguuccuauuucuccacauccucuccagcaccuguuguuuccugacuuuuuaaugauugacauucuaacuggugugagaugguaucucauugugguuuugauuugcauuucucugauggccagugaugaugagcauuuuuucaugagucuuuuggcugcauaaaugucuucuuuugagaagugucuguucauaucguuugcccacuuuuucaugggguuguuuguuuuuuucuuguaaauuuguuugaguucauuguagauucuggauauuagcccuuugucagaugaguagguugugaaaauuuucuccuauuuuguagguugccuguucacucugaugguaguuucucuugcugugcagaagcucuguaguuuaauuagaucccauuugucaauuuuggcuuuuguugccaaugcuuuugguguuuuagacaugaaguccuugcccaugccuaugugcugaaugguaaugccuagguuuucuucuaggguuuuuaugguuuuaugucuaacauguaagucuuuaauccaucaugaauuaauuuuuguauaagguguaaggaagggaucgaguuucagcuuucuacauauggccagccaguuuucccagcaccauuuauuaaauaggaaauccuuuccccauugcuuguuuuucucagguuugucaaagaucagauaguuguagauaugcggcauuauuucugagggcucugaucuguuccauugaucuauaucucuguuuugguaucaguaccaugcuguuuugguuacuguaaccuuguaguauaguuugaagucagguagcgugaugccuccagauuuguucuuuuggcuuaggauugacuuggcgaugcgggcucuuuuuugguuccauaugaacuuuaaaguaguuuuuuccaauucugugaagaaagucauugguagcuugauggggauggcauugaaucuauaaauuaccuugggcaguauggccauuuucacgauauugauucuuccuacccaugagcauagaauguucuuccauuuguuuguauccucuuuuauuucauugagcggugguuuguaguucuccuugaagagguccuucacgucccuuguaaguuggauuccuaaguauuuuauucucuuugaagcaauugugaaugggaguucacucaugauuuggcucucuguuugucuguuauugguguauaagaaugcuugugauuuuuguacguugauuuuguauccugagacuuugcugaaguugcuuaucaacuuaaggagauuuugggcugagacagugggguuuucuagauguacaaucaugucaucugcaaacagggacaauuugacuuccucuuuuccuaauugaauacccuuuauuuccuucuccugccuaauugcccuggccagaacuuccaacauuauguugaauaggaguggugagagagggcaucccugucuugugccaguuuucaaagggaaugcuuccaguuuuugcccauucaguaugauauuggcuguggguuugucauagauagcucuuauuauuuugagauacgucccaugaauaccuaauuuauugagaguuuuuagcaugaaguguuguugaauuuuggcaaaggccuuuucugcaucuauugagauaaucaugugguuuuugucuuugguucuguuuauauucuggauuacauuuauugauuugcguauauugaaccagccuugcaucccagggaugaagcucacuugaucaugguggauaagguuuuugaugugcugcuggauucaguuugccaguauuuuauugaggauuuuugcaucaauguucaucaaggauauuggucuaaaauucucuuuuuugguugugucucugcaaggcuuugguaucaggaugaugcuggccucauaaaaugaguuagggaggauucccucuuuuucuauugaucggaauaguuucagaaggaauguuaccaguuccuccuuguaccucugguagaauucggcugugaauccaucugguccuggacucuuuuugguugguaagcuauugauuauugccacaauuucagauccuguuauuggucuauucagagauucaacuucuuccugauuuagucuugggagaauguauguuucgaggaauuuauccauuucuucuagauuuucuaguuuauuugcguagagguguuuguaguauucucugaugguaguuuguauuucugugggaucgguggugauauccccuuuaucauuuuuuauugcgucuguuugauucuucuuuuuuucuuuauuagucuugcuagcggucuaucaauuuuguugauccuuucaaaaaaccggcuccugaauucauuaauuuuuugaaggguuuuuugugucucuauuuccuucaguucugcucugauuuuaguuauuucuugccuccugcuagcuuuugaauguguuugcucuugcuuuucuaguucuuuuaauugugauguuagggugucaauuuuggaucuuuucugcuuucucuugugggcauuuagugcuauaaauuucccucuacacacugcuuugaaugugucccagagauuguguuauguugugucuuuguucucguugguuucaaagagcaucuuuauuucugccuucauuucguuauguacccaguagucauucaggagcagguuguucaguuuccauguaguugagugguuuugagugaguuucuuaauccugaguucuaguuugcuugcacuguggucugagagacaguuuguuauaauuucuguucuuuuacauuugcugaggagagcuuuacuuccaaguauguggucaauuuuggaauaggugugguguggugcugaaaaaaaaguauauucugcugauuugggguggagaguucuguagaugucuauuagguccgcuuggugcagagcuuaguucaauuccuggguauucuuguuaacuuccugucucguugaucugucuaauguugacagugggguguuaaagucucccauuauuauugugugggagucuaagucucuuuguaggucacucaggacuugcuuuaugaaucugggugcuccuguauugggugcauauauauuuaggauaguuagcucuucuuguugaauugaucccuuuaccauuauguaauggccuccuuugucucuuuugaucuuuguugauuuaaagucuguuuuaucagagacuaggauugcaaccccugccuuuuuuucuuuuccauuugcuugguagaucuuccuccauccuuuuauuuugagccuaugugugucucugcacgugagauggguuuccugaauacagcacacugaugggucuugacucuuuauccaauuugccagucugugucuuuuaauuggagcauuuaguccauuuacauuuaaaguuaauauuguugugugugaauuugauccugucauuaugauguuagcugguuauuuugcuuguuaguugaugcaguuucuuccuagucucgauggucuuuacauuuuggcaugauuuugcaguggcugguaccgguugugccuuuccauguuuagugcuuccuucaggaucucuuuuagggcaggccugguggugacaaaaucucucagcauuugcuugucuguaaaguauuuuauuucuccuucacuugugaagcuuaguuuggcuggauaugaaauucuggguugaaaauucuuuucuuuaagaauguugaauauuggcccccacucucuucuggcuuguagaguuucugcugagagauccgcuguuagucugaugggcuucccuuuguggguaacccgaccuuucuuucuggcugcccuuaacauuuuuuccuucauuucagcuuugguaaaucugacaauuaugugucuuggaguugcucuucucgaggaguaucuuuguggcauucucuguauuuccugaaucugacuguuggccucccuugcuagauuggggaaguucuccuggauaauauccugcagaguguuuuccaacuugguuccauucuccccgucacuuucagguacaccaaucagacguagauuuggucuuuucacauagucccauauuucuuggaggcuuuguucauuucuuucuauucuuuuuucucuaaacuucccuucucgcuucauuucauucauuucaucuuccaucgcugauacccuuucuuccagcugaucacauuggcuccugaggcuucugcauucuucacguaguucucgagccuuggcuuucagcuccaucagcuccuuuaagcacuucucuguauugguuauucuaguuauacauucgucuaaauuuuuuucaaaguuuuuaacuucuuugccugugguuugaauuucauccuguagcucggaguaguuugaucgucugaagccuucuucucucaacuugucaaagucauucuccguccagcuuuguuccguugcuggugaggaacugcguuccuuuggaggaggagaggcacucugcuuuuuagaguuuccaguuuuucugcucuguuuuuuccccaucuuugugguuuuaucuccuguuggucuuugaugauggugauguacagauggguuuuugguguggauguccuuucuguuuguuaguuuuccuucuaacagacaggacccucagcugcaggucuguuggaguuugcuagagguccacuccagaccguuugccuggguaucaguagcaguggcugcagaacagcggauuuucgugaaccgcgaaugcugcugucugaucguuccucuggaaguuuugucucagaggaguacccggccgugugaggugucagucugccccuacugggggaugccuccccguuaggcugcucaggggucaggggucagggacccacuugaggaggcagucugcccauucucagaucuccagcugugugcugggggaaccacugcucuccucaaagcugucagacagggacauuuaagucugcagagguuacugcugucuuuuuguuugucugugcccugcccccagagguggagccuacagaggcaggcaggccuccuugagcuguggugggcuccacccaguucgagcuucccggcugcuuuguuuaccuaagcgagccugggcaauggcgggcaccccucccgcagccuugcugccgccuugcaguuugaucucagacugcugugcuagcaaucagggagacuccgugggcguaggacccuccgagccaggugcaggauauaaucuccuggugcgccguuuccuaagccugucggaaaagcgcaguauucgggugggaguggcccgauguuccaggugccgccugucaccccuuuccuugaccaggaaaggggacucccugaccccuugcgcuucccgagugaggcaaugccucgcccugcuucaucuggcgcauggugcgcugcacccacuguccugcgcccacugucuggcacucccuagugagaugaacccgguaccucagauggaaaugcagaaaucacccgucuucugcgucacucaugcugggagcuguagaccggagcuguuccuauucggccaucuuggcuccuccuccuccaaaaguguuuaauuuuauaauauuuaauuuuuaaugucaggugagcgaugaauaauguaaacauauaguaagaaaaccuaacuuaauccaaggagaccuaacucauauuggccuuauaauugugguuuauuaaaauaugauucuugugacuccuaaggcucuauuuuaugcacuugggcuuauuggauauucacauuucuagaauuuaacuucauuagaauuuccucuugucuuuauuccuugcaguuaagugaugagcacaauauuccagaaaaauuccuaggaauugaauccuagcuacuacaccaucaggggggaacguaauauuauagaaaaauuccuaggaauugaaaaauuuccacuuggugugaacugaagcuauaugauagcacaucaaguguagaaaaugcguaagcccuaaauuaagaaaaaaaagcuccaaaauacuucacauugauuuauuucccucuaaagagaaaagugacugaagacuagagacaaacaguuauggagaauaaugggaucaugggggaaaggacuguaaguuuuugaaauaauagagcuagaauaaucuuuucagucucauaacaugggauacaaaggcaagguuuuuuuuuuuuuuuuuuuggagaccgacucucacucugucacccaagcuggagugcaguggcuugaccccagcccacugcaaccucugccucccuccccaguucaagugauucuccugccucagucucccaaguaguugggauuacaggcgugugccaccacgcccagcuaauuuuguauauuuaguagagaugggguuucaccauguuagccaggcugauguugaacucccaacuucuggugauccacccgccuuggccuaccaaagugcugggauuacaggcgugagccaccgugcccagccacauuaauuuuuuuaacccuaucauuaauuugucuagauaaaguuagguuuguuucaauuauuguaaaauaccaagacacuugcucaccaguguacacauucgagagcauaggugugguuaaguauuacuguggagucuugcugaacauuuuaguuggcuguugucuuucugguuuuggaaauggaguuguuugugggauuagaauacuaaaaaugugcuuucugcacugugcauuugauguucugguuuucuaagucauggacaguagcugugcuuuaacuguaagaaucguaacuuggcuaacaauguauaacacugccagguagaaaaggaauaauaauaauaaauauaauaagauuuaauuauaauagauugaaauaacacuugucuaaugcuuauucuguacuaugggcuaucuuauccuaagcacauuacauauguuaacuaauuuaauccacacaacagcccuauaaaguagacaccauuauuaaucuccauuuuauaaaagaggaugcugaggcagagagaaauuguauuccuaagguagcacaacugcuaaauagagagucaggauuccaauuuaggcaguuugcaucuggagcccuauauugccucuucuguaaggauacaaaaccucauagucauguuugcugagcuuuuguaugaacaauuucacauuucuuuuugaaaagauauuacauuuugaaaaaugaaaaaaauuuaaucuuacuaauuuaauauaacuuuuuuuagcaucuguuucuuauaguuauucuguccuuuuuaacaguacuuuauacuguaggaauucagccaauauuaaugugccaaguguuuugcagaucaucagguaaaagucugcagcuuuauuuaaaggacaaaauagugauuucacuuuuauuucauauuagcuuuuauaacucauuuuuuaaaaguauuucuucaaagcaauaacuacaauuuuuuaaauuguaggauuaaaaacaaauaugauaguuuaugguaucccaaaauauacauauuuauaacugcauuuuauguuuuguucuucauauuuguacuuaugauuaguucugaucuuuuaauaaucaugcaacuauuauagaaagagagugauugguuuucaaaaauuuuuuuuaaucuuggccacuagagucuuauaauuaccauaagacauuucugccauagauauguuuugagugucuacuaauuucagacucuguucuagauguuggagcaauuguuuaggugaaaggauuuauuuuagacaauaucaccuaaugcaguucaguuaaauaguaaauacagauuuaugcaauagccauguuccuuaauucuuuuucacauuaugauaugcaguuuuaaaguuaccccacuauauucguaaauuuuccaucgugucauccuuguauucucagcuugauuuaacuuaauuuagcuugguuugauaugucuugauuuggaacucagguugugaaaauagcacaaacauugaaaauuuuuuugaagugacguuuuuaagacuauaaugagggauaugcauaauguuuauaaaguuucucugugcacagcccugucuuccucuagccuccucucuguuuuuauucaucucucucugacuuugaggcagcauuuuacuuuugacucauuauuccacaaaaaagugacauuuucuauuucauacuguuuugucuuuaucuggacuuuucuuuguuuaugccuuggcuggaaaaauguuuauuccuaauuucagaaguuugagauugcaauuuuucuuuaggaauuuucauuauuaucuugaaaaaaaauuccagauuuuauuuuuuacauuagaaugacaacacauauucuaauuaauugacuuauagcuuaaaauuguuuuuuaaaauuucuuuucaaggccaggagacaagcuucucaagucuuuacagccgagaagauuccuugaagaaucaagcauuuaagcauuucagugauugagaacaauacuuuguuuucuaaauguagauauugaacuccuuaauacaauuaugaaucugugaauucucuuaagucuuaacauauaauuuaauuucuaaaaugccuguguuaauugaauuauaccuaucauacuucauuguuugguaaauuauuucaauaaaaugucuuguuuuugcauugug

SEQ ID NO: 192129 - RNA, 184181 nt, Homo sapiens
caucaucauggcaacaagagcugcagccugggaccgaggagcccgugugauucccggcgguggcggcaguggcggcagcaccagcaccgacgaaagcucgagggcuucucuccugcggccccuugccgggugcuccugaggaggcggcggcagcagcgccuacaccgccccgcccgccgcuccucgaggugccucugugugaggggagggggccgugccgagaaggggagggggcgccgccgccgcugcggagggagccgccgccgcugcugcugccgcugccgggucgccagugaagggaggcaguggcggcggcggcgaacauguuuucaguaaggauagugacugcagacuacuacauggccagcccgcugcaggggcuggauaccugccaauccccccucacccaggccccugucaagaaggugccgguggugcgagucuucggagcgaccccggcagguaagcgggcgccgggcgcggggcgggagcgggagucggcggggcgccggggccgcccuccccgccgcgcacacgcgcacacgccaccggcgccggccgucuccguggaucgcugccgcgucuucccuccccuccgcccuccucgccuuuucucucgugcgugacaagagccgcaaaaauguggguccgcgcgagcgcugcgcggcgcccccacccccgggcagggagguggcgagcgccgcguguuuagacugcguguggcggccgggagcgggagccgcacuccagggcgcgggccgggagagcgaaagccgcgggcgccccggacggcgggccagguggccgcgccauguccaucgguggacggguucguagggccugcucugaggucggucgcuagugggacaucccuugugucccccaagugccgcuuucuggaaacggggaagugucagccuuguugucagucgcuccccauggucucuucucacccucgcucuccucugccaguuccggagaugcagugggccggagagaguggcgcuuggggccagauaaucuuucucacuggggugaccguguggcucugcugugagugcaggucgugacuccuuagaguuuagugccugagcgucgggggacagggcagcauccuuaggugcagugcuuucaggaaaugugcauccauggaaguaggaaaugcguguuuauguugcccaaccuaaaacaucacacuuaauggggugaauuuauuaggaaccacagccagacucagcagcacagacauuuugaaaugcuccuaggcugggcuguaggauugcguuuuaaguacagguauauauuuuuuaaacacaacuauguugaagaagggaugggaaggggagacagccgugacagaagguacguucucaaaaacuccuggggcuuaugauaauauaaaaaagauagaggcccaguuuacuagguguuuuaaaaugguuuugcuuuuuugcaugcuuugaacugcuuccaugaaauaauggaguucuaggaaauaaugcaucuuaggaaagguuguucuucccucuagcuaugaauugcccuaugggauuuuagauagcauuucccacuugaugcuccuugcccucaucaccauucaucuuauuacuacagucaguuucuguggacuaccaagauaauagcgcuuucccaaacacaagcacucauuuuaaagcaguuaucuuuuaaugugaauucucuuuguuaaaaugucaauguugugagauuugguagcauauuccuauuuaaacuagugaauaugauuuugauaugaaccuugaaagauggggaauuugagugcuuuuaacguguugaaaguguaacacuugaaacuuuggaggcugggaaaucgaggcgaugaaguguucuauaagauagguuuucugcccuuuuaaauauaguggugcugucuuuguuuccaauuggaauuucaguguaaugcacuguucucacuucagaugcagaggaaggauaaaauagugaaguugauauggcccuguucagccaaauuuccgaaucauaaagugacaugcuaauaggauauacuguggcauuucuguguauuacagcuuguaugguuugaguuacuuuuccacacauaauuuuuucuccuccacacaagucauuaaauauguuuuccugagagauagucaagcuuuguuguauaggaaaguuucguuuguggaaauaaaugaguuucacuguaagcuaauguaauucuauuacgugaggaaauguuccuuaaaaaauaaagaauauuauauacuguuguuuuccugaauauuuuuuaaaagacacauuaacuauuuccuauuuaauccuucauggacaucccacaauagauuaccagcaccuuaaaaaaaaaaaaaaaaacaaaaacgaaaaaaccaaagacuaaaaacccccauugggguuuuuuuuuugguacauacuuugaaauuuauauuuuaaaugaauuaaaaaguaacacuuuuuauauguacauugaaagacauaaaacuugauacagagaaagucaaauuuuaaauuguuaaggauuaucaaauugaauuugccauguaguucacaguuuccaacaaaauguuuguuucaacaagaaaaaauuugaagucauuggcauacauuuagaguuuacacuuuucauaaaccaagccagcauuuuuauuagcacgucagaaacucccagugagauuaauauuaauuaaacauaaucaaaaacugcagaauuaccugcuuuugaauuaucuccccaaggaaaacuaguccaauaaaauaaaacuugaaaauuauuaauauaaaagagaggccagucugacuuaguaaaacucugaaugcuagaauuuuuaaugaagacagauuuauuugaaaguaaagauguaaacauaaugcaaagauauaaacaugguuuguauuauaucuuuauaguuuauaucuuuacuaacaaguaaaauaagguaauaaaaauguguaacacaugauaaaccuaugcuacauaaaauagcauaaacauacuuuuuucauauauaagaauuacuuugggagguccuuaaugcuuuacuuugguuuggagagaaaauguuuuaaaauugacuuugcuuuacaaaugagauccugaaaaauagcaaccaaagauauuuuuucucaaaugaaguggccguuucaaaauuauauuacaaauucugaacugauuggauuaauacccuuuuacuaguuuaguuuuucuauuauugccugaaaagcauuuuucugcuuuagaaaacaguccaguugacuuuugauuguucuguguuuugaggacguaucuugaguaauuuaagaaauaaaguguuuuggguuuaaaagcucccaugucuuaaguuggugaaauuugaaaagguauuuuuaaaaagagggauauucagggcugggugcuguggcucaugccuguaaucccaacacuuuggaagacagaggcaggaggaucgcuugaacccaggaguuggagaccagccugggcgacauagucuguacaaaacaaacaaacaaacaaacaaaauuggcugggcgugguggugugcaccuguaguacuagcuauuuggaaagcugagacaggagaaucgcuucagcccagaagguugaggcugcagugagccaagaucacgccacugcacuccagccugggcaacagagcaagagccugucuuaaaaaaaaaaaaaaaaaaggcggggggggauauucagauuugaaugguaaauccugacugauuuaaucccuugccaacugaggauauugauuccuaagggaaucacuuaaaguuucuucaucugaguuauggaauuuuuuaaaaaacaaaaacaaauuuccucuccauuuuuuuaacuaguuuuuaaaaugucuugaacauuauuuugacauaaucaaauugagcaguaucauuuguagaauaaauuguuaauuuuuucuuuuagaacaacauuuugguaacuuguuuuaauggagggaagaaagguugugaauaaaguauaggacaauguuuuuucauuuagauuugaauauaggugugaccacucagaggauucacuacaaaugaaaucaucaggcuucauuuaaggauuugacugagguggacuugggaagcuguccauuuuccacaucucgacuuuugcuuaguugcuugauguaacucacuucaugcugaguuuagacagcucucacaguuuccucagcaccagguuaaacagaacuauccuuucaaagagcuucccugcugagaugcagaguaggaguaaauagaagagugugggauguccacaaagcaaggaauuaaacaaaguaggccagacagacuauagagggagcugcuugucuuuaagauuacucuaaggaacucugccacuuccucuagcuuagugaauauuuugguagauuguucuagauacuguuagccaugaaaucaagcuuuucaacauaaggaauugauaauucugaaaugcuauauaaguuuauguagaugcuuauccaauuauaaauauauucucauuguuuauauuuuauaaaauuaaauauaagaaacuaccagaauaaccuuuuuuuuuuuuuuugguaaauuggaguuaaauuugcaauaagaauaauuuugaaaauuagcguguaucaacaacucagguucaaaaguuucucuaauagaaucugcuuuguucauagucuguuuuuuacuaagcuauuuaaaaauauuuuaagaucauauaacaccuauuugauuacaauuauuggagagauuuucaggaacgcuauggagauguaaugacucaucacaaacaaauuggucacuuuuuuuaaaguagguauuugaagcccugaguagcaaguuguuuuagcuuuaagugccuuaagaacagcuuuacucuccagaagcucacaauguaguagagaugaugggcauguaaacguaagucaaaugcaguaugacuggacuauagaaauguguauaagacaaagcaaggauucauugggagacauguucuauauccaggcaaaaaggggagucagggaagacuucgugaaggaaauauggauuagucauguuaaaggaauuuuuaaggaacuuaaaauuucagauagaggaacagcuacaagguaauugacagaugaagacaacugcucuuugcagggcaguuuggcaauguauauuagaauccuugaaguguucuuuuuugacccaguaauucuaguuuuagggauuuuaaucuaugagcauaaaucuuuuggcaaaucugguugucuuuugaauccgucuacuucuuuucauaauccaucaccacccuaaacuacuagcauuuuuggucagguuuacuacaguagccuccuaaucuugguuuaucccaaucuacuuuguccccuucugaucuguuuccuacacuguaaucagagggaucuuuuaaaaaugcaaaccugauuacaucacccuacuguuugauaugcuucaguagcuuuccauugcauucaggauauggacagaacucugugucuuauaugguggcaucugccugucuuacaaggucuugcauagucuggcccuuaccuuucugucuagucaugacuugagccauguucuugacuuacucuuuuuguuccagccuuguuggccuuaucucagucccuuguucuugccaugcuccuucccacagugagggcuuuguaccugccguugccccugcugagaauguuuuuacuuuucuuucaccuaaacuucgauuuaucuuuccucagggaaggcuucccuaucacagacucucagagcaccaugaacucuccucauagcacuugcugucauuguaauuucauauguguuggagauuaacaucuguuuuuccaaauagauuguaaccuccagaaauccugauaauguguuucuuuuuccucaccauuauagaguuaaugcuuaccacagugcuugaaacucgucuauuaauucuuggaacucauuuguggcaaggauuaauaaauagaugauaaucaucacagagaacaacucuaaguguucaacaauuggcaaaugguugcauaaacuggguauauucauuugggaggauguguuuaaaacauguuguagaaguauguguaauaacaugggaaagugcugucauauuaugugaaaaaauuaguuuacaaaauagucacuuauuaaaaguguggaaaaaaauacaccgaaguauaaaaguugguuaucucuggaagguauguuuuauauuuucagauuuuuuacagauaacaugugcugauuuuauaauuuaaaaaaaccauguacaaaauuaaggaaaaauugauuuucuagauaugguuccagaaauguagugggagacaugagauucguaauggucuccaaaauaugugucaaccaaaaugcaugauugcaugaugaucauauugaacuuaauuauauaaauuccauuuagaaauugcaaaaugauucauaaauuaaagcaagccaguaauuucugguuguauuauucuuacuuguauguaaagugguuuuaauuuuaaaauguuuugaaaaguaacaugguuuuggcacaugacagcacuaaaacagaguaaagacuagaauuaacuuaaauauauaugagagcuuaauauagguugagcaucccuuaucuaaaacuccauaaucugaaauccuucaaaaucugaaauguuuugaacaccaacaugaugccacaaguagaaaauuccacaccugaccucaugaugggucgcagucaaaacuucguuucaggcuggaugcaguggcucaugucuguaaucccaacacuuugggaggcuaaggugggaggauugcuucagcccaggaguucaagaccagccugggcaacauggaaagacgcuaucucuacaaaaaaauacaaaaguuagccaggcagggugguacacguuugugguuccagcuacuugggaggcugaggcaggaggaucgcuugagcccaggaggugaaggcugcagugagccaugauuguaugacugcauuccagccugggugacagagcaagucccugucucaaaaacaaucaaaacaacuuuguuucauguguaacauuauuuaaaauuauauaaaauuacauucagguuuggucccauccucaggauaucucauguaugugcaaauauucuaaaaucugaaacacuucuggucccaagcauuucagauaagggguauucaacuuguauaugaaaauggaucccaccuucauuuaugaguagggaaaagaagaauuguuuaauaaacaguguugggauagccaguuagucaucuggaaaaauaauguuggcuuccagaggaguuaaagauuuaaauaugaaacaaagaaacaaaaaagguaggguaauuauuuuuuacguaauccaggauuggugaaguccuuuaauagcauacuggguugcuggauuuuaggacauaaaaauaaaauucuguacaggggaaaaaaucaaacaaaguuaaaagagaaacagacuaguaaaacuuauuuguauacuucacaaagggcuaaguuccucuuaauacaaagaacuagaaaauaauccaguagaaaaauuagcaaagagaauucauaugaaaaaauguacaacuuuauuuauaauauaauaaagauguaaauucaagcuacaacauacucuuugucaccuaucaaaugagcaaagguuauguauaguauaacucgggaaaggugagaagagaaaauggucagccuuauacauugcuggugggauuauaaaguauucauacucuauagaaagcaguuugaaaaugguuuucaaaaauuaaaacacagauuuauuucguucuaguaauuccauuauaggauuuuauucucuagaagauuuugcauauaugucaaauaaauaucuaagaauauuuguggcagcauuauuuguuacugcaaaagauuggaaacaugcuaaacauaucaguagggaaguaguuaggugaauuaugguguauauauucaacagaauacuagucagccuuuaaaaauaaugagagaauacuauguguacugcuguggugcuaugucaaagauaugaggaaaaaaagcaagaggcaugacugcaugugcaguuugcugccauucgugugguuaaaauauauauuuuuauaugcuauauaugccuauguauuagaauaaaauucuuuauuauaauaaaauccauauguguguguguguguguguguguguguguguguguauauauaggcagcuauagaauguaaugugcaugggaggauacgggagagucugaugacaguaauugcuccaguguguagaagugguugccuagaggacaaagauggacuaacuuuuaaaguauacuguuugguaauuuuucaguauuuuaaaaucaugugcauguaauacuauucaaaguuaauauuuuuaaguuauguuuugcuuacaggaauugguaagaaggaaaaaauaagagaccauaauaguuguuacaaacaaaugauuacugcaauacuguuuuuaacuuuaguuauuguuagagaucuucuaauucaaaguuuucaguugauguuacauggcucacagaaggguaguccuaguagaaugggggcugaaggaaggcguugggguuccugugaacaaauagcauggugagugacaaccaacaguuaaaagcagcauacugcuccuuuugauauuuuaagugcauuaaaugaggugugccuuacuacuuggaaucuacuucagcagccagccacaguguacagcugccuuuugugggaaagggaucauggaauuguuacuggaguuuguauucacggugccgaaggaacaugccaccuaccacaaggugcaacccacuuacaaugagaggacaaggaagcagggagggugucucugguggcccagcuccaggccugacuaucuguauucaccuguauuggaugcugcucaccacgugcguuugauaugcucugcaaggugacugccuaauagugcauguauguuugucagaaauaaagcaugauuuuaauuuugaaauauucuugaugugaaaauguuugguuuugaaauucauauuaaaauuuucagcauuacaugugucaaaaaauaucuaccauaacacuuuacauuuuuucuucuguaauuagaaaauaugauaauuuuuuuucaccaggcacuguguagaugccuccaaaugcccuccuguuguccagugugcuaaauuuuuuuuugcugacaaguuuuguuugcaauguuaaaaggguugagaagcaucauucuagucaaauguacucauuuuguaugaagaaaacugaaaucuacauagcaggcucagggauuuguccaguguccuacaguugguuggugugaggcuggauuugaaaauuggggaucuuggaucuugacucuucagcucucaucaccucacacugacccccucuccccccgaaacaugagggaauauuggaggaaggcauugaugauaauugaaagacaaaaauacagaaccucagaggaauuauuaaaagaacugcacauauguaguucagaaaucuuugagacccuacuguaucuaauagugcuuagaaucuucuuauauaauaauauuauuaauauucuauaaucuagaauagauuauaguaggauucguuuuaugaugacuugggcuguaucuuuaagaaaacaaaagauuauagcaaaaggaguuuagggcaaacauaaauaaaaauugauacuaaaaucguauguaugcuauuuccaaaaaagggaggagggaauauaugagaccuuucaaguuccucugguacuauaauuacauuuucucucaucuugcuuuugauuggauuagaauucacgcaauuaaagauaaucuagggccaggcaccuauaaucccagcacuuugggaagcagaggcaggaagauugccugagcccaggauuuugagaccagucugggcaacauggcaagaccccgucucuuuaaaaaaaaaaaaaaaucuaagugaaaaaugauucaagucuaaauagguuggguuaaaguagguuuuagaggauguugucauuggugcuggauauuucaaagaaauaguuugaacuuacuuauaaaguaagaaaugggccaugguaugagguaugucacucugguaucuggcugccauuuuaacaucauagugauaauaagaggaaauaaugggaguuaaggaacaguaaacuuugggugaaauuguguuaacuuguaauuuccauguagauacagauaaggcaggaaugagugucuuaggcaauuagaaauaacucagucuacuguccaaacaugauguggauuuugagaccaaaacaaauuauaaguaaaaguaagacccucuuaaugacagccuauuuaaccuuuuugguguuuuuguuugguguguguguguguuuucugucguuccuucuaaguuuuccagaugaucuuguguuucuuccagcucucuguggguuuuuaaauauuucauuuuauaaaugaaaaauacuuuguuguuuaauuagcauugguaaacuggacuguuuucuguagcagaaauugaauacaagccuagcaaaguaaauucugagaaaaaugaguaguaauugucaauggaaaauuucgugguuuuuuuuuuucuuuuuuggccaauucuauuuuuuuagaugauaguuuugggaaauacuaagaauuugagcucaauuuacuuuggggcaguuauuuaauuuucuuuggguucagagagcauuacuacuauauaaacaauucaaauaauaaaagaguguuaccucaaaaaugccuuguguaauauauaacaguucacaagaauacuauuuuucuuccauuuauuacgauuacaaagaaguauaacaagaauuaaaagaaauauauuauuuugcauauauauuuauacuucaaaguaauuuauauacuaaauuagguuuuguuugagauggugaaaugaaagacuuuguaaauaagaauacauguugauaugugaaaaauguaaaguuaaaacauguuggcauacucgcaguuucucagaacaagaaaaugacuaaucuaaauuucauuucagaauaaaacccaagacaagccacauaaaagcaaccuaaaaauuaaacugucaucauauuauuuguuuuaaaacuauggaauaauauaucugaggaagauuucucucaaaauuguuuuucucaauuucaaguaaguaauuuauuuugguuaauauauugggggugaggggggugggggugagccuuggcauugaaguugguaaauccuacucacccuuaacuaacaacuuaaauaucaaccucuuuaaagccuucugugacuccuuugcccauucccaaagauuaucuccuugguuuuccaagucuucauccccuuccacauugcuguuaaaaaaggaucuguuacaauggauauuguguuugucucuaagaauagucauguggcacuaccuucaugggccccaccucauacuucucaaccccacugccuucuguugcugagagaccccgagcaaguuauuauacuuauguuagccuuaauuuccuccucuguaaagugaguuuuaauaauuucuacagcauagcauuauuaugauugaauaagauaaccagcuaaugucuggcauacauaguaacauaaauguuacuuucuuuaccugucuuaucuccagaaucugcuacauuaccucauauacugaguacucuuuaaaauguuugaauugaaaugaaacauggaauuuuuguagcagguauuccucacauuaggagaaacuaaaacaucugcacauugugguaugagauuuuuuacauuucguuagugacauaucuacagucuagguaauugccuguuuaaaacacuuuuuaaaaauuuggcuauguuuuauaagugguccaucaggaccugaaaagaaccuuauuuuccaaagccaucacuagugccuuaaaaaaaaaaaggugauagaacauguugaaaguauguaugcuagaugucacaguaaaggugacaugucaguaggauuuauugcucucuugugaauuuguaacacacacaaaaauggaagccuuuguauuuuaaacguacuuaggauuguggaauguggacuaaaugauuuauuauugcccagagcuucaccucucaucaccauauauuuucuacauacauuccuagguuuuguuuaauaacauugucuuuuacuuauuuauuuuuauuuauuuauuuuuuugagacagagucucacucuguugcccaggcuggaguguaguggcacaaucuuggcuccgugcaaccuccaccucccgaguucaaaugauucuccugccucagccucccaaguagcuggaauuacagccacgugccaccacacccggcuacuuuuuguauuuuuaguagagauggaauuucaccauguuggccaggcugguuucgaacuccugaccucaggugaucugcucaccuuggccucccaaagugccgggauuacaggcgugagccaucaccacaccccggcaugucuuuuaauuuuuuaaugaggucauuagaaagauauccaaauuaauuaugaugucucacaccuuaguugauaaugcuuaguguuuugaaaauagaagccauguuauuauaguuaaaagaccuuaauuuuacgucauuuuacuaaacgaggugguaaaccguuuauuaaggacugugugcccuguuauaagcgauguaaucuucacaacaguucuauaaaauaggacuguuauccccauuuuacaguugaggaaaugaggcauagagagguuaauuaacuuugccuaaagugaugcagcauaauguuuaccucauaccaugugaggauuaaaugagaaaacauguauuaggccauuacccacuuaaacagaagaaacagugaagcagaauuugagaugagugucuucuaacacuuccagaauuugauaauagccauuauugagaugugacagugaccgugaauauauucuuauucacauuugugugugugugugugugugugugugugugugugugugagagauaguaaacccugguacucuuaacccauuuuuuuuuucugaagcaauauuaaugucuccucucaaauucaugcuccuauuuggacugaauuaauguauuuguguuuacaaggugauaguaagauuuuaauaucaaucugauauaaaauuuuuauaaguucaguguaauuaaauaguauguggauauauucucauugugaaauuugaaaagcagaacagguaagggaaaaaucuucuuugaccaccuauuccccucucuacuuggaucagcuuuuguuguaugauaaaucuccccaaaacauagugcugugaaacaauaggcauuuguuagccuaauucugggcugggcucaauuaagcaauucugcugcagcuuaugucuggccuugcggauguggcugcagucagcugaugggucagcugggagcugguuggucuaggauagcuaugucuggauaauccguacugguuguuugcuugggugaugggggccaugugucucccgcaggcuaggcguggcucuuucaccuggaggcaguaguaggguuuacagaaguaacuagugacagcaagccucguauauuuucuguuguccauaggccaaagcagaucaacauggccaauuccagaguugguaugggagggguuuccuaacugaguggggcuaauuagggggccauuacuacaacaaucuauuauccaacuguugcuggcuaacucauuuuucaggaaacaugcacuaacuagcguggcauugcuccuuucuugaaguaguguuuauguaagcaauuuauucaacaguucagauaaauuuaguuaauucauuguucuuguuuuuauuccauuuuugucauccuucagcauuauucuuaguuucauucaacucaacaaauauuuauugagcacccauuaagugcacaauaagguaucaagaggugagcagcagauagagcaagacuacuguguuaaucauccagguuuguuuuguuuuguuuuguuuuuuguuguuguuugaaacagucucgcucuguugcccaggcuggagugcaauggugugaucuuggcucacugccaccuucaccuccuggguucaggcuauucucccaccucagccuccugaguagcugggauuacaggcaugcaccaccccacccagcuaauuuuuuguauuuuuaguagagacaggguuucaccauuuuggccaggcugguuucaaacuccugaccucaaaugauucacccgccucagcccucccaaagugcugagauuacaggcaugagccacuacgcccgaccagucauccaaguuuuuaaaaguggccuaccugucugcuucauuauguaaacagaauucuauaaaaguagaaaacuuuuaacaauuuuuugagaaugaccaacagcccacaccaggcuaaauauuaucuuacaugcuacauuuuuaaacaucuuacaaggauuucuucaaaugagaaaaacuaauacagagguuguuuugaucuguacucccaccagcaauaggagacuuuuuccaugucuucaucaagauuauguucucaaauguuuugaucauugccaaucuaauagacauaaaauggaucucaguguaguuuuaauuugcauuccuuuuauuaugagugagauugaguguuuuuucauaugcuugagaggcccuuaugguauuuccuucucagcguacuguuuaucuuuuacccauuuuccuguugagacucuuggucuuuuccuuacugauuccaaagagccuucauauauuaguaaaguucaucuccaucuguaaauugaguuccaaauguuuuccuccguuaguucuuaugguagauuacuuuuuauuuaaguaguaucuuuuuuucauuucauaaauaaucuuuauaucugaauuaggcuuuuaaaucacauuuagaugaaguuagguuuaaguauuaggcaugggaauggaaggaaaagauccuggcauuaucaaaucuuuuguagagaacuuuuuaaaacucuggauaguuaaaaugaaaaacuucaaaaggauccugucuuugauuuauuuuuuccucuucuagguuugguuuuauuaugacaucagucguuuugaccgggcaguccaaggaguaggaucauaaccucuggagggcuguuuuuagaugaugagauuguauaguauagauggaaaauacucuguguaacuuagaagaaauuguuaauaauguugcuuugagucucguuaauuucauuguguguguguuugugugugugauguguauaaaacaugcauagaucaugguagugcuucuagcaaugcucuacucuuacguacagucuucccucuguauccaucccuuaguaucugugagggauucguugcaggaaucccugaggauauaaaaauccacagaugcucaaaucacuuauauaaaaugguguaguauuugcauaaaauaaccuaagcauauucuccuauauaguacuucaaauuaucacuuacaccuaauacauuguaaaugcuauguaauaguugugauacuguauuauuuaagguaguaauaacaaggaaaaaaguuuguacgcauucaguacagaugcaacucuuucccugaauauuuuugaucugugguugguugaauccacagauguggaacccacagauauggagggccagcuauauaauuuucaaucuguucagccaaccuuaaccuaaucaaccacauggguauguuaggauggcuagauuaggcuagccauuagcaguggaccacacagaagaaaaacacacagaauguagacucuuuugagaaugcaguaaugcuaccuacugcccaaauaauauccuagauuuuuucugagauugugggaagccaggaagaagguggcagagacaucugugaccuccuaugccacaucugacaugaaguacuuugaccuuuucccuugacuuuuguauaaaaagguauuagaaaacugcgaggcuggacauuuuauauguuuugaguaauuuaauauaauuuuaaacauuuuaaaguugucgaacccuuucuucuuauauaauuuuacccagcagcaucaaaaacaaauaggaauccuuaagugauuaguggggcauggcagaaagccaguuuuuuaccaugcuuuacauaguuuuuaguuuuucaaaguuauugauguauucuuuagcgucugcuuuauuacuaacaucuuuauacauguuucacugaaaauugaaaggaaguuuuucauuuaauaccaaauuauugacuuacuguuauuuucuugguuaauccuuuuuaaacaauuuaaaauuucuuuuuucuaauuuuauuuuauuuuuugagacagagucucacugugucgcccaggcuagagugcuguggugcgaucucggcucacugcaaccuccaucuccuggguucaagugauucucgugcuucagucucccaaguagcugggauuacaagcaugugccaccacaccauaccugucuaauuuuuguauguuucauagagaugggguuucgccauguuggccaggcuggucuugaacuccugacuucaggugaucugcccaucucagccccucaaagugcugagauuacaggcaugagccaccucgccuggcccaauuuuaacauuuccgaguuuguaaugugucucacaguauguacauuuaauacaguaauuuucccuccugaaaagcugguauuaaacugauaggacauuuauaaucagugacuucuuagagaaaacgugacauuuuaaaauuccucuaugugcuuuuuuuaaaaaaaaucuaaugugucauggaauggguuugcuucccaaauaaacauuuguccuucauuuuugccuugcaucuguaauuguuuuaaauuuguauauuuugauguguuguuuggcacaucccagcuucaugaccgauaagucuuuuaucacagugcuuuucaaauuauuuguggugaagaaucagguuuuuuucccaauacuucuuuaaaauacauuaaaaaugaauuacuagaaaaaugaaaugaaaugagaauaacuugacaaaauaguaauauaaccuccauuuuuaaaaauuauuuuauuuaacagguauagaauuucccucucagacugcuguaagaguuucuaaaugcuaaguuucgagcuuuguucuugucuuguugcauagcuguagcaaacagcuaguucauagauggcauuugaguagcacuguagagaucuuuuuagcaauauaaaaagacuaauucauuucuuaaaaucuuuuuguccugugucaaaauuauuauuccuauuuccuuucaguuugacuauuucugcgauauauuguauaaaucguuuuucaucacuauuuuuaaucuuuuuaugucaguucaguuuuaaacccaucugaagauuuuaaacaaaguuuuuuuuuuuuuuuuuuuuugguuuuuguuuuugagucggaaucucgcuuuguugcccaggcuagagugcucgggcgcgaucucagcucacugcaaccuccgccucccugguucaagcgauucuccugccuuagccucccgaguaacugagauuacaggcgcguaccaccaugcccagcuaacuuugaauuuuuagaagagaugggguuucaccauguuggucuggcuugucucaaacuccugaccucaagugauccgccugccucagccucccaaagugcugggauuauaggugugagccacugcgcucagccaacaaaauuugcuauaauugagguuugauuuuguuuuucacucuuguaauuuuauauuuuuacaauaacuuggcugggugcuguggcucaugccuguaaucacagcacuuugggaggcugaggcagguggaucaccugaggucagaaguuugagaccagccuagccaacauggcaaaaccccgucucuacuaaaaguacaaaaauuagcugggcgugauggugcaugccuguaauccuggcuacucagggggcugagccaggagaaucacuugaacccgggaggcagagguugcagugagcugagaucgcaccauugcacuccagcacaacaagagagaaacuccaucucaaaaaaaaaaaaaaaacaaauaaaaauaacuuuauuuuacccuuuccuuuagugugugacuuuugcagcauagaccguuuuauguguuuuccuuuuuuuugagauggagucuugcucugucacccaggcuggagugcaguggugcgaucguggcucacugcagccuccgucucccagguucaagcaauucuucugccucagccucccaaguagcugggacuauaggcgcacgcugccauguccagcuaguuuuuuguauuuuaguagagaugggguuucaccauguugcccaggcuggucuugaacuccugagcucaggaaguccaccugucuaggccucccaaagugcaaggauuacaggcgugagcaaccaugcccggcccuguuuuccuuuuuggaaaacauagauaacagaacucauuuuuaaaaguguauguaccaaaauguaguuuuuuaaauuguuguuucuauucauuucuuuuuucuuaucucuuaagaguuccauuuauaucuuagacugcauauaagucugucuuuuuauuucuuccuauauguauguuguugagaacacacagcauauacuuuuuacauuuuuucuguuucuaaauauaaauuaucacagauucuuuucuuuggcauuuuuaagaagauguuuuaucuaugcugcugaauguuuguuuaggucccauuccauacauaccuaucuaugaacaagggcuauuuuuccaagccuaguguuugccaguagguaggguauggcaaguucacuuuaaucauauuuauuuucugcuuauaaaaagauagauuugccuucccuagcauaaagaacuaaugaucguauacaacccacuuagaugaaaacauucacuuaguguaccucuacuggauugagguuuaagguuuuuuccacuuuucuccuugcacaguucgcugguauaugggaacuaacauauuuauggauaaccugaaacaguuuuuuuuuuuaaauuuuuguuauuuauuuauuuauuuuaccagaacauugcaugcaagccuccagguuguaaaggcccuuaggacuuuuagugauuuaaucagugaugggagcuaauucauuuauuuagauuuuggaugcuuuuuaacaugccaggaugaagacagcuaugcugcgucaauuauguugauauugguuguuuuuagaguagaugaacagagguauuacaugucuuagaaaauuuuuaguaggggacugguuucuguuggagcagaccguguccccaagguagagaaaagaguuacacaguaaguccuugcuuaauguccaugacagguucuuggaaauugugacuuuaagugaaaucacauauaaugaaaccguuuuuuucucauuguuauaauaaaaugaaguugaacaaaaugucauuuggagaucugcuacaaaguuuuucuuaaaguuuagguuuccaagaaccuaucaacaaaguuaagugaaaauuuacuguaugucuuaaauauuuuagugaaaaauuuagagaaggauuauucuguauuucaucaauucuaagaaguauauuuucccuccuugugcaucucaguaauuaggauaugucuuacaaucaguagugcaccauauuuacuuaacagcacuuuucuuaguacaaaaauuaauuaugucauaaucacuagcaucuuggauucagugaaauauauuaauaguuguuuagcuuagugccauucuaaauugaaucucuuuauuuguuguaacauuaaccuuucuucucuucggacaguuuuggccuuggcuuaacuuccuagcuuuguucacuuggaagcuugauaagguagaauaucaguuguauaaccgagcaccauugcuuaugguaauaaugacucaugauuacugaauugcauaaggaccagaggaggacugugaaugaauuguaaauacugguacuuauaccguuaacagcuuuggacuucccugagugugauaacucuugcaacuaagcaaaucuguugcugaagcucaggaagcuaugccuaugagacuggagauauugguugcuauuugguaccuguaagcuagaguagcuacugcaaggaccuuaugcucucauucucuuacacuugaucugccaccugagagggccaaagauacuagcccccgaauugcaaugaggacuccugccugacauguuaaguauaaccagccuguuuggguuaugugagucucggugucuaguuaggccuaacgggguguuguacuuacauucuguggcuuuauuuuguuuuuaauauuugcugagugaaucuauauuuacuauuuauucgucauaagaauuuuaaauuauaaauaugagcacaucucuacuaaguaaugccaaauuguuuuccaaagugaucauaccaaucuauacucccaccagaagugugaguuucugauguuccacaucuucaccaauauuuaggauugucagacuuaaguuuuaaauuaggaauuaauuuaaaacaucucauuguggguuuguacauuuuucaucacuagugagagauugaguuuuuccauauguuuauagccuacucguucuauaaaauacugagagauguguugaagucuccaacuuaauagauuugucuauuucucuuuccaguucuaucaguuuuuuuuucauguauuuugaaaguuuguuagauccauacauauuuaagaucggugugccuuucuggcggacagccucuuuaucucugguaauauuccuuguucugaaaucuucuuugccuuguauuaauauaaccacuucagcuuccuuuugauuaguauuuacaugguauaucaugucaaaaacugaaguuugccaugaauuucauacauauuagcaauagacaugagauuuccaucucuccauuguaucacuuauuaauaaagaguaacuggggagaugguugcagaccagauacugagaaguagguucaaaggcagcuaccucaacagagacccauggagaauugucucccaacauauuuuuucuguuuuuguuuuuuguuuuacuuucacuuucaaccuaucuguaucuuuacacuuaauauggguuucuuauagucagcauauagaugggcuuacuuguuuauccagucugauaaucucugucuuucauuuugacaugucucuuuuauuuaguguguuuagauuguuuauauuuaucaacauugguaauaugguuggauuaaaaucuaccacuaugguaucugguuuauguuagucuaucuguucuuuuuuucuuuuggauuacuuggacuuuuuaaaaauuccauuucucuccgcgguuugcuuauuuauuuauaccucuuucugaaauuuguuuagugguugcccuaggguuugccguauauuuguaauuaaucacaguuuucuugauauaauaauacauagcuuuauauguaguauuaggaccuuauaguucuauacucccauuucuccucuucaucuuuuauguuuuuguugucauacacuuuacuuuuauauauaugcaaucaacaugcaauauauuacuacucuaagacuuuacaguauauugcuauagauuuuauagaacuguucauguagguuauaauaaauuuauuuuuaaaaagucuucaauaauuagccuuaccuuacuguaacuuuuacuuuauuaacuucuuaguuuuuuaaacuuuuuuacucucuuacaauaacuuagcuuaaaacaaauacauuguacagcuguacaaaaguauguccucauucuguaagcuuuuuucuauuuaaaaauuuuuaauuuuuacuuuuaaaacuuuuguuaaaaacuaagacgcaaauacauuagcccuaggcccacagagagucaagcuauaaauaucacugucuuccacuuccacaucuugucuggaaggucuucagggacaauuacacacauggaacugccaucuccuaugauaacaguuccuucuucuguaauaucuccugaaggacuuaccugaggcuguuuuacaguuaacuuuccuuuuuauguaaguaggaguacauucuaaaauaaugauaaaguauauaauaaauacauaagcuaguaacuguuaccaugaucaaguauuauguacuuaacauaauuguauaugcuauacuuuuauacaacuggcaguguagguuucuuuacaccagcuucaccacaaacacgugaguaacucaucguacuacaauguuaauacaacuaggaugucccuaggcgauaggaauuuuucagcuucaucguaaucuuaugggaccaccauuauauauguggucccuugucgauuaaauaucauuaugcaguacaugacugcauuuuugcuuuagagacaguuaucuuuuagaacaauugcaaauaagaaaaauaugaaguuuuguauuuacuuucauuuauaccguuuauacuguuguucaugucuuuguguagauccaaguuuucugucugguaucauucugucuaccugaagaacuuuuaacauuucuuauaggccaagucugcuaguaauaaauuaucuuuguuucucucaaaaagacuuuauuuuucuaaaauauucuugcugaauauagaauucuggauugccuuuuuuuucuuucaguacuuaaaagaugucacucuacuguuuguuauauggcuuuuacguauauauuuuuauuugaauuaaauuuuuuuucuuuuuccgcuuuuauuuuagauuccggguguaccugugcagguuuauuacaaagguauauugcauaaugcugagguuugaaguacgacugaacccgucaccuaggaagugagcauaguacucaauagguaguuuuuccauccuugccucccucucccaucuuguauucuccagugucuguuuguucccaucuuaauguccauauguacucaugguuuggcugccacuuguaagugagaacaugggguauuugguuuucuguuucuccauuaguuugcuuaggauaauggcccccaacugcauccguguuguugcaaaggacaugauuuuguucuuucuguggcuguguaguguuccaugguguauauguaccacauuuucuuuaucucauuuacuguugauggacaccuguguugauuccaugucuuugcuguugugaauagugcugugaugaacacaugggugcaugugucuuuuugguagaaugauauauuuuucuuuggguauauacccaguaaugggauugcuagguuaaaugguaguuccauuuuguguucuuuuagaaaucuccaagcugcucuccacaguggcugaacuaaguuacauucccaccaacagcguaaagguuuucccuuuucuccacagccccacugagaucuguuauuuauugacuuuuuaacaaaagcuauucugacugguaugagaugguauuucaauugugauuuugauuugcauuucucugaugauuagugaugagcauuuuuucaauuuuuuuuuggccauuuguaugucuucuuuugagaagugucuguucauguccuuugcuuacauuuuaaugggguuauuuguuuuuuacuuguugauuuaaguuccuuauaaauucuggauauuaggccuuugucagauacauaguuucugaauuuuuucucccauucuguagauuaucuguuuacucuguuaaugguuucucuugcuguauagaagcucuuagguccuacuugucaguuuuugguuuuguugcaauuguuuuugaggacuuagccauaaauucuucgacagggcuguugucgagaaaagaauuuccuagguuuucuucuaggauuuuuguaguuuuaggucuuacaguuaugucuuuaauccaucuugaguuaauuuuuguauauggugauagguaagaguccaguuucauucuucugcauauggcuagccaguuaucccagcaccauguauugaauagggacuuuuuccucauugcuuauuuuugucaacuuuguugaacaucagaugguuguagguguguggcuuuauuucuggguugucuauucuguuuuauugguccauguaucucuuuuuguaccaguacugugcuguuuugguuacuguagcuuuguaguguaguuugaaguugaguaaugugaugccuccagguuuuuucuuuuugcuuaggauugcuuuggcuguuugggcuguuuuuugguuccauaugaauuuuagaguaguuuuuucugauucugugaaaaaugauauugguaauuugauaggaauaaugcugaaucugcaaauuacuuugggcaguauggucauuuuaaugauacugauucuuccaauccaugagcaugaaauauguuuucauuugugugugucauuucugauucuuuaagcaguguuuuguaguucuccuuguagagaucuuucacuacuuucauuagauguauuccuagguauuuucuuguuuuuguggcucuuguaaauggaauuguguucuugauuuggcucuuagccugaagguuauuguuacguagaaaugcuacugauuuuuguacauugauuuuuguauccuaaaacuugacugaaguuguuuaucaguucaaggagccuuuugguggagucuucggaguuuucugguauagaaucauaccauuagcaaagaaagauaguuugacuucuucuuuuccuaucuggauaccuuuuauuucuuuuucuugccugauuacucuagcuaggacuuccauuacuauguugaguaagaguggugaaagugagcaucauugucuucuuccauuucucaaggagaauguuucuaggcuuugcccauccaguaugauguuggcugugggugugucauaaauggcucuuagauauauuccuuugauaccuaguuuauugagggguuuuaucaugaagggauguuggauuuuaucaaaagcuuuuucugcaucuauugagauggucauaucguguuucuuuuuaauucuguuuauguggugaaucacagugauugauuugcauauguugaaccaaccuugcaucccaggaauaaagucuacuugauuauggugaauuagguuuuagaugugcugauggauuugguuugcugguauuuuguugagauuuuuugcaucuauuacauauuuuugucauuugucuuugauucuuugcauauaauguccuuuguucauuuaauuuauuuuucuuuuggccgucuuuaagaguuucucuaucuuuagauaugauuuaucuuuauuuugaaugugaugugucuguuuucuuuuguugguuuguuuggucuucucugaguuuuuugguucucugguuuagcaucuuuuacuuaauuuggaaaauucuuagccauugucucuucauguauuucauuugaccuguucugucuucucuuucugugauuucaauugcagguauaugggccauuuaauaauugucuaauugcucuuguaugcuuuguucugcuuucauuuuuguuuuuuuaauacuuguuuuuuuucuaacaugaugagauuuuucagggagauuaccuugaugauaaugguuauuguugcuguuccugaagcaucaauuauuucaaaagaugaagcuauauuuuagagacauaggcuucuuggcauauuugagauccuucagauuauuaguaaaauauaaguuuaugauaaucuuuuucccaacuaaaaacaaucugcuuagauuuagggaccaugagauauagccugggguuguggcuauuguugugaugauaaaauguaauguaauaacccuaaugacuuaugaacuaagcuauguuuuuaguuuucuguaucaaaauauuuucuuauuuuucuguuagaucacuugaaugucauuugauugucuucggaauuaugcucguuauuauacuguuauauauuuaauuuggaauaaagaguauuaccuauuaucaaguagcuagaccuagauguuuuuauuuuucucuccuauaacuauguagaauuaaauagacuugagguacaguacaauuaaggaauuaacaauaauuuuuuuuucuggaguguguuaauuugcauuuauguuaagaaagugguuugaaaguauaaaugggaugccuuuuaaagaaggauuuuuguaaugcauaaaauauuuaagaccgcuaaaagguaauaaacugaauuaguguaaauaaaacaaauuuaaacuuagaaauaucaaaguguggagauuuuuuugaguagauucagacuuuuugaacuacuaaaagugaugaaugagaguuauucugguuucuucuuaaaauuaugugguagucaagugaaaaggaauauuaccugcaaagggaagcaagauacgcuucuauuaaauuuacaucaauucaggugugucagauuuaccagagauucuuuggauaugucugauuccagugucuaaaaguuuaaucauagaaaaccuuauauuugaaaucugaaguuuaauauuguggaaugaguauuaguaucugagaaaagauuguuuugggggaacuaguuauaugcauuuuuaaaugugaucucugcuuuaccuaauaggauucauagucuugauacauuauacucuacagagaggaaaguguuuuguuugacccauguuucaguagcuggcagauuuugagauagggacaucuccaaguugauauuggagaacagccacaagaaaagacaaggagccaaauccgugaagcauuugcuuuuuuggcagaaagccucaguauuuauauacagauuucuucuuaaaaauugaaguaaacuggauuauggacaguuucuuguuuaguguguuaaauucccacuacauccccagcacauacuugagaacagagggucaagcuucuguugacaacuguuaacucuuucuggcacuccucuugcaguuguagaacagaaacaaggaauuguuuuuccucugguaaaaaggaagaccgacucuaaaauuacuuaaagguauaguuguguguugcuuaacgacagggauguguucugagaaaugcauugguaggcgauuuugucauugugugaacaucauagaguauacuacacaaaccuagaaaaaauauguauaaauaaaaauauauuuguauguuacauuagaaaacgaaaugucccagcaccauuacugaauaucagcuauuuccccuacuugaucugcagugucaauaucaagugccauauacgagguuucgauaugaugcucuaucuuaaggaaccaccauugcaugugcauuccaucuugacugaaacauuguuauguggcacaggauuguaauuggagcccugauuccacacaccuacacauacauaaaagaaaagugaaaaugcauuguguucuuuuauccuaauauguuuuugucaauaauuuuuaauacauuauggggcuuugguagauauuuacugaagaagagaaauuauuucuuuuuauuuaaucauaaacagguaacaaucacuuacauguaguuuguggacuuucaaguccauucucuguccauuuccaugguuacuacuuuaauugaggugucauuauuuuugcauggaucaucauaauagccucccaguuugucucuaacuuuaccuguuuucaaauucagcccuuauauauuuuagauuauagcccuggccuauaaucuaaaauaaaacucuagacaacauaaaguuuuuucaugaucgagcaccugccuaccuuuucagcaucaucuucugcuucucccucaagcacuuugcuuuucagucugaacugcuugcucuugcucaaauguauguaccucaugacuuugcauaugcuguuagcuuaaugaaagcagguaccuuggcuguccuagguguucagugucugguguggugucaucccuuaugaaaugacugaaugccauuccucuggauggaauggccuuuucuacuggugaauucuucacacuucaagacuguccugagacaucaucuacacugugaagccucucccaacuacccuuagucauaucaguccuuugugccaccauuguacuuuguaucccuguuaaagcaguuaucacauuaacuugcaagauuguuuguuuuuaacaugucugacuugccucuuagagugugcguuucaugagggcagauucaguaugcugccagucuuuguguccuuagugcuuauugccuacacaugcauuaaaaauuagaaaaaacagccgggcgcgguggcucaugccuguaaucccaacacuuugggaggcugagguggguggaucaccugagguugggaguuugagaccagucugaccaacauggagaaaucccaucucuacuaaaaauacaaaauuagccagguguggugguacaugccuguaaucccagcuacucgggaggcugaggcaggagaaucgcuugaaccugggagauggagguuguggugagccgagaucgugccguugcacuccagccugggcaacaagagcgaaacuccaucucaaaaaaaguuagaaaaaacucaggaaggaaggacaaauacaugauuccacuuauaugagauaccuacaauagucaaauuuauagagaacaaacaauagaauaguguuuacugagggugggauggaggaggaauggggauuuauuauuauuuaauggguacagaguuugugaugaugggaaaguucuggagauggauagugaugaugguuacacaauaaugugaauguacuuaaugccacugaauuguauacccaaaaaggguuaagaugguaaauuuuacguauauuuuaccacauuuaaaaaaaaaaaauucaugaagguaaggaccuuggccuguuuacucagcuuuguuuucuguaguuccucacauuguuuuguuuuauuguuaaauuguuuucuuuugacaugguaguacuugauuuuuuuaaguguuugaaauuggguccagcacaguagcucaagccuguaauccccucacuucaggaagcuaaggcaggaggauugcuccaggcuggguguuugagacccgccuggacaacauagugagacccugucucuauuauuaaaaaaaaaaaaaaaguuugaaauuaaauuguguguaagcgcaugggauauugucuaagaaaccaacugaaucuauaaaguaagggaggaaacauagcacauaacuuuuuuauuuucuuauuuuuuauuuuuuugagacugagucuugcccuguagcccaggcuggagugcaauggcaugaucuuagcacacugcaaccucugcuucccagcuucaagccauucuuuugccucagccucccagguagcugggaccacaggcaugcgccaccacgcccagcuaauuuuuuuguauuuuuaguagagaugggguuucaccaugcuggccaggcuggucucgaacuccugaccucaagugaucuacccgccucagccucccaaagugcugggauuauagacgugagccaccgcacccagcuguagcacauaacuuuaaaauaucacauauuuaaaggaaauauucuugugauaauauaaauauuaacuaaaauuaauaacuaaagugguugucaccugcuacuaagcaguauauagugguaaaagagaggcaguauggcauugugagacuucaggcuugguaaggucaaaaagucuuuuuuaccugcuuagaaugauguuccuauccaaguccaggaugacuggggaacaguacaaccuugaguguaucuuauguuauagauaaucucauuugagcccccuacgucuccaugaaauggagauaccucuauuuuccuauaaggaaaguauaugugcuauugaauacuaucaaccuggcauaauugcaaacccaguugauauauaugugugaguacacacguguacauuagaacuucuaauaaagucauucugugagacuaaauuugcaaaauaauuuaucuggaaacaguuuaaaauggggucuuauuuuuaccuaagagugugugauggauggaguaggucugggauggugcccagaaauauguugaugccugugauuuagguaacccuuagaaucuacucuaagaaauacuguuuugauaaagcaggugauauuuuggauugaugaaggucucuuuuagaaucagauuguucuuauuauugaaugguuaaaauauauauuuauguauuacauuauuauauauuaaaauauguaaagaaugacauugcuuuuaucuugacugcauaauucuuaucaauuucuugcucuuuccagugauuuccacauuuuuacuuuccuaccuauugcuauuuucugucagguguugauaaauucuggugagugacagguaauaugaggggcaaauauguuuauuccccuguucuuuuucuuuaaucacguuuauugagguauaauuuacauauaauaaaauggaccaauuagacgaguuaugacaaacguaugccgucauauaaccaucaucaccacagucaugguauauaaaauauuucuaucacccuaaaaaguucccuugugcuccuuuuaguaaaaccucucucgcuauuccuggucccucacaaccacuuaucugcuauaucacuguaaucacuuauaguuuugccauuucuagacuuucuuauaaauggaaccauguguuacguaguuaagugucauccacauugucguaugaguuaauguuuuuuuuuaauugcauuauaugcauuuauccauuauauggauauaccauucacuaggugcugaacauuuggauuguuuccaguuugggcuguuaugaauaaagcauuuauguacaagucucugugauuauauacuuucauuucucuuauaaauacuuaggagugggauuguuggguugaaugguaaguuuacuucauaagaaacagccagauuuuuuucccaguguggcuguaccauuuugcauuagcuccagcaacucaugggagguccaguuucuccuacccucuccaacauuuguuuauauuuagucuuuuaaaauucugucuuuucuagugaaaguguaaugauaucucauugugguuuuaauuuucauuucccuaaggucuaagaaucugaacaucuuuuagugugcauauuugccauucacauaucuucuuuggugaaguauccaaaucuuuuuuacaaaauugaguuguuuuucuucuuguugaguugaaaggguucuuuauucauucuggacucaaguccuuuaucagauacauguuuugcagauauuuucucccaaucuauggcuugcauucuuauuuuucuagugguaucuuuugaagagucaagguuuuaaacuaugauaaaguccaauuuaucuuuuuuuuuuuuuuccuuucgugauucauacuuuuuggugaccuaagaaaucuuugccuaaccuaaaauaucaaauguuuucuguuuucuuguaguuuauguccucuguucuuaccagauugugguuugauuucuaaguugucauuaggugguacuuuuuagaaguauuaauggagauuauuuugauaggcuuuuuaagcugugagguagcuuuauaaaaauucccuucgguauugggcccaaaauuugcuuuaaauauaggcagaguaucaguagaaggcaacacagagcuauucugugcccuaggauuuuaauuucugaccuccugguuauaguugguaucugcccagggauaauugcucuuaggguaagacuuuuaacauguaagccagccugucaaaagugcaccuaaaaguucucuuucagucauuuucugaguuacugauaggaacauagguacugugugaaucagaucugagaggauuaugaauguuauagaaugccuuuuguuagggaauuuaagcccagaagaaguugggaaagugacagauuuauauaaaugcgagugacaaaaccaguuaaaauguucugacucaacuugaaauauguuggacuauauaauaaauauaauauugugagauauucugaacuagacucaacucugcucuggcuuuccucccuuguaauuccauuacuuggucccuuuccccuuuuucuucuaugaccucuggcaauuuggcuucuuacacuuagaacuuaacuaacacccagcucagacccauggcauccacuuacacuucaugaagaacugugaaccuguaauguuuuuuauggaaacucauuaugauucugucuccuuucugccuuaucaccugugugggauaaguuucauaaacaaauagcuucucugguucuuucuguugugagcugacuaggauaguuuauagguaauaucucauuccacuuuucugcauaacacagacugguugguugucuuucccagccaaaacagcauaagcaacagauuggacaaaagcggauaugauaacccagcuuucucuucugaaacccagacguuagagugauuuacaaaaauguaaaacaauuucugucuuuucacaguuuuuuucuuuaauuauccaaauguacagcuuuucucauuacuuucuuccucuccauaauauguaauaguuugcucuuguaguaccauuuuaagcccauacuuuucuaccuuuuuuguuuuguuuuguuuuuuugguaauuguauauagcacuuacccuccacugcaggaacuuaaguuauacauauauaagccugcuuaaagauguaacauaggauacuaauguuuuuugguuuuuuuuuuuuuuuuuuuuuuuuuuuugagacagggucuugcucugucacccgggcuggagugcaauggcacaagcauggcucacugcagccucgaauuccugggcucaagcaguccucccaucucagccuccugaauagcuggaacaacaggugcgcaucaccgugccuggcuaauuuuuuaauuuuuaguagagguagggucucacaauguugcccaggcugggcucuaacuccuggccucaagcauuucuccugccucagccucccaaagagcugggauuacaggcaugagccaccacacccgcacccagccuuguucauguauuuucaggcuuuuucugugcuucauuuuggacgguuucuauggcuuugucuucaaguuuauuaaucuuuaauuccggcauuucugauauauucuuaguucuacucauauuuuuccucuucauuuauuuuucauccgucaugagaugaaaauuuugauuuauguuuguuuauuguccacaucucuauuuaauauauucaggcauucuucuacuucuugaacauauaguuuacaguugcaauaacuauuuuaauaucuuugcuuacuaauuccaucaucuguaucauuuccuggcuuguuucuauugcuacauuuuuuuccucauaaugggucacauuguucuguuuauuacaugccuaguuuuuuucacuggauuccaggcaugguggauuuuaccuuguguucuggauaucauuguauuuuuagaaauauucuugagcuuuauucugggacacuuaaguuauuuggagauaguguaauccuuucaagucuuuuuaugcuuaguugggugggaacagaacaaacuuaacuagggcuaauguugcccaucuacugagucaauaaucuuaugauuauucuacucgaugucuugugaaguauguuuccuucuuagaugaaacauaaguuauuccugcuacugugugagcccuugggauuguucccucugcccauuuuaguuacuuauuuuucugcuuuagguacauuccucacaaagcacgugcugauacuuucaguaaaaccuugagggaacccucugcagaucuacuccugucugucucugcaguucucuucucccgguauucuacuaggcaaauucuaacaagcauggccuucaacuuuguuuccucaacucagggagauugccagcuuccaccuggguuucuuaucccucugcuccguggaagcuguuaaguggggagcuauugaagaaggacuuacaauguuuguuucccgucucucagggauuacuguccuaugcuggccaaugucuaauguguaaagaccauugauuuacaugcuuuucuguuuauuaauuauuucaggcaguggguaaauguauucccuauuauuucaccuugacucaaaacccugccuacucguuuuuaaaguuuaagcucaagcauuaaauccucuccaaaguguuucauauuccauuuucuauucaggaaugauuuguuugcaaagaccacaagcucuuucaaaaaagcuguaauuggccaggugugguggcucacgccuguaaucccauucagcacuuugggaggccggggcaggaagauugcuugaggcaagauugcuugaggagucucuaacuccucaagcaggaguuagagaccaggcugggcaacauaccaagaccucaucuuuguuaaaaauugaaaaaaaaaaaaaaaauagccaagugugguggugugcuccuguagucccauacacuggagaggcugaggugagaggaucauuuaauccugggagguugaggcuacagugagccgugauugugccauggcacuccagccugggugacaguuagacccugucuuggaaagaaaagaaaauggccaggcacaguggcucacgccuguaaucccagcacuuugggaggccgaggcagguggaucacuugagcccagaauuucaagaccagccugggcaacaccaucuuuccaaaaacuacaaaaauuagcugggugugguggccggugccuguggucccagcuacccaggaggcugagguggaucaucugagccuaggaggcagagguugcagugagccaagauuacucuauuauacgccagccugggcaacagagcgagaccuugucucaaaaaaaaaagaaaagaaaaaaaagaaaaccuccaauaaaaaggggauuuauuauuacaguauagagaaaucucacagaucuucguugcaugguauaaacaagucuuacuucucuuccauuguuuucucugcagaccaguuuccacacaguucuucccauuugccuuuggcucucacuugccuguuaagguauuaacuguggccuuaacucaacaugaccauucagcucuaguccuuauaccugaucguuggauugcuuauuuauaugaacagccccaaggagccagaaaauucauaucuugggugaacagaguucaauacugacaugauaguguuccaugauucauaauacaauuaaaguaaaauuuuuaauuaaaaaaauuuuaaaguaaggauuuuguguggggaaauaaccuauaaauucuaacuuaggaaguugagucucaauacucaaugaacacaguguuuguauaguaguagagacauuugguuaaguuuuuugcuuauuaaauaauaugauucaucaauaaacauauauagagcaucuauuauguaucaaggacugcccagagcuuauauucugaaagagggguugaccaacuauagucugugagccaaauccaguccagccaccuauuuuucuaaguaaaacuuuauuggaucacugccccucacaucgauuacuuauaauggcuguugucaugcuucagcaggagguaguugcaccaaagguucacugugacccacagugccuaaaauauuugccauuuguccuguuauaccuuaugccaaccccugacguaaagugaauuuuuuuaaugugaaaagguuaacaacuuuuuacagggugaaaaccaucuuuaaucaggucuuagacuuugacgaaaauuaauagagguuaaauuacuuuccuuagagucgugacauuugaaguuuuugguuuuauuugcucauaaagaccacagguuuguuuugucucuuuauuaauuucuaguuagugagauugcauuuuucucuguaaguguuuucuaauagcaagcauuugaaaguuggaguugaaauaaucucacacgagggcaucccgguuuacuggugauucagaacacaucugguacgguauuuggcaagaggcuaaaggcuaaguuuugcagccacccguauuaagucuuuugcaaaccaucagguguauucuguaauuuuagcaauaaacagauuuuuuuccuucaguaugcuaaaauaaagacugauauauuuugggaugguagguauaguugaaaauuaacuguuuucaaauauaaaaaacaccgaagcucaggaaauaccaucugagucuaauuauacuugugagguuagugaucaguauguaguucuugugucuucaugguugucauuaguuaagguaaagaagucucauauagauuuacacgaaguuauucauccuucaagucucugcuacuauacaaagaguagauuuauucauuuuuaauauaugccuaucucuuuaaaaugccauagccacuaaucucaguaucaaauacuagauucuccuaaggcuuuacaaaaggagauucccacugaagggaauuuguggaagaaaaguagagucccugugauuugggaguuguuuguuuguuuguuuguuuguuuguuuguuuugagacagagucucacuccgucgcucaugcuggagugcaguggcguggucuuggcucacugcaaccucugccuccuggguucaagcaauucuccuguuucaaccuccugaguagcugggacuacaggcgccugccaacucgccuggcuaauuguauuuuuaguagaaaugggguuucaccuuguuggucagguuggucucgaacuccugaccucaggugauccacccgccucggccucccaaagcgcugggauuguaagcgugagccagccaccgugcccagcugauuugggaguuuuuauaacuaaagucacuucaucccaguuuguugggauguuccuaauuuacacuagcauuauuauuaauaggaaccaccuuuauucucaacaauccaguuuguacaagaaauuauauuguuacucuauuaauagaaucauauugauuauggagcagcaggaucuguuuuaaaauuuagcauuuaaccaaccucagcauuuauucugauuaacuguuaacucucaugggaguugguggauugaugaccacaagacagcacaauuguuaaaaugagacuuaacucauacacaggcccaucugacaguaaagggcuacauuauguaugucuguacagcacaaaaucauuugaauccccacagcugaaaaugaacuuuuuguguuguguaaagggacuuccucagucugucuccauuguucuuuucuaggcuuauuucccauuuuucuuucucuuuaccaugaaucuuauauuucagccccacucauaugcuuggcauuuccugaauauauccuaugcuuugucuaacccccauaccuuugcuuaaacuguucccucuguuuuuuugucugcuuuaccuuuuccagucuccuuuuccuaugucuguuaaauuccuacccauccuuuaaagacugguguaaauaacacuucuaugaauccuuucuugccacauccauuccaauuaguuucccuuuuuaggggggcucccuaagcauuuuguuuccaucucugucuugcaguauaacuuuuugcaacaaccccauccccagcucuuuaaagguagagguuguacuuaauucauuuugaaauccacauuaccuuuauaaagccuuguacacacuuagguguucaguaaaaacguauggugaauuguugguauaucccccuaauuuauuuagaauaaccagaaaauauuuaaaaaaugguuuucuuuauaagguuuuaagaguaacuuuacuccaauuucuaaauauauuuaauacuuuuaauuuucuuuauuuuagcuguuuuuuaaaaaaauugcaacuuauauuuuggauucagggguacauauucagguuuguuacauggguauauugcaugaugcugaggcuugggacaugauuuacccccguuacccagguagugagcauggcacccaaugguuacuuaauccuugccccccucccuaccuuuccuuucuaguaguucccacugucuauuguugccaccugcauucuuguuaacacuuuuuucuucagauagaaguauauucucauugaguuuuuaaguggaccccaaaaguuuuuguuucuucuucccuuccaaggcaguuggccacaugccgagagcuucuuauauuucucuccuguugccgucuuauuaucuguaguugauucuugaaaacgaugaggugaucgguugcuugacugccuagguuaguucucuggguuaaucauugccuuccauaaaucuccuucgcuuuggccacuauacuucugggaaagaaguaggaugaacaguauucaguucucuuugccaguugaggaaaauauaccuuaaacauuaaccugcuuugugaaauuuuucuaaugacaaaaaggacaaauuagcagaugacauuauagcccuggcauuuuuuuccuuucaaauaagucuaauuuuauuguacuggaguagagaaagccuacaccaagcaacuaacccguuaggcauuuuaucuuggcuguaucaaaaaguuuuguuuugagugaaagaaguuuguaggaauuuucagaacguaaaaccuaaagguugauuaucauuugauauauuaucagucguucuacuuuccuuuucuuccuuuucuguggaaauggccccaucauauucuuucaccauuuuucuuuuggguugcuaucuuucuuacugauuuguaggaguucuuuauauauucuggauacugaucauuugugguuaaguguauuggaaacaucucuuucaggucuuugucuuuuaauuugugguauuuguggccauuuuaauuuaaagucauagcuuuuucuuuuguaguuuaagccuuuuaugcuuguuuuuaaaaaucuccuucuagacagagacuuuaaaaauauuuuguauauacuuggauuugaaucuaucuggauugauuucuugggcaguaugauuuuggaaaucuaacccuaccuuuuuucccagcuugauaaccacuuggucuagcacuaugcaaugggcaaucaguuccuuuucugcugaucuauaguuuuaugaaccuguguuuuuaaccaauacuuccuaaucugccaguagauguuugaaggccugucuacauguuacauuuccaugucaguuaccauugcuauacacacuuuguuaauucucuguuguuugcccauauuuuauagagggaauggaacauggacaauaaugguacucuguuuucuguuugguuuggaauauuuaaaaucaguucucuuugaccucagagcuuugggaaauagaauuaacuccuuuuuauaaaacaauuaagaauuucuggccuacaccauuaaagucauguaucagacuaaaggauagcaucuuuucuaaauuccuucaugaaaugaauaaaugaacagccuauggcugaauguuaagcuguguauggacagguuaagacccuaugaggccaauuuucagugaaaggauagcuacugaaaaccauaaauuaagcaacuaccaaaguuugcacacaucugcaaaauaugaacauuuugucuauucagaguauugagaccuucuugaauacaccaggcauucaguagaaauuccagaaaggucacaucuuaugaguagggcuaauguagucuuagcguaaaggcuuuccuggaccugcacuaacaaaauuuaaaaacgaggcucaaaacaaucagauugaucugcaaguaaauuaguugccugcugggacaaaccuuucuugaaaggaagacaauaaaauccacauauaagcagguaucuacaaugcccaccaucuauuuaaaaauuacuagauauggccgggcgcgguggaucacaaugucaggaguuugagaccagccuggccaauauggugaaaccucgucucuacuaaaaauacaaaaauuagcugggcgagguggcggcgccuguagucccagcuacucggaaggcugaggcaugagaauggcuugaacccaggaagcggagguugcagugagccacugcacuccagccugggcaacagagaaagacucugucugagaaaaaaaaaaauuacuagauauauaaagaaguaggcaaauguaaucuauaaaaaggagaaagucuugugaauaaaaacagacccagaaugcaauaugugaucaaauucaaauaaaaggacuuuaagauagguauuuaaguguauuuaguaauuuuaaugaaaacacaauagaacaaaacuuauaauacaacauagccgccugagcgacaaagugaaauccugucccagaaacaaaaaacaccaccaccgauccuaaacaggacacacacacacacauacacacagagagagagacaccauggcacaucauaauugaauuguugcaaauuaauaaaaaucuuuaaagcagccaagaaaaaucucucaaaccauauacagggaaaucaucauaagaacaacuacuuaaagagauguaguuaauaagacaacugauaaggcagaauugaaucuaaaauuuuuucaggccaaaagagagcagguuaggggaaaaaaaugagcaaugaauaagcaggaaaaauagaaaacaaaauggcaaaacauaaccucaaaccuuauuacuuaaauaauuggauuaguuuuacguggacuuauuauucuaacuuaaaaugcaaagcacuaccauaugcagcucauaagaaucauacuuaauauauagacaguuugaaaguaaaacaguggagaaauguacuuugcaaggaaaagucacuaggaacacuggcguaucuaaagaucaggcaaaguagacuucaugguaagacauauuaucagaauuaaagagggauauuucaaaaugauaaaaaguucaaguuuucaaaaagacaaaaaguucaaaaaacuugaugcaauacugacaucaagggagaacauaagggagaacuaaagagagaaaaagauaaagccaguguuacaguuggagacuucaacacuccucuuuucagcauuuggugaaacaaguggguagaaaaucaguaaguauaugaaacacuugaacaacacugucaaccaacucagucuaauugacauuuuuagaacccuacaccuaccuaauaauuucagaauacacauuguuuacaaggucacauguaacauuugccaagggaaaccaccagcgccguaaccaacucagggaaagggaaguaucuaacuccagcccccuuuauucuuccuguuucaccuaaguggggggaaaagcugaaaaucacuugugacggucacacccccgggacacaggcccacuuaaagacugaaacguaaucauaggacuauagaacacuuuaucuucuccccauaccccacaucaacagguucuuccccuccccucaugucagcaggcuccuguauaauaacagaagauuacagcugaaagaacugcaaggcuuagacucacacuauguaaagaguuucuagggaaacccaaagacaguaugagacaaaaacaaggacaguagagaaaauauuagccucuaacaccuauaacuacagcaaauaguaaacaugacagucuuaacucccagcuagauauggcagagauuuuggaauugucagauugauaauuuaaaauaaugaugaguaacaugguaaggucuguaauaaaaaauguagacaauauacaagaacagaugaguggcuggacgugguggcucgcaccuguaaucucagcacuuugggaagcgaggugggagaaucacuugagcccaggaguucaagaccagccugggcagcauagugagaccuugucucuauaaaaaauaaaauuagcugggugugguggcauaugugcuuguagucccagccauuugggaggcugaggugggagaauugccugagcccaugaggucaaggcugcagugagccaagaucacgccacugcacuccagccugagugacagagcgagacccugucucaaaaacaacaaugacgacaacaacaacaguaacaaaaagaacagauggauaauagaggcauagggauuggaauuguaagaaaaggaaaugcuagaaauaaaaucuauaacagaaaugaagaauaccuuugaugggcuuuucagaagaacaaaauaaauauuugaaguaauaaugacugagaauuuuccaaaauuaaacaccuacacauaucauauucaaacugcaggaaaccaaagauaaagagaaaauuuugaaagaaaccagaggcgaaaaaacccaccuuacuucuaugugaagaaagcaaaaauuacaucggacuucuguucacaaacaaugcaagcaagaagcgagaggagugaaguguuuuaaguguugaaagaaaaacaccaaccucgaauuauucugugugcagugaaauuauccuucaaaaugaaagagaaauaaaaaacuuucucagacaaauaaacauugagggaaucuguugccaguaagaaauguuacuugccuuauaagaaauguuagaaguucuccagagaaaaggaacaugauauaggugagaaacuuggaucuacauaaagaaaggaagaguauuagaaaaggaauaaguaaagguaaaaucuuuuauuuucuuguucuuaacugauagguaacuguucaaaauaauaauagcaguaaugcauucaguuauagcuuagggauaagugaaauuaauggcagcaauuuuauaagggacaggagggcugucccuuauaaguaauugcaguuuuggaccaggaauuuuaaaucauuguaacuaggcucagacacaucuuuauuaaucaaaauaggaaccauuauaaucaacacauuuucgccaaaagauacguuuguuuauuucuguagcauaaaaaucuuugcuuugggacucggcgugguggcucacgccuguaaucccagcacuuugggaggcccagguggguggaucaccugagguugggaguuugagaccagccugaccaacauggagaaaccccgucucuacuaaaaauacaaaauuagccgggcaugguggcgcaugccuguaaucccagcuacuaggagggaggccgagguaggaaaaucacuugaaccccggaggcggugguugcagugagccaagauugugccauuguacuccagccugggcaacaagagcgaaacuccuccgucucaaaaaaaaaaaaucugugcuucaggauucagugaacucuuggaaagcauuuucugcauccuauggguuguggaagcauuuuccuggcaaaaaguuguccagaugcuggaagaaaucauaguccacuggcaagaggucaggugaauaugauggcugaagcaaaauuguauagcccaauuucuucaacuuuugaagcgcugguuggcggucaggcauugucuugaagaggaauugggcccuuucuguuuucggugcaucucauugauuugccgagcauacuuuucagauguauugguuuuugccuggauucagaaagcuguagugggucaaacgggcagcagaccaccaaacugugaccaugaccuuuucuugguccagccacugagcuggucaucacauaaaauccauuuucugucauguuaccauccagucaagaaauguuucguuguuauuggguagaauaagagaagaccauacuucaaaacgauuucuuuuguuuucaugcagcucaugaggcacccacuuauguagcuuuuucacuuuuccaaugugcuucaaauguugaaugacuguagaaugcucuauguugaguucuuuggcaacuuuucguguaguuuuaagaggaucagcuuugaugauugcucucaauugguuguugucuacuucugauggccagccaccaaguuccuuaucuucaagccucuugucccccuugcacaacuucuugaaccaccaccgcacuguacauuuguuagcaguuccugggccaaaugcauuguugauguugugaguugucucugcuauuuuacaacccauuuugaacucaaauaagaaaaucgcucaaauuugcuuuuugucugacgucauuuccauacucuaaacauaaaaugaacagcaaguaauaagucauuagcaaaaaaacauaaagugagaaaugccuguuaaaaggauguauaacauaaucacauuuauuuaagaauguauuacaaucaaacagcaaauuccaacaaugcaaaaaccacaguuacuuuugcaccaaccuaauauaaguuaccuuugaggcaguauaguauuauuugaaaguggauuuagaauaguugcaaauguauacuucaaacuccaggguaaccacuaaaaaauugacuguuuuuuuugucuuuuaauacauuaaagauguugcuccacugacuucugguuugcacuguuuuugacaaguuuaguuaauguguuuuugcccaaagcuuuggacuuuggauuuuuaugauuuaucauuuugccuuauucaggaccccgugagaucaacuguaugcuuaguagaacucacuugccauaucaacccaggacucuaaauaauuaaacauaguccuaagaaaaccuuucuuuaauucauguaugaaaguuauaggauaucggguugggauaugggauuuugagggaugugaggagccuguucaaauauuaaauuguuuuuuugucauuuaguuuuauugucugagaaaacuuucuuaacauuaacaguucuuucuuguuaguuuauuuuuugguaaugaucacuuuaccucuuuuuuuuuuuuuuuaaucuuaauaugauucaggguuuaaagccagguacacuggugcacacuuauagucccagccugggcaacauagcaagauucugucucuaaaaaaauaauuaaaauaaaaauacuauauuuagugcaucauuaaauaaaaauaaagauauguaagugguuguaguggcaaaugauuauauuucuguauauucauaauuuauuccuaugauauaaauugaauaauuuaaugaaugcauuuucucuaaugguauauucaaaauuaggucaucucauuagcaacugcuaaagaaaacaaugaguauagauaaguuuaaaagauuguauaauaggccaggugagguggcugaugccuguaaucccagcacuuugaggcaaggcagcuacucaggaggcugaggcaagaggaucacuugagcccaggaguuugagaccagucuaagcacuuagcgagacccugucucuauaaaaaauaaaaauaaaaaaaaaaaaauuaggcaggugucacauaccuguaguuccagcuacucgagaggcugaagcaggaagaucacuagagccagguggucagaccugcagugaacugugauccugccacugugcuccagccugagugacagaggaagacccugucucaaaaaaaaaauuauguaaguuuauugagauguaguucacauacuauacauuuuaccuauuuauacaauucagugaucuuuguucacagaguugugcaaccauaagcgcaaucaauuuuagaacacugucacccuaaaaagaaacaccgucucaaauagcagucaguacucauuucccaccaauucccuaagccccagcaaccauuaaucuccuuucuuucucuauaaauuugccuauuuuggacauuucacauaaauggagucauauaauaugugauuuuuugugucuggcucccuuagcauaauauuuaaaauuuuucucuauauaauauaaaauuaaaauauuuuaauuaaaaauuguauacuaaaaaugcuaaaaauuaaaaaguuuuaguauacaauuuuuaauugaaauauuuuaauuuuauauauaguauagcauuuaucagcacuucauuccuuuuuauggcugaauaauauucuauuuucuggauaugcuguauuguauuuauccauucaucaauugauggacuucugaguuguguucaccuuuugaccauuaugaauaaugcugcuaugaauauucauguacagguauuuguguggacauguauuuucauuucucuuagacauauaccuaggaguagaauugcuggucauaugauaacucuauuuuuuuaacuuuuugaagaacuaccagacuauucuauaaagcaccugcaccauuuaacauuccuagaaguaguguaugaaauuuccaguuucuccacaacacuaguuauugucugacuuuuuaauuauagcuguccuagugagcgugugguuccgauuugcauuuugcugauggcugcugauguugagaaucuuuuaaugugcuuauuugccauuugauaucuccucaggaaaauguuuauucacauccuuugcccauuuauaauauuuaguauuuuuuauugagacauaguagauguacauauguuugggguacaugugauaauuuacuacauuuacauaauuuguaaagaucaaaucaguguaauugggauauucaucucaucuuaaauauuugucuuuaugcuagaaauauuugauuuauucucuucuagcuauuuugaaauauacaacauauuauuguaaacuauagucacccugcugaucuaccaaacacuaggucuuguuucuucuaucaaacucuauauuuguaccccuuaaucaaccucucuucaucccugcacccccacccuucucagcuucugguaacuaccagucuacucuauaucuucaugagauccacuuuuuuagcucccacauaugaaugagaacauguaauaaugucuuucuguacuuggcuuuuuucacuuaacauauaaugacuuccaguuucacuuacguugcugcaaaugacaggauuucauuuuuuuuauauggcugaauaacauuccauuguguauauauaccauauuuucuuuauccauucauccacugaugggcacuuacauugauucuaauaauuuuuguuauugugaauauagugcuucaauaaacaugggaguacagagauaucuucaguauauugauuuucuuuuggguuuauauucaaaaguggaauuguuggauugaggaaccuccacacaguuuuccauaguaacuguacuaauuuacauucccagcagugguguacgaggauucuccuuuauccgcauccucaccagcauccauuauucauugucuuuuugauaaaagccauucuaacuggggugagaugauaucgcauuaugauuuugauuuguauuucucugaugguuagugauguugagcaucuuuucaugugucuggccauuuuuaugucuucuuuugagaaauaucuauucagaccuuuugccuauuuaaaaaucagauuauuuguuuuguuguuauugaguuguuugagcuccuuauauauuuugguuguuaaucccauguuagaugaguagcgugugaauauuuuuuccauuuuaugaauugucuuuaucacuucauugauuguuuccuuugcucaacagaagcuugauguaauccuuuugucuauuuuuggcuugguugccugugcuuuugaggucuuacccaaaaaaaucuuugcacagaccaauguccuggagcauuuccccaauguuuucuucuaguaguuucauaguuucagguguuagauuuaagucuucaauccauuuugacuuuuguauauggugagagauaaggagguucuguuuuuaguuucauuguucugcaugugguuauucaguuuucccagcaccauuuguugaagagacuguuuuuuuccccauuguauguuuuugaugccuuuguugaaaaugaguuagcuguuaaugucuggauuuauauguagguucucuguucuguuucauuggucuguaugucuguuuuuaugccaauagcaugcugauuugguuucuauagcuuuguaguauauucugaagucagguagugugaugccuccagcuuucuuuuugcucaagauugauuuggcuauucagggucuuuuaugguuccauacauauuuuaggauuguuuuuucuauuucugugaagaacgucauuuauacguugauagggauuccauugacuuuguaaauugcuuuggguagaauuguuuuguuguuuuguuuugagacaggaucuugcugugucuuacaggcuggaguacaguggugcaauuacauacaguucacugcagccuugacuucuggucucaggcaauccucccaccuuucagccuccccaguagcugggacuauaggcgugugcuaccacguccagcuaauuuuuguauuuuuuguagagacaggguuucaccauguugcccaggcuuaccuugaacuccugggcucaggcaguccuucagucucggccucccaaagugcugggauacaggcgugaguuaccacauuagccagaauuguuacuuuaacaauauugguucuucuaauccaugagcauggaguaucuuuucauuuuucuguguccucuuuaauuucuuucaucaguguuuuauacuuuuucuaguagagauauuuuacuucuuugguuggauugauucuuagauauuuucuauucuuuguaguuauuguaagugggguugcuuucuugauuuuuuuuucagauuguuugcuguugguguauauaaaugcuacugauuuuuguauguugauuuuguauccuacaacuuuacuggauucauugauuuuuuuuuuuuuuuuugagacggagucucgcccugucgcccaggcuagagugcaguggcacaaucuuggcucacugcaagcuccgcuucccggguucacgccauucuccugccucagccuccugaguagcugggacuacaggcgcccgccagcaugcccagcuaauuuuuuuuuuuguauuuuuauuagagacgugguuucaccauguuagccaggauggucucgaucuccugaccuggugaugcgcccacuucggccucccaaagugcugggauuacaggcaugagccaccacgcccggaccauuaaucauuuuuaacaguuuuuuugguugaguuccucaggcuuuucugaguauaagaccaugucaucugcaagcaaggcuaauuugacuucuuccuuuccaauuuggauacucuuuauuucucucucuugccucauugcucuggacaggacuuccaguauuacauugaauaaaaguggugaaagugggcauccuggucuugcuccagaucuuagaggaaaggcuuuuaauauuuccacauugaguacaguguuagguguggguuuguaauauauauucuuuauuauuuugagggauguuccuuuguugaggguuuuuaucaugaagugauguugaauuuuauuuaaugcuuuuccagcaucuguugaaacaauaauaggcuuuuuuguucaugauuauguuaauuugauguaucauguucacugauuugcuuauguugaacaaucugcaucccugggaugaauuccacuugaucguggugaaugaucuuucuaaugugauguugaauuugguuugcuagaauuuuguugaggauuuuugcaucuguguucaucagggauguuggccuguagucuucuuuuuuugguuguguccuugucugguuuugguaucaggguaaugcuggucucauagaaugaguuugaaaguauuccuucugcuucaauuuuguuugaagaguuugaguagaauugguauuaguucuuuauauguuugauggaauuuaggaaugaagccauuagguccugggcucuucuuugaugggagacuguuauggcuucagucuccuuacucauuauugguguauuaagguuucucuuucuccuugauucaaccuugguaggcuguguccaggaaauuauccauuucuucuagguuuuccaauuuguugguguauaguucuucauaacagucucucauauauuagccucuucauaauagucucuuuguauuucuguggucucaguuguuuuaucuccucuuuuguuucugguuuuauuuguuuggaucuucucucuuuuuuccagccuagcuaaagguuuguuaguuaauuuuguuugucuuuuuaaaaaaaacaaccuuucauuuuguugaucuucuguauugguuuuuagucucaauuucauuuauuucugauuugaucgcuacuauuuauuuccuuccacuaauuuuggguuuguuuuguucuuuuucuaguuccuucagguauaccauuagguugucuauuugaagucuuucuacuuuuugacauagguguuuauuguuauaaacuuccuucuuaguaccacuuuugcuguaucccauagguuuggguauguuguguuuucauuuccuuugguuucaagaaauuuuuaaauuuccuucuuaauuucuuuauugacccauuggucauucaggagaauguuguuuaauuuucauguguuuguguauuuuuaagcuuccuuuuguuauuaauuucuaguuuuauuccauuguggccagagaagauacuugguaugauuucuacuuacuuaaauuuggugagacuuguuuuuugucucagauaugauuuguuucggagaauguuccauaugcugaugaaaagaauguguuuucugcagccauggguaaaauguuccauaaauguugauuaggccuguuuguguacuguguagcuuaacuccaguguucuuucuugauuuucugucuggauguucuguccauuacugaaaaugggguguugaaguccccuacuauuacuguauugcagucugucucuccuuuuaaauguauuauuugcuuuaugcacucagaugcucugguguugcaugcauagauauuuauaauuguuauauccucuugcugaauugacccuuuuaucaauacauagugacccucuuuguuucuuuuuacagucuugauagucuguuuuaucugauacaaauauagcuacuccugcuuuuguuuccaguugcauggaauaucuuuuuucagccuuucacuuucagucuguguguggcuuuauaggcgaaguaaguuucuuauaggcagcauauaguuuaacucuugcuucuuuaucuguuuagacagaauucauucugccuugugauuagagaauugaguccauuugcauucaguguuacuguugccaaguaaacuuacuacugucauuucauugcuuguuuucuguuguuuuagaacuccuuccuuuuuucuuuuucuuacugucuuccuuugugauuaagagauuuucucugguaguauguuuuaauucauugcuuuuuaguuauagugaaucuguuauagguuuuugcauugugguaaccaugagacuacaaaaacaucuuaauuacaaaacaaagaauagaaauuuuuuuuaaaaacccucuuuuuuuuuccucaggucccgcuuuauuaccuaauacaaguccaaccucuggaacauucaaauucacuguugcaaaguuuaauuaaaaacacaauuuacaaauauuuaacauauucuaaaaagcguuucuaaguuaagaaugaaaaaguauguacauaauauauaaucaaauacagguggccucaacuuccaccagguccacauucagcaacauucgucuuuuuagguucuucaguaucuucugucaaauccacagaguuguuuuccaugacgggggaaggaauggaaauccccauugcuuuucaaacuccguaugugcuuaugauaucaccuguaguuacuugcugugcaaguucuuuaagauuauuggucacuuguucagugagaugcauuucucuguaugagggacccaagagacagaucauguugggagggggucugguguugaaacauucauucugggcuuccuggagcuagcucccugagcaaucugguggucucaucaaguuucuucuggaauauuucagcuuccucagaaucaaaaacuuuaaccggaacgccaaaguuuguuacugcuuucagcgcuaugagccugucuugaaguauuggaguccagacauccugguggcucuacuucuguaaucuccauuucuuuugcugugucagguguccuaguauggccuuccaucuucaggcagugacaucuaaaucucuuguaggguccuggaaugcccuccuuuuguuaaaacauccaguaaacuaucugccaucacagauggauaaucuuggcacguggccaaaaacucauggcugcugagaucgcuuggaagaucugugucuuccccauagguugaauagauuaaaucagaaucauucuuguugauauuugcauauguggagucauaaugcggugcauaagaacuguagggcccauaauucaaauauaacacuggagugacuuuguucuuuuguccucuuugaaccccugcaaaguauucacaccagacugaagucuuccaguugucauucccagucucacagggcaguagccuggcucuccuacaaugagauccacaggauggagaagucccaacauuguuguuccgucugguuuucuucuuuccaauuugcacugacuguucacaagccgccuggucagcuuuccuccagauuccuucacgaugcggucaagcugcuccugcgcucucucuaaauuauugcuuuuaaacuuaucuucaagcaugucuuugucuuucuuuuuauuuucuuugcugggacucuugaaggcgugugcuuuggcaucuccagaguccucucucuucucggccagcagccucuguccuccccacucugcgaggugucuguucugucuuccugcuuuugaguuuucugcaagucagccaugaagucuaugcucugcuucaggcucugaauucuuucaugucuaagaauuuucauccccgagugcaaccgcuucuuugcagcuuuauaauaaauggucucugguuuauuguaaaucauggcauuaguacacauuaguuugaaaauauccuuuaguuuuucuauggacugguagucauuguucuugaucuuuucuuucauuuaaaauccauuggguguuuaaugaucauggaguagccaggagcaguaaaaucagucacaggaaaugaaagaaagcacuuggaucuuuucucugcaauugucucgccaguugauucaaagcuucuugaaggggugggguaucuguucuacuucuucuuguuuggcuaaagugcuugugagaggcuucucaccgggcaagucuaaucccacaggggcgugacacuggaggucuuuuucugccucauucuccaccccgucucaaucucgcuucuuuuuauccuccuuaacucuuaucuguuuucuccccuuuucuuccccuggaaccugcuugucuccuuucuuucucuuuuuccacuuucuguccuuuuguuugucaugauuguuuuuugucuucgaagaggcuggaguugugccccgagcugcccacggagaguucggugacuucauucccuccugcuuugaggaccagcuucaagggcuucucuacauacuccugguagagguguuuguccgacuugagcuucuugugcuugugcuucuuguccauguccgaccgggccccugugcucaccccccgcgccaggcccaggcagugcggcgcugcuuccggucugggccaggcgagccgagggcgggagcggggcccgcgaggccccucucgagaagcuaaaaaacccucuuuccuauaacuccaccccaccccgccccccacauuuugacacuauguuguguuaauuuuuauguuuuuauauugccuaucucuuaauggguugcuauaaguauuacuguuuuugguagauuugucuuuuggacuucauaccaaacagaguuacaaauggauuguacacuacaaauugcaguaauagaguauucugguuuguuuguguacuuaauuuuaccaguggguuuuauaccuuuacaagcuuucuuuuuguaaguuaguguuuuuuucugucugguggaagaacucccaugugcauuuuuuuguaaggugguucuggugguggugaauucucuuagcuuaaguuugucugggaaagacuauguauuugacugggcacaauggcucacaccuauaauccuagcacuuugggaggcagagaugggaggauugcuugaguccaggaguucaaaaccagcauggucaacauagcaugauucccaucacuacaaaagaagauuuaaaaaauaaaaagacaaaccaaaaacccucuuuuuuauauuugaaggauagcauugcucaauacuuuauucuuagauggcauuuuuuuaaagcacguugaagauggcauuccacucuuuccuggccuuuauaguuucucuuaagaugucuguugccagacaaguuggagcacuuguauacaucauuuacuucuuuucucuugcugcuuucuuuguccuugaccuuugaguguuucauuauuauauaacuugggaguagucuuauuugcaucaaaucuauuugguguugucuuaccuuuauuccuguaccuggauauuuaucuuuuucucaaguuuuugggauuuuuuucuguuauuucuugaaauaagcuuuuugccccuuucccuugcuuaacaagagcccucacucuuaaauaccaauaaauuucuuagauuuugucuuuagagguaauuuucuguaucuuaaaggcagccuucauuccuuuccauugguuuuuuucuuuuuucuccucauguauuuucaaauagccugucuuugagcucacugacuuuuuuuuguuucauauauccugcuauugagagacuuuaaugaauuuuucaguucaccaaauguauuucucaguuuugauuucuguuuguuuucuuuguauuauuucacucuucuuguuaaauuucucuaauaaauuucuguauuacuuuucuguguugucuuguagguuauuuaguuuccauugugcuauugagaguaucuaaugaauuuuucuguucaccaaauguauuucucaauuucgauuucuguuugguuuuuuuuguauuauuuugaucuccuugcuaaauuucucuaauaaauuucuuaauuacuuuucugcuuugccuuguaaaaguuacugaauuuccuuauaccugguauuuugaauucuugaucagaaagcucaugucacugucuucuuagggucagucacugguuccuugcuuugucuguuugaggucaugguucccuguuuucuguuguuuguuguggauauacaucugugucuuugcauucaaggauuaguuauuuauucuagucuucucuaucuggcuuguuuugguuuuuaucgaauaugcuugcuuagagauucuuugaaguuuaccuguuaauuuucuuucuuuuuuuuuuuuucuuaaaucugcuagguugcugccuccuuuucagcaccuaaccucuggguagagguucauguccaaugaaccugugaaaugaaccucuuaacaguguggugcugcugaacagccacuccaacuuggcaucucuuuuggcugaguuacauagcagaguuuccaggacuagggaugguagucccaccuccgaccucuucucuuuauuucuggugguuuucagggauuauuucucccuuagguauuuccacugcucccaguuauuaggacagggauaggucucuugccaacaaacccaagaugguggagaagccaguuguccaccucaguuauacuuuuuccaguguagcaacucugaguugggaaaguuuucugcaugcuuggugcuggacagauugaggggaggggcacugugauuaugaaagucuaauuugcuuucuuuugcucagaguuuuuucacuucuuuguggccuugggaacugucuccucauauuugaguucgggauauugcucaugaucgugucagcacuguauuugugguuuugguuuccuguggcagugagugaagccagguuacuucuguaccaccguuuuacaaccagaagucucuguccauuuuaaaauuuuauugucuuuuuauuauugaguugaaagaguuguuuguucuagauacaagucccuuaugaaauauaugauucacaacuuuuuuuucauucugugcauugucuuuucaacuuucuuuuagacagguaaaagcuuaagguccuuuaguauucagcuaccauaaaauaugguugaauaauuuacuagacuugcauauaauguuaauuaccaauaauauuuuauuuauuugcauuugaaggagcauuuagguauuuauguacaaauuugaccagacaguaaguuuguuuugauuaacuuuugauauugcuuuaaauugagaugaauuuucaugucauaaucagaauuuuuuuuugagacuuugguuuauuuaccuuucaauuaaaauaccacaaaaauuaaugugugugaccauucuggcuaaauuaucugaaacuaaaaaguguuuguuuuacaagccagaauuuuauuuuucacuaagguuaauaacacuaauuauuuuuaugacguuuagucugaaaggugcacauuuucuuggagauuugugcuugaaacuacuguuagaagcuuuguuuuuuaagacugagcuuuuuagaaauaguuguaccauggcgugugccuuugagcaguacccauauaguuucauaguuauugaaaaucaagggaauuguugauuuacuuucuauaacaauaauugcagauuaaauugcuuaugaacuuuggauacaacauuucaucagauuucugacauauuaaucauaaaagaaucauauuaaucaucaaacuacuguuguucaguuuggaaguuggcccuuaacccauuuaugccuaguguuccauuauugggcugcuaagcuugugggaguuauuuauauccuacugcucagggucaucaccaaagucugauuuuucacacacaaaaaauugcaaccucuggcauaaauggguuaauugauucccuucuaguuccguuccauaaaggggagaugugaggacauuauacauaucuucauuguuuauaaggagaaagaaaauaguuuauaaggagaaaguaagauuuaaauccaucaaauuuucagcuagacucaguugaaagccuucuuagaggccacccaauuugaaaaagacauccugugcaucaguuuuacaguaacaaauucucgguuuucugacaucaacuguggguguucuacaauugaauucaauucugacacuaacuacuacuaauguauacccuacaggguaaggguucuguccgauaguacugcucacuucagacaccagccacaaauggagucccuaggcucccugcacuucugcccuaccugaggcuauccaggagcccccagcuaccagucaucucauugguacacauguaaacacuuaacacuuaaaagaauccaaacguuuuaggagcuguguaccaggaagagggacaaagaccaaauauauauuucuucuuauaucauaguaucauacccccucuuguaaauuuuucauuuuaguuauugaacuuuucaauucuggaauuucuauuugguucuuuuuuuauaauuucucucucuucauugauauucucuauuugguaagauguuggucucauacucuccuuuaacucucuugacauguuucuuuuaguuuuuugaaauagcuggcuuaaaaucuuuguccaguaaguccaacaccuuggcuucuucaugaacaguuucuguugucugcuuuuauauauaugugugcauauauauauauauauggugccauauuugccuguuuguguguuuuauaauuuuauuuuuguugaaaaccagacauuuuaaauuauguagcaguucucaaguuagauuccucucuacccacccaguuuauuuuuguuguugcugcaguuuauuucuucagugauuuucaugggcuuauuuuguauagucucuauucuuuuuucuuuuuugagauggagucccacucugucgcccaggcuggagugcaguggcgcaaucuccgcucacugcaagcuccgccugccggguucgugccauucuucugccucagccucccgaggagcugggacuacaggugcccgccaccacacccggcuaauuuuuuuuuguauuuuuaguagagacgggguuuccauguucgccaggauggucuugaucuccugaccucguaaucugcccgccucggccucccaaaacgcugggauuacaggcaugagccaccgcgcccggcagucucuauuugaaaucucugcucagcuagcauaguggucaguuaaugguugaccagagauuucuuuaaaugccucuuuucucagcuuuugcugaggggcucugugaguauguuggggcagagccucaagaucaaccagaggcaaaauauuagucuucuuagaucuuuccugggcauguacauagcccuacacaugcuuauggccuucuaaauucccuuaacuguaucaaagcuuuuccaagcccccgguggacauuucauuccuguuuguacuuuugaauuuuuuggucagccucuuguuagacccaacugguaaaauuucuccaggcagcuacagcaauuaaauaauugcuguugauuguuuuccacaaagacccugccgcauauagggcucuucacauagugugagcccuucuucaaaucaaauaaaggcaagugcugggaauggaguguuguucagcaagcugccagacaaguccaauaguggcaguuuucugaggguagggcuuuggaggagcuccaaauggguuccggcuccuccaguggcugccuggcugcugguuuuuacagcugcuauggaugcaaggcuuugauuuucaagacuguuuugaagcugcagagggagagaucagauuagaacaaguuaaaaugccacaaagcuugcuguuuuagcauucaucugguguucuugaauaaauacgccuugaauuguugcaaaccuuuaauuuccagaguucugaaaaaguugcuuuugacaguuuuugccaguguucuuguugcuuuuauggaggaacagauauugaaagguccuuacucagcaauuuuguaaaugccucuuuucaguccuauauacuuuuaucuacauccugccaccaaucucugauccagccucucguuacuugccuaucucuuauauuuccacuggauccuuggaacacugguuccauggcuaauauguuuauauuaucaaauuuucacuauuagcuucccuuucuugccugguagcccucucagggcucugucugucacauuucacauaaaucaaaauauuuagugccucucuuaaauaucggcucaggauucuugccuaggucccuucucuuguauuggguauuggauauuuucccugagaaaucuuacccaauuguugcucauacuggcaaaucugucuucuucucuagcucagaucucuuucuuaagcuccauaucuguauguguuucauuuaaauauccauuuagaaauucuauagacauguaaaauuguauaaaugcaaaacagaagucaacccgccccucuuuuacaguuuucuuugagugacauuaucauccguccaguugccuaagccaaaaauaagagucaucuuugauuccuucugccuuauccuacucucaaauuccaguuaccauagccucuugauucuacucccuaaauccuugaccuuuucuccaccucuacugacaucucgacugaauuccuccagcagccuccuaaacagauuuuccuuucuguaguucuguugcuaguguccccacaauguguccacagggaacuuuauaaaaugcgaaucuguacaggucauuaguacaugcaugugcgcacacacacaaaaacacagacuuucucucacacacacacacacuguuuuucucucucucauacucuuuuucuuucucuccuucucauacucuuuuucuuuucucuccacugcacuccuuguuucaucccaccuacacuuuuccuguucccagaugccauguuucuguugcugucagguuucuguacauacugaaaacauucuuccucauuugcuuggcuaaaucugauucauaguucagauaucagcucaaaugucacuuccucugguaagccuuccuagauucucacaagucugaguuagauacuuguggauauagccauaggauuuugugcuucugagcaccugucauaccauacuguaauugccuauuuauucaucauuuucuccaaguagacuauaaaguuaguggcuuuauagucaugaaguuaguggcuguguuauaagcagccuaugguuuagcaccaaacauugggucuccacaaauuacuugaguagagaaauuaugacuacauuuaugaauaaaggaaccaacuauacccugcacuguauauacaaagacacauuagacaaauguaugaauaaaauagacuuuugaaacaucugguauuucagcgauauaguuucucuuaguaauuugggauuaaucauuuaaagccaaugauucuagauaaaguucuguauauuuuauuugaagaaauaaaauggcauaaauaaauuugaaacuccaaaguauuauuuacaaauaaaaggagaaaaugaaaggaaacuguuauauauuaugcuuuguuuugccuuuuaaguuucuggguuauuuaaaaguagguaaauucuuucuuccucccuuuuguuuacacaaguuguauauuuaguggggggaaauauauauauauauauauauacguauauauauauauauguauauauauauauguauauauauauauauguguauauauauauauauguguauauauauauauauguguauauauauauauauguguauauauauauaaaagaaucacccauauauauauaaaagaaucacucaucaccuggucucauguacuauguuauuuuauaacugauuuucaucugacuauaaagacaucauaaacauuuucuuauacuaggaaauacacuuaaacaucuucuguugcugagguuagcaaacuuuuucuauaaagaacaagaaagcacauauuuuagguuuugaggguuguagggugucuauugcaacugcucaacucugucuauagcauaagcagccauagaccauucuaaauggcugugguguauucuuauaaaacuuuauuuagaaaaucaggcaggaagcaggauuugcuacagagccacagagcuauuauacagauauaacauaauuuuacuuauuucccuauuuuuggaaauuuagauuaucuucauuuuuuucacuauuguuagucauaccucacaucuuaguaucugaaucuucguguacauuuuuaaguuuuucuguaagauaaauucugaaaaucuaauuuccaaggcuaagaguacauccuuacaacuuuucuuuuuccaugagaauagauaauuuaacacuuucugugacugaguuuuguuuaguucguuuugugguuuuguggagaugggaaaagaaagauggaguaaaauuuagaaagacagaagcaaagaaagacuggaaggaaacagauggaguuaaugauagugauauaaaacuugagauguuccaggaagaagaaaauaugaaaauuuuuguaaacguaaauguucuugcucacauaccaaguuuuucuguuuuauagcucugucgagguuuguuuaaaaccuuguuuagauugaauuugagauuugggagaugggauaugcaaauuacacaaugaguauuucuuauucuccuaagauacucuuaggcuaucacuauuuugauuuugauuacccaucagcuuuaaaaaaaaaaaaacuuuucuauuccagaugaugauggagaaagaagucuaauuaauuagagcagagauuggcaaacuacuauccaugggccaaaucccucauguugcguguuuuuguaaaugaaguuuuauuguaacacggucaugcccguucacuuaaguauugcauacagcugcuuccaggcuacaacagcagaguuauguaauugugucagauacagcaugucccauaaagccuaaaauauuuacugucaccuuccagaaaaaguuuucagacccccaaauuagaggaaugguacauuuagucuuuguguuuaucgaaacugaaucuacaaaaauaccccaaguaauuuuacuacaaauaggcuaacaagauuuuagaugggcaauuuagagaccaaaucaagacaccuaaauugcagaauaaaauguugaaaaaugacaauaagaaauguugggauauaaaggacuuaauguuuuguuuuguuuuuguuuuuuuugagauggagucucgcucugucucccaggcuggagugcauuggcgcgaucuuggcucacugcaaccuccgccucccggguucacgccauucuccugccucagccucccgagugucugggacuacaggcaccuggcuaauuuuuuuguguuuuuaguggagagggguuucaccauguuggccaggauggucuugaucuccugaccucgugaucuaccugccucagcccccaaagugcugggauuacaggcgugagccaccaugcccagccaaggacuuaauguuuaguauaauucuggguuccgugaaagaugaaauucagagcacccacauacuccuuguugaagaggcaucugccuuuuguuauguacuuacacacaaugggaaguagccagcuccacagaguuuugccauggugucaaguuuugguggcgcuuuuuaaaauaacuuuugcagcuucugaauuagggaacaucaaucaaauuggaaaauucaaacucugaaauuuuugaaaccuguguacaugggcuuguucagccacagacgaucuuauuucucuuggacuuguugucuaacuucaguuugccaugauaguaagagggaaccuucagaggaggggaaggggaguuguuguuuaaagaguaugaaguuucaacuagacaugaugaauaaguucuggacaucaguuguacugcauggugacuguaguugauaauguauuauauacuugaaaaucgcuaagagauuagauuuuaaaugcucuuaccacaaaauaauaaguaugugaagugauggauauguuagcucgacuuaaucauuucaugguguauacauaucaaaguuucauguuguauaccauauauauguacaauuuuuauguaucaguuuacguuaauagaguugaagggguagggauauuuucuuuccuuaaaucuauauguuaccuagaaauaccuaauacccugacuccuuuaagaauccaaaauggccgggcgcgguggcucacgccuguaaucccagcacuuuggaaggccgaggcagguggaucaugaggucaggagaucgagaccauccugauuaacacggugaaaccccgucucuacuaaaaaauacaaaaaauuagccgggcaugguggcaggcaccuguagucccagcuacuccggaggcugaggcaggagaacggcgugagcccgggagguggagcuugcagcaagccgagaucgcaacacugcacuccagccugggugacagagcgagacuccaucucaaaaaaaaaaaagagaauccaaaaucauuuaguagaagguuucaaaauaccauaacuuucacuaauuuuauaaaaacauucuugaaagcauccuguauguggaacuucuagaaguauaguggaaaagcgccuggacugaagucacaaguucuuaauuagaccacuaacuagauguugaaaaaagcuggguuucuaguaccagcuaccuaccucuggacuucuuuuaggagagaagccacuaauuuuaaugcuaaauccacugauuugggggcauuuucucacaauuuaaccuaauccuaacuaacgggaguuguaguagacugguuuaucucuaaagacuuuacagcucuguaucuccacacauuugugugagguagagcuagcggagggaaauaaauagaaguggucuguaucuugucaagauaaagcaaauuacagaacuacaaauuuuaugguaauaaaagacauacuauuuccaaaaagcaguugacucucguguucauuuuuacacauuucucuuuccuuauuuaacuuuugaguuuuuuauuuuauccuguuucuuucauuuucucuuauaucauucuuauucuauauuagagcuguuagugcuaugccaagaauuccuuguguugugguuguucuucaggagguuguucuugaggaagggugaugaguaaggcacugagccaucucuagcugcaggagcacuggagagagagguacgucuguguugauagagugacuacagauuuggauggcacuucaggucauucaggguaggaaagugcaauauguuggggauccuucucaaccccacacacccauguccuccucuaacccugaugguaguuacauuaauuguaucagagucccucuuuuuucguggauguguuucuucagauauucaaaggcuuucacaucauuccuuuguccuuaagcaguuauucuguuuuguuguggguucuuuaauucauuuaauaaauguuuguuaagcacauaccauguguuuuuuguugaguucuggggacauaguguucauuugaacacaauaacaccucccuaagaguuuuugccaugaaaugggaaaguuagauaaggaaacaggcaauuauaauaaaaaauaaaaacugaggaauuaaggaagccaacauugacuuuuuaaaaacauugaaccagcaugguuaaauggaaagaguauugguuuuagguuuuguugagcuggauucuauugcuuaauaguuaugugacuuugggaacguuaaccuccaucaauacugcaagauuauccuaauuagaaauacauagguaaagcacuuacccuauuaccugcugaguaaaucauuucuuccuuuuuccuaaauuguacaucccaaaauuguuguaguucugaagccuauaaauagaaagguaauucuucuggucccuacuucacaggagaugugaaaaguggauauaaaauuauuuuuaagacacuuugugaacacucugaccauaaagaaacuauuaauacaguccaauuuuguaauuguuucuuguaaaauuuacccaaaauuccauuauugagauauauugacuauaaaacaaauaccuuaggaauuuacaguauugcuuguaaaauauggcauugcacuaguaauucuguaaucacuggucuugcauuugucaacuuaagaggaaauaauucacugucuucccaccucccucaaccuguaguuuagcauaccaguuacucuuagucaaauugugguuuuuguccagaaggguaaugguuauaacauuuauucaugagauauuuaaaaagcauucaaguaagucaucaguaaauugauuaaaucuauuaagacucauuaauauaguuugaauguucucuauuugaagaauugaaaaacuaugaaauuuaggaauuaauaccauguuguauuuagaaaugaaauagccaaacuggaaacugaaauuuguauaacagcaacacaauuuguaauuuuucaaaagcacgacaguugguaguucaaaucagaauauuacaguucggagaaucagaucuuguuucauuaugugacugaucuuucuaaauuugcucugcuuuauguaauaacuguuccagauuuauuuuucugucguaaguguaccuuaaaaauaagagaagcuaauguuauucuuuauaagaaauguaaacauuaagauaucaacacaguguagaacuacuuucuauauauuuuauauaaaucauucuaaaucauaaaugggaaauagugaucaaacaaauauuuacauuccuaccaaaagaaaaggcccagugaagcagagugaggagggauaagggguggggaagaagccugaggcuuguguuggcaggaacagcacagugagagcgggugacagcaugagaaaaauggauguguucuuccaucacugcuguucuccucucuguuuggauuagacaaauggcacauacccaaggggaacuagggacaaugcucugaggacaguaaccacuuccauacagcccugccagauucaugagagcaauggugcaucugcuuuuuguugccauuguuguuacuuaaucuugucauggacagauuaucguuucuguggcauuucuuuuguggguucucacucaaauuacuuucuuuaucauggcugugcuggauugucuguuggcaagucagcaccauuuaccccuucugcaccuugacugauauauugguuuucugagaagugugcauguuggccuuuugucuccccuuguuccauaccaccaaauauaaaauuuagauacccugaaauccauuauagauaauugaucuguagagauuuuguuuugauuugguuuugucuuuuuuuuuuuccuuuuaauggcaaaauuucauuuuuacccuccuucccacugcaauagcaaaauucugcacacuggaacugcuuuuacauuccccuuucucccagagcugccucucuuuuagggaaggcucuuguuugaaaacauuaaugccaagacaggcauucauugauuuauuuaguaaacuuuuugugaauuuuuguaaccuucauaacacugugcuuauaaccuucauaacacugguauuuauagaugauucagugaaguacacaagacuaguuggauuaugaggguuaaauagugaaaauacuuucaucaaaacuacuguuuaagucauacuguuauacaaugcuuguguuuacacaauguuuccaaauguucuguuguaaaauguaguuaauacugguuacuuugaacuauggguuaauuuuuuucaacucuucccuuagauaagcuguguugccauuagaacauuuaaaugaguuucauucugaguuuuguauuguuaaacugugucuggaaacuaaacuuuauaauguguuacauuuuaggucagaagacaugucuucaucuacauggcaucuuuccuuaccucuaugugccauacgaugguuauggacagcagccagaaagcuaucuuucucagauggcauucaguaucgacagagcacuuaauguggcuuuaggcaauccaucuuccacugcucagcauguguucaaagugucauuaguaucaggaauguaaguauaugauaauauauuuuauaauuucuguuuauguugcuauucuauuuagaggaaaacauacucaguugauaaacucuauuucuuuuacuucuagucuaauggaacuguagugaauuccuugcuguaacuuuuuaacaugaauuuuuauggcaaugaaagguagagagucaacagugauuuuuguuguuuccuuucccauuucucugcuuccuguaacuauagaaauucauuaguaauucauauaguaauuuauucagcaaauauuucuuaaauacuuuuuaugugcuaagcacuguucuaggcguuugggauauacugcuggacaaaacaaagagcccugcccauguggaaguuacauucuacuacgggaaacagauaauaaccaauaaauacaacauuaaauuaauuuauuugcuauaugauaauuagucguguggaaggaaagaaucuauacaagcaggauaagaaggaauaguagugugggguaaggaaguagacuagugacaauuuuagaguaaucagggaaugugucauugacaaaguaacaacaucugagcaaagaccugaaggagguaagggaguaggaacagcauggaagccaggugacuagaguggaagaguaaaggagaguuggacuaaaugagauaagagagagaugagaggguagagacugugaggaccaaugauucucaaagugugguuuccauacuuugguuuccuaguaucaccuacuaucauuagcuuuaccuaguuuuacagccaugagaauauaccucucagaucuccaaauacacagagaaugagugaauggccccagcuacuauacacucaauuccagucugucacuccacaugagcugcuuuccauaggcuacucuuacccuaugacugagcauggcaaagauacuaaagcagaucuguaaaacaucccucuguccacuugagaugagacugguaucuaggucugguggcuaugccggcuucuucuggcugccuucucauuuucucucacauuuggcauuuacuucuuggaggacugggacugacacaccugggaacuugguagaacuacauucuuggggcccagcaauuuguguuuuaauaaagccuuucugaugauucuuaugcaugcuuaaguuuguuaaucacucaguaggcuaauguaaggacuuugacuuuuacuguaaguuauuacaugauuuugagcagccaagaucuggcuuaaacuggaaaggauuacuuaagcaacuguauuaauaauagauuguagggggacgagaauaagagcagggagagaauuaggacauuaaucuggguaagaaaauaugguggcuugauauuaagguagaaaagaccaaggaauuaaaauuaaaacaaaaaagaaaauaguguggcuugaacuagggugguagcagggaaguaaucaucagcuucuggaucuauucugaagguugaguuaauguauuagcuuugcuuuguguuuggguaaggauugugagagaggaaucaagguugacugcaaaaguuuaaggguguucugcuaggaagacggaagguagagguagagucaacugacaggaaagaucuggagcucauacaggaacauuugaguuguuuuauguccauaugaaauccaaguggagaccuuaaaucucugcuuccaccuuaaucuaggcuuuccucuggaccaugauaguaucauuuuaauugaauuuccuucuauuuuuaucucauuccagagcagcagaaguacucuuauacuguaaauuuaaaaucauuuaaaaauucuugaguggcuucauauuguuaauagaauacaauuuaaacuucuagccauaaccuaugugaccucaccccaucuaccucugaaacucugcuuucuguauuccauucagaaacagugacuuucucucaguuccucugcuauccaaguuguuucucaccuaaguucuuuguauguacaauuuucuuuccuugaguguucuacccuuccccaauccuccagaucauugaccucuucagagaaguuuucuuugacuaucccacguaaaauaagguauuuuaaguagggcauuauuauuauuacuguuuuuauuauucuguaucucagcccauuauuuguuuucuuuagcacuuaauacaguuugcagguauuuuaauuuuuauuuauuuacuuaauuuuuauguguuucuuccacuagcauguaaacugcaugcuagugcacuagcauguaugagaugacucaauaacuguuugguuggauaaaugaaugaggugaaaguuuacacucauccuauaacaggagcaauuauguuagggauaauuaucuacuuuaucuuuuaguuuuguuuauucuugauaguuucuaauaacuuuccuauauauauccucauuucaaaguuaagucuccaaacagcccagugaaauacauagucacuuaucuuccuguauuuuuguauuuguuaaagacauugccacauuuuugagaguaguugaguuacagaucuggauacauggggcaacagaugagcugcucacucuaauuuuucauugcaguuuucuuuuuucuucuaauuuuuuggucauuuucuucccuagauccccuuuuuccuucccauucauucuaccuucucuaauuccuuuacuccuucaauuuuuccuacuuaaguuacauaaaguugcaucuagcuaccaaauuaacauuuacaugagguuuaacucuauucuuuuuagacuaucacuauccugaggcugaguuaagagauaggaucaugaccuugggcuaauuucugggauuccuucucacucaugauuuuagagaaucuucuauaaagagauucucaauccaucaaaauuaauuaggugagauuuuucgcuauccacacucauuuuccuuccuauugauauacuuaaaaaacuaauuacgagauauaauuuuuuaaacaugaaaacaucugcuuucauacuccuccauucuacuuuuuucccccaaagagucucccugaugaggaauucuuuuggcaaaaccauucaucuggcugaagauaacccauguuuccagacaacuaccuuuguauauaugaaaaauaccauagcaggaaagggcuacaguuaagguugaauuugccaaugagagagaaugauaucauuuauguaauaugucuuucuuuaaccaauucuucauggcaacaaaauaggguauacagcagcaaacuagacgggaagugguauuauaaaaaguuaagaaaagggugaagaguaagagggagggauggucaggugagacuuuucugagaagguaaauuaagcagaguucugaaugaagauuaaacaagccaugcaaaaguccagagcggagcuuuccacuugagggaucgaguuagagggucugaaauguuuagagugguuggaggagaaggaagaaugguaugacuugagauuggagugagaggcaaggaugagaugaggaacccuuuagaccuugguaaauaguuguuuuuuuuuuuuuuuaacagaaauuacuuuauaacaauaauacagauggcuuaaaacaacuaaaaaauuauacccaaaauaaugucucugcuaccaaauuaguccuuuauuugauguccacuacacuauuagacaucacagagaggugauguccuaugagaguaaauucuauuaucugcugccugucauaagggaacaauguuuuuaaauaaagagugauuggguuuauccaccuaaagauuuaaccguguauuaacagaccacuuuucagccaauacaaagccuuuuauuucauucacaaauuuacgccuguuuauguauuguuucuaauuacaucauccuugaaaauaguguucuguauaucagagguuguaguguaguuucagauccuccugaaaugaugugagaguucagcuuauuucaucuugcaccgaggauuucucuuccuguuauauagccuuuugcuucccccuuuccucauuccagcugauaccccgagaaaaaacucagccauaacaugauuauguugcuuaaguaaguccauggucuuuuucagucucuuaaguuccugucuacacaguuuuuucacaggaugcacuugauaugguuguguguuacagguuuauucauaucagcuacugaaauacaugcuguguguacauauaauagguacauugucucugcuuauugaacuuauaaaauaauaauaaacagcugaauaaggaaaguaauguaaguguuguuaaguaaaggacuuuguugaagaagaacuucaguuuuuaacaaaaaaaugggagccagaagaaggcggcugaaaggucuguuucucucauauguggaguaaagcaaacaaaaauauguuuucuuauauguggaguaaagaaaacaaaaagccacuuaaagagucuugauguuugagauuaagggguggaugguuuguucuuccuuuuuguccauaguuuuuucagagugauaauuuuuaauucccaucgucaguaauuaaagaaagugauauuuuuuacacuuuuuaaaaaagcuucaguauuucauguuaaccugugcuagguuuaacugaaagguuugggauuuuuuaguuguuuuuugggggguggauaauauuaaacguaagacugaauuuggccagcugaaucuaauuagggcaauaaguugcauuauuucaucucugaauuaugaaaauaauuugaaauuuuuuuucuuauauuucaggccuuuuuaugguuaucaugagaaggaaagacacuuuaugaagaucuaucuuuacaauccuacaauggugaaaagguacaaagauaaaugaaaccaaaauaugaauaacuaucauugaaguauuuuaauaauaaaaaaaaucuagaaagaaggccucuauaguuuguagucuuauuaaagacagagaccguaaaauacacauguacguguauagagagagaccaguggcuuggacucuaugaaggauauuuuagagguggaggcucccaacugcuucuuuccuguuacagauuagagaguucguagaaguagguuaggagagauuacggcugccuugugugauguuaggccucuucuggccagaccuuaguucagcauuaagagaaaguugcucuuuagcuucaaagcaaggggaaauauguaggagugaguccagagugagagggcuuuugagaucucagaaaccuguugacuguuuacuagauguuggugaaauuuuauauuccagguuuuuuguugguuuugguuuugguuguuuuuucuucccucaguuagucucccugccucuagcuuauccucucaaucauccuggagggcagggaagggcacauauauggaagauuuuaaucauccuuucagauucaaaacaaggauuuucacuauguauagugggaagcuaggguaaaaguggccucggagguguacugaguauuauuuuuucaggagguccucucugcuaguagguacuggguuccaaaaaguaacuuuuuuguaaaacacagauuggauguuuucccauagugaauuaaagcacuacagggggcacgacugcccagaacaugagguuuacccuggauuaaaccauuugaguacuucacugaagcacagcucuauucccaaugguuauucccuuguaacugaaaacuaguuuucuuacauccugcccuugaucuuacccaaaauaacuucuguucuguaccaguuccccucuacucauacuuccucauauucguggaguacaaaagagcaauuucuguggacucuuauucucucacacacauacagagugguaagagaguaaaccucagucauuuuucccuuucucguccacaaguugugcuggagugggagccaugauuaaaagaggcuuaaguguuuuauaaauaaccuauaaacaaauuauaaauacaaucaauuuuuuuccuugcaaccauagcaaacacuaaacuguucucaguaaguuugcuuuaaauuauauagucagcuuaucacaaugccauucuaaaauuccugauuuauuaauggauucauucauuuauucaucauuauuuguucauuuauuauuuuuucaagacagucuugcuuuguugcccaggcuggaguacgcaauggugcagucauagcucacugcaaccccaaacuccugggcuccagugaucuucccacguuagccucccaaagugcugggauuacaggccugagccaccauaccagaccuguuuaugcauguuuaauaaauauuugcaaaguaccuacauuacuugaugcucuguggaaguugaugggcagacauggugagcaaagugugcaugguucaugcccucagggaacuuacaacaagcuggggagauagagaauacacagguaacccaaauauauaagcaaaaauugugguacucuuuggucugccaaaugaaaacgucaguucugaauucauccauuuauuuucucuccacuaagccucaguuucugauuacugcagaauaaaaaaauuuaaaaaaaaauuacacacuggugccacuguaaauucaugguuuucaacuucacccagacccuucccugcgugcuguaugucuacuuuuuucuaguuaauugucucuuuacuauucucuauccucuacucaggccuuaccuucuuagagaaaacagaacccaucauucuagagaggugguuuucaaagugugaaguggggauuucugaaacccuuucaggggauuuguauggucagaauucucuuuauuauacuaaaauacuaagaucuuuauuauacuaagauuauacugauuuuccuuuugcacuguuuucauugauaguggguuaaucuggcaccuugucucaaaucaggguaaugacaucaacuacuaaucauuguguuuucuaccacuaaguacucaccuuuaaaaaaaaaaaaaagccgguuucacauuagaauauccauuaggacaugguaaaaauuauuuuauugaauuuugacccuugguuauauaucuuuguaacauuuaugugacaaaaugaaaguaacaugaaaggcuauuaaauuauuuucuuuuucaacuccauaucugugugaggcuagauuuucuuuauauacaucaacaaaagcaauauacugcaacagauugaacagaagcugauguaauaauccagcuaucuucuguaaaaacaaggauuuguaaacauguaaaacaauguuucuuuucucacuaaguuguucuuguuuugaaaaauauaguuuaaaacaauguuauuuauguuaacauaggaguuuauuguuacuuuaaaauuaguagguggggcacgguggcucacacuuguaauuccagcacuuugggaggccgagguggguagaucacgugaggucaggaguuugagacaagccuggccagcaugaugaaaccccaucucuaccaaaaaauacaaaaauuaguugggcuuguggcaagcaccuaucgucuuagcuauucuggaggcuaaggugggagaaucguuugaaccccagagguggagguugcagugagcugagaucgcaccacugcauuucuguuuuaauuucuaauaugguaaauaucaguagauauaaaccacauaaacaaaagcucuuuaguguucucaauaauguuguuuuuguuuuguuuuguuuuguuuuguuuuguuuuguuuuguuuuguuuuuaagauggagucucacuguugcccaggcuggggugcaguggcaccaugucggcucacugcaacuuccgccucccagguucaagcaauucuccugccucagccuccugaguagcugggauuacaggugcccaccaccaugccuggcuaauuuuuuaauauuuuuaguagagaugggguuucaccaucuuggccagguggucucaaacuccugaccucaggugauccgcccaccucaggcucccaaagugcugggauuacaggcgugagccaccgugcccagccccucaauaacauuuuaagaaugaaagggguucuggggccaaaaaguuugagaaccacuggaauaaagcucucuuaaggcuuucuuaaccuuaaauugcauuuacauccauucucuccucgcugccuauuccgugaaagaaauuuuuccuccucaccucugaggcucaagauucaucuucuuugauguuuucaaggaucgcuuccaucugucggcuauucccgucuuucuuuccaauuccauuuuaauauuaauaaaacuuugcuaauuauacgcacacauucauacucauagaaacaccuuucucauuuagccauucuccuugaaagauuuaucuauacuuuguguauccaacuucuuaccucccauucauuguuuguuuguuuugaauuggaaucuugcccuguugcucaggcuggaggucaauggcacgaucucagcucacuguaaccucauccuccgggguucaugcaauucuccugccucagccuccugaguaguuaggauuacaggcaccaccaccacgucugacuaauuuuuuuguauuuuuaguaaggacaggguuucuccauguuggccaggcuggucuagaaccccugaccucaagugauccaccugccucagccucccaaagugcugggauuacaagcacaagccacugugcucggcuuucccauucacucuuuaacuuacuacaauauggcuucuaccccaaccauuuuacugaaaauugcuuucacuaaugaccucuguguugcuaaauccaauuuuagguccuuacuuuuugaccucauggugaugcuuauggugccuuaaaacaauccuaaauguuagcuucugugauauauaccaccucuaguuuuucucauuccagugugaucaaucauauuucugccauuuuguugguuuacauuuuaacaucuaugguuguuucuuagaauucugccuuagacuuucaucuuuacucuguauauuuucuguucccucuacagacuuauuuacucccauggguuuguuugguuuuaacuuuuguuuuuguuuaucuuuaugcuuuugacuuccaaauguauaugaauagccucauuucucucuagagcuucuaaacaauauaucaaaccaucuacuggauagauggaauagccgagugguuaagagugagggcucacaaggcagagaaauuuugauuugaauuuuagccccuuuguuuuuuuaagacacaggaucuugcucuguugcccaggauggcaugcaguggcgccaucauaccucacuguaaccuggaacuccugggcucaggugguccucccaccucagagcucuucuaucuuuugugugauuuuuaaaucuaagauaauuucuuuauuuauaaaauggagaugaucguaccacagacuuguaauaaacauuacuuguaauaaaguacguuagcacaguauccaauauauagugcucagaaauguuaguuaccucugcuguguuaauaaaaugauuauuauuuucuuuaugauucauuuccaauauuauuauuggauccccacuauaccuaaaugcccuugugucuaaauugaguuuauccuuauuccccuuccaaaaaaucccaaaccaauuuuucuuacaguucuuccccuuucaaauaauugcaccaccacuaaccagcugcuuaagcaagaaaucuaggcaucacccucagccccuuuucugucucacccuucacaucuaguuagucaucaaggccugaucauuucaccccuuauaugucuccugaaucaguacauuucuaugauccuuguuauagccaccauccuuaguuuuuccacaacagccuauuuacuccuuaccuguagucuucuguguucuauagcuagucuggugaugucacuuuucugcuauucaccucucagacaaauuucacuaccucuucaaaugucuuaacaggcucuucaugcucuuacuucucauuacuucucuaucccugccucugacacuaggucacagucuuacucagugguuucaguuccugaauaagccguguuuucucgugacccuuuacaugugcaguuuuauuuacgugaauacucuucccucucuucagagaaaaaagugccucuaguucaucauuuagucucuugcuuagagaguuucucuaagguuuugcagaaaccaccucuguaccucuaucuguuuaguaucuuuucuagauguuuaauguauuuccccacauaguacuuaacuaugcuguauauaauugucuguuguuuguauucgucaucaugaagggaaaaaaaauacucaggaaagaaaaauaucaaaauggcaauaccucugaguggugggauuauaaguaaugauuucuuuuccuuuuuugaauauuaaucuuuucaaaauuauuuguuauuuuuaaaagaaaaauuuuauuuuaaaaaccuuuuaauuuuuaaauauaguuaguaucaaauugguuuaagacaaaauauucuucauccaugcaguuuuuuguuauucagaacauguugcuuacuugaaaacuugauugaaacuuuuaauuucuaacaaaauacaaauuuccgguaaaauugagauggaaauuuugugugcuaauaagugcuuuguucuguauauuucuauaaucauuguuucauuuaacauuuuagggaacauaauuuuaugauaaaacuuuuuuuuucuaauuuaggauaugugaacuuuugcaaagcggagccauaaugaauaaauuuuaccagccucaugaagcgcauauucccuaccuccuacagcucuucauugacuacaaucuuuauggcaugaauuuaauaaaucuggcugcugucaaguuccgaaaagcaagaaggaaaaguaagguuaauuuucagucaaauuaaauuuuugucaaauuaaaguuuugaaacaaguguuauauagucagugauuuauaaaauaauauauauuuagaaaauaaauguugagugacuaaagaaugaaaagaaauacaugcaaagugggauuagagauugucaggaaaagcaucucagaaaaaauuuuuuuugguaacagcuuuauugaguuauaauuuauauccguuuaaagaggacaguuugaugguuuuuaguauacaggcuaccuaaaagguauuguggguuuaguucuagaccacugcaaaagugaacccuuuacacugcuuagcaauugauauguauugugauucuuuuuuuuuuuuaaccucagaccuuaauguuacuuuuuauauuuuaggaauaguauaugauacacaauucuagaaaucccuggaguuguuagagccuuguuacuuuaguccagcacuucccugauggugugaauagcuguagguuaguggacguguuggucucucagcauuccagacggauuccuaagucccuugagccaucaccuccaccacugaacauccuuguccauuuuaucucagugggcugugcaagcauuguuauuuuucuuugugugacaugaccugaaaaauauugcaggcagagcuuucucugggugaauuugcuauuucuuuaaaguucuuuauuuauagagccguugauauuaugaacaaaacagaauaacauggcuauuugaauaagugauuuccucucaaaacaaauuuauuuuuccuuuuacauuuguagcuuucugaggugaaaaguaggagaucccagauuuuuuacuguuggaauggaaaguuacagaccagagcagccuagagcaucuugaauggugaauccuuucuggaagguuuucaauauauuuugcccagauccaucaguggaaucacugucagugacagcuauagccuuaugaaaugcacuucuuaaauaauaagacuugaaaguugaaauuacucuuugacccaugggcugcagaacggauguuguguuagcaggcagggaaccaacauuagucgucuuguacaucuccaucagaccuguugggugaccaggugcauuguuagugagcagaaauaguuugaaaggaaucuuuuuucugagcaguaguucucaaaaaugggcuuaaaauauucagucaaccaugcugcaacuguuauacugucauccaugcuuuuuugauccacuuauagaacacaggcagaguagauuuagcauaauucuuaagggcccuaggauuuucagaauggcaaaugagcauuggcuucaacuucaaguuaccagcagcauuaaauaacccuaccaagagaguccuuugaagcuuugaaaucaggcauugacugcucucagguuguuuucaucuacauugcaaaucuguuauuuaguguauccaccuucaucaguuaucuuagcuaggucuuccagagaacuugcugcagcuucuacaucagccccugcuguuucaccuaucugcaguaaggcuauuucacuuucucaucguuuguguguuccauuggaguagcacuguuaauuuccuucaagaacuuuuccuuugcauucacuacuuggcuaacuggcacaagagaccuagcuuuuggcuuauuuuggcuucugacaugccuuccuugguaagcuuaaucauuuuuaguuuuugauuuaaagugagagacaugugacucuuccuuucauuugaacauuuagaggccauuguaggguuacuaauuugccuaauuucaauaucguagugucucagggaauaggaaggugcuaggaaagaaagaaacgggaauggccagucaguggagcaguuggaacacacucaaguuugcugucuuuuaugggcacgguuuauugugguaccugaaaacaauuaacaauaguaacaucagagaucacuguucacagguuugaaauauugcaagaggaaccaaaaugugacagagagacacaaaaugaacacaugcucuuguaaaaauggcaccaauagauuugcucaaugcagaguugccacaaauguucaauauguaaaaauuuuaauaucugcaaaaugcaauaaagcaaagcacaauuuaaugggguauuccuguauuuggaguuaugcaaccaucaccacaaauucagaacauuuucaucaccucugaaagaaauccuaugaccuguagcagucacccccaagcuucccauguuucccacuccugagcaaccuuacuaaucuacuuuuggucucuguauauuugcccauacugcacauuuaauguaaguggaaucauauaauaugugggguuuuuuccuacuuagcauaauguuuucacgguucaucaguguuguagcuuauaucaguacuucguuucuuuuuauggccaaauaauacucuguuaugugaauacacuacauuuuauuuauuccuaucccaguuaauggauauuuuggcuauuaugaacaaugcugcugugaacauccauuuaugaauuuuuguguagcuauauauuuucauuucucuuggacaccuaccugggaguagaauuucugugucaaguguuuuagcaucuuuugccuuuucuucucauugaauuccuucccuucuacuucucuuaaaaugaaacugacacuuccaguccuaauauccuuucuaacugccauaauuuuuuuucuuuuccaucacugucaaccuucuugaagcagagguuagcauuuuuugucucuuaguucacuuuugguuuaacuccucgcauuucuucuaccauacccaaacuaugcucugaaaagucaccagggaggguuucuuuuuguugccgugaauagugggcuagguuagugggaucagcccuucugcuaaaaacaauuuaagggccaggcaacauugaaauaaaaaaauuuaaauacauugaagaguuuaugaacaauaaagaagugcaggccaaaagggaauagaacgcuuaaagcaacuuuugaccugagggcauuuacuaaucuuggaaaauuaagaaccuucuuugggaaggccaugcugggugagagagaugaaaagcagaaguggguccugcccagcaggugggagcccuccgcagguuaagguagggccucaaaugcauauucucuuaaggugagcacagacugggaaauggaacauacuucagacauuuuuuuuucaguauaguuugaaucuccugggacuaaaagagauucccaaauccagagcuugaucuaagguggugcuggucuaguaauagacucagaucugacagaagcagcaagugcaaauccucccuagaggauauuauuuuuauuuuuuauuauuuuuuucuuuguaagacaggguuuugcugucaccagacuggagugcaauagugugaacauggcucacugcaaccuccaccuccugggcucaagccauccucccaccucagucucccaaguaacugggacuacaggugcaugccaccgcaccuagcuaauuuggguauuuuuuuuguagagauaggguuucgccauguugcucaggcuggucucagaacuccuaggcuuaagcgauccacccaccucagccucccaaagugcugggauuacaggcaugagccaccaugccuggccuccagaaucuuuaucaaauaaugaugcuauaugcaaugcucuaaugucauguuauauucacuaauaguuuuauuuguuuugucucuccagcaugcuaguaauuuucuuauguggaacaacuuaugcauuuaaacuuuuuuucagaagagaauguuuuguggugacaacuuguuaaaauuacauuuuuauuuuaaauacacaaauauugaagcauugaaacuagcaugugccucccuuuuagagcagaguaauucauuuguucauaacuaauucuucuggauaauaaccucagguuuagaugacaacuuauaguuuacuaaaugccaguuuuucuuaucuucucuguaucuuagaguaguauaaaauucccacaguaaaccaaaguaugugagcaaauaacuugcccuugguccuuagaauucccaagagggaaucauauaaugaaggaugaaguaggcuuggcuuuuucuccauaaugacugaaaggaaaggaaggaagagggaagauagaagaaaagcaggacagagacaacuguccaccaauuucucccaucuuugugaagguuguauuauuucauguccaggagauaauccuuuuuuaaaguauggagacuuccaaaaguugagguuuagggaguucauuacccacuuucgagacuuacuauaaagcaacaguuaucaagacagcaugguauuggcaaaaagauaaacacauauaccaauggaacagaauagaguccagaaauagaccuauauuugaaauaauccauaauuggcccauauagucaacuuaacuuugacaaagauauaaugguaauucaauggagaaagcauagccuuuucaacaaauagugcugggauaauuggauguccauaugccagaaaauaaaaauaaaagaacauauuuuuguauguucuucacaccuuauacgucacauacuucacaccuuaaauaauaauuaaaauacuucacaaacuuaaauguaaaauaugaaccuaucaaacuucuagcagaaaauaagggaaaauguacccagucuuggguuuggcaaugaaguuuuagauaugacaccaaaagcaugauccaugaaaagagaaauuaauguuagauuuugucaaaauuaaaaacuuuuacuuugugaaaaacuguuaaaaaaugaaaagacaagucauggacugggagaaaauguuugcaaauuacaaucugauagaggacuuguguauaaaauauauaagaauucuuaaaaaucaacaauaagaaagcaaacaguccaauuaaaaauggucaaaagaccuaaagaagauauaaggauggcaaacacaugaaaagaugauauucaacauuauaugucguuagggaaauacagauuaaaacuacaaagggcuaccacuauauaccuauuagaaugacuacaauucgcaagacuaacaauaacaaauguugaccaagagguggaacagcagcgcugacauucuuugcuggugggaaugcaaaauaauauagucacuuuggaagacagauaguuucucagaacacuaaacauagacuuagagugcgacccagugauggcacuccuagguauguuuaccuaagugauuuagguccacccaaaccuguaugcaaauguuuauagcaacuuuauucauaacugccaaaaauguaaagcaaccgagauguccacucaacaggggaauggauaaacuuugauaacauuuagugauaaaaaggaacaaacaauugauucauauaacauggaugaaucuuuaaagcauuuuacuaagugaaagaagccagaccgaaaaggauacaaacugugugacuucauucacaugacauucuggaaaaggcaaaacuauagaaguagaaaauggacuauuaguuguuaggguuuaggagagagggaaguauugacugcaaaggggauguacaggggaacuuuuuaagagugaaggaauuauucuguacaguccuggguuggugguuacaugacuauucauucaucaaacucuauaaccacgugauguaccuuaaccaagugaugagguuuaaugucaccaguuauuaugucaugugggugucauguggccccucaugugaugugauaacaaagguacuucgccugugugauauucuugccaaaaacucguaaccccagucuacucaugagaaaaacaucagacaaacccaaauugggaguuguccuacagguuaucucaucaguucucaugacugcaaaggucaugaaaagcaaggaaagacagauaaauagaccagaggagacuggaaagacauggcaacugaaugcagugugguguccuagauuggauccuggaacagaaagaggacauuaguggaaaaacuggugacauucaaauaaaagguuuuguuuaguuaauaguaaucuuccagugucaguuucuuuguuuugacagauauaccaugauaauaugauaacaaugagggaaaccaggugucugguauauggaaacucucugugguacccuuggaacuuggaacuuuucuguaaaucuaaaguuauuaaaaaauaaaaagguuacuggggaaaauaauaaguuaguuaucauugucaaguauaaccaagaauuuaagacagauugaggaauggaagaguuucuagaguauauacauuagauauuauagaaagaggagauaauuuucauaauuaguuuuuuccaguaggugaaaaagcacaagaauaguuugaauuagcaaauauacagaaaccauuuauuuuauuuauaaaaguuagauuauuggaaugguacucagaaggguuuuuuucagaauaucggaaguguuuacagauuugaaggcaucaugugaaauuuauuagguuguugcaaaaguaauugcagcuuuugcuguuacuuucaauggcaaaaaucacaauuaguuuugguagaaaggaaguuaaaaacagggaaauugcaguaugauaaaaaaauuuacaucuucuuuuaucauauaguuagcccucagguuuuuguuuuuguuuaguaugagauaaaagauuauacugaaaucauguacaaaaucagugaauaauuuuuuuuauuuuauuuuaucauguuaucucaggcacauuacaguuuaacuugacaguaaacuucuuguaaguaaauauauguauuacauguaugcauaacuucauuuuaccugauaaauuaauauaauacauggaguuuuacuuuugaaaguaaaauacauucaaaaaugaaaaugauuuagaaauuugaauauuauaugugcauauacaguuuugccucagcacucaguuguauaaucaguggucaaaugaaauggaaaugaugcuaauuacuguaguuguuaaaaugaaguguauaaaguauguaaaugggacaauuuuuuuuuucuuuuuucuuuuuuuccccccacauggguaaaagaggaauaaauggagcaaauguuuugagcaccacagaagcauuuuauauuuuuuuaacauccucauuuuucaacugaguauguauuucuugcuguauaugaauuuuuaggauacaauuuuaguaacuagucacauaaguuauauauuauuuuacuuaaagggaacauuccuauaguuugcuacuagagaaguuucucugaacauguagagugcugaaaagauguaacaguucucaauauguaugcacccaacaccagagcacccacauauauaaagcaaauauuauuagauugaaagcaaauguuauuagauuugauucuuagcaucuguccaaugcugagagugggguguugaaguccccaacuagccaauacaauacagugauagcuggggacuucaacaccccacucucagcauuaggcagauaaucuagacagaaaaucaaaaaagaaacauuggauuuaaacuuuacuuuagagccgggcaccguaagccugacacuuugagaagcugaggcaggaggauugcuugagcccaggaauuugagacuagcucagguaacauagugagaucucaucuuuacaaaaaagauaaaaaucagccaggugugguggcauacaccuguggucucagcuacucaggaggcugagguaggaggauugcuuaugccugggaaauugaggcugcagugaacuguggucacaccacugcacugcagccuggugacagaacaagacacugucucaauaaauaaauaaacugcacuuuagaccaaauggaccuaacagacauuuacagaacauuuuauccaguaguugcagaauacacauucuccucaucugcauguggaacauucuccaggaaagaucauacguuaggccacaaaacaagucuuaacaaauuuuagaaaauugaaaucauauuaagugucuuuucugaccacuauggaauaaaacuagaaaucaauaaaaagagaaacuuuggaaacuguaccaauacauggaaauuaaacaaaaugcuccugaaccuuuauuggaucaaugaagaaauuaagaaggaaauuuaaaaauuucuugaaaccaaugaaaauggaaacacaacauaccaaaaccuaugagauacagcaaaaacaguacuaagagguaaguuuauagcaauaggugccuauaucaaaaaaaagauuucaaauaaacaauguaaugauguacuuuaagaaacuagaaaagcaagaacaaagccaaaauuagaagaagaaaagaaauaauaaagaucagaguagaacuaaacaaaauagagacuaaaaaaaaaaauacaaaagaucagagaaaugaaaaacuggugcuuugaaaagaucaauaaaucgcuagcuagacuaaccaagaaaaaagaagacauacauaaaauuagacaugaaaaaggagacauuacaauuuauauaacaaauagagaggaucaucagagacuaucaugaacaacuauaugugaacaaguugggaaaccuagagggaauguguacauuuuuggacgcauuacagcauaccaagauugaaccaggaagaaauaggaaaccuggccaggcacaguggcucacaccugcaauccuagcauuuuggaaggucaagaugggaggaaggcuugagcucaggaggucaagaccagccugggcaacagugagaccuugucucuauuuuaaauuuuuagaaaagaaaaccugagcagacgaaucacaaguaacaagauugaaucuguaauuuaaaggucucccaauaaagaaaagcccaggucuggauggcuuuacugcugaauccugccauacuuagaaagaaaaacuaacaccaauucuucucaaacuagucuagaaauuugaagagggggaaauucuuccuaacucauucuaugaagccagcauuauccugauaccaaaaucagacaggacacaacaaaaaaagaaaacuacaggucagcaucacugaugaacauagacacaaaaauccucaacaaaauacuaacaaaucgaauccaacaaaacauaaaaaaaaaaaaauacaccaugaucaagugaaauuuauccuagggccaggcacaguggcucaugccuguaaucccagaacuuuggaaggcugaaguggguagaucacuugagcccaggaguuugagaccauccugggcaacauggugaaacccugucucuacaaaaaauaaaaaaauuagcuggguaugguggcaugcaccuguagucccaccuacuugggagacuuagguaggaggauggcuugagcccaggaggcggagguuacaguaagccaagaucaugccacuguacucaagccugggugacagagugagacccugucucaaaaaaaaacuuauuucaggggugcaaggauuguucauuauauacaaaucaauaaaugugauacaucacaucaacagaaugaaggacaaaaaccauaugaucaucucagcuaacacagaaaaguuauuugauaaaauucaaugucccuucaugguaaaaacucuugauaaguuaaucauagaaggaucauaccucaaauaaugaacaucaugucugaaaaacccacauuuaacaucuuacugaauggggaaaagcugaaaaccugcccucuaagaacuagaagaagacaggaugcccauuuuuaccacuccuguucaacauaguacugaaaauucuagccauagcaaucagguaauaaaagacaccaaauugggaaaaaggaggucaaauugucccuuuuucacaggugacaugauauauauggcaaaaccugaagacuccaacaaaaaacucuuagaacugauaaauuuaguaaaguugcagauuuuuuuuuaaaacccacaaaaaacuaauagcauuucugugcaccaauaacaacuagcugaaaaagaaaacaagaacacaaucccauuuauuaaggcuaccaaaaagaauaguaauaaauuuaaccaaggaaguaaagguuguauaggaggaaaacuagaaauuacugauaaaauuaacugaaguagacaguggaaauagacaaaugggagacaucccauguucauggaucagaaacauuaauauuguuaaaauggccauauuuuccaauaaaaucuaaagauucauugcaguucauaucaaaauaccaaugacauucuucauggaaauagaaaaaaaaauucuaaacuucauguggaacuacaaaagagccuaaauagccaaagcaauccugagcaaaaagaacaguuggagacaucauauuaccugaggucaaaacgauacuacaaagcuuuaguaaccaaaucagcaugauguugguauaaaaauggacacacaggcugagcaaaauaauacuacaaagcuuuaguaaccaaaucagcaugguguugguauaaaaacagacacauaggcugagcaugguggcuuacucuucuaaucucaacaguuugggaggcugaggugggaggaucacuugagccaagaaauuugaguccagccugugcaagauagucaaagcccaucucuacaaauuagccagucacgauggugcaugccuguugccccagcagcuugggaggcugagaugggaggaucauuugagccuggaagcucaaggcugcagugagccauaaucauacacugcacuccagccuggaugacagugagacccugucucaaaaaaaaaaaaaaaaauuguaggacagauacucugggacauuggucugggaaaaaauuuuauggcuaagacuucaaaagcacaggcaaccaaagcauauagacaaaagggacuguguaaaagcuucugcacagcaaaggaaacaaucaacagaguaaagagacagccuacagaaugagagaaaauauuugcaaacuauucaugaaaugagacuaaucuccagaauauguaaggaacucaacaggaaaaaaaauaguuucguaucugaauagacaccucucaaaaaagaagacauacaaauggccggcagguauauuuuuuaaauguucaacaucacuaaucaucagggagaugcaaaucaaaaccacaguaagcaaucaucuuaccccaguuagaauggcuguuacggaaaagacaccaacaaaugcuggugaggaugcaaggaaaaggaaacucuuauacacuguuggugggaauguaaauuaguacagccauuaugcaaaacaguauggagguuucucaaaaaccaaaaacuagaacuaccauaugauacagcaaucccacugcuggguauuuauccaaaggaaaggaaaucaauucaauauaucaaagauagauaaccuacacccccauguuuauugcagcacuguuuauaauagccaagaugcggaaucaaccuuaagugcacaucaguggaugaauggauaaagaaaaugugguauauauacacaauggaauuauauucuaccauauuuuuuaugaaaaugaaauucugucauuugcagccacauggauagaauugagaucauuauguuaaaugaaauaagccaggccuagaaagacaaauaucacauguucuuacugaugugggaacuaaaaaaaguucgucuuuagccaggagucgugaugcaccccuguagucucagcuacaugggaggcugaggcaggaggauugcuugaguccaggagauugauuccagucugggcaacauagcaagaugucaugucaaaaaaauaaauaaaaagaagaaagguaguuacuagaggcugggaaggguguaugggaaggguuccaggaagauacgaagacaggcugguuaauggauauagacauacaauuagacgaaauaaguucuaguguuugauagcauacaggagugacuguaguuaacaacaauacauuauauauuucaaaauaacuagaagagaagauuugaaauguucucgacacaaauggugaauaauguuugggcugauggcauccuaaguaccuugauuuugucauuacagauuguaugcauguaugaaaauaccacauguggcucuaugaguauguacaaauauuauguaucaauaaaaagggaucuguaauuuaugaguaauaaaauuuuuuaaagaacauuuaccagccgggcaugguggcucacaccuguaaucccagcacuuugggaggccgaggcaggcggaucacaaggucagaucgagaccauccuggcuaacacggugaaacccagucucuacuaaaaauacaaaaaaaauuugcugcgcuuggaggcuacucgggagacuguggcaggagaauggcgugaaccugggagguggagcuugcagugagccgagauugcgccacuguacuccagccugggcaacaaagcgagacuccaucucaaaaaaaaaaaaauuuaccuucuaaaaaguaauuauaugaaaauugaaaguagaauuuauuccuuuuaccuuucuauuccuagguaauacauugcaugcaacuggauccugcaagaaucauuuaucaggaaauucucuugcugauacuuuauuucggugggaacaagaugaaauaccaagguuaguuaauguuguaaaggaaaugaaaauuuuacauauauccuaguugugaucagaaaucagugguuaccauaauuaaauuuuaaccuuuuauuguauuggaucuuuuuaaucuauacacuuaacagaaacaaaccuugacauuaguguauuacaaggaauaaacgauuuuaaaaacaaaccaugaaaauguacuaguuauuaccuaauuaacaaaaggaauacaagguagauauuguuauacuuuucugcaacauucaucuucaucaucuauucuaauuugauauccuauaacuugucaaguaaaacaauuacauuuaugauaaaauaguaauuuaaaacaaaaaucuaaauauuuuuaauaaccccuaaaauuuauaaauauuaaauaaguaauaaaguauuuugacaugcucugguuuugaauaauauaauuuguaauuuauuuguuucauuauugauuagauuuuuuuuggaggcaguauauuccaaaugcuuggauuucucuauuucaaagcagcuauguauuugcuuaugcaaauuuuuuacucauacauuuucugucuacuggugcuaauuuuuaauucugaaaacuacuuccccuccauaggaacaccuccuguucugaaugucugaaguaguuuuguauaagggcaaguuguaaauuucuacugugagauuauauuuuuugagguuauuguuucccuccuuucucucaaaugugcuacuucgggaauauucauccuugacauuuacaacauaauuauuucaaauuauaaaacuuuuuuauaugagaaaacuguggaucauaaacauuuuuaaauuugauacuucaauguguguuaaauuguaugaaugaagaggacaauucacauuuuguuguuguugagacaaggucucacgcuguugcccagaccggaggucaguggcacaaucucagcuuacuacgaccgccgccuucugggcucaagugauccucccaccuuagccucccaagaaucuaggacuauaggugugcaacaccaugccuggcuaguuuuuaaaaauuuuuguagaggugaggucuuacuauaaugcucagccucccaaguaucugggacuacaggugugcagcaccaugccuggcuaauuuaaaaaaauuuuuuguagagaugaggucucacuauauugcucaggcuggccucccaagccgaagcugggaucacauucaugagccaccaagcgcagcugacaaucuauauugagaaauauuuuuucugaaagagaaaggaauauauuaugauagguuggcuaauuauauuccuucucuaucaauggugaaaagauacguguguuugaacaucuaaauauauacuugugaguacauauauacguauauuauuugaguugugaaaauucugugguuuaacaacuaacauguaauauuccaucaaaauuuccuuuaaaauagacaauggaaaaugaguuuuugcuaacauguuuuucuuaaaacauuaaaaaguguuucaaggccagggcgcaauggcucacaccuguaauuccagcacuuugggaggccgagguaggcagaucacuugaggucaggaguucaagaccagccuggccaacauggugaaaccccuucuguacuaaaaauacaaaaauuaacucugcaugaugucacaugcuuguaaucccaguuacuugggaagcugaggcaggagaaucgcuugaaccugggagguggagguugaggugagcugaguucgcaccagugcacuccagccugggcgauggagcgagacuccaucugaaaaaaaaaaaaaaaaauaccaaaguguuucaaaucaaaaguuaaugaaauaugucaucaaccacuuuguaguaaaauuaaggaucuccccuuuuccacuugguguccauuuuuguacaaggccuaaauuuuggaaugaguaaacuaggauccacacuagauguuaucucuucauucuguuaaguagggucaauuauguggugucuucuuuaucuucucuuuuggggcacugaugaaaagcaaaugcuuuugagucaaagauccagacugggaaacaauccuuuguaguucucauaaaaauuaaugaccuggugauaucauuacuuuuccuagcuaugaucccacuguugaucauucauacauuuuaucaguucuguaguuaugaagaauuuuaaaguauucccuaucucagcaguaguugagggcaggaagaauggugaauaucguuugcccauuucucagugugcucaccuucccuuuuauugcauguucucccuuguuuuuugaauacugaaaaagaugucucuaggcaacugauuucauauguguaugguuuuuuaugcauuccucugagguuuuuauauuauccuaucccauucugccccggguauaaccauaugcuaaaacguuuuauauuccuuuuauauaaaauauaaugaaccaaaauacguagaauuuacuucaaaaggaucuaggguagucaguauaauauguuuuguauuuuucucauccuauuuuucauuauauauacauauaaaguaucaauuuugucagaauaauugugaauuaauauaucagguuuucuggguacaagcuaaauguaagauaauuguauaaguaagaaaaauguuagaaaguuugcucucacauaauuauuauguuuuuuauauccuuuaauugcagcucuuuaauauuggaagguguugaaccacagaguacaugugaauuagaaguggaugcuguagcugcugauaucuuaaaucgucuggacauugaagguucauacacaauuauucuuaauauauguuuuuauuuuuuaaaauuaaugaccggcgggugugguggcucacgccuguaaucccagcacuuugggaggccaagguggguggaucaugaggucagaucgagaccauccuggccaacauggugaaaccccgucucuacuaaaauacaaaauaaauuagcugagugugguggcacacgucuguagucccagcuacuugggaggcugaggcaggggaaucacuugagccuggguggcggagguugcagugggccaagaucgcaccacugcacuccagccuggugauagagcaagacucuaucucaaaaaaaaaaaaaaaaaaaaaaaaaaaauuaaugaccaaaauggaauagaaaaaguaggaaagaaaacuuuacgaggaaacuaagauauuauagaaggaggauacaaaauguuaugaagauugcuucuauacuucugaugagguauuaauuuuuuguuuauauuuuuguccaaaugacuauauuugaauagaugauacuaaaauaagugugacacuaaauaaaauuagcuaauauaaagcaauuuaauguacugugccuuuuaauuucuuaauuuucauauuauauaucagcaaagggacucuuaggucuauugacuaucaucagauguuugaauuguauucacuugcuggauuuuggggaaccacuaggaagaaaacuaaaaaaggaguaacauaguaaguguagguugggauaauuuguccacuuuauuacacaaaauaugugauugguuuuuuuaaaggcaguauuuguuaaagaaaaguuuagauuuuuuaggcauuucuuacuuugacccuguaguauugaaguauuauugugauuacagcucaaauugguggaaacccuggucuacaggccauaugggaagaugaaaagcaacggcgaagaaacagaaaugaaacuucucaaaugagccaaccugagucacaagguauaaaccuaauagugcucugauuauucuuuuaaaucaaguauuuuaauggaaaaguuugucauugaguuguuccuuugacauuagauuuuacuuuucaaaugaccuuuauauuuuguauguauuuuucuuguugucauugcuguacagccacuauuuaucuuuacagcugucuccaauugucgcuuauuaucucuuuguaagaaguugacguuuuuacuguucuuuguuuuuaauguaccuuguccucuugccucacuuuuuuguuuucauucucuaguauguucuagcccucuguauuuccaaaugagcuauagaaaacucacagaagaucaugaaucucaacuuagaaacacuguuuaauacauuaagcuuugaaaauguagccauugaaaugcugcccacaguuuauuuucugaguaugucauauaagcucucacuuuguucaauauguacagcucuaaagaaacauuuauugcuaaauggugccacauucaaaaagaauucgaggggguuuagauaauaccauggauacaacaguuuuaaaaauaaagguaaaagagugaacgacaucauucaaaaggcagauauauuauuucaaaauacagcaguaagccuauauugaaguucaauuaaaauuauuauaucuuaggcacuaaaaauguuuugauaaacuuugagugccuuuuauacuuuuaaaaauagaaauauauuuuaugaggggaaauuuuuagcuuuaggauacaauauauuuauagguagagaacaauuuuucuguuuuagauuuagauuauaauuauagaacuuaaucuugaacugacuuaagugccuaauuuuauaacuuuaguaacaaccguuucucuuuugugugauucuaugguaaaacuacaguuagguuguauuauguauaucuagagaaagauaggaaauugccaccauuuuuaaagcuacuuuaggagaagggaaaauauuucauucauuugcuauuuacauuuuuuaaugcacuuuuaaaauucaaagaucacagguuugugccagcaacagaaagugaaaaaaaauuucagaagagacuucaggaaauucucaaacagaaugauuucucuguguaagugguuauuuauuauagaucucagaacuaauuuuauuccuuuguuauguagucuguuauaaaggauauguuuuaauuaagcagaacauuaucaggaucuguggacuacagcgauggaucccaggaguucucugcugaguuaacauugcacucugagguucugucuccugaaaugcuucaguguacaccagccaauaugguagaaguucacaaagacaaagagucaagcaaagguaagauuuucuuuucauguauacagaaacuacuagaacagauaucuagcacugagauguuaauauuugauugaguuugcuagggauuuuuuucccuaugaaauaaauauuguggauauagcaaaaauuucucccauucugucacccuuucuacaucucuaaagguaagcaguauccugaaguuagugcaaacuguuaccauauauaauuuuauauuuucuuauaauguuugcccaccauauauaccauuguuuuaaguuuuaaauuuuacguaaaugauguucugcuuggcguagaugaagcaacuugcuuuuuucacucagcauuauauuuuuaagcagcuugaaguuuaauuuauauaacauaaaauucagucauuuuaagcguauaauucaaugauuuacaaaguugugcaaacgucuccacaauccaguuuuagaauguuuccaucaguccacaggaucccuuguguccauuuacaguuaugccuauuuccaccucaaaccccaaguaaccacuaauaauacaugggccuugucuagauacuguauauuauguaagugaaaccauacaauauauagucuuuugugucuggcuucuuuuacuuagcauaauacuuucaaguuuuauacauguuguaguaucuaucaguauguauggagauaccacauuuuguuaauccauuuaucaguugaucagcauuugaguuguuuucacuuuugccugguaagaauagugcugcuggccaggagcaguggcuccugccuguaaucucagcaauuugagaggcugaagcaggcggaucaccugaggucaggaguuggcaaccagccuggccaacauggugaaacucugucucuacuaaaaauacaaaaauuagccgggcgugguggcgcacaccuguaaucccagcuacucaggaggcugaggcaggagaauggcuugaacccaggagguggagguugcaguaagccaagaugaugccacugcauuccagccugggcaacagagcaaaacuccaucucaaaaaaaaaaaaaaaaaaaaaauagugcuguuauaagcaguaaagcauaaauuuuaggauaaauaucauaaaguuguaaaaugauaucaauaguaacaaaugaaacaguuuaagaauaaacgucacuaaaaagauuaccucugccaagcaaaagaauuacuagggcaugugguauauuuguguuuaauuuuuaaauaaacucccaagcuguuuuuaaagugacagcaauguuuuacuuucccaccagcaauauaugagaguuucucuggcucuauauccucacuaacacuuguuauuaucugucuuuuuuuaauguagccauccuagugugugaaauagaauccuacugugguuuuaauuuucguuacccucauuacuacugaugucgagcaucuuuaugucaacauuauaacuuugaaauuuauccuuguucauucauuuuagcugcugaugacuguuccauuuuaagacuaaacaacaauguuagcuauuucucuacaaguauuagauggucuuuacuuuugcacuuagugcuacaucugucuccuuauggcuaugugcaggagcuucucuaccaaacacauguagaagagugaguugcugaauguuaggguguaugcauuguacucuaccuagauagcaucuguucuaacaguuuuucuauaaugcaauuagcuuauacaugguuaguaaacaagacaauaauaaaaguuuuacucagaagucacauuguaucauacgcaauuuuacuaggcaagcaaagccucaacauuugauagcaucaaauaauaaggauaaaauaauagauguaaaaaauuugcugcucugauucuuugaaauagugucucugcauuuuaaucugcauuuccuaauuacuaaugaauuugagcaucuuuaaaggccauuuggguuucucuguuugugaauuacauuuugugcuuauuuucuauugagucauuugucuuuuucuuauuuguaggaguucuucauauuuucuagauauuaagucuuuaucaguuauacuuauuguagagauguuuucucuccaucuaggcuuaucuuauaaaaaucuucaaaaaaaaauguuaacuucuuuuccccccauuuaaaaaaaaaaguuauccuugggguuuuacaugucuucaguuuuaaugucaaguuuaccaauauuccuuuaugguuuaguuuugguaugugauuuaugagaccuucccuacccugauguaaugaaaauuuucucuuaaguauucauuuuaaggcuuacgugugcuuacaguuugguuuuucacauuuaggucuuuaaugcauuugaaauuuuacauuuuacuuuuaaauuuuuuuuaauuuuuguggguacauaguagacauauauauuuaugggguacaugagagauuuuuauacaggcauacaauguaauaaccacaucaggauaaaugggguauccauaaccucaagcauauauuucuuuguguuacaaacauuccaauuauacuuuuaguuauuuuuuaauauacaauagauuauuguugacuguagucacuguguugugcuaucaaauacuagaucuuauuccuucuauuuuuuuguacucauuaaccauccccacuuccccaccccacccuacuacccuuccuagcuucuggcagccaucauucuacucucuuaucuccaugaguuccauuguuuaaauuauuaauuagcccccacaagugagugagaacaugcaaaguuugucuuucugugccuggcguauuucacauaacaugauguccuccacuucuauccauguuguuggaaauggcaugaucucauucucuuuauggcugaguaguacuccauuauguaaauguaccacauuuucuuuauccauucaucuguugauggacacuuagauugcuuccaaaucuuggcuguugugaauaggacugugauaaacaugggagugcagauaucucuucaacucgacauaccaauuucauuuccuuuggauaaauaccgaguagagagauugcuggauuauaugguaguucuaucuuuaguuuauuaaggaaccuucauacuguucuccauaguggcuguacuaauuuacauuucuaccaacaguguacgagaguucccuuuccuccacaucauugccagcauucauuauugccugucuuuuggauaaaagccauuuuuacuagggugagaugauuucucauuguaauuuugauuuucauuuaucugaugaucagugauguugagcaucuuuucaccugucugccauuuguauaucuucuuuugagaaaugucuguucagaucuuuugccgauuuuuuaauuggauuauuagauuuuuuacuauugaguuauauauauuuugguuauuaaucccuugucagauggauaguuugcagauauuuccucccauucuguggguugucucuucacuuuguugauuguuuccuuugcugugcagaagcuuuguauaauaacuugauaugaucccauuugucugcuuuugcuuugauugccugugcuuuggggauauuucccaaaaaaucuuugcucagaccaauauucuagagaguuuccccaauguuuucuuuuaguauuuucauaguuugagucuuagauuuaagucuuuaauucauuuugauuuaauuucugaauaugguggagagaucagggucuaguuucauucuucugcauguagauauccaaugucucagcaccauuuaucgaagaaauuguucuuucccccaagguauguucuuggcaccuucaucaaaaacgaguucacugcagucaugaauuuauuucaggguucucuauuccauuggucugugugccuguuuuuaugccaguaucaugccguuuugauuacuauagcucuguaguauaauuugaagucagguaaugugaccuccaguuuuguucuuuuugcucagaguagcuuugguuauucgggaucuuuugugguuccuuauaaauuuuaggauuuuuuuuuucuguuucugugaagaauaucauugguauuuugauagggauugcauugaaucuguagauugcucuggguaggcauggacauuuuaucaguauugauucuuccaauccaugaacguggaauaucuuuuccauuuuuugguguacucuucaauuucuugcaucaguguuuuauaguuuucauuguagggauguuucacuuacuugguuaaguuuauuccuaaguaucuuauuuguagcuauuguaaaugggauuacuuucuugguuucuuauucagauuguucacuguuggcauauagaaaugcuacugauuuucauauguugauuuuguauccugcaacuucgcugaauuuguuuuuugguggagucuauagguuuuuccuaauauaagaucauaccaucggcagauaaggauaauucgacuucuuccuuuccaauuuggaugcacuuuauuuauuccuuucuuuugucugauuacucuaacuaggacuucuaguacuguguugaauaacaguggugaaacuaggcauccuugucuuguuccagaucuuagagaacgggcuuucaauuuuucccagugcugugaaugcacugggucacaccugaagucagcaugucccugggucucacccgaggccugcagcaaguacugccugagugucacuuguguuuacucaaggccaaagggcucuuuagugagcaagugaugaacccugccaggucugaguccuucucuucaaggcagcagguucccuucuggcccaggguguguuuagagaugucauccaggaguuagggccuggaauaugugugucacgacucuaccuccucuacuguggcugagcugguauccaaguugcaagauaaaguucucuucacuccuuccucuccuguccucuuguggaaugaaagagucuucuggagcugcgaguugugcugccugggacugugaagguugggggagggggggugacacaaauaauucuuuagcugccccagcuacucucucaccaggcgcguguaccccaagucuacuggcucugagcccagcacagcacugggacuugcccaagaauugcaguccuuguggauaagacuggcuuucaaguuuauuuaggaucccaaagcacuuuagcccauaguaguaaggcuggcugcaacucagguucuggacugcugggaugggcaguuucccucuggcuggggcuggucaaauccucuccucaugggugcuggcuaaauucuauaccgugucgcucuccacugugacagggacguugcuuuccacugugacaggguagcacugaguuccaaugcaaagcaaagucccauauucacucuguucugucucuccuaagcacagauuucucucuccgugccucaagaccacugccugagagaugggaggugcugucagcaauucacgacugucuuuucuacccucuucgcugccucuuuccuugauacguuguuaaaaccaaguacugugauugcucuccugauuuuuuauucuaaugaaggcgcuuucuuguguggguaguucaguuugguguuccuucaggggacggcaauuguuggaggauuccauauggccacauggacuaauauuuuuugauaucaugaaaauguaaugaaugugauauauaaugaaagcuuucugaaaaauauuaauguaaaaugaauuuuuuaauugcuuaaccauuucuuuguauuuuuauagcacuuaaaaacuauuucugcccaguuauggcaaugaaaugggaaaccacaacuacaguucacaaacaggcaugaaaaaccaacacacgccccauuagggauuacacuaagcucuuuauuuuuuaugcauucaaaagagaguccaauacacaugugucaaauaaugagcacugucaauuuuuuuuuucuaggagaguucaaaaacauuuauucuaaauuuguuguuuuugaaccauagagaauaaagaauuuuaguauucaaauaagauaguuuaucuuuccuuuucacuuuauauauuugaauaugcagugauuuuuaucagaguaauauaacuacacacauuaaguaggauuaaagagguuauaaauauuuggugauuuauagauucaguguuuguuuugauaaauccaugugacugguuaaauauuucuguggcuuuuuauuauguuuuuauuuggcaugcaucauuaacauuuugaaauuuaaaauagguuuauaugguaaugcuuccaaauuuacacaaauucuaaaugauaaauuuuggauuuaggccauugcuucaauuuuuuuuauucuuugucaaauuaaggucacacuagacacaaaguggaagaagcucuuauuaaugaagaagcaauuuugaaccuuauggaaaauagucagacuuuucagccuuugacccaaagacugagugagucaccuguuuucaguaaguaacagugcuaccauaaauauucaguauuguaauucagagaaaauguguguugugaagaggcauuuuuuuuuuuauugacuugaagagguaaauguugcauguucaguaaacacucuacugaauaugaaaaugaaaccuugcauuaaaucaaguagcuuugcuuuuuuucuauacagcuuaaaaaaauuugugaaagaaaauaguuuuuuuaacuguacuuugauucacggaaaaccguauuacuuaagaaggaaaaugcauuuauuuugaauuaauauuuugcaaaguucaguacauuacuaaaacaccauaagugguucuuucuuggugaguaucacaaauuucaccggaggaaacacggguggcuagggccauggucccagccuccucaucucacuggccagggcugcacucaaccaguccuucaguggccuccccuugaguggcaucucaggcuuccugcagccacugccagccuucccuggcaaggccucccaacuaggggcugacagugcugagcuguacccacggccaagacccugugcagucccaggcagcccuggcuggagcacacaacaauguuauuuuaauaaugucccuaaauuacucuaaugcaggugguccaaggaucaacuuugauaggagagcuaccucaacaccugagccuuuguaccaacuguauucuuucagccugugccaguaucuaugauguuguuauuuuauucugagugaucugaauuguuggauuauuaagaaaacaggccgggcgugguggcucacgccuguaaucccagcacuuugggaggccgaggcaggcagaucacgaggucaggagaucgagaccauccuggcuaacacggugaaaccccaucucugcuaaaaauacaaaaaauuaaccagguguggugacgggcaccuguagucccagcuacucgggaggcugaggcaggagaauggcaugaacccaggaggcagagcuugcagugagccuagaucacgccacugcacuccaacuccagccugggugagagagcaagacuccgugucaaaaaaaaaaaagaaaacuuauuuguuggugauuauuguacuuguuuuauaguggacaguaguccugaugaggcucugguacaucuucuugcugguuuggaaagugauggauaucggggggaaagaaauaggaugccaucaccaugucgcuccuuuggaaauaauaaauauccacaaaauagugaugaugaagaaaaugaaccacagauugaaaaagaggaaauggagcuuaguuuggugaugucccagagaugggacagcaauauugaagaacauugugccaaaaagagguaauuuuuuaguuauugcaguuguuuuauuaacuuuuaucauuauuguccuucaaucagaaauuauuuauuacuauuguucaugauauaaaauaccuuaugaacuaaauugauguuuuaaaauuccccuuuagugaucuguuuuucauauggcguauacuccauauuccaagcaaaauaaaguuuugcuacauuuuaaaagauuaaccuaacuuuuagaaguuauccauuuauauacacaguauuaacauaugugagugauaaauggagcaaaauugaagugccuucuuaucuuagaacuuaagaaaaagaaugcccugugauaguugaacuguuggguaucagaacaacaauguauagagucagccugaagacaggguaugguuuugggcucugauuagacuaagggaacuaagguuaaaaacaaauaaauaaaagacuaagaagcaaacacugguguugugguuuguuucucaaaauaaaugaauaaguugguguugugguuuucuaaaucagucucugugaacuugauugguuugagucugcccuuuaguuauaugcucuguguauagaaaaaucuaggccuaugagccugaaagacugaguaugccucuccuuuaaacuucuauaggcuagauuagaacuuuuuuagucuguauuugaaauuuccaacccaaagccaucacugaaaggugaaacagguuaauccauaaauucaguguuuacauguauaugaugaaaguuuuuauuuuucuacuuaauaaaucagauauagaaaucuccagaugugauguuaaauucuuuccucuaacauugucacugcuguaauaauaggcauagucaauccuaugauuaaauuuauguuuguauguucaguggcugaaccaauuuggugaaaaccaugcccaauuuaaccuugggaaaacaaaccuaaacauuuuguacacauauauuagagagagauugaauaguagaagcauggugucuagaaaaggguuuaguuaauucugcucuuuauauuggauauuauauucugugcugaguaccauauuuuaagaauacugaaaaaggaaagggaaagaagaggaagaaaacuagaaggaucugugagcauugucacuuuugaagaacuuuugaauggagaauguuugaucuaauuagaauuacaagaugaaugagaaaugccuuuauguauuuuaaagauuaucauguggaaaaugacaucaaccugcucuguauagcuacagagaacaaaauaggaaucauguauggaaguugaaagaguuuguguauuacaagaagacaacuaugaauaauuaaagccauuaacaguggaaagauugcccugugagacagcaagccccuuauacagauuauguaaaaacagagauugugucagguucguuaaaaaugagguuuucgcauuggguagaaaguuggacuggaccucugauaccucuuucagcucuuaagggagugauuuuuaugauaaauugugauuuggaaaggcuuaauggaaaaacaguuccaguauaauaaguauaauaaaauaauaauaauuucaaauuguugagauuagugaaagaaaaaauuggguauggauaggaaaaaaguuugcccauucaauuaaaagggaaaacaucaaguuaauaccaauaugagaugaaacuuaaagacuggacuucacuguccaucugaauuucucaguaacccuuuguaguuauugucagguugacugaacaccuuuacuacuuccuauuacccucucucuucuucagcauuuucucuucagcccugaccucaaugccccuucacucaucuuuuuauucuuguuucuuccaauucagaaugcaggaauugugguguauuuuagcucacaugaaagggauuaugaagucuaauuauaauaacucuuuguaaguuacuauaguaagacauguuaauaaagcaaaguaaauaugcuuuucuagaaguuacaauuuucagauuuuuuguauuguuuuacuauagaguaacuuagauacauuauuauaguuaacuuagauacauuauuauagaguuaacuuagaugcauuauuugcaucugagauggucuuuacuaaugaucaugcucaccagugaauuuuaauguucuccagaucacugugcagaaauacccacagaaguucaacugaagaugaugacucaucuucaggagaagaaauggaauggagugauaacaguuugcuucuagccagucuuucuauaccucaguuagauggaacugcagaugaaaauagugguaaguaaacaagucuacugugagaaauugguuauucacgaucuaaaaauguauuugauuuugaggcuaggcgcucuggcucacaccuguaaucccagcauucugggaguccaaggugagaggaucacuugaauucaggaguucgagaccagccuaggcaacguagugggacccccgucucuaaaaaacuaaaaaaauuagcccagcauagugauacaugccuguagucccagcuacucaggaggcugaggugggaggcuuacuugagcccaaggguuugaggcugcagugagcugugauugcuccauggcauuccagccuaggcaacagaacaagauucugccuccaaaaaaaauaauaaauaaauaaauaugauuuugaaacuuuaaucauacuuucuauugauuuugaaacuguaaucauacuuucuauauaguuggcuaagggaggcuauagugauguuucguccuucaggauuuuuuucuuuugaaagaauuagauacaugauuugcuucucauuucuaaaaggauauaacauuuguugaccacugaauucaagcuuugaaaacuuuaauguuuguugugcaaguagaauaauaaacugaaaaauaugcucaguuuauuugaagugauaauguaaagcauauuauuuuaugaacauuuuuaaagugacaguauuuuucccuuaugccccaaaggaacuaaauaguaauauaaucuauuucugaucaauggaauauuuguuuaaaaugaugacuaauaauuguaacuaacuauauuuagauugagucauuaaugauaagcauuaccuuuuuguuaagauaaccaaacuuaauuugauguaauuuuuucauagugauagcauuaauaucuuggugugggaaaaugucuuaaaaauuaaaagaguaaaaugaaauaaacuguuuuucccuccucauuucagacaauccauugaacaaugaaaauucuagaacccacucuucuguaauugcaacaagcaagcuuucaguuaaacccuccaucuuucacaaagaugcugcuacauuagaacccucaucuucugcuaagauuaccuuucaguguaaacacacaagugcccuuucuucccauguuuugaacaaggaagauuuaauugaagaccuuucacagacaaacaaaaauacagaaaaaggucuagauaacucagucacuucuuuuacaaacgaaagcacuuauucuaugaaauacccuggaucuuuaagcaguacuguucauucagaaaauucucauaaagagaauaguaagaaagagauccucccaguaucuuccugugaaaguaguauuuuugauuaugaagaagauauuccaucuguuacaagacaaguaccaaguagaaaauauacaaacauuagaaaaaucgaaaaggauuccccuuuuauacauaugcaccgucacccuaacgagaauacauugggcaaaaauucuuucaacuuuucugacuuaaaucauucaaaaaauaaaguauccucugaaggaaaugaaaaaggaaacagcacagcucugaguaguuuauucccuucaucauuuacugaaaauugugaauuacugucaugcucaggggagaauagaacuauggugcauucucuuaauagcacugcugaugaaaguggacuaaauaaacuuaaaauuagguaugaagaauuucaagaacauaaaacagaaaagccaagccucagccagcaagcagcacacuauauguuuuuucccaguguuguucuuucuaacugucuuacuagaccacagaaacuaucuccugucacauauaaauuacaaccuggcaauaaaccaucccgguuaaaauugaauaaaaggaaacuugcaggucaucaggagacuucuaccaaaaguagugagacuggauccacaaaagauaauuuuauacaaaauaauccuuguaauaguaauccugagaaggauaaugcauuggcuagugauuuaacuaaaaccacucguggagcuuuugaaaauaaaacacccacagaugguuuuauagacugucacuuuggagauggaacguuagaaacugagcaguccuuuggacuauauggaaauaaauacacacuuagagccaaacgcaagguaaauuaugagacugaagacagugagucaaguuuuguaacucacaacucaaaaauuagucuaccucaucccauggaaauuggugaaaguuuagauggaacucucaaaucccgaaaacgaagaaaaaugucuaaaaagcugcccccugucaucauaaaguauauuauuauuaauagauuuagagggagaaaaaauaugcuugugaagcuaggaaaaauagacucuaaagaaaaacaaguaauauuaacagaagaaaaaauggaacuauauaaaaagcuugcaccuuugaaggacuuuuggccaaaaguucccgacuccccugcaaccaaauaucccauuuauccacuaacaccaaagaaaagucacagaagaaagucaaaacauaaaucugcuaagaaaaaaacugguaaacaacaaaggacaaauaaugaaaauauuaaaagaacuuugucuuucaggaaaaaacggucacaugcuauucuuucuccucccucaccaucuuacaaugcugaaaccgaagauugugaccugaauuauagugauguuaugucuaaacuagguuuucuuucugagagaagcacaagucccauaaauucuucuccaccucgcugcuggucucccacagauccaagagcugaagaaaucauggcugcugcagaaaaagaggcaaugcuuuuuaaggguccuaauguauauaagaagacuguuaauucucguauaggaaaaacuagucgcgcaagagcacagauuaagaaaucaaaagcaaagcuugcuaaucccucuauaguuacuaagaaaaggaacaaacgaaaucagacaaauaaacuaguagaugauggaaaaaagaaaccaagagcaaaacaaaaaacaaaugagaaagguacaucgagaaagcauacaacacuuaaggaugaaaaaauaaaaucucagucuggugcugagguuaaguuuguacugaaacaccagaaugugucugaauuugcaaguaguucuggaggcucucaacuacuuuuuaaacagaaagauaugccacuaaugggcucugcuguagaucauccccuuucugcuucccuacccacuggaauuaaugcacaacagaaguuaucuggcugcuuuucuucuuucuuagaaagcaagaagucuguagauuugcagacauuccccaguucacgagaugauuugcauccaucaguuguuuguaauucuauaggaccuggagucucaaaaauuaauguucaaaggccucauaaucaaagugcuauguuuacucuaaaggaaucaacguuaauucaaaaaaauauauuugaccuuuccaaucauuuaucucagguagcacagaauacacagauaucuucugguauguccucaaagauagaagauaaugcaaauaauauacaaagaaacuauuugucaucaaucggaaaguuaagugaauaucgcaauucccuagaaucaaagcuggaccaagcauauaccccuaauuuuuugcauugcaaagacagucagcagcagauugugugcauagcggaacagucaaagcacagugaaacuuguucuccgggaaauacagcuucagaggaaagccaaaugccuaauaauugcuuuguaacuuccuugagaaguccaaucaaacaaauagcaugggagcaaaagcaaaggggcuuuauuuuagauaugucaaauuuuaaaccugaaagaguaaaaccgaggucguuaucagaagcaauuucacaaaccaaagcacuuucucaguguaaaaaucgaaaugugucaacaccuucagcauuuggugaaggacagucuggacuggcaguucuaaaagaauuguuacaaaaaagacagcagaaagcacaaaaugcaaauacuacacaagacccauuauccaauaaacaucaaccaaauaaaaauauuucugguucccuugagcauaacaaagcaaauaaacggacacgaucgguaacguccccaagaaaaccucgaacucccagaaguacaaaacaaaaagaaaaaauccccaaacuucucaaaguagacucuuuaaauuuacaaaacucuagccaguuggauaacucuguaucagaugauagucccaucuuuuuuucagauccaggcuuugaaaguuguuacucacuugaagauaguuuaucuccugaacauaauuauaauuuugauauuaacacaauaggucagacuggauuuuguagcuuuuauucuggaagucaguuugucccagcugaucagaauuugccucagaaguuccuaagugaugcuguucaggaucuuuuuccaggacaagcuauagaaaaaaaugaguuuuuaagucaugacaaccagaaaugugaugaagacaagcaucauaccacagacucagccucauggauuagaucugguacuuuaaguccugaaauuuuugagaagucaaccauagauagcaaugagaaucgucgccacaaccaguggaaaaauagcuuucauccucuaacaacucggucuaacucaauaauggauucuuucuguguucagcaggcagaagacugucuaagugaaaaaucuagauugaauaggaguucaguaagcaaagaaguguuucuuagccucccacagccaaacaauucagacuggauucaaggucacaccagaaaagaaaugggacagucucuugacucagccaauaccucuuuuacugcaauacucuccuccccugauggugaacuuguagacguggccugugaagauuuagaacuguauguuucaagaaacaaugauauguugacaccaacuccugauaguucaccaagaucuacuagcucuccuucacaaucuaaaaauggcagcuucaccccucgaacugcuaacauucugaaaccacuuaugucccccccaaguagggaagaaauuauggcaacuuuguuggaucaugaccugucugagacuauuuaccaggaaccauuuugcaguaauccuucugauguaccagaaaagcccagguaaucaguuauuuuuucccuugggucacucugaauuauuaugauauauaaaauuaugcuauggggauugaaaaaaaaagaauguaugcaacauuugguuaccugacugcuaguuuucugugauaccguauuuguaaguauaucauuguggaaaguauuucuaauuacagacuuacuaagaaaauucaaaaacuaacuggaugguuacaccuagagaaauuuauuuaaguugacuuggaucuaccauuauuuaacacuaugucuucauuaaagauuagaggugcucacuguaaagaugucaugauacuuuaaaaggauuacaaugaucauuguuuaaaugguauuuaauuuuuaaauguuaaacuuuuauaccauuuuaaaagaacuucauuuucaaguguuuugaaaaugagcauguauguguuuuaaguauuccucugauauaucucuaagugaagauuauuguaaguuguuucuauuauaaaccacuuuucaugugguuucaauaucuuguauuauauuguuauuguuauuauaguuuaugcaguuauuagcaaauggacuuugguuuccauucuccuuucuuuuaagaauuuuuucagguggcuggguaugguggugugcaccuguaaucccagcacuuugggaggccgaggugggaggaucgcuugagcccaggaguuugcgaccagcccaggcaaaauagugagacucucucucuacaaaaaauuaggccgggcacaguggcucacgccuguaaucccagcacuuugggaggccgaggggggcagaucaccugaggucaggaguucaagaccagccuggccaacauggugaaacccugucucuacuaaaaauacaaaaauuagcuggacaugguggcaggugccuguaaucccagcugccuaggaggcugagacaggagaaucacuugaacccaggagguggagguuguagugagcugagaucacgccacugcacuuuguugccugggcaauaaagagugaaacuccaucucagaaaaaaaaaaaaaaaaagauagcugggcaugguggcaugcaccuguggucccagcuacucaggaggcuaaggaaggagaaucacuugagcccaggaugucaaggcugcagugagcuguguucacgccgcugcauuccagcuugggcaauagaaugagacuuuaucucaaaaaaaaaaucucuucagggaauugauagacaaacaugugagcgcacgcacacacacagcaaauagcaaaauagaaaucagaguacugguuuauuuaucaguaguuaaguaguuaugguguauaccacuuucaucaccaaguuaggacauaacugaugaaagcuaaauuggguaauguggcuuaauccagaaaguuuaaaugauggcucuuguuccugcccuuguguccaugaucucauauacuuaaccaguugcagagcaggcaguucauuucagccauccauucagaagcagaagaggauggcuggaacugcuaaggcaggcccugccuuagucuaaaucuuggaaagagauaggaaaagcagcagaggacacacugcauguaugcacugaccuguggcaguaccauguuccugacuccagugggaaaaaaaaaaaagaaagauacaauaugaauauuacacauuuguucaaagccauagaaaguaccacaccaagaacaaacccaaauguaaucuguggacuuuggacaauuaugaugugucaacauagguucaucgauuguaacacauguaccacucugguaggggauggugauaaugagggaggccauguaugugugggggcacaagggauauaugggaaacuucuguaccuuccuuucaauuuugcugucaaccuaaagcuguuaaaauaucuuuuuaaaaaaguuuaaauuaaaaaaacacgacagugaaugccaggcuuuuacccagcagauucacaauaauuccuauaggaauccauuuaagaaaggguugagaaugugaaaugauggauauguuaauuuguuucacuguaagaaccauuuuacuauauacuaauaucauauuuuauaccuuaaauauacacaauaaaauuuauuuuuuuaauaaaggggugagaaaagguuaucagaaaugcagaauaaaaguucucuccuguaaugacuugaagugaaagguagaaauguccaccucccagccccuuuucaacacacaguuuuguuuaguacccacauggaacucuuuauuucacugcuggagcauaugaaaucuguucuuuagacguuaguuuccaucauuuuggggacuuugguguuauuaguagugauuaugguauauuuacuuuuaguuaccaaacuuuaugugcuagucauuaccuuuguguuguuguuauuguccaacuuugacacuuguccugcagcuaaaauaaaaaauaaucauuuuugaaaaauauuuuugaaauaugaaacuguaggccgggcacgguggcucacgccuguaaucccagcacuuugggaggccaaggugggcagaucacaaggucaggagaucgagaccauccuggccaacauggugaaaccccaucucuacuaaaaauacaaaaauuagcugggcaugguggcaugagucuguaauccuacucgggaggcugaggcaggagaaucacuugaaccagggagucagagguugcagugagcugagaucgcaccacugcacuccagccuggugacacagcaagacugucucaaaaaaaaaaaaugaaacuguauauucaauauagaaaauuuaggaaguaugaaagaagaaaaaauaaaaauuacaucauuuuuccauguaguaacagccaccauaauauuuugauguguauucuguuuucuuuuuuaaaaaguauaguuuuuaguuuguuuuguuuugugaagugugaucuuacuauagucacaguauuauauccaaauuuuucacuuaacauuauauuguaaacauuuuccaaaugaguuucuugaauauuuuaaucgcugcauauguugcaucauguauauauuauuggacagaaagguuguuugcaauuuugccacuauagauauuauguauauuauuauguauguuaagaagauauuagcauuuucuucuuaaagcauuucuuguauuuuggaguuuuuccuuauagcccuagaaguaggauuacugaaaaauuuaaggcucuugauacauauuaggagauuuuuuuucccaguggguuauagcaauuaccaugcugcugacaauauguaagaaaacugaauucaccacaccucaccauuuuuuuuuuuuuuuuuuuuuuuugagacagagucuggcucugucacccagguuggagugcaguggcgugauuucggcucacugcaagguccgccucccugguucacgccauucuccugccucagccucccgacaccucaccauuuuuuauucuugaccucauuaugacuucucuauccuuaguauuagaguuggguauggucacuugguauguguauucauuuccuucaacagcauuaauucuguuucuguuuuuucacauugccaagaguggaugcagggacagugcuggaugcugguuauggaguuaacuaguaggggcuuaagucuuuucauauaaaggagacagaguagcccuaaugcucuucuuucagcuucaaaucugaaaacaugauccaguuaguggauuuuacauagagagugauggggacauuuggggaaucaugcccuaagagaagugauugaaaaaacuaugaauuaacuuuauauccauaauaaaguuaacaugaagaaguagaauuauuuuauguugcuguaguaagcagaaauaguaucaagggauuggagaaagacagagguuucacuuaauauuuauaacuauuggaaaugaaaccagacuguuuucauuagugauuucccacauauucaugcauugguaacauuuaagccaugcauccugugggcucugccagcuccuaaguuaugucaguguuaaucccugccauggaaugggaagaaagaauuagaguaauuuaccucaguugguauuuuuuuuaauguuuaagggaauuugagaguacgaagauucauuugaauugacuggcuuuguuaaacuacagauacuggagaauauaggaagaagcuaugaauaauauccagggacauaguauuugaaugauaaauucauuguuuuuauucauaugugguaauaauggaaaauuuauuuuaagauuaggagaggaaaggaaucugaaaaguuugugucaucuccuugaaggacagaaggcuucauggggcauuaaaauaaaacaaaaaauaccuucucucccuaagauuaaugguaccuuccaaaggaaauuaaguaguagucauauaccugugaggaaaagcauauugagacuaaagauagaauguaccugcacaauauagagggggcagggaagauagacauggacauuuuugagacuccaaaagggacuuuaucuaggauauggaguuaaauauuuugguaauugcucuuugaaacaaaacaguuguucuaaaauauguuauuauagggagauugguggacggcuccucaugguagaaacucgacuugcaaaugaucuggcugaguuugagggagacuuuuccuuggaaggacuucgucuuuggaaaacagcauucucagcaaugacucagaauccaaggccagggucaccccuucgcaguggccaaggaguugucaauaaagggucaaguaauagcccuaagaugguugaagauaaaaaaauugugauuaugccuugcaaaugugccccaagucgacaacugguucaaguguggcuucaagccaaagaagaauacgaacguuccaagaaacugccuaaaaccaagccaacuggaguuguaaaaucugcugagaacuuuagcucuucaguuaacccagaugacaaaccuguagugccuccaaaaauggauguaaguccauguauacuccccacuacagcacauaccaaggaggauguugauaauucucagauugcuuuacaagcaccaaccacgggauguagucaaacugcaagugaaagucagaugcugccaccaguugccucugcaagugaucccgaaaaagaugaagaugaugaugauaacuauuacauuaguuauagcuccccugauucuccaguaauucccccuuggcaacaaccaauauccccagauuccaaagcauuaaauggagaugauagacccucaucaccaguagaggagcugccuucauuggcuuuugagaacuucuuaaagccaauaaaagaugguauacaaaaaagccccugcagugagccucaagagccucuagugauaucuccaauuaauacuagggcaagaacugggaaaugugaaucacuuugcuuucauaguacaccaaucauacagagaaaacuucuggaaaggcuuccugaagcaccuggccuuagcccauuaucaacagguaaguguacaaauaacaggaagucuccauaauuguucuucagaaauagaaaugaagauaacauuagacuguaaugaaaaucagagcuuuuuaaaugaagguauagcucagcaaauauuuuucgucaugucuuagaaagucgucacauggcaacugucuuucugcugugaaaucuacuuauauuugcuuccauccugucuugugggugaaaugcaggagcccucucaaaaggcuuaucuucucaacuugacuuuccuguuggcuuuuauacauacccaggucucccacauuuuaaaacagaaacaaaaaaccugccuugaccucacgucuccagccagcuucuacucuuucuccuccccuucaaagccaaauuucuuaaaagauuuaucuaauuugacaacuccaguuauuuaccuccuacucauuucucagcccacucuaaacugaauucugccccugucauucuacauuauagcucuuguaaagauucccaguaaacuuauagcuaaaaccaauagauguuccugagucuuaucauauguccucuaagcagccauuuucuuguugaccuuaccuuccuucuuggagcuucuccacuuggcuuuccuccuacuucucuguuuuuuucccacuugauuuucucauuauucucaguuguuaucuaaauguuggaguuuauuaaggcuuggucuuaagccuucuuuauaucuuucucuaaaugaucuaauuccugucuacaggauuacuacagauaacucgcaaauuuauauucccaguucagaucucucuuuuaagcuccagaacacuauauccaacuaccuaucugacauuuccacuugaaugcuaaauggcaccucaagauuaguauuuuaaaaaccaauucaugaucucaccgcauacauucaccaccacuuccccaacacacuuauauauacaugccuccacauaaaaacccaucuggccuucuuucaguuuuccuuauuucaaugaauagugccaucauuucuuaguuacacaagucagaaacauagaauuuauuuuuaacacucaccucauucccucauuacccaccuuguaguuucuagucccuaaccaagccuuaucacuuguuuaucucccaaguaacccagaucuaucuacuuuauuguacuucuuccaccacaaccuuaggccaaacugucaucaucucuugccugggcuccugcaccagccauuuuaucuacucuuaguaacuuccaauucuuuugcacaguaaucagggaaaaauccccacucuguucuuaguuaguuacuacucucuucagauuuuaccuccaggaaaccuucccuaaucuccuugacuacauaaaaauucccaauuauauuccccuuuguuguauuagugcaguuauaauuuuauuuuucuaguauguuugaugaaugucugauucucucucuagaccccacaagggcagagauuaugucuuuucuuccucaucauagauacuugauaaauaagugaauaaaugaauuaaacaguucucuagguuaaugacugagguauaaaauucaguaauuaaaacauaaacauuuaaaauacaaaaugucaaaauguuauuuugguugggaucagagguuugaauuucauuuuuaaauuaugaaauucuggggggaauucauaggacagcacccacaagugguacuuaaguguuuggaacaacaaaagguuuuuuaaaaaccagaagcagguaauuuugauauacauguuaaauauuaaauuucuuucuacagaaccaaaaacacagaaguugaguaauaagaaaggaaguaauacugacacucuuagaagaguacuguuaacacaagcaaagguaacuauacuaaacauuuuuaaagaucaguggaagagccagucuuuuuccuagauuucaguuagauaauuguuaacuuugucucaauuaaaaaauuuugguuacuuaaauuuuugcaucauuauuugcauaucuuugagacaacaaaaauuugccuuuuuuuaguuuuuuuuuugauguugggaucuaaaagauucuuauauguaaauacaaauauuacagagaaagugaauaugauagccaaaauguggauuaugaggauacaaauacauuaacugauuacuggcaaaaucagaacaauccaaugacagcagagcucaaguaagugauuuuugaucccaccaaaaauauauccuuuuucuugguuuauuacuuuuuucuaaaauauaaccuuauugauuuuuuaaaauuuauuuuacuaaguaguaaaagaaagcaacauuauuuacuacugaaacucuggaaagucacaaaugucuuuauucaaauacuaaaaauaugacaaaacuuagaauuauaugguuaugugaaagaaguauacauuagacauacauccuuggaaauauaugcuagaaaucacuuauauauuggccacuucuuauaaaugucauuaacuacauaaaauauauuuuaauauuucugagauuaucaaacuuuuuaaacuuucauuuauaaaauacuguugaauuacaagcuauauauauuaaaaaauacuauaucaguguguugugaacauaacacuuuggggaaaacaguuaauagauuuagaaaucagaaaaaauaauuuuguaagaaauggaaagauuccauuuuuuucugaaucuuugaagauuacauuguuuuauuuaauucaucuuucagacacauguuauauuagaguaaaauacaaaucaguauuucaaaucuuuuacaaacuuuagccaaaguaguuggaaauauauugauugcuugcuugucuuucuuacuuccaagaaaggucaagauaaauguccaugugguauaaaugucaacucccuacaaaacuguuauuuucaguauugagggcuucugaacugagagauaacauaugguuugcuuauauuucuacauguauccaguucugauaucuuuguuagcaugaaaauaacauuaauaaaauacaguuuguucuugaacuuagagaugauauuaguuuaccauuuauuacuaaacacauaaagcauauuaucugagaauaaguaaucaaaagaaaaaugauugcucauguaucuuuuucuggcuguguguguguguguuuuuuuuuauagaaucaauuugcagcaguaaauaccccacagaaagaaacuucucagauugauggaccaucuuuaaacaauacuuacgguuucaaagucagcauacaaaacuuacaggaggcaaaagcuuuacaugagguaaaacugcaacaguaaggacacauacauuguguucaguuuaacuccuguuuuauucuauaaaacaaguauggaauuuuuuuaacaagggaggaguauauugaauucuauccuauuaaucuucaucuuguucucauuuuacuauuuuguauauuuacauguuuauguacaauacauaaacuuaaagcauuuaaguugcugagacugcuuugugauuucauaucuuucacaaaucucauaacugaaauucagcuuauggacauuaaaauaagaaaagauuuuugggagguggaggugggaugaucccuugagucgaggaguuuaagacuauccugggcuacauaggaagacccugucucuaccaaaaaauaaaaauaaaauuagaugagcaugguggcgcgcaccuauagucucagcuacuugggaggcugaggugggaggaucacuugauccugggaguucgagggugcagugagcugugauugcgccacuacacuccagccugggcuacagacagagcaagacucugucucuuuggggaaaaacaaaaaaaagaaguaagucuguauuuuggggauuauuauauuaagauguuaugucacaucugaaaugugauauuuacuuguauuuucuguuugauuggcugaguggauuagagcuugcuacaaaagaggauaaauucauucacucauauacucucuacuuaauccagcuaucuucacagcacaggcugccugccaaagacuaggacuuugcaaaaauauacaucagcuacaguaugcauuggaaagaauaugugaaugggucacuguaaauuuauuuguaugcagaaaacaaacucaaagcacauaucugacuggcaguaagauagaaauuggaguauguuuucauuguuuacaccugugcugucguaugguagccgcuagcagcauggauauugagaacuuaaaauuuggcuuauacaacugaagaacugaauuuuaaacuuuauuuaauuuuaauuuagauuuuaaaacauaguugacucaaaguauguuuggaacgacuuagguauguaauacuauuuuuuacucuuaaguuguaugaaauuacagaucaaguauuucuguagaaaauuuagcgugcacagugagauauacuagaaggauaaaguacauacucauuucaaagacuucauggaaagaauaauuuaaaauauuuuguuaguaauuuuaauauugauuacauguugaaaggauaauauuuuaaauauauuggaucagaucaaaguguuuuuaaauuaaccuauuuuuauuuuuuuaaaugugacuacuagaaaacuuuaaguuacaugugacuuucauuauauuucuauuggacaaugcuaguuuuauacagucacuuuaugucuuugcuuuuaaagcagaggauuaguaaccaccuuuaaguuauaauucaauuuuuaagugugguuuuuuuucucaagucaauucuguuguaaacuguucuagagauuagauuaacauaaacugagggaaaaauuuuaauauuguccuccuuuguucuucacauuugaacugagaauuauguuuuuuuagaauuagauuggaacauagucucucccucauuuauucauuugcacauuuuucucauucagcagcauucauucaguuucuguuuuauaccuaggucuauacuagccccugaagccuagauaaauuaagugauaaauucaguaauacauaccaucaaaugcaaacuugaaauuagcaaauuuuuaaaaacuuuuuuaaaaauauguauuaaagcaaauuugauagaccauagcaaaaagacauguuacauuugauuauucucuuauuugaaaaguacgcuuuucuacauuuuccuagguaacccuguuucagaaccaugggcccucuggaaguuaaaaucacucuggaggucucacugguugcucugacagcuucuuccucccgauaaccggcuuuccucaucucaaggcacauuccaaacugccgcccggugguugaaacagggaauaaaccaaagaaaaaauacuguucucuuccuuucucuaggaaauuaugcuuguggcauuuucucccucuguuuccauuacccuaggauaaucucucuuucuucugcacaucaguacucagugcagaagacaaggguuguaaucuuugucccccuucucaccugccucuugccuagucacacucacuaaaucucucaagccaugucuuuauauaguuugcuuuaaaaaaauacccccuaagcacaguaaugcauuuuguuauuaaggaauagaaaugcaaauuuugagugugaaaauuugaucuaguaaacaaaaaucaaccucuaagacccuuuuaaccuaaaauuguuuucagagucuucaugucuuuucauauguucaucccuuucuuuuuuuuuuuuguuuuuuuuuuuguguguguguguuuuuuguuuuuuuuuguuuuguuugagacauagucucacucugucacccaggcuggaaugcaauggcacaaucucagcucacugcaaccuccaccucccagguucaagcaguucuccugccucagccucccuaguagcugggauuacaggcaugcgucaccacacccggcuaauuuuuguauuuuuaguagagacgggguuucgcuacauuugccagacuggucucaaacuccugaccucaggugauccaccugccucagccucccaaagugcugggauuacaggcauaagccaccgugcccggccucauauguucaucccuuucuaaugaaacugguuguuuuguuuuauuuggguuugugggaggaguuuuccauuuaaaaauuuuuuauuuacuaaauuaaugcaugcuuauuguuaaaauuaaguucugaagaguaugcauuuaaaaguaaaaguuuuuucccuuagcucuccauuucaugugguuugauuuuuuuuuuaauacuaauauuuuaaaguagaaacagcaguauauguuucugaggaaagugguagauuuguauuuguuuuauuauuaugccuuauacaugcauaauugauguucuuuauauuuuaaaaaguacuuaguggccaggcaagguggcucacaccuguaauccuagcacuucgggagguugaggcaggaggauugcuugaggccaggaguucgagaccagccugagcaacauagugaggccccaucucuacagaaguuuuuauaaauuagcuggccauggugauauguaccuauagucccagcuaguaggaaagcugaagugaguggaucacuugagcccaggaguucagggcugcagugaacuaugaucacaccauggcauuccagccugggcaacagagagagacccugugucuaaaaaaaaaaaaaaaaaaaaaagauuauuuaacaaauuuacaaugagcacaugcaauaguauauauaccaaaaauacucaaucaggacaaaaaaauuugcaaugaaaaguaagcuucccuccuacuuuaggcuagcaauuucuuucccccaaagcaauaaguaugucugcauuuuuaugucacuuuucagaaauuuucuaugcaugugcuuccauuuuuucauguauagaaguuuacuguguuuacugguuccauguaucaguguauuauagugaucuuuuuauauuaggacauacagaucugccucauucccuugaaaaucuuaaagguuacagaauauuccauuguguguauccuuuauggauaccacauaauuuauguaaccuguccccaacagguaaacauuuaguuuuuuuccagucuuugcuauucucgaguaaacauccuuguuguguauauuuuaucuacauguaugaguguaucugucucuaggauaaauuuucaggaguaggauugccacaucaauggauuuuaauuuugauagagauuuaccaaauucuacuccugucacuagugagaaacuugaauuuacauuucuucaacaguuugcaugcaagauaauacaaaacacaaauccuuuguuaaauuuauaugaucugaauaauuaccaauauugaaacaggaaucuguuuuccauugccagguacauguacaugauaaaaagaugagguauaauucuagcuauaaucaugaauucaaccuauauuuuguuuuucuuauuuacucugucuugauuuuagaaagaaaacuaagaauuacaguuaaaaguuuauauuggcauagaaaaauaagcaugaaaagcaaauauuaacuuuuuugcauuauauguuaaagagaaaaugugcauguguaaaaaucuggcuguuguguaguugauaccauaacaguucuuuuuuuuuuuuuuuuuuuuuucaggaaaaacuauaauuaaaaaucugccuaguguaugcaaaagucuaaguuuaaguagcccucaaguaguagugaauuaauugguaggaaauuugaauuuuaaaaaagcucucuuuuuacuuuaaacuacagguaaaacuauauaguuuagcuaacuacaugaagaguaaaacgugacagacuuugguuucauuguauaacuacuuggacuagucauucucuuucucaaacaggcauugagagauccugcauauauuugagaaaaauagucuaaauauugucauugagagcagauuuucugaaauaacaucaugaauugauuuaaucuaaucuugggauuaaaaaucuuucguuuuaauauauggagugcugcugagcugugacuuuguccuuuauguccauuuuuucuguaaucuuacauacauauuucccuagagccuuacauacuucuuugagcaugucuuuaaaaaauguuuuaaaaacauaguauuuauuugcuuuuauagauacaaaaucuuacccuaaucaguguggaguugcaugcucgaacuagacgagacuuagaaccggauccugaauuugacccaaucugugcucuguucuacugcaucucaucugacacuccacugccagauacagaaaaaacagaacucacagguguaauagugauugauaaagacaagacaguuuucagucaagguauuguccauuuuuauuaaugauauaccugcccacucuagggugaauguuuuaauggggaauuccugugcugaagaucuaaucuaagcaagcaugaugacucuuuucuaaaauguuugcugagguagggguaggagauuguguauaacuuuguccuagauuuauuauucuuacuuggauuagucagaagcagccaggcacaguggugccugcuuauauauagucccagcuaccugggaggcugggcaacaggauugcucgagcccaggaguuuggggcuguagugcacuaugauugugccuguaaauagccacugcauuccagccuggguaacauagcaagaccccauuuauuuauucauuuuuuaagucagaagcaaugcaauauaaagaucuuaauauuuauaauuaucuuauauaauuuguucuaaguauuauuuuauaaaaauacuuacuacuaauacagaguccaccuuauuauguaucccuagauuaggugcacagucuuccuuauguaugcauaugcagguauuuuccugcugauagaggguuuaucuuaccacuauaaguuaaugguuuauaagauacuuuuaagauauauucuuacuuugcuuauaucucuuuaucuuucuuucuaaauaauauacuuuugguucagagguucuucauauagaaugccauauaaggcauuuuauaaaauaccuacugucccucugcagcuuucaguggucaccauuacaagugaauucaguccacugaggaggaagucuuagcacagaauacaaccauauuaagaauuugcaauuuauucagugaugugcuugagcugacacauaccagcucacaagccaguucuuggauuuucaugaauuuuucaaacuaguugcugucacuuuggcaguuggaaaucagucauagggugggggagggguccuuacaucaugaaauaggccagcacuacaaauuaaggcuuucuuuuuuuuccugcagaaguggugguuaagcauuuucaucauaccagagauuaaaauguccugugcuaagcaaagcucuccugcuaggaagaguaaagacagaaacaaaguaauacaguuucuucacaagagauauguuauuuucuuuuuuuuuuugagacagagucucgcucuguugcccagguuggagugcaguggugcgaucuccgcucacugcaagcucugccucccggauucacgccauucuccugccucagccucccgaguagcugggacuacaggugcccgccaccaugcccagcuaauucuuuguauuuuuuaguagagacgggguuucaccauguuaaccaggauggucuugaucuccugaccucgugauccgccugccucggccucccaaagugcugggauuacaggcgugagccacugcacccagccagugauauguuauuuucuagggaauuuuaugaaugcagccuuuucaggagaauagcugaaaauacaaaauuugaauuuucaguuguauauuaaacuaaaaaaucuuuugagaguuuuuuaaagacauugaguuaguuauguuuucacuuggggagauguuuucuuaauuugaaauauuucaguaguacaauuuuacuuaaaaguagaggauaauauuacuuuuauauuaugaagguauauuauuauauaauguuauauauaauagacauuuuguuuguuuuuuagauaucagauaucagacuccauuacuuauuagaucuggaauuacaggacucgaagucaccuaugcugcugaugagaaggcacuuuuucaugaaauugcaaauauaauaaagagguauuguuuuguauaucugauuuuuccaguuuuauucagagagucguuucaugcuauugcagauaauagugaagauaaaaguaaagguaggaagaaagcgaaucccuuccuaugacccuugaaagcagaguuacucuugggaagauuuuauacucacuucccaccaccaucacuauuuucaucagacaagggauaggaaaagcaguguucuguucucaagauugaggggccagugaaagacaaauauuuguuuagccucuaacuaacuucccaguuguacuugagguugguuuuucuguggugcugaaauaauggagaacuguauaaaguuccauuguauuauucauuaacuagguuucuaccuugggagccagccaccauuucaguaccuuuuuuugguuuguuuuuucuuuuuuaaaguuuucugaguucuaaacaagccaauauuuucaaaaagcuuugggaugcauucucuguauaaauuuaucuguucauaaauguaggauuaucuauuacauacucuugugcacagagcuccuuaaaaaaucucuuuugaccauuugguagucgguccucaguccgauaguagaaucuuguccaaguuuaugaaaaaaaauuuuuaacaaaaauauuuuaauuuaaaaauaaaaucauuaaguggauaauuugcauuuucucaacaguguagcucuugguagccauggacucucuuauuaaaugcuucacuuuguagaaacuuaaggauucugcccauugcuagguuuaggguuuuagaugccuaaagcaagauagaagacauucuuuggauccugauauacagauaaaagcuguccaugagcauguuguuauacucacccuuuuuuguuuugcuuauauaguugaacuucauccuauaaaaacuaaaucaguauucuacaugaaaaauuaagaugauauucuacagacuugucaucagauugaaucccagauggguuaacauaaaccauucugagaauuagaaaaccaaaacauguguuuucuacaaaacaaaauuaaaugacagagcaucaaaaauaguaugcuacuacccacgacucugaaggaaaaaaaguauuuuuacuauuuauagcacuggugacuagauagauucccaucuauuugagucuugucauugucaguccuaccuuuuaucuucucacagagguugucaucaacaugucagaugcuuucaguauccacacuucuuuuauuucugcaagcaacucagagaaagaaauauguaagaguuucagucaauacuauuuuguguaccagcacauguccaguaaugucccugggcuuguaugcuugccuuuuccuuguuggguauauucccaaugauaggauuaccugccaacauugagaauuuuguuagucauuugcaaguauaauaacuuucuuaaauguccauaaaaugaaauguacuaguaauuaaggaaaaugggguaaacaaaacugucauaaaaagaaaaaugcuuaaaugucaacuuuucaauucuauaguguucuuuauauauuaguccaaacaacucugcaaaaagauugauuauuucauucuuucacccuauuuguuguguaccuacucagcacagccuuuggagucagccagcacuguguuucugucuugaauaaguugcuuaacucucucagcuuuguuuuccuaaucuguaaaauggguagauaauacacauaaaacucuuaaacucaggucuggcacauagugaguacauaaauguuaacuguguguaaggggcagugcuagguacuaauauaaaaauaaauauaucuuuauuuuuccauuuuuaauauugacuuccucaagugacaaacacgaaaaguaauauaaagugauauuaaacaaguaaaaccucaucuauaaucuugucacaaucauuuuccucuuucuguauuuccuuggacuauuaacuucacuuugcgcagucucccuaacuuaaauauaacuaugauucuucccuuuuccucuucccuaaaugcuauuacauuuauauuacaucauauccauuuaaccucagaauucuuuuucaagaugauuccuuccccuccgugccccuugccucuacuagaguacccuuaucugucauguguguagaugguagugaguuacuuaaaauacuaacugugaagcagcuuuuuucugccuaagcaaauggaaccauuuaccuauuucuucugcuucuauuuuauccacaguuuuggguuguuuucaccacuaaucccaucuacccaacuuuauucuuucuguaacuuucagaaaccugauagaaugaauaaaacccacuagaaauugaagaacaagucaucaagaccuuguuauugucuccaaauguuuuuagagaggaaaaauggaauccuuuggcuuuugaacuugaaaacagguguuuuaucagcuuuaaaagagucucuuacauccuccagacuaaacauccuccgggucaaaaaauaaauauauauguaauauaucugaaaaaaugccugaaacaacuuuacaauucuucuaaagggacaaaaucugugaaauaaaucugagaagcgcaggguaacuuuuuucagcagucauuucugagcuguagcaguuuauaaaaauagacagcuuuuuaucugagacgaaguuauuuucaauacauuauuuuuuuuaaaaaaaguguacguagccaacucccuuaguugccacaacagaacaaauagcugacuggaauaagucuugcaauaacaagauguugcauaaaugagaaagauucagaugaagaaauuagaagaacugucuuuauaacauuuaaaacagaaggccuguguaaucaucuggcauccucuucauguuguagcuguguaacuaugugauaugugauagguaacuaugugauaggaacuccaggaaucuucccgauucuuaagaucaaggucaacuguggccacacuguaaugccuauucugagccacucugaguacuuagcagacaacuguguggguucuguuguguuuguaugagaaugcuucaagucugcgaccccugaugauccuuagagccacuuaauacuugugccccaauucucaaauguagccauucauuacacaguuaguuuuaaagggagauauacuggacaaguagauagucugucuuuggacuaagaagaguuuaaugaaagagaugaagucaguaucaaggauuugguuaaggguuuggguguuauguuggaagacuaaacagaaagaguauugggauauuucucuuuccuugagugcccugggaucuuucuggacuuccuuucuggauauucaugccauuguugcuuauugcuuugcuucaauagcuguuuauuaaauuaagccauuuucucagaaaugucaacccuauuuguauagagaaaagcacauaaauaauauguuuauuaucuuuuucuccuaacaaguuugaaggcugcucagcaagucugugguauaacaauggaucaugaacagaucaccagauauuaaaauuuauacuacagaauguacuuucauagggccuuuagggaauaggaaaauuuaaaagugugcuguugcagaaguuugaacccaguucuuuugacaucagccacugaaauacuccagaauuaaaaaucagaaaacauuuauugugacauuccaauuuuuauugacuagguaaaaacgaaagccauucaauacccauuuuuagaagacagcuauggaauuaugauaaaauauuaacauauugguucuaaaagcagaucuggugaucuggucaugauccauuguuaugccagacuugcagaguagccauagauagcuuauaucaguaaauuagucuaguacuguagacauuggcugaggcuuaggguauuaaaugcuguaaauuggacaggcugcacaucucacaauuuaguguuucaugaguaguuauguaaaacucaacgauuuaaauuuuugugauauuucacuuggccuuuuggcauuuauaaagaacaagauaaugcuacuaauugauagagcuacuuacuguaguuuuugcucucaaaacuuauaacuauaauuaguuccgcucucucccacacaauuuuccacucgaaauaaauuuucauauuuauagcuaaacauuucucuaugguggucacaacauggagguucuaagaggagccacaaagaggcuccuucuggauuggacgcagguggucgguucaguuuugccagugaagcucugaccacgaggagcacauuuuucuucuagauucugauguuuaccuuccccaccuuaaucccaccucuauuaauauuucauucuuccauuaaguugaaucaccauccuuuuaaauuuaaaggacaaacuugucauuacuuaggccuuauuuugugugagaaccaaauaauuacuaaaauuaagugagaaaaggaaagcauucucauuuuucuuucucagcauuaaaacuguuuaagggcaguauagauuagaaggguagauaaguggcaacacaaugaccuagggaucuuuuucaaaauaccauacccacacacacccucacacuucaccuuccccugcccacauuauauucucacuuguaccuucacucauauacuucagugguaauggccugccuuccaccccaauuuccaucagccucuuuucccacuuguaucaaacaaauacacagucuaaguaaaaauuauguuuacuuuacaaaaauagcgucaaaucgccuauaaucccagcacuuugggaggcugaggcaggcagaucacuggaagucaguagucugagaccaaccugaccaacauggugaaaccucaucucuacuaaaaauacaaaaaauuagccgggcgugguguggggcaccuguaaucccagcuacucaggaggcugaggcaggagaaucguuugaaccugggaagcagagguugcagugagcuaacaucaugccacugcaauccagccuggacaacagagugagaccccaucucaaaaaaaaaaaagaaagaaagaaacaaaguagcuucaaaucaaguacucuuaaccauccaucucuuccuguauaaaaacucuguagguaccacuguaucaucccuucuccaucugggcaccguuagagaacauagguuuuuguuuucauaccuuauaucaugaagaaacaauuauucugguuaaagguucaaauguaugguacuuauauaacuuuuuuaaauuccuuuuuuagguaugauccugauauucugcuaggauaugagauucagaugcauuccugggguuaccucuuacaaagggcugccgcuuuaaguauugacuuaugucggaugaucucucgggugccagguaugugucauugugaauguuuugucauucaacuacagagcaaauuauaaaggaaauaaagacagaauguuaaagaguacuuaugcuguagcccaauuuuuuaguacuaaguuguguaaguuuuagauauagcauaacuccauuguagaaaaaauuaaaaauaaaauaaaaaauauucuagucucacugcuauauguacuguuaguauaguuguuggguuuuuuccuuucagucacuuuucauauacauauguagugguuuuuaaauaaucauaccguauauuccauuuuuauuaugcuuccuucaucuagugucuuaccacacauauuuuucugcauuaugaaauagucuucauaauuauuaugaagcuacauagcauuucuuugacuuguuguaccauaauuuuauuguuugucugccucuguuuuuuuuaauccauuuuguugguuaagaaggacaggauggguugaggaacacuaguaguuaacuaaucauugauuuuuauuuggauaucaggcuacaaauauugcagaaauuuugaaguccauuccccaaaguuucauucuaacuagaagggaauaauaauauucauaccaaaauuauuuguaguuuauaaugcacuuuuuaaaacuauguuuucuuuauaaacauaggauuuuuaauaaauuuguucccaaggguucccacaagucuaacuaaaacaaaguaguguauacuuuaggaaaaguugaagcuggaagauuccaggacaguaaaguuuuuuagcuuugcaaaaaauuggaauaaaaagaucaggugcaguggcucacaccuguaaucccaucuuugggaggccaaggugggaggcuugcuugagcccuggaguucaaaacuaucccaggcaacaaagugagaccccauuucuaccaaaaaaaaaaaaaaaagaaagaaaauuagccaggugugauagcuugugccuguagucccagcuacucaggagacugaggugagaugauugcuugaacccaggaguucaaggcugcagugagcuaugaucacaccacugcacccaagcuugggcaauagaacaagacucugucuuauaaaaagggaauggggggcagagaugcuuuaaguuuagcuuuucauuccaugaauuuuuguguagcuuguguguccuuugcaugauagcaauagugguauaucuuuuuuuuuuuucaauaucuuuuuugggauagguuuuaaauauccuugucucaguuuauucaucuguaaaauagggauaauagaacuuauuucauaggguuauuuugaagaacuuaaaacaaucaccagaguauauguuacauuguuugcuaaaugaaaaacaaacuuuuaaacauuaucucuuuaaaauaaaaagaauugggugagugguuguacauggucuuuggauucagguaauccuaguuuagaauacuaguuuucuuacuguaagaucuugggcaagauauaacauuucugaguagaauuuuccguaauacaaaaugaaaauuauacuaacuucuuaaaugguccuguuaaaauaaaggaaguaauguuuguauuaaaauaaaugauguugguaaaauucuuagaacauaauaaaccuucaauaugguaaauauuuuuauuauucuggaaccucuaaucaucaacauucacauauaccuaguguuacauaggagagacgcauuuuaauuuauauucuagguaaacuucaucuccuaagaaacuagacucacaacgcuauuugcuaugaggaacucuucaucuaguucuccauaugcauucaagagaauuucauccugaaugugaacaugaugucaacaaauuuucagagaaucguuuagguuaaaaauugaacuaguuuuuuuuccaagaaauuaccagauuaacuguggaucuuucucaugcuaagaccaaagaaauguuagcauuagguguuuauaaagguagcaucaggcaccuguagucccagcuauucgagcagcugaggcaggcggauugcuugugaccaggaguuugaggcuguagugugcuaugauugcaccuguggcuagccacugcacucaaccugggcaacauaaaaaacaaacaaaaaaagguagugccaaaaauuaccaaaucuaaagaaaaaaguguuucuuauuuaaauauagaaagaaggagggagggagagacuucagguuauauuuauuucacaaaauuuuuucauacauugugaauuauauuucaucuuuaauauucauccuuaauguauauucucauuuucccuggcauaauuuuauugaaaguuuguuuucugugagcccugauacagucuguuuucauuucuauagaugacaaaauugagaacagauuugcagcugaaagagaugaguauggaucauauacaaugagugagauaaauauuguuggccgaauuacacuaaaucuuuggagaaucaugagaaaugaggugggugauuuauccaaaauguuguuuagaaauaagauauucggucaauauaaugauuuaaucauuauagaguauuaguaagauuuacuauauagcuuaugcguuugucaauuacuguuauacuuaaguagaguuaaaauaguacuuucuaaaaugcaaaacuacagagguaauagacuuuaauguuuuaagugaguuuuuuuuuuuuucuugugucuaagguagcaauaacuagaaaggucuauagcuauaauaaaauauuggggccaggugcagugcucacacuuguaaucucagcacuuugggaggcccaggcaggggcaucccuugagcccaggaguuccagaccagccugagcaacauggcaaaacccugucucuacaaauaauagcuaaaaaaaauuagcuggauguggaggcgcaugccuguggucccagcuacuugggaggcugaggugggagaaucacuugagcucaggcagccgagguugcggugagcugugauugugccacugcacucaagccugggugacagagugagacccugucucaaaauacaauaaaauauuguguuguacauguugaauauugucuaauuucaccguauuuuuuucacggaagucauuuuugcacuuaaggccagaugaauucagcuggccuuguugauuuauuauaguaagaaaaauuuagucuagaaauaggaaggagcuucucaaaugaaguauauuuaaauacugggucagauuaauaagauaaagagacaguacuuugaaauaguuaauaauuaaggcuuugggagcucagauaaggauuuuuuaguagaguaauuucaaugaacuaucccauuaauuugcauucacuuagaaaaagaauuauuucacacacaaaaaguaagaucauaggauuuuccuggguaauauuugcauccuugaaguuacccaauuucucuuauuugaaauguaaaaaagccauacaugguggcucacaccucuaaucccaacucuuugggaggccgagguaggaggggauagcuugaggccaggaguucaaucaagaccauccuggguaacauagcgagaccuugucuguauuaaaaauaaaaaauaaaaaacaauuagguugggcaugguggcucauaccuguaaucccagcacuuggggaggccaaggaggguggaucacuugagcccaggaguuugagaguagccugggcaacacagcaaaaccccgucucuaccaaaaaauacgaguuagccauguaugguagcaugugccuagcguguagccaggcaacagcuacuuggaaggcugaggugggaggaucacuugauccugagagccaguggcacacacauacagucccagcuucucaggaggcucaggcgggaagaccuuuugaggccaggaauucaaggcugcagugcacuguuuuauuaugccucaaaggcaaggguugcagugaacugagauugcaccaccacacuccagccugggugacagagcuagagccuaucucaaaaaagacaaaacagaaacaaagauaccuacuauaaauuggucuauucuuagacuuuggacuuuggauaaugucaacuaaaauguuuauauuuaaaagaaagcuaauucuucaauugcuucugcucuuugaaacuacuuucucauuagacacuuucuauuauauacuuauuauuauuaucuucuuggcucuuuggauuuauauaaaacauuugacuuucuaagcugcuguaugcaguauacaacaugacucugcuugagaaugauuuuaucuuguuguguuguucuuaaaauaauagaagaguguuagaguccccagugauuuaaaguaauuucuagugauacagcacaggauauaagagauacagagauugugguguauuugguguguauauuucauuauauauauauauuuuuuuuuauuuuauuuauuuaugagacggagucuugcucugucacccagaauggagugcaguggugcagucucggcucaccgcaaccuccgccuccuggguucaagcaauucuccugucucagccuccugaguagguaggaugacaggugccugaaccacaccuggcuaauuuuuguauguuuaguagagacacgguuuuuccuuguuggccagccuggucacaaacuccugaccucaaguggucugcccaccucggccucccaaaaugcugggacuacaggugugagccacagcccaggccucauuauauauuuuaauguauagucugauauugccugagaugagcacauacuuuaaguguauaaacacaaaguaaauuacugaauccuaguuucaggggucuuuucaacccuguauauccaaaaggcaacaguagcaaauuaacuaguagcuuaaaauugcaaauuagagaacaaauauuuuugcaaaguuuagggccuucucuaguccucacugaaaauucagggucaaauguuuccucucauuuaggaugaauauauaguaucucugaucuuuaugcaaaugugggaaacaacuguaagaaaguuaugagcuggguaaccuguuuuuuaaaaauuuggaacuggguacaguggcacacacauauagucccagcuacucaggagacucaggcgggaggacauuuugaggccaggaauucaaggcugcagugcacuguuuuauuaugccugugaauagccugagagauaaagcaggaccccaucuguuaaaauaauaguaaucauaaauuuuguuuguuuuuuuaauauacaaguacuagauuucuuucucuuacuuuacuuugaacauagaacuccugcaguuuccuuauggacuuugaauucguagugacaagcaaaauaccucuuaaauaguaaugcuuauuagauauuuguugacugcuuaaaugacaauaaauagcucuuccccagacaguuauacuuagaggccuucuggaugucaagucaaucuaggcuuuucaagaauuugccaaguggguuggaaacagacuugauucaauucaacaaauauuuacugaaugccaucuuuggugcacugguugaggggccuggguuuagauaaaguaagaguauaguaacagacaggaaggcggaauauauggguauggauguugguagguagagauauggcagugagaaucuguggaaguucucuugugauucauuuucucaguaaaauaggaauuacuguucuuagcuaaaacagaauuguggagaggcuuuugggguuugaggagagaugaguuugaaaugguuauuaggagaauuugagagaaaauauaaacacugggccacauuaagagcccauuugagauuuggguuaggaaauuaaagugauacccaccagcuauguucaaauucacaggugcaaguuagauuuaaccaucacucacaaaggguuauggauuugcuuuaaaaauuaaaaaaaaaaaggcggcagcagcaggaaagggacaagggaaugaaggguacaugcaggggaaugauuaccaugauugacuaugaaauuuaaacuaaauaaggagcagagaggucagagcaucaaggggaguaagcuggaagcaccggagaugauggucagagaaugggaugcaugagauuuuggagggaguacagcuguugauagauccugggguaugauuaugggaguggguagcuuagguaggauggaggacaaaaucauuagagaagaggaguucaaggaaucaaggaguaucuuuauuuucuucccacauaauuguuacacuuacugcauauaaaauaacaguaguccuuuuccuuuaaaauucaaguagauauagugccauucaccucuggaauuuaguacugcagaggagaaaucuaagguccagcuaauuaauauauuugauuauugcuccugucuccauauuaggcuuuccuuuaggaaccuaauuauauauuaacauucuguucucuguuccccauaucuucccucuucucauuuucauguuuucauccucuuuaucugcaugcugagacauuuccauauuccuaacuugacuuuuaguagaacuauuuaguagaacuguucugcuauuuacugcuuucaauaugagcuuucauucuguuagugauuuuauaauccuuccucauuuaaucuuguggccuuuuccucauucuauugcucucuaccuuuuuacaaccuaugaggggcaucuguguauauguauaccuacacaaguacauacacacacugugaagugugcugcauuguagugccauuguucugaagauugacagaaauuguagauaaaguaagaccaauuugggucacugcacugagauaagauuaacauucaaucccuauuuuguaccuccuggaucacaggaguggaaaagaaaguaauuuaaaauuauaauguaauauacaaaugugaagugcuguuugaacuauuucugaauccgaaacugaccuaagaauggggacuacugguuccuuaauuuccauuuugcauugaaauaccugccauugucuagauugcuuuugucuuguagauauuucagagaaaucaucuagcuggaaguacauauuuauuaauuugggcccuuuuacaguauccuuuacccauuaacacugcuuucacuuacguauuuggaacauggggagacauuucugacauuuuaguauuuugcuuuuggaaugaaauugaguggcucuauaaugucuguguaguggggucuaguaacuaauguaauuauugggaggagaaugccugccuuuaacuagauaacucaccucaaaucuguggaaucccauuaaucagcaugucaucaagaaccaaaaaguaaguauggaaagaacaaaaaauuaauuugcuugacaaugcuucugucaauauguauauuaucauggaguauaaaaaugguaagaacuagaaucucuuaaaauaaguauuauaugaccaaguugaaucucaucaggucugcuuucucuaauuaaauaauuuuccaauuuguuaugaacauuucuguccaguaggcucuacauaguuuugaauuaugauucaguuguacugcacaucaguuuuacaaguagcuuuaauaucuacuaugaaaaguuuaaagugauauugguaucuuuuagaaccaaauuugcuacauaaauguaagcauuauuauaauggugucuugccuuuuuuuuuagguggcucuaacuaacuacaccuuugaaaaugugagcuuucauguucuucaucagcguuuuccccucuuuaccuuucgagucuugucagacugguuugauaacaagacagaucuauacagguacuguucuauaacucugaagaagguaauauaaaaucaucauugagauguaauuuauauguaauaaaaugcacacauuuaaaguguauuguucaggccaguugcgguggcuuacgccuguaauccuagcacauugggaggccgaggcgggcacaucaccugacaucaggaguucgagaccagccuggccaacauggugaaaccccaucucuacuaaaaauacaaaaauuggccagguguggugaugcaugccuguaaucccagcuacucaggaggcuaaggcaggagaaucacuugaacccaggaggcagagguugcagugagccgagaucgugccacugcacuccagccugggcgacagagugagacucuaucucaaaaaauauauaaauaaauaaaguguauuauuguucaaugacuuugaaaaaugcauuuaucuuguacucauuacuccaaucaagauaaggagcauaucucacacccagaagauucccuucuacagcuuugcagucaaccuacccaucccuaaucaucuagauaauuacuaauuggauuucuauuacuguagauuaguuuugccaauuauagaacuucauauuaauggaaauauucauaaucuaucuuggcuuugaagaaacucagaaaacauaguauguauuucuguugcauaaauaguuuguucauucuuauuauuaaauaguauucaauuauaugaauauaacuuacccacccaccuguugauggacauuuggguuguuuccaguuugaggcuauuaugaauaaaacugcaauaaagauuugcauaugagucagcaugugaacauacauuuucauaucucuuaggaguagaauuacugggucauauggcuguuguguguuaacauuuuaagaaacuuaaucuguuuucuuuggcaagucuguuggcaaaaaauuaucuuagcccuuguuuauaugaagaugucuuuauuucacccuuauuuuugaaggauaauuucucagucucaguugcguuuuuuucuuucaccacucuaaagauuuuguucccuuccagccucucauuuugcugaugagaagucaacaguuauucucauuuuuccaguauuugugauucauuuucuuuccaaagucagauuuaaugagugguugaccgaugucacuuuuuacucucugcaagguuuauaguggaggcagggggaguuucucaguucuccugucuaaccucagucuuuggaucuuccuguucuuuuuuuuuuuuuugagacagagucucgcucugucacccaggcuggagugcaguggcacagucucugcucacugcaagcuccgccucccgaguucacgccauucuccugccucagccucccgaguaccugggacuacaggcgcccgccacgacaacuggcuaauuuuuuguauuuuuaguagagacgggguuucaccauguuagccaggaugggcucgaucuccugaccucaugauccgcccgccucggccucccaaagugcugggauuacaggcaugagccaccgugcccggccuggaucuuccuauucuucugggguuugcucagcacuccugcucuucccacagaggcaacagaccucugcuuuguaccacuggcagguccugggcccaaguaagcuuccugacccucccccuggggcagauagcauuuucuucuacuccuuucucagugauacuguuccuuugccuggaaucuaugacaggaaguuuucuugccccuuuuccaguugcuuguuauuuaguucaaagccuaugguuggaacaggcaaguauaccaggcccaagguguuuccuaagcuccuccaacuugauguaggauucaaucuccaaacucugucgucuguacauauugucaguauuugguuuuaaguuuuaucuagaguaggccuuucucuagggcaaaggccucuguuuuuuucugggcucacaacugaaugccaagguuguuaacaagggggugaugaggucucuccacucuggcauuggugagccuccaaccccagcacuaucugaccauuucugcccacacucaacccccagcgagcugcucuuuauucagccucaugugguuucauccuguucguuuucgggacagccuugagcuaucacucauaaggaauccagcuauacuucugaccccccccaacuccugccacuugcacagcucccuuucucuccugugcuccgucccacagacucgagcugugagcugccuaaaugaacucugagcuguucaucuuuggcuuaguaggacagccuugcucuguguagacuguggcacacugcacugugucuaggaaaaguccuuaaauuaaugugucuaauuuuuuaaaugagugaaucuguacuuacugaauuguaaggcuguaugguggugaggauggaaaaaguauagcuuugaaaacaacuugauaauauuuggggaaacugcuuccugagcaugucaucgcauauuccaaucacuuuugaggaaucucagggaagugaagugaaguaacagaaagcacuuagcuucuaucaaagccuuauagaaauagaagcugaggcgaaguuggcugagugcaguggcucacgccuguaauuucagugcuuuggaaugccgaggcgggcggaucaccugaggucaggaguucgagaccagccuggccaauguggugaaaccccaucucuauuaaaaauacaaaaaauuagccgggcaugguggugcacaccuguaaucccagcuacucgggaggcugaggcaugaaaaucacuugaacccgggagcaggagucagagguugcagugacuaagaucacgccacugcgcuccacuccagucugggcgacacagcaagacuccaucucaaaaaaaaaaaaaaagcugaggagaaauuauacaccaauaaauaaaacuugauauuuaacuuaacauugaaaacuauauucagugguuuguuuauaagccccggaaucucuaaauacauguuuuaccaccuuuaauuagguauuaucuaggaugauaacuguuuuugacaaguaaaauagaggacuggaacuaaaauuguacagaagggacuuagacuagacauuagaccauuuaugucaaauggauuauguuauaugagaagaccaugcacucuuugaguagucuuggaaauaucagacaacuucauucuuaaauuuaagugaauacuuaaauuuaaaugaguacauucuuaacuuuaagugaauacaaaaaaauaagucugacuuacuuuuuugguagguaugguaaccccuuuugauuuccauuugcuuucuacaguguuuuaaggacauacauauauauuguaaaucgacuuagaaugagaagaacuugcuagucaaggauuucuuguguuaaaccuguaaaacacaaagguacccuaauuuuuuuuaauaaacccagauuuuugucuccuggaagccccagauuuauaugaaugaauuauguucccaacauuuuauuguuucaagcuuagaacacauuuuuucauaaaauaaugucuugugauuagauuccuaagccagccuauaaaacuuuuccuaaucucuaauauuacuaaucuauauaauuccuaauaccagcaugauuuuaucugucauucaaggaauaguuauuaaauacuauuccagauuccaguuucugagcuaggagguauauccugggagcagaguucuguagcugaagaagauaauauaagaaauuuucuuuucuauuugcugaguauagagccaguccacagaaaaacuucagaauaagugaauuuuguacucgggauucuccugucuccuuuuuugucaccuucuccccagaugaacuaucuugaaaaauauccaugccuucaggaugcucuaaguucccauuucagcacuacccaagccuauccugaguagcaugugcuuuauaaguauguuucccuuccuccuuuccggaucaaaacuuguauuuauuaccguuaaguuugacaaagcauuaggaggauggcauaauucuuuaacaacaauuuaaaaaacuaacaaaagucaaucuucuccuuuaaccauaaguaaaggccacaauuacucuuucucuuuuauguuauaugguuagucagauaggacccgaaaguagaaaggaugaugauuuuauuucggaaagaucacuuuuuuaaauuaaaaagucuaaaauacauuuuuuuaaauuagccauucaaaguauuuuuuauauucaugccuauaggucagcagauuuagaucagaaaacagcaguuguuaccugcuggauaaacuguauaagauaaaaugucccuuguuaaauuaaccuuuaguuaugaaagauaagaugcaucuaauuuguuuauauuacuugguuaccagucaguggagaggaauacauuuagugugaaaugaauaagcauucauuucacaaaauggucuaccauuuuuguuagugaggaaaugaguacuuugcugugaugacagaaauuuaacaagacaguuacucauuuauaauguauuaucuuguuuucuuuucaucauguuuucguuuauuuggccaaaaucucagguucuaguguacuagguuuguaaacuaggauggauuagucuuacaguaauccucaguuuucuuaucuauaauagagagauguuaauauauucuaccucaugaagugaaguaagaauuaaaugagauaguaugagucuucaacacacagaaggcucucaauaaauguuaauuaauugguacgucuuucuuuucaggauagagaauuagauucugaaugaaauggggaaauaguaauuaccauaauuaucauaauaauagcagcaaagguuauuaaguuuuugcuuuugccuaacaccuuacaacaguuucaccuuacaacagugaaaccacuguuucacacauacagaaacugaaaacuagagaguuaaaugauuugccuagggucacguagcagcuugcaguagagccacaauuugaaccuacgacuaucucacuccaaagucugugcugucaaccaauaugugaaaaucucuuagacuauauucuucaaaaugugaaauaaaccauuuccacuuuuuaaaaagaguuaguuauauguagcauaguaaaaauauuucuuuugaaauauacuauuauauccauuuauuuaaguucuaauagacuauacugccuaaaaaaauagaguugaucuuagucaaaucacuuaaaucaggaaccuuuaagauucaguuuaaucaguuuuguauauaaaguauuagacuuacuuucaccauuuuugcccaaaaacaaacuucuguacuucauuaaauaacaucaacaaaaguaaaaagcuaacaucaaccuaggaaaaccauuuucaccguaacaguuauguauauuaacuauauuauauacuuuuaaauuaguaaaaaaaaggguaaaagacaugaacaauuaucaaaggaaaaaaauccugaaauauucaaauguuuaccuuacuaaaggaauucuuaaucugcugauuauguuucuuaauuguaccaugaauuacaaaaaccuauuggcaagaucagucuuauuuaaaaaaaaaaaaaaaaaaaaaaaaaaaaaaaaaaaaaaaaggacuuuagacuggaguaaacaaagaaaauaaaccaguauguuuuaaaacacauuuuccgaaacaaauuaucgucaacauacuucaauugguaacucuucuccugaaucaccaccuacagauuucaaggaaauauucgugcccagucagcaugauuaucuguugaaacagauucuuauauauguguaauacauaccuuuuuaaaguuuucuguuaaaccuguguugguugagacuuaacacuuauuuuucucauguuuuacaaaucucagcaaaaugcuugugugcugccuggcauuuucagaaauuauguuggugucucacuauuuugguaucucauuuggcauguuucuccaggucagcucucuguccauauguugagagggcaaaguguaaauguuaucuccuuuuucugcacucuccauagauaaauccacacauccugaaggaguggugagccauuaaauccauuuuguucuauuuuaaagggacugaucugauuuguacauaaugcauuauuucagauuuacacuuugcaguuuuguauuguugagggguuacauuaaugaucuaaaacaaaacaaugcagauuaaaauguaucauuuuuugucuaucaaacucauaauaauuuuaaaaacuauaaucuucauuguuaacaaauauacaaggaaacaagcacuuuaucaucacuaguaugaauauaaauuauuaaaaccuuucuggaaagcaguguauuguuagguauugaaaacugaccaaaucuaggaauuuauuuuaaggaauuauuuaaucaucuguauaaagacuuagcuuuaaaaauguucaucauaccauugcuuacaguaauaaaagauauucaguaaguguuucgauuaaauauguuaucauuauacaauagcacgcucgauagcuacaaaacauaaauauggggagucaguauauuaaguuaaaaauguaaauuaugaaacaaaauuucuguuucuuaaacauuuauagaguuuaggauucuuucauguuugccuaauguuuuaacagcuuuauucagauauaauuuguauaucauacaauuuacccauuuaaaguauauaauucacuggcuuucaguauauucagaguuguacaacaucaucacaguaaguuuuauacuauuuuaauuacucuaaauggaaauccugcaucaccuagccaccacucuucaaccuuucaucacuccuaucacccccuccaccagaguccccccacccucuaccucuugccuuagacaaccgcugaucuauuuucuguccccauagauuuauaucuuaaguccccugacagcuuuuuaauucucuaauuuucccaaauaaauuugacuguccucaacauuucacaugaacagaaucgugcaauauguaaucuuuuguggcuggcuucuuuuagcauaaugcuguccagaauuguccauguuauagcaucuuucaguauuucuuuuauugcugaauaauacuguaucguauggauauauacugcauuuuauuucuucaucaguugauagacauuuugguuguuuccacuuugggcuacuaugauuaauacuguaaugaacauugauauauaguuuuuuguguagauacccucuuucauuccuuuuggauauguaccuaggaguagaauuuuugguggauuauaugguaacucuauguuuaacuguuugaggaacugccaaauuaucuucccaagcaacuacucuauuuuacguucccaccagcaguauaugaggauuccaaugucucuacuuucuugguaauauacuguuauuaucuuuuuuauaauaggguauuuuuuucuuccuucacaugcauuuucuaguuuuucuauuaagcauuagucaugugucugaggaaaaggucuuuaaacacauuuauuagacaauuaugugacuauauuguucuaaaagcaauauaauuaaagauuacaauauaugugaaccuuaaucuucaaaugaauaaauuuuauuccuuauaguauacuucugggucauuuuuacaucuuauaauauuaaaauucuuuuuauggauuugcugaggguuuuauuguuuguuuucuuaagaagguaagguaaagagguuaaauuuaagguuuaaacugaaaaacagaacuuuuauauuuuaacaaaaaauacuuauugaaauauguuuaacccauguauuaucucacuaaaauuuauguuccugauuuuucuaaaucuucaccaaauuacucuuuuuuuuuugccaugaacauagugcauguuuuuauuuuagacuuacaaugauaacccagacccuucauguucuuuaaaaaucuauagauaugauaaauaauuauugcauaaucagcagcuguaucuuaaaggagaauguuaauuuucuauaauaagaauagaaaaaaaaagaauagagcaacaucaagcaaaauauugaaaaagagugauccuuaaucuuaccaccuaaucacaaguacuauuuuaaauuuuguguaucuuuacugguuuucaugcccuugaaauaccuaaaauuuucuaauguuuaauuccuuagcauacuuugcuuaaaggcucauaucauuacucuuuccuuaaguaaccucacuuuuagcauguagauuuuuggcaggaaaaaaaguacuguuuucaaguguccaaauuuuucccugauguucauaauguggauucuuuuuuaacagauggaaaaugguugaucauuauguuagccguguccguggaaaucuccaaauguuagaacagcuggaccugauugggaaaaccagugagauggcuagacuuuuuggcauucaguuuuuacauguacugacaagggguucacaggugggaaaucaguuuucuugcagacuugaaaguucuguaugagugauacacuuuugugauguuugaagugauuugacuuuuuaaacuuucuguuugguaccaacuaaucaauagcuggguaauuaaaucuugucauuuuauucucuuucuaugccaacuuuccggccacugccaaguuuuuuaugguauuaagaaaauaaauguccaugcccuuaaggauauaauauuccugaauauuguuacugugauuaaagaugucccuuaaaacuagagaagcaacaaagaaaguaccuuucuuuuguuuuacauuuuuaauuuuggcuuguuaaaacuucccauagauaauuuuaauauaaaaauaaaaagcuugaaaaucaauauaaguggacuauguaacuuuuuuaaauguuauaaaaaaagaaaccuaagaagccauuuaauucauaucuaaguaauuucccaaggauauaaugagagauuuuuacuaaacgccuugcugaaaaugauuuuauauauucaacaaauauguauuugaauaccuguaguuuguuaagcacggugguaggcaucagcgauaccauauuaaaacacucagauuccuuaacguuguaaaauccuuacuuauuuuaauuaccugugucuauaacauaaucaaccaguucaguaaauauagcaaaaauagaguuccaacuacguuuguuuuaccuguuuauuucauuuaauugcuuauaagcuauuuauuuuauuuauacccaucaaauuuaacaacuguuugagcuagucuguaauaaaaggcaaaaauaccuuaaaaccucaugagaauacuucagugaacccaggcugguucuugugaguaauuuuuuuucuaauaccccaagccuucuaauaguuauuauuagaaacaaacauaccaguaauugcuugauucaguuuugcuagggaccaguaauaagcugauuacuauucaguucuuuuuuuuuauuuuuuaauuauuuccacaacaaaagccacauucaauacuuuauaauucuauaaucauuuuguuucuuucuuugaaaaacugggauaacauuuucuaucuuaagucuccugacagcuuuuuaauucucuaauuuucccaaauaaauuucuccaggauuaucaaccaacuucuuaaacgaaauugucaaacuauacagcugucuguccuacaguuuuuuauuaugguguagcuguauuuaaauacaaagagggccaggugcaguggcucacaccuguaaucccagcaguuuaggaggccaaggcaggggaucacuugaggucaggaguucaagaccaccuuggccaacaugaugaaaccccaucucuacuaaaaauacaaaaauuagcugggcaugauggcacaagccuguuaucccagcuacuugggaggcugagacaggagaaucacuugaacccuggagguggagguugcagugagccgagauuuugccauugcacucuagccuggacaacagagcgagacuucaucucaaaauaaauaaguaaauaauaaaaauaaaaagagaucuaauugcaucugucuuuuaaaauugacuuaucuuuuaaguuauuugacauguuuuauaguuuuuauaaaagucguaggaauaggaaaaggauuuacauauaucccuuuucgcaucugaaagcugacuaaauaaccaguauuacaggcuggucauaguggcucacgccuauaaucccagcacuuugggaggcugaggugggcggaucaccugaggucaggaguucgagaccagccuggcuaacauggugaaacccuguuucuacuaaaaauacaaaaaauuagcuggacaugguggcgcaugccuguaaucccagcuacucgggaggcugagguaggagaaucgcuugaaccugggaggcggagguugcagugagccgcaaucgugccaucguacuccagcuugggcaacaagagcgaaacacugucucaaaaaaaaaaaaaagucauacaaucuuauucugaaaagcagauuauccucaaaugauuauauauucaaaugaccaauauauuuaacuguguuucuucucuucucaccucccuuucucccugcaguaccguguggaaucaaugauguugcguauugcuaaaccaaugaacuauauuccugugacaccuaguguucagcaaagaucccagaugagagccccacaguguguuccucuaauuauggagccugaaucccgcuucuauagcaacucuguucucguuuuggauuuccaaucacuuuauccuucuauugugauugcauauaacuacugcuuuuccaccugccuuggccauguggagaacuugggaaaguaagguuuuuuucacauuuacaauaauauuguugugcuuuguacuucuuacuaaaauuagacacuuucugagugucucuuugcucuggacaccuucccuaugagcaagauaaauggacuguaucccagcuaauccauucauuauaguugucuuaccaauugacauggaucaccauaugauuaauccagcuucauggauggaugacucaugaagaggauugggaauaggucagccuugcaacuguuucacuccauauguaacuauagucucuuuuaaaaugaaaguuaaauuguugauguaaauuaccuuucaguggaacaguuugaggauuaugaucuuauaacuucaacuagaccuccucuuuauuuuucuuauaaauaguccaggauuuuaaaaauuaaauguuagguuuuauuaauuaauguaaauuaaauuuuauaaacugauaauaacauuuuaaauucucaaaggauuagauacuuuucuuaaauuguaggaaauaacggagucuuccuuuuuauugauuuuugcguauuugagaucauguguugguuuuaguauauccuauauuccuucauagaaagcaucuguggaaauuauauugguaauccugucuuuuuauuaaaaacaggaauuuggaaaauuuacaagauuuacaguauuucuauuuaagguuuaaauuauucuuuaaauauauucacaaggauguuaaaauaaauuuuuauuuaaguaauuuaguauaagaugauugggcuggacgugguggcucacaccuguaaucccagcacuuugggaggccaaggcgggcagaucaugagguuaggagaucgagaccauccuggcuaacaugaggaaacccugucucuacuaaaaaugcaaaaaauuagccggguaugguggcaggcaccuguagucccagcuacucgggaggcugaggcaggagaauggcaugaacccgggaggcggagcuugcagugagccgagaucgcgccacugcacuccagccugggugacagagcgagacuccaucucaaaaaauaauaauaauaaaauaaauaagaugaucagauguugaguugaaauuugguauuucaguauagauuuuacccauaaauuuuaggauagugccauuuaagaaauguuucuuguaauaaauuaugaauauuugaaaaacuauuuugguaaugaggcaaauaaacauauuacuaaguacaugaauucuuguuuagauguuugaaaaugaauuucuaauggaguuagaaagauuuuuuaaauugcguaaaaucucuguucuaugauuugaggaaguauuugcuuaauguucucuuucuuaacagguaugaugaguucaaauuuggcuguaccucucugagaguaccuccagauuuacuuuaccaaguuaggcaugauaucacagugucccccaauggaguagcuuuugucaagguaauacucucuuguaaaugaaagauaacaacuauggcuuaacuuuuggagagcugauaaugguuuagauauuguuggcacauaauagaaaacaaaaacaccgaguuugcuugaauauuuuaucucaaaaagucaaagauaugagaaucuucuaagaaaucacuucaggaacaaaccagucaccuuguuuuucuugaauuuagguuuuaaaucuuuaaauuguuaaauuuuaguuaacgaaauauugaaagaaauaaacguaugcuuauacuuucugcccuuuauuagaaucaggcagacuuaaauggcaacuuaauggucaaaauauauuaccuacaaagauuuaaauuguuuuaauguguagaugcuacuaguuguucuucuacauuauuuuaaauuaagacuaucuuagaauuaaugauacucuaauaggcuuauuguuuauauuuuucagaagauauccaaacuaaaaauagggucccuuuuuucucuccuguaucuccccucaaaagagacagaggaaaacuuuacaaauuaaagacaaauaagagacaucuuaaaagaagauuauauugccucuuaaaugccaacuuuauuccuuucuuuucuauuuucuuagcagugagucuguacuagaaucaugagacaguagagugguugaugguagaguggaccccaccagcccucaaauucauucugguguacuauaucaaaaguggcaucauucucuaccaguaagagggaauacuaaacuaaaauuagccauguagaugaagaaaauuuuaaccaaagaguucaugguauguuucuuuuuggaaaauuuuaaaauguaguauuucuaaggacugauguagaugagaucuacuuggagaaauggaaacagauuuuuuuuuauuaaaugggucucuauauaaaaaucaguuuuccagucacauuucugcgaauuuggucccuguucuuuuuaucuuaugucuuaaaacauuauggcugcuucaaaauguacaccaaaugaauuagagguuagaauauguuccauugucgcauaucuagcagcuuauuaucucccuuuaacagcuuuuuuuuaaacuugcaucuacuuuuggacccaguguguaaagcuuaaugaaaauaagauuuuuuaaauauucaggugugugaauauccuauaccugagauuuuaauuguuaggucugacaugcauuaccuugcacgugucugugaaucaucaucaaaguuaauacuguuuugugguuuucauuccuacuggaguucucauaaauucucccuagucuugaugaauacaaaugauuuuuuuuuuggcaucaacaaauuuuaucaccucacuauucauccccucuuccagauugcuaauaaauguaggccggaggggauggcuuaguggucuaagcaucagauuugaaauaccuagagucccuggaacugcagguuugaaugucagcagagucaacccagcucaucauucuuccaagguagauaaauggaguuccaugcagauuucuguguggggucauuaggaugagaucuuuaaaaacugaguugguuaugagugauacaagucccaugugucauuuugaaagaauggggguuucugucaaaguuucgaacaaaauuucccucugaaguuguuguauggucacuuaugcacuaguugacauccuccucccuggaggucucugaacucacauagaagugcucuguuagauuuauaaacauugcaggaaccauuuaggagaaauccucuuccaagaaauaaaaugugaugauuuuauauugacggccacuaauacuauggucacucuguuguuagcauguuucaauuccugacaguuggccauuauuauguuuuaugcuuccuucuuaauuauguaaaucuauaauguuugagggguuuuaaacauuuuuuuucuuuaugauagccuucaguaagaaaagguguacuaccaagaaugcuugaagaaauuuugaagacuagauuuauggugaagcagucaaugaaggcuuacaagcaagacagagcccugucacgaaugcuugaugcgcgucaguugggacuuaagcugauagcaaaugucacauuuggcuauacaucugcuaauuuuucugggagaaugccaugcauugagguaagugauacaaaucuguaguuuuuucaaaagagacuaaaauacagugaggcacgguggcacucaccuguauucccaguuacuuuggaagcuaagauguggugcgggggucuucagcccagaguugaauccugccuggacaacauagugagaccucaucucuuuuuuaaaagaaaaaaaaaaaaaaaaggccaggcaugguggcucacgccuguaaucccaacacuuugggaggccaaggcaggcggaucacaugaggucaggagucgcgaccagcguggucaacagggugaaaccccaucucuacuaaaaacacaaaaauaagcuaggugugguggugggcaccuguaaucccaguuacucaagaggccgaggcaggauaauugcuugaacccaggaggcagagguugcagugagccaagaucgcgccauugcacuccagccugggcgacagaaugagacuuggucucaaaaaaguggcucacaccuguaaccccaacacuuugggaggccaaggcauguggauuacuugagcucaggaguuugagaccagccugggcaacauggugaaaucccaucucuaaccaaaaaugcaaaaacuagccgggcauaguguuaugugccuguggucccaguuacuugggaagcugagaugggaggaucacuagagcccaggaagucaagguugcagugagccaugauugcaccacugcauuccacccuggguaacagaacgagacccugucucaaaaaaaagagacuaaagcagcauuaaaugaaugccuguucauucaagcauuucauuuuguuuuaaaacuuuaaaccauuucauuucuaugacauaacaucaguuuuucucaugccaagccuaaauauauauauauucuuggggaucugugacuuuucucuauaagauaccucugugucuuuauuccaaugauaauuuuagaaauuagcauacaccuauuucugcaugaucuucauaacuauacuguaacuuucuauuagcauaaaauuucagugccaccuuuguagcaguuuuuacaacagccuugguacugcauaauucauuuuauguauugacaagagaucugauuauaguuauguuggcuuguccaaaugucacaauuagccagguguggugucucacacuugugaucccaacucaggaggcugaggugggaggauugcuugagcccaagaguucaagacuagccuaagcaacauagugagcccuugccucuauuaauacacaaaauuaaaaacuaaaaaaauuuuuuaagucagaauaaacaacagucauuccauauuuacuaguauaccaguagauauaaagcacaaccuuuuuugcaaugauagugacaguugaaagacauuuuucauagaaugacuuaauuucauauuuacuaaguuaagguguuuauuugauacaaauacaauauagugugacaggguaauauaaauaauauacuagugagugagaaaagaacagaguaacuuguuauauugugaucuuuucaugccaaaugaaggucagagaacauugugguauaucauauuugcauuaguucaguaagagaaaagcagggaaagcauaaagucuucacacagcucacaguaggcaaaaugaacuccaaaaacaugagcaaggcaguaguggcauauucacauugaaagcagcaaaauaccaucuauaguggaaacuuaauauuguuaacuugaauauuuugguacaguaauaugauuuugugcuggauaaauuuuuuuauaguugcacuguaaaggcuguaagcaauaaaaguuuguaucuagguuuauauuuguauacuuuuagguaagauaaaaaauacuuugucaguccuggggguucauauuaauacauuugaaaaccacugaucuauaugaucuagcaggaaaaaaaaaauggaaaugauauuacuaauguaaaaccaaaagcuauccuuuuuuuuuuuuuuuugaaacagcgucuugcuuuaucacccaggcuagagugcaguggcuuaaccacggcucacugcagccucgaccucccaggcucaagcaauccucccaccucugccuccaaguagcugggacuacaggugcuuaccucuaugcccaguuaaguuuucuauuuuuuguagagaugggguuucgcccugcugcccaggcuggucuugaauuccugggcucaagugauucuccugccuuggcagggauuacaggugugagcgaccaugcuugucccaaauccuuucuuaggggccauuuccacauuucccuaauuucuucccugccucucgguuuuaaaaguguuuauuaauguauuuuaguaauaaugcagaaauuauacuauuuuuaaaauauguaaauacuguaacuuuagaauaaccagaauuugguaggauuuuugaacuagcaguggaaguuuaggaauaggguuucaccagggaguacguugcugcuuugcacggugaacucagacugccaagcaguaccugcuuccuugacccuggucuucucagcuauccucagauuaaugacugcaagcaugcauuugaccccucaucauaugcuaacuucgcaacaguacaauguuaacuucuaggugaaaucaugaguggaaaaagcagcuaacaucacagaaagagccucucaugaauaagugaaaaguuagcaccaauagaguaaaaauggaagauaucagccacuuuuuuuuuuuuuaaagggcagauggcuucauucuuuuuuauggcuguaugauauuccauuguacacauaauauggcauuuccuuuauccauucacucguugauggacacuuagguuguuuccauaucuuggcuauugugaauagugcuacaauaaauaugggagugcagauaucaauucaauguaccgauuuccauuuuuuuuuuugggggggguauauacccagcagugggauaucuggaucauauggcaguucuauuuuuagauuuuugcagcauccuauauuguucuacauaguggcucuacuaauuuacauucccacuacaguggguuccccuuucuccacauccuugccagcauucauuauugccuguuuuuuggauaaaagccauuuuagcuggggugagaagauaucucauuauaauuuugauuugcauuucucuaauuaguaauguuagucauuuguaugucaucuuuugagaaaugucuauucagaccuuuugugcauuuuuaaucgaauuauuuguuuuuuuccuacugaguuguuugaguuccuuacauauucugguuauuaaucccauguuagauggguaguuugcaaauaauuucucccauucuauggguugucucuucacuuuguugauuauuuccuuuacugugcagaagcuuuuuagcuuuaugugaucccauuuguccaguaaucagcccuaaaaaagaauaaaaucccgucauuugcaaaacauggauggaacugaaggacauuaugcuaagugaaauaagccagacagagaaagacaaauaucacacauucucacucuuauggaaacuaaaaaaaauaaaggaacucauggagauagagaguagaaugaugguugccagaggcaaugagguggggagggagggagauaaaguagaaaugauuaaugaguacaaaaauacaauuagaaugaauaaaauauaguauuuaguagcacaguaacuauagugaacagcaacuuauuguauauuuuuaaauaacuaaaagaauggaauugaaaugucuaacacaaauaaaugauaaaugcuugaggugauggauaucccaguuacccugauuugaucauuacacauugucugccuguguacaucauauguaccgcauauacguauauauacaacaguuauguauccagaauaauuaaaagcuuuuaaaagcgggaggcaaauggauuacugacuguggucuccugcuuuccuucagagaacacacaaucaaaaaaguacuagaucuggacuaucauagagaaagaugagacuuuguaagcauauaaggagaauauggagaauaaauaaauguagcuaauaguuguagguuaaugucucugucucaguaccaucauagagaaagacaagacuugguaagcaaaaauuccuaugaagagaauauggagaauaaaguagcuaauaguggagguuaaugucucugucucaguuggacuuacuucauaaauuaaaauuuuuauauguugacaguuuucuacuaaauuauuggucauucauauuuaugauaaagguauauuugugccuuuuaaaaaauugucugaacuuuauuucuuccuuuuuaugucuuuucagggaauuaauuuuuacuuaaaacauuuguuuuuauuaagacuuuugaggccaggugcaguggcucacgccuguaaucccagcacuuugggaggccaaggcggguggaucacgaggucaggagaccaagaccauccuggcuaaugcggugaaaccccgucuuuacuaaaaauacaaaaaauuagccgggcguaguggcgggugccuguagucccagcuacuugggaggcugaggcaggagaauggcgugaacccgggagguagagguugcagugagccgagauugcgccacuguacuccagccugggcgacagagugagacuccaucucaaaaaaaaaaaaagacuuuugagcauccccaaucauggccuaaauugugaaaccauuucuuuuccucuuuuaaauccucucuuagcccuuuaaugaaguaaugcuuuucagguuaggaaccuuggcacaaaguagcagaaucuguuaauuuaauuacuucuccuucccucuuccgccucccccucacucuagugcugcugaauucuucuuauuauguggucuucagggguaacugcagaguucugacucuuugggguauaacuuaaaugcgccagaguaagagcauuaggcagacauuuaagaccacuauguauauguucgaguauauacuuguaaguauacaucucagaaguauauuugacuuugacacuaaaauggcuugcuuaugcagcucuuuuuccucacauauuuaaaaguugaccuuguuugaaaguggcaguagguaacagaacauuuuauucaauuugaguuuccauuagauaacaugauuuuuguaauguauuaaguuacaguuuacauucucaagauuuucugauguacuagaggucucagcagaauucauaaucuuaauuuaaaaccuaaggccaggcaugguggcuuacaccuguaauuacaacacuuugggaggcugaggcggguggaucauuugaggccaggaguuccagaccagccuggccaucauggcaaaacccugucuacuaaaaauacgaaaaauagcugggcaugguggcacacuccuguaaucccagcuauucgggagacugaagcacgagaauugcuugaacccaggaggcagagguugcagugagccaagcucacaccacugcacuccagccugggugacagaacgagacucugucucaaaauaaguaaauaaaucagaauaaauaaauaaauaaaucccaacucguuucuacuacuaguuuuauuauuuauuccuuuguucauguacuuaauauguccuuuguaaugcaauuuuaaauagccuuuuaaauacuauucaauccuauauuuaguaauucaaauuuuacaguaaagggagaaggaugauuauugcuauuguuugcuucuuaacaaaaaaaaaugugcaguuugcguuuuaaaauugcaaaaggaaugcuccauuuauguuuuauguugaauggcaauuuuucccacucuuagcuuuaaugaguuuaauaaauaaaacagcauuguuauauagucuccuuaauuuacuuaacuguaaaaucucauuagcaugcuucucauauuugucaaggcccagcaucuuuuuguuuuguaaacucaugcuguggucacuguuaaaauucacuaaucaccaaugaguaaaaccuuccuagauauauaucuaccuauuuaauuuaaauugaacaguuuuaauauauuucccaucauauaauuagauacauuuuucuuuguauaacuagugacaagauugaaguucagcauuaacuuuaaugauauugaaagacauuaucaucaacacuucaacagaaaaauuuugagagauacacguacauauacucaugcacccacaaagagugcuuuucugccugaugaguuguaagggcacauaagaaaguugaauaggucgggcacgguggcucacgccuauaaucccaguacuuugggaggccgagguggguggaucacgaaaucaggaguucaagacuagccuggccaauauggugaaaccccaucucuacuaaaaaauacaaaaauucucugggugugguggcgugcgccuauagucccagcuacucaggaggcugaggcaggagaaucgcuugaacccaggaggcagagguugcagugagccaagauugugccacugcacucuagccugggugacagagugagacuccucaaaaaaaaaaaaaaaguucuugaauaaagaaggauuauucuuccaagaauccaacguagcugaguaccuuguaacaagugcaguccacuuacuguuauacucaaagacaaguuuguauauugauugguucuuucaaauucuucaccucaguuucuucuugaguacuuguagaaagaaugaugauacugauggcuauuuugauuucuuuuuuacguucuuuucucguuucauuucuggaaauauuuaguaauuaaauguauuauauguuaaagucuguuaacuuauacugagcuauguuaagaaauuauuuccaauguguuuguaccaacagguuggcgauaguauuguucacaaagccagagagaccuuggaacgagcuauuaaacuggugaaugauaccaagaaauggggggcuaggguuguauauggcgauacugacagguaauggguuuuugguuuuguaguugucuuuugcaucucucuagaucuucauuucaguguuuaaaauggcuuaagggaaucuuuucuaaaaacagaguucugucugaguccuuuccaguccuuacgaucucaugaucagaguuaacacagauccugauuuaccagauaggaucguaagagacaguuuguguccugagccacaaacugaagauaccuauggcuucccuccagguagcucuaagccaaguagauagugaucuguaaacuaacuguguacacaggagucuaguuuauuuaaagaaacuacuuuuaaugugaauaauuccucuaauauagcuguaacucucugaauuuaaguguauaucuuaaaauaaacuguuuuugaaggacaauugccagaacugugaaugguuaacuuaccacucggccccagaauauguugaccuucuaagagaagugcauauaggcaaauacaguuuuccauuugauuccagaggguccacagacuuccucaagccuauuauuuauggauuggcaaauaaugugccugcauuugaaggcacguuauuaauaauguaaguuauuaacaccagcuugcaugcuuccugcuugcugugauauuuuucagguuucaguuauuuauguaacaucuuuuuugcauggcuuauugaaauucuucuagaauguaggcacuauucaaauuucuuacagugaaauuuuuuccauauuggggacguagagucacagugugaucaugcuaagagcacuugcuucaagaccucugaucucuuuacaguccaacagagcaauaggagauaaugcuucugaucauuaaauagcuuauaaguaaucuuugaacagcauuuaaucuuauccaguucuuuaaaauguucauacagacagcauaaucauauuaaugcugaaugagaccuugccuuauagagcagcuguuucauuaccagccgguggggauaguuucaaauuauccaggcccuaauuauccauauucucuccuguugcucaucaaaagccacuucuuaguuuggcuuugguuauuuuauuguucuaugaaacuacuucugcuggguauuccagcaaaauaagaguuacuaaaauaaguucuccacuuguuagcagaacuccuuaaaaaauauuuagggaaaaauguuaauccuuuaacuuacugauuuuaauucaggggcuauccauguuguugacaacacccagaagucagcaugauucugauuguaguuauauuauuuacccuuuaagaucuguaagaagucaagcuacaaaaaauaauagacucacagaaugucagagccggaagggauuuugauauuauuuaggccagcaguuuucauacuuggggagagcuuagaaugugccucaagugaugcuuauuaagaacaaauuucccuaggauaagaaauuuaagaucuugcaacuagucaguaaagagccauaaauugauauucaguguuuugauuccuagcugaugcuuucucucuacaucagauuuuauaguuauuauaugauuccagucaaaggaaauuuacuugcaaugucauuaaaacuuuugaucaccauucacuaccugauacauucaacaaacauuggccaggcgugcugccucauacuugaaauccuagcacuuugggaggccaaggcagguggauugcuugagcccagaaguuuuaagaccagcuugggcaacaaagugcaacccugucucuacaaaaaauuuaaaaauuagccggacaugguggugugcaccuguacuccuagcugcuugggaggcugugaggugggaagaucgcuugaacccaggaguucaaggcuguagucaaccaugaucaugccacugcacuccagccuggaugacagaaugagacccugucucaaaaacaagaaacccaaacguuuagugacaucuguaugagagcaauucacaacagugucacccuggcagaauacaaguaaguucuugaaggaggacacaaaaaagucaguaccauaguuuuuggccccacagugcccagaccuacccaacaauauuuuacuucuuaguaauuacuuugccuuguuaaauauaauuuaaauuuguguuuuuuuuuccuuggaaggacaauaaugauaaaagguugagaaacacugcucuugggauaauagguaaugccugguggagugaaaaagaguuccuggcugggcgcaguggcucaugccuguaaucccagcacuuugggaggccaaggcaggcagaucaccugaggucaggaguucgagaccagccugaccauauggagaacgccaucucuacuaaaaauacaaaauuagcugggcgugauggcgcaugccuguaaucccaguuacuugggaggcugaggcaggagaauagcuagaacccgggaggcagagguugcagugagccaagauugcgccauugcacuccagccugggcaacaagagcgaaacuccaucucaaaaaaaaaaggccaggugcaguggcucacaccuguaaucccugcacuuugggaggccgaggcagguggaucacuaaaaauuaaaaaaauuagcugggugugguggugcaugccuauaaucccagcuacucaggaggcugaggcaggagaaucacuugaacgcaggaauuggagguugcagugagccaaaaucgcgccacugcacuccagccugggcaacaagagcaaaacuccaucucagagaaaaaaaaaaaaaggaguucccaacugagagugaggagaccuggauucucuuucuagcuauacuccuagaugauggcauaaccauuaauaagucauuuugccucucugaggcuuaguugccucaucaucaaaaugaaggaaaucugauagacgaagguaaaugaccuuccaauuaugaugacauuccaauuaaacguuuaguuauuuuuaaauguacaauaaguuaucguugacuguaaucucucugcugugcuaucaaauacuaggucuuauucuaacuacauuuuuguacccauuaaccaucuccacuuccccacacauacacaguaccuuucccagccguggcaaccuagcagaaacuuuuuuuuuuuuuuccugagacagaaucucgcucugccgcccaggcuggaguccagugcaguggcgcaaucucagcucacugcaugcucugccucccagguucacgccauucuccugccucagccuccugaguagcugggacuacaggcaugcgccaccaugcccagcuaauuuuuguauuuuuaguagagaugggguuucacuauguuggccaggcuggucuugaacuccugaccucgugauccacccaccuuggccucccaaagugcugggauuacaggcaugagccaccgcacccagccaauaauaacuuuuaagauguaaaguauauguaccuuuauuucuuuaucauuuuuauggaauuauaauuuuuaacaacauguauaguauguaauaaaauauuaaaauauauaggcccaaguuaccagcuaucaugcccgucaagauauagaacacuuuuuaucacccuaaaaaguuaucuuauucucccuuuacagugaaucccucgcccucacuccaugcccuagacaaccacuuaucugauuuuuauuacuguagcuuaguuuugccuauuauaaaaccguacagaaauauguguaugugcacuuauuuuaaauguugcauacggccgggcgcgguggcucaugccuguaaucccagcacuuugggcagaucaccugaggucgggaguucgagaccagccugaccaacauggagaaaccccgucucuacuaaaaauacaaaauuagccgggcguggucgugcaugccuguaaucccagcuacucgggaagcugaggcaggagaaucgcuugacuugggaggcagagguugcggugagcugagaucacgccauugcacuccagccugggcaacaagagcaaaacuccaucucaaaaaacaaacaaaaaaaauguugcauucaucauugcaucugaacauuuuaagaauaaucuuucauaaaaaguuggcaguugcacaugaaguucaacauacacuuagcauaugacccagugauuccacuccuuuaugcuuaucuuagaaaaaagaaaaccuggccgggcacggucacaccuguaauccuagcacuuugggagguucaggcgggcagauggagaccauccuggcuaacacggugaaaccccgucucuacuaaaaauacaggcgggcagauggagaccauccuggcuaacacggugaaaccccgucucuacuaaaaauacaaaaaauuagccgggcguggugguaggccccuguagucccagcuacucaggaggcugaggcaggagaauggcgugaacucaggaguuggagcuugcagugagccgagaucgcgccacugcaccccagccugggugacagagcaagacuccgucucaaaaaaaaaaaagaaaaaagaaaaaggaaaaccuauguccacacaaaaacuuguguaugauucuucauuggagcuuuguucguaauaguccaaaacugcaaaauaucuaaacgucuaucagugagugauuggacaagcaaauugugguauauccauacaguggaauacugcucaacaauggaaaccaaccaguugcuguuauucugacaccauggaugaaucucaaaauaugcugagugaaagaagacagauauaaaagaguacauacuauauaguuucauuuauauaaaauuuuuauuuauuuacuuagagacagggucuaacuauauugcccaggccaucucaaacuccuggccucaagcaguccuccacuucagccuccagaguugcugggauuacaggcaaaagcuacuguacccagcucauuuauauaaaauucuuggaaaaaaccuauauaacagaaagcaagucuuauguauugaaccuggggccaggaauagacugaaaaauuauugugaaggaguacaaggagguugaggcgcagugagccaugauuaugccacugcacuccagccucgguaacagagugagacccugccucuuaaauaaaauaaaguaagguaguauugguauaaaugagcaucagauggccuauaaagaaacuaaaaaaaaccuucagaugguucgaaguauagccuagauugaaggucuaauuaacuaaggcauuuuuauucuaccuuagugaauguuaaaauuaauucagauugagacaauauuuauuuuaaagacuuuuaguagaguugaauaaacuacuuuuuuccuuucuuuuaauuuuucauauuaggcugucaggcaaguacugucuccauuauuagcagggacuuuuuccaaagaaaccauccaaaaugggauuuaaaaauccaguauaaaaacacuucagaaauaugagauugguuuauauggcuagaaaaaagaaucuuaaagucauguuucaagauaucauccauuuccacuauuuaaugucuuuucacuagaaauauaagugaagaugaacuuuauaaucuaucuuacuuaaauauuuauuaaccauuacuucuguugguggucagguuguagaauauacugaaauagaaaaaaagaugcccaaugcauuuuaucaguuauuuuugaguauauuuuguauugguauuuugaguauauuuuauauugguguuuuuuauucauguaauucaauauuauucauuaccaaguaacaugauccauuauagcauaugaaaagauuuacagauauacacaaaguguuuguaaugucuuuuuuguauaugauaugauuacagauguugauuuucuuccgugugucuuuuuauguuuucuaacuauuuuucaguuaacauacauuacagaauauaugucugucuuuuuuuuuucuuuuuuuuuuuugagacggagucuugcucugucacccagacuggagugcaauggcgcaaucucagcucacuguaaccucugccuccuggguucaagcgauucucccaccucagccucccaaguaacugggacuacaggcacacgccaccuccccuggcuaauuuuuguauuuuuuuaguagagacgggauuuugccauguuggccaggcuggucucaaaauccugaccucaggugauacacccgccucagccucccaaagugcugggauuacaggugugagccaccgcacccagccaaugucuuucuuuuuuaaguugagugauucuagccuuaagggaacuucucccauaucacaaguacaucuuccauuuucuuauaaucauauagucucuuauuuugugauguacuuaacuguguaccacagugguccccaaccuuuuuuuuuuuuuuuuagauggaguccuaagcugcagugcaguaguauaaucucaguucacugcaaccucugccucccaggcucaagcgauucuccugccucagccucccaaguugcugggauuauaggcacaugccaccaggccuggcuaauuuuuauauuuuaguagggaugggguuucaccauguuggucagacuggucucaaacuccugaccucagaugauccaccgccuuggccucccaaaaugcugggauuauaggcgugagccacugugccuggaccacagcaguccccaaccuuuuuagcaccagggaucgguuucauggaagacaauuuuuccgcagaccaggugguuuggagaugaaacuauuccaccucagaucaucaagcauuagauucucauaaggugcacacaaccuagauccuucacuugugcgcaguucacaauaggguucaugcuccuaugagaaucuaaugcugccacugaucugacugaucugccacugaucacagacugacugguaucagucuguagccuugggguuagugaccccuuguguaccauacaaagccuuaaauguccagggaugauccaggacuuucuugacuacugggauaucugagcugaucuguguguuagaaauauuggaugucuuaaaagauuuguaacaagauauaaguacauaaggaaaguaauaaaacaggagagcuuacauagaaagcaucuuaaagaguaaauaggagaaagggaguuuucuuuggcauuagacaagagucauagccaggaaaguuacucuugauaaaauuuuuguuauaaugacuuccucauuaccuuacuuuauuuuuaauccccuuaguauguuugugcuacugaaaggagccacuaaggagcagucuuuuaagauuggucaggaaauugccgaagcuguaacugcuaccaauccuaaaccagugaaauugaaguuugaaaagguaagaggaauguaauauuaguaauuacauauaaaauucauauaccuucuagagaccucugauuuguucaguacauuuucagaaucacuaacaguauacgggucuauuaaaguguuaaauuugggucacuggcucaugucuguaauccuggcacuucgggaggccaaagcaggaggguugcuugagaccaggaguuugagaucagccuggacaacauagccagaccccaucucuacaaaaauuaaaaaguuaaccaggcauaguggcacacgccuguagucccagcuguuccagaggcugaaguaggaggaccacuugagcccagguauucaagguuacagugaacugugauugaccggugcacuccagccuggggaacaaaguaagacccugucucuaaaaaaaaaaaaaaaaaaaguauuuaaauauuuucucuuuuguauaauuuucucaaaauuuguuuaguaauguauauauguaaggaaaugaaaacuuuguuccaguaacuauuauuguguaacagaucaccccaaacuuaaugguguaaaacagccagcauuucauucugcucacagauuuucuggcucaggaaugcagacagggugcaacuggaauggcuuuucucugcugcacgaugucuaguuccucagcugagaagacuguuagggguuagggguaacccaaccagcagcuaaggguugaaaccaucugaagcuugcuuaccaucaugucuggugguugaugcuggcuacuaguuggaacaucagccagaacaccuaccaguggccuuucaccggggcugcuuguucucccucacaacaugaggguuggguucuaggugugaacaucccaaagaaacacaaaagcugcuuuguuuuguaugacccaggcucaaaguaacacagugucccacgccucucuagauuuaaagggagugaacuuagaccccacuauuaauaggaagaaugucaaagucacauuguaagaagaccauguaggauggaagauauauucuuucuuugcaaaacaaagucuaccacaaggacuuugaacucuuuuucacuuaccuuuagauaucaaauauguauuucuuucuuucuguauaaaagauacuuagccuaggaacuguguggaauacgaagaagcauaagacacaguccugcccucuaagagccaguaaucuaaaaggaaagguuaggaauguauauaagcagucucuuguuguaaacauaacggaaagcaagaugagaauagcccgcuuaaacacugugagagcacaaaggaaaggaggaauugcguccuccugggcuggauagggagacuccauauaggaaguaacaaugaacuaugucuugaaaaauuguuagaauuucaguaggcagacauggggcugcaaucauucugcacagaagaaaauggcauguauggaauuggaaaaggacaguauggaaauacggggaagcaggagauagauccggaaaaauaaaguugagaccagacuguagacugucuugaaugccaagcuaaaguguuuauacuuuauucaguaaauaaacaaaacugguagcgcaagaaaaggagugagcaagugguaacaacuuaaagacaauucauuuugcucccacguguuauaucaugaauuuguugggcccaaagucauauauagaauuuuuuaaauaauugauacuugauuaaagaaagcacaaagacauaaaaauaaaacauucuugguggggggaaaugguuuuuaagaggcauuuuauuaauuuuaccacagguauauuugcccuguguuuuacaaacaaaaaagagguauguggguuacauguaugaaacacuggaucagaaggacccaguauuugaugcaaaaggaauagaaacagucagaagagauuccugcccugcuguuucuaagguaagguuuaucuaucuugucuucaucuguaagaaauaaguggcuaaagugucuggugaaaauguaacuacccuuaaacaugcaucuaggugaaggaacuauagccuauauaauuaauauaacuauaggaguaacuacaugaauuuugagaauuuuauuuguagugucuuauuuuguuuuuguuuguuugagacagggucucacuuugucacccaggcuggagugcaguaguccaauccuggcucacugcagccuugaccuccugagcucaagcaaucuuucugccucagccuccugaguagcuagaauuuuauuucuaauaaaaacaauuuauuugauuuuaguccuuaaguuucugacuuccucccauaccuuacguuuuaucaaaaauuacuaaaaagcaauacaugagaguuuccugccuauugccuggagaucauauaugucauaguguaacaacuccugaaagcagagcaggauaaacaagacaaacagacccggugugguggcucacgccuguaaucccagcacuuugggaggccaaggcaggcagaucacuugagaucaggaguucgagaccagccuggccaacguagugaaaccccaucucuacuagaaauacaaaaauuaucugggugugguggcgcaugccuguaaucccagcuacucgggagacugaggugugagaaucacuugaacccgggaggaggaggcugcagacagccaagaucacaacacugcacucagccugggcaagagagugagacuccaucaaaauaaaaagagagaaacauaauccauuccagauuaacugaacuuucauuuauuuggauuaucaaauacaaauuaggaagauuuccaaacaauuagcuauaaauuacucaaauuucucaaccauaauaacccugauauuuuuuggcuuuuucuuuauucgggccuagacuccuucuauagcaaaacaaaaauaaaugguauaaaugggaauagcauucuauauacuguuugaugagagcauuaaaagcauaguggauugaauauuaucaauauauuaugucauauauauaauauuaugugaauuugggauuuuuuucagcacuauuucuggaagagauauaauccaguaccuucuuucucuguaggcagaauuguacucaagcuaaauuaauaagcuuauuguauaaauauccauugguuccaguauucagaauaagacacagagcuuucaccuagaacuaacuuaaucuacuuggccgggcacgguggcucacgccuauaaucccagcacuuugggaggccgaggcgggcggaucaugaggucaggagaucgagaccauccuggcuaacacggugaaaccccaucucuacuaaaacaaaaaauuagccgggcgugguggcacacgccuguagucccagcuacucgggaggcugaggcaggagagucgcuugaacccgggaggcagagguugcagugagccgagaucacgccauugcacuccagccugagcgacagagcaagacuccgucucaaaaaaaaaaaaaaaauuaaucuuacauaaauccacugcaugcugguuauuuccuaguagaaauuuccaacacagaaaauucugucauaguuauuuaucaacauuuuuauaaaaagucaaaaaggcugauuuugauuugacugccuggugaucuuuaaacuucucuguguuuccugugacugaaucaggacccuuucuauacugguaaauaaaaaaacaauacaugaaaucgugucugguuucuuguaccuagaggcuuugacuauuaaaaaaaaaaaacuuaacguguuuuauguugcuuaucacaugacaaauguuaauuugcaugucauuccacaugguuuuccuuaaacuacaugauauucuauuuuuagaaauagcaagcucucuaaagucucaaauaacuuucaauuuuuaauaauuuuauuaucccaucauuguaaguaacagauuauuuagguagguuagcagguuacccaguaguuacauaauugaaaguguaauaacaauggugaaacauacuaggagauauuuuaucuuuacuugcauaucuuuuuuguuuuaagauacuugagcguucucuaaagcugcuauuugaaacgagagauauaagucuaauuaaacaguauguucagcgacaauguaugaagcuucuggaaggaaaggccagcauacaagacuuuaucuuugccaaggaauacagaggaaguuuuucuuauaaaccaggagcuugugugccagcccuugaacuuacaagguaaugauacccucaguaccuugccaggauaguccugagauucugcacaggucuagaagacccaaaugaaaagacaguccauagacacagacacaaaauuguuucuuuaccugcgcacaugaagccucacugaaaguuagugaauauucccucauacuucguaagaugugaagaggaaauccucuuuugggcuuuccuucagaaacuuaugcaaagaaauugugacacaguccuugauucauuuguuuuucccacaucaaaaucacuagguaguccuuaauauuguucuaccaaagcauuuagaugguaucauucuggaaucagauaguuuaaccagguaaauuuucucuuaucuuucaugauagauuuaaugauaguuaguucucauucuuaggggauaaaauacaucuuuuuccugccccuggaggcagggucucacucugucgcccagacuggaaagcaguggugcaaucacagcucacugcagccuugaccucccaggcucaagcgaaccucccacaucagccucccaaguagcugggauaacaggugugcaccauuaugguggcuaauuuuuuuguggagaugggggucucgcuauguugcccaagcuggucucaaacuccugggcucaggugauccuuggccucccaaagugcuggaauuacaggcaugagccaccacucccaccuaaaauacaucuuaagcuaguugauaucugccaacucauuauuuuccagguaacagugauuuacagaguaauuuuuaaacucuuguaggauaucuacacuuggugucaacuaagcaaaauguauauauauuauucucaaagaaauaguaauucuguuuugaaauugucuuuuguaguuuuuucauuguuuuauuauuguuuaauucugacuuaauuugugagaaagauggcuuccauaacaguauuugggugugguuuuuuucuuugaauucgaauaggaaaaugcugacuuaugaccggcgcucugagccucagguuggggagcgagugccauacgucaucauuuaugggacccccggaguaccacuuauccagcuuguaaggcgcccaguggaaguccugcaggacccaacucugagacugaaugcuacuuacuauauuaccaagcaaauccuuccacccuuggcaagaaucuucucacuuauugguauugaugucuucagcugguaucaugaauuaccaaggguaagcuuaccaaauaguacaugugcucuaacuauggagagauuucacuccaaauuuucaguagaacuaaagguuuuaugugcuauugauaugggagugcugggaagggaagaguguggucccguaaaaugauacggaaagcgggaggggaagugcuggguagagaaaggugggucccuggcuagggcuccacccccacagaucuaggugaggauaggcacuccugcuuucaugcccaaauguuaccauuuuccaagaccaccuuggccugccaugccccaauccugggccuauaaaaacccgagacccuagugggcagacacacgagcggcuggacauugugaggaacacuucgguggaagacccaagcagcuggucgucaagaggagcacgccagcagaacagcacaccgagaggcacuggcaugcuggcaggccauugaccggcaggacaagguggaguuuggccagggcagucagagaagagacggggccaccuagaagcccaacuccaggggaaaaccaucucccugcugauuccaccaucagaugagagcuacuuccacucaauaaaacguugcacucauucuccuagcccacgggugaucggauucuucugguacaccaaggcaagaacccggaauacagaaagcccuccauccuugagacaagcuagagggucuaauugagcugguuaacacaagccgccuauagacagcaaacuaaaagaauacccuguaacacacacccacuggggcuucagcuguaaacauucaccccuagacacugccauggggccagagcuccacaaccugcccgucugugugcuccccuagagguuugagcagcggggcacugaagaagcgagccauugucccucucgcacacccugcaaggggaacaagggaaccuuuccuguuucacugugagagcaaagcagauccucuguccuaaacuggcaaagaugccaugcucuccugguuuccuaaaagauaaacguuuuaaguauucuacaaacacauuccuagcuucuaucaaguuggccaaauuauagaaauauuaaaauaaaucccacaacaauuucaaugguagccgcaaauaacguagaauaagccaguuaauagaaaauaaauguacagcaaaaauuccuucgaaaugaaugucuaagaaagguguaggauuuaguaucuagacacacuagacacagcccugaagaaaccagaguaaagaauuacugcaaugguaaaauagcauuauaguuguuccccaacuuaugaugguucaacuuaagauuuuucuacuuaacgauggugcgaaaaugauaugccuucuguagaaaccguaguucaaguacccauacaaccauucuguuuuucauuuuugguacaguauucaauaaauuccaugagauauucaacacuuuauuauaaaauaggcuuuguguuagaugaucuugcccaccuauauguuacuaaguguucugagcacauauccuggcucuaaggcaggaaacucagauucuuuauuacuaauguucauuucaucaucggcaagaauguuaacccaaugacauuuguaagaggcuaaccuaauaacuuuuuuacaaagggauuuauugcggcacuauucacaauagcaaagacuuggaaccaacccaaauguccaucaaugauagacuggauuaagaaaauguggcacauauacaccauggaauacuaugcagccauaaaaaaggaugaguucauguccuuugcagggacauggaugaagcuggaaaccaucauucucagcaaacuaucacaaggacagaaaaccaaacaccgccuguucucacucauaggugggaauugaacaacaagaacacuuggacacagggcggggaacaucacacaccagggccugucgggggguggggagcugggggagggauagcauuaggagaaauaccuaauguaaaugaugaguugaugggugcagcaaaccaacauggcacauguauacauauguaacaaaccugcacauacccuagaacuuaaauuauaauaauaaaaaaaaaauguaucugauaauauuaagauguaaguuccaugaaggcaaggacuucauucauuucuguagcuccagugucuggaacagugccuggcacauaguagcuacucaacauuuguugaaugagugaaugaacgaaugaaugaaugccugaguaaaccuguaauuagcaugaaaauagcagcuuugcugugaagcugacucaggcuuacuucugaauggauguuuuuauagauccauaaagcuaccagcuccucgcgaagugaaccugaagggcggaaaggcacuauuucacaauauuuuacuaccuuacacuguccugugugugaugaccuaacucagcauggcaucuguaguaaaugucggagccaaccucagcauguugcagucauccucaaccaagaaauccgggaguuggaacgucaacaggagcaacuuguaaagguacaguuuuguuccaugggcccagaaucacaagcagucugaucuuacaggaagauauagucacucuugaauuauagugugagauacaaaacuggugugaaaagugaaaugaagagucuaaaugauaaacuuccuaaaaaucucaaaaauaucauaaacuauuaauaaugguuuguuuuauaauuuauuuuuuguuuuuuuuauggaauaguguguuguguuucuuaauagcuacaacaagaauggccauccauccaauuucuuuuauaauacagguugagcaucccuaauugagaaaaaucaaaauucaaaaugcuccaaaacugaaaguuuuugagcaccaacgugacucucaaagggaaugcucaugagagcauuucagaguucagauuuucagauuaaugauacucaaccaguaaguauaaugcacuuauuccaaaaucugaaaaaauuugaaaucugaaacacuucuggucuuaagcguuucaaauaagggauacucaaucuacaguauuaaaaagaagaaaggaaaagucucaauugcucuacuagugcuuaccauucuuuaaagaaaaauaccuaguugucuuagagaauugcuugcuaguaaacuuggaagguuuauaauucugugaguccagguagaugauuaauggcaugauugagucauacugugugccacagacuguucuaggcaccuuuacaggugaguaaacugauacagagaguuuaagugauuugcauguuacacugcuaaguggccgagcugggauauagacauaaaaugcaaggaugauuuuucaaguaugagaauucuagcagaaauaaacaacaaacaucucaaaguaaguugaagaaugaaaucuaaagaaaaauuugccaccucgcaccccccaauaaaaucauuacuccuuauuguugauaagucaucuccguucugucccuaccugcuaucccucugucacgauuucuugcucuucucugucacacucuaccucgacccauaccauauugaacuucucuuaggucugugaaugccccucgccgccuccuccuggccuuuaaacacccugcuccuucugccaggaacacuuuccucuaccuaucccaccccaccccccaucuucugaggaaucagcugaaaccucuggacugggugaagccuuccuugcaguaggcuccugccauaaucuccucugcuuuacugugauuugggguuugucugucuuccucacuaaauagcaaaugaaccagugaggacagaggcccaguucuuugacugucaagucaguuaugccuagcauauagccaagcccauggggcuggucuguaaauauuuauugaauaaaugaacaaguuccugguuaaugcaugauuaaagaaggaauauaucacuggaguuauuaccaaccaacuuucagccauuuuuuaccaguuuugugguucuagucaguacaaccacugaagucacugggugcucccagcuucuauuuauuuaauagacuucuguccugauggcagcagccaacucucauagaaaauucccuugcuggauccuaguaugacgccuaaaugagagcaggaccuccagggcucugcuaaggucaggcuguuaaaugguccuuuccuagacuuucuuauguuuuuucugcacucaaugacaaacacaucacuacuuggugccaucaauuuacccagagcccauccuccuucaacauuagguguucauucuuuuuuucuuuuuauuuauuuauuuuuauuuuauuuuauuuuugagguagggucucacuuugucacccagacugaaaugcaguggcaugauuacagcucauugcagccucaaccuccugggcucaagugauccucucagcucagccucccauguagcugggacuacaggcauaucccaccauguuuuacuaauuauuuuuuuuuagacaucgggucucacuauguugcccaggcuggucucaaacuguuggacucaagcaauccucccacuucagcugccuaagggcugggauuacaggcaugaaccaugaugcccggccaucuuauuucuuauaaaaauacaguuuaaaagaaagugaugccacagccauaaaaaaagaauaaaaucggccgggcgugguggcucaugccuacaaaucccagcacuuucggaggccgaggcgggcggaucacgugaggucgggaguucgagaccagccugaccaauauggagaaauuccaucucuacuaaaaauacaaaauuagccaggcgugguggcacaugccuguaaucccagcuacucaggaggcugaggcaggagaaucgcuugaaccugggaggcagagguugcagugagcugagauugcagcauugcacuccagccuggggaacaagagcgaaacucugucucaaaaaaaaaaaaaaaagaacaaagaacaaaaucauguccuuuguaacaacauggaugcagcuggggcuauuauccuaagcaaauuaacgcagaaacagaaaaccaaauacugcauguucucacauauaaugaacauuggguacucauggacauaaagaugggaaugaugaacacuagggauuccaaaaggggggugaggagaggaaaaguugaaaaaccaccugucagauacuacauuuacugcaugggcaacaggaucauuagaagcucaaaccucaacaucauacaguauacccauguaacaaaccuacauguauacccuuggaucgaaaaaaaaaaaaaaaagaaaaagcgaugcuauuuauaaauaaugaugguuugucaucuuucaagagcuauuuuaauuugagguguuuuucaagaacguucaaaugaaugucucccauacacuaauuuguagaaauuuuuaaugaagcagaaauuacuagagauguaaugagaauuagaaacacauccaaacaggagauuuuacaucauucucaauccaagaccaaucaagugaucagaaauaagugaaauuauggaaauuguaaacauuauaagucagaccuugugauuauauaucaaacucuguaacccaguaccaaaaaauguacuucuuaaguguuucuagaauguuuuaaaugucucccaugcacuaauuuguagaaauuuuuaaugaagcagaaauuacuagagauguaaugagaauuagaaacacauccaaacaggagauuuuacaucauucucaauccaagaccaaucaagugaucagaaauaagugaaauuauggaaauuguaaacauuauaagucagaccuugugauuauauaucaaacucuguaacccaguaccaaaaaauauacuucuuaaguguuucuagaauguuuuaaaaauaucuggccagguguggugacucaugccuguaaucccaacacuuugggaggccaaggcagguagaucaccuggggucaggaguuugaaacguuuggccaacauggagaaaccccagcucuacuaaaaaauacaaaaauuagccaggcaugguggcaugagccuuguacucccaacuacucaggaggcugaggcaggaaaaucacuugaacccaggaggcagaggcugcagugagccgagaucacaccacugaacuccagccugggugacagagcaagacuccaucuuaaaaaaaaaaaaaaaaaaaaaaaaaaaaaaaaaaaagucauagucuguuaaaaaaaaaaaaaaaaagccucggcuggggaucauggcucacgccuauaaucccagcacuuugggaggcugaggcaggaggaucacuugagggcaggaguuugagaccagccuggccaacauggcaaaaccccaucucuacuaaaaauacaaaaauuagcaggguaugguggcaggcaccuauaaucccagcuacuugggaggcugagguaggacaaucgcuugagccagggaggcagagguuacagugagcugagauugugccacugcacuccagccugggcaacagagugagacuccauuucaaaaauaauaaauuaaaaauaaaauaauaaaaauuaaaauuuaaaauuagccaggcaugguggcgggcacccgcaaucccagcuacuaaggaggcugaggcaggagaaucacuugaaccuaggaggcagagguugcagugaacugagaucaugccacugcacuccagccugggcaacagaaugagacgcucucucucaucucaaaaaaaaaaaaaaaaagaaagaaaagaaagccucaguacauuucaaaaaguagaaauauuacaaaugaauguaauacaaugcuauaaaaugguaauuaauuacaaacuaaaaaaaaaagugauccuuccacuuguaaauucuguuaaacaaaaugaaaacacugcaaaucagauucuagauggcagaccucagagaaaaauucaucaccuuaacacuguuaaucauaaacaugaaagaaugaaagcaaaugaagcaagcaucugacugaaaaauuuuuuuugagacggagucucacuguugcccaggcuggaguguaguuggugcaaucuuggcucacugcaaccucugccuuccagguucaagcaauucuccugccucagccucccgaguagcugggauuacaggcaugcaccaccacgcccagcuaauuuucguauuuuuaguggagacaguuucaccauguuggccagguggucucaaacuccugaccucaggugauccaccugccucugccucccagaguacuaggauuacaggcaugagccacugugcccagccuugacuaaauuuuuuuugaacaagaaagccaaaggauaguaaaaagaauaaagauuaaagcagauauuuuuuaagugccugccucccuaugugcuacaaaguagauguccggguuggggcacuaaaguuuuaaauguaagccugaaucaagcuauaaugcucaggguuuaaaccaguaaaggaucuugaaacuaaacacugaguuaaauuuagugagucaaguaauuccauccuggcuuauuuaucagacaagcacagaaagagcuuaaauauuuaucaguuuguccuggcaccugaauguaacugcaauucauagagcuguaauacagaaauucuauauuugggaauagauuugagucucuuggcagagaucuaauuagcaaaggcuucaucauagaacagcauacucagucuucauggagcauacugaagcacauguuuguaagcagucugcuugugacaauaucauaauauuggauacaguaaccagucuacuuagaaaaagugugcccuucgguuaacuggaagauaacuggggcaaagaacaaaacuucacuggccugugagccaucucugaaacugaaacccuuugauaaauauagaucaaagaauucacuagagcguauuugauuucucuuaaaagacaauccagaguaguuguugccauuugguauggcuuuuuuaaaaucacuugucuacacuauucaggugaaagucggccugcauuuucuuaaccuuuggagucuucauuggcauccuuuuuaauuuuuuuauguucuucauguuuuauaaccuuuuuuuuaacuauauaugcaacuugagacuuuaaaguauuuuuaaaaauugaucauuguguaaaacauuauagugcuucucuuuuuaaaaauugccuuaugauuuauuauuuuccuuaagaucagaucuuauuauacauccaaaucaucugggaagccuuaagaaguacagauucuuaggcuuucaugccuggagauucugacucauuaugggucugggauggggcacuuguuuauuuuuaagcucauuguuagccaggguuaagaaccacuggucugcaccacuacuuucaaauucacauuauuugauuuuuuuuuuuuuugaaauuuuacagcugggucucugggggugacaucacauguuggcagguuccuugaugccccuugagccacaaaaccagcaaguuuuuauuagggguuucaaaaggggagggguguacgaauagggagugggucacaugcuucaaaggcaguaaaauaucacaacagcaaagaggcagagugagaucacaaggccagggugaaacuagaauuacugaugaagguccaugucgugcugggcacacauugucauugauaaacaucuuaacaggaaacaggguucgugaucagacaaccagucugacuagaauucgccaggcuggaauuuccuaauccuagcaagccugggggugcugcaggaggccagggcauauuucaucccgugucuacaacugcauaagacagacacucccagaguggccauuuuagagaccuaccccugagaaugcauucguuuucccgggguuauuccuugcugagaaaagaauucagcgauauuucuccuauucgcuuucugaaagaagagaaauaugacucuguucugccaggcccugcaggcagucagauuuuaugguuaucucccuuauucccugcaaaucgcuguuauccuguucuuuucaaggugcucagauuucauauuguucaaacacacaugcuuuacaaacaauuugugcagauaacgcaaucaccacaggguccugaggcgauauacauccucagcuuacggagaugacggaauuaaaagauuaaagacaggcauaggaaauuauaagaguauugauuggggaagugauaaauguucaugaaaucuucacaauucauguucagagauugcaguaaagacaggcauaagaaauuaugaaaguauuaauuuggggaacuaacaaauguccaugaaaucuucacaauuuauguuuuucugcuguggcuucagcagguugcuuuucucuucuggaauacgaaaaagaguaacuuuuuuaugauuggcauaugagaauauagucuaaguacuuugaaaacguguuuauaguucauguaagagacauucuuugguaauuggguagcuuauguagauuuuaauaggauuccauuguaaaugaaaguuaaucuuaggaauuaaaugaauccuuagggaaauuuguacucuaucuuuacaaaauaauauccuuuagaaaugucucaacauaggguagucuaggcuuccaagagauuaaaauuaaugaaaguuucuguaauguaugucugccaguaaucugugguagucuagaaaguagggauuauaaaaauuuguuguuugcauacacgcauaaaaacuuuccuauuauuuuuuguauuucucuuaugcuuucagauaugcaagaacuguacagguugcuuugaucgacacaucccauguguuucucugaacugcccaguacuuuucaaacucucccgaguaaauagagaauuguccaaggcaccauaucuccggcaguuauuagaccaguuuuaaauugucaauaucacaguauuacaggugcuauuuuuuucagugcuuaccacuaaacuguugugcauggugcuuuuuaacuuucaucgagucaaggauguucacugucuguuaucugaagacuaugaagacuucuaugcuaaccgaauuaaaauguacuuguugaucucugaauagcucacuucuuacaauguacaaauuccucauucugucaccuuuuaaacauuguuuuauaaugcagguguuggauuugcuccaguauguguaccaucuuguaaauucauuugaguagaucauguuuacuucccaguggaaggagcacugaaaaccucuuaaagaaaaagcauuuguguguuuuccuugaacugucuguaucaagacguguuacuucgagauauccauucacuuuauaauuuugacugcaaaauauuuuguaaauacacuuuuuuacuuuucaaacgagcaaaauaaugugcaaugauuuuuauacaaaugauuuucaaguuguuugguauauuuccucuagguuuugcuugacucaaaguagaucguuauuuugaucaaacugugcaaacaguaguaccacguguagcauuuugaaacauuauuuuuuuuuaaaaaaugcugucuugcuuuagcuauuaauggggcauugugaggaacugugcaaagacauuuuuguuacaaaccugugggccuguugcaauacuuuaaaaauaaaaaauuuuauuccauuugcuuguuuuguauagacauuucuauugcuucuaaauauacuuaaaauauuuucuuuccuuauguacuguacaguuaaucuuauuugccaucaucuugaacacaaaauguguauuuagaauauuuguauaacuguguaaaauaaaaaaggaauuauguggucagugcauuguuuuuuaaacuggaaaucauuuuguuuuaaaaguuaauaauggaaaccauauuaaaauugaauaaaauauaaaauaauaua

SEQ ID NO: 192130 - RNA, 43504 nt, Homo sapiens
guugcagguagcgguagcgauggacacucuggaucgaguaguguaagugcgcugggucucagccccggggagcguuggggugaaagggucccgugaugagggugguacugucucggccucucacucuuccugguuaccccucuaauuaccugggugggggccgaucgaucaccagcccggguccuccucagcgcgagcugcuugccaggagacaguggggaagcucucaagugggagccgugggaugggagggaugugggauugaagcguuggccgcuuuuauccuagccaguugaaaaacgucugacuuccgaaguaugagacagaugguauagugggguuaggagcacagcccucggaauccgacagaucugagugacagucuggcgcguccacuuaaagcuuugugacuuugggucauuaaauaucucuaaaucuuagcuuauucuguaaaauagcgcucaccauagucauacuucauagagcugugaggguuaguuucgagaauguauguagagccuuugcugcagcacguagaaauguucauuaguuuuuucuuuuccuuccaacuuuguacacuccucugaguuauccuugaaugauaccuguuuuaaauuuguucaagaauauuugggcuaaacagcccugcuguuacuugcugugauuuucuugcuauuuaccuaaguuaacauguauccaaaacgacaguuuuagucauucagagauuuugcacaccugcuaugccucuagcuguuuggacuacaaagaguaguuuacuagguauugggacuaguucacacguuaauugggagcaggcagcuaauaaaacauguuaauugcuauuugcauuuguugcuguuuaaugagauacaaaagauagaauaauuuguaucuuuaucaaccaguaaaugaucagaagcuuuauaugugacauuauaucuggaggaguauuuuaaaaaucuacaugggaaacuuaaguguauguauggucucuuuuucuucccaaaguguccaugggacuggacgagggagggucauaauuauuugggaggaagaauucuuucaguagauggcagagaacugucugaaaagcaaggugcucauuguagaggaagcagaggugaagccccucuuuugaacagaaguguguaaaaacaugccacuccuacugucacaucauaaagucagaauaaugaauuuauuuucccuucauauuuuacaggguaauuggucuagacgaauuuuuaaaucuagcuuuaaaaaauuuguuuuuuuuugagacaggguaucacucugucacccaggcuggagugcaguagccccaucacagcucacugcagccucgaccucccugggaucaagcaguccuccuaccucagccugcugaguagcugggacuauaggcgcacaccaccacagcuaauuuuuguauuuuuuguagagacaggguuuugcauuguugcccaggcuggucucgaacuucugggcucagugauccauccaccuuggccuccuagaguguuuuuauuacaggcugugggccaccucccagcccuagcucauuuuaaaaauuggccuguuuacuugcugugugaucuugggcacauuaccugucuguucaauugccucaucuguaaagugaagauaagaauuguaacucgcgcguggaggcucacgccuguaaucccagcacuuugggaggcugaggcgggggggugggucacgaggucaggagaucgagaccauccuggcuaacacggugaaaccucgucuguacuaaaaauacaaaaaauuagccgggcgucguggcgggcgccuguagucccagcuacucgggaggcugaggcaggagaauggcgugaaccugggagacggagcuugcagugagccgagaucgcaccacugcacuccagccugggcgacagagcgagacucugucucaaaaaaauaaauaaauaaauaaauaagaauuguaacucucaggauuguggugaagauuaagccuuaauagagugacuccauguaaacaucagccuuauuauuccccauuguuggcaauaauacuggcauucucagcaaugauguuggagugcaacaguguauacuuccuggcaggcauuguggucuuaaaccuaaaagaaaaauaagcagucguuagucuuauguuuaguaaauguccacagguugaucagcaguugaugcucaauucuuuguauuaggguacaggauacaguuugacuacuuaaaguuugaagaaaaaagaagaguaagaaagaguaagagaaaaaaaacagcaacaguauuuacuugagccuuuuauuuuuuacuuaaaaaaaagauuggaaagagcaguaauaaaagaauggugggaauacaaaaaugaaagcuuuuuuuuaaaagcuaucaaaacacuuauuuaacaauaauaaggaaauaucuuuuacuaauaucuaccaaaaaagugagauuuuggccggcccuuguggcucgcaccuguaaucccagcacuuugggagccgaggugagcggaucaccugaggucaguaguucgagaauagccugaccaacauggcgaaacccugucucugcuaaaaauacaaaaauuacccaggcgugguggugugugccuguaauucuagcuacucgggaggcugaggcaggagaauugcuugaacucaggagguggauguugcagugagccaagauugugccaucacucuccagccugggugacagagugagacuccaucucaaaaacaaacaaaaaaaaacaaacaaaaaaaagaaagugagauuuuuuuuaaggguggaacccuaagugacaaauauguuuuuaagaauuuucauauuaguuaagucauggcuuugcaaugugaggaaaauguuuaaauaguuaugaauugugcuuuucugaacagaaagcccaaaacgaaaagagccaagagauuccuugagaagagagaaccgaaacucaaugaaaauauuaaaaaugccaugcugauuaaagggggaaaugcaaaugcaacagugacaaaaguacuuaaagaugugguaaguauauauacuuaaucuuuaaaagguauugaagucauuuuagaauuuucagcaugcuaggaugggcugucggagaaauacguagauaagcuugccuuaccauaagaacuacuagucuuagagaagagcuaaaguuggggguuuauuuaccuugcguggcaccuuuucuuaaagcaacuaguucucuuaguaaauuuuauuauuguuuuuuaggagcacaggugggucugguagagugaaggucucccuuaguaaauuuaaacuguuuucaauuacuagaauuuggcuuacuuacauuuuaggaaaaaaucuaauuuguaaagagaaguaacugcauauugcuguauauuuagucauucaacaacaccgguuacugugccucugcugggaauuaauaggugagacacaguucuuucagugagcuuagagagauagacauguaaaaaguucuuacacugugcugugcuggaggcauggacaggguagggugggaaacaguuaaaaucacauaggggaggccaggcacggugguucacgccuguaaucccagcacuuugggaggccgaggcaggaggaucacgaagucagaaguucgagaccagccuggccaacauggugaaaccccgucucuacuaaaaguacaaaaauuagccgggugugguggcgggcgccuguagucccaguugcucgggaggcugaggcaggagaaucgccugaaccugggagguggaggucacagucagucgagauugugccacugcuccagccugagugacagagagagacuccauuucaaaaaaaaaaaaaaaaaaucacauagggggacccccacacaggguagguucccccagagauaacacugcagcuucauuuugaaggagaaguuggugcaagaagugggagagaaagagaagauccucugaggcugagaaagaaguuugugcaaaagggaguaugaaggagcauugaugcauuuggagaacuguaaauaauugggcauggccaaaggagagugggcuagaugaggcuagaagaggaggcaugggucacauaguaacaugaaauuugaauucuaaucugaaagcuccguguaaucauugaaagauauuaagcaagagauaccaucaguccuuuuaauuggcuugauuagagaggguugagagcaaauguaggaaacuaagccauugcugccagcuaggugaagagcaucuggaguccagugguggcaaugaaaaugagaaaugaccagaaagaauagauguugaggaaagaagaguugggaacuagugaaaaguaugacuucccagguguuuggcuugagugccugaugggcaauaaugccaauuagaaaauguaucaagcggagcagguuuggagggaaaggugaaagguucgguuugggacauguaauuuaaguaaugaaaauaaaagcuuuguuuuuucuaccucuguagccuaguguacagcccagugucuggacauaguagguacucaauauauauguaaucuaugaaagaaaggcauaguaugggccaggcacaguggcucacaccuguaaucccagcacuuugggaggccgaggugggcggaucacggggucaggaguucgagaccagccuggcuaacacggugaaauccugucucuacuaaaaaugcaaaaauuagccagccaugguggugggcgccuguaaucccagcuacuagggaggcugaggccggaaaaucugcuuggaccugggagauggagguuggagugagcugagaccacgccauugcacuuacuccagccuggguaacagagcaagacuccaacuaaaaaaaaaaaaaagacauaguauguggagauaucuaguagguuauuugacuaauuaggccuugaguacagccaauagaucuuugaauuaaaucaauuaaguaaucgaauacauuuuuguuguuguuauugagguggagucucacgcuguugcccaggcugaagugcaguggugccaucuuggcuuacugcaaccucugacucccggguucaggcgauucuccugccucuagccucccaaguagcugggagccaccacacccagcuaauuucuguguucuuuuaguagagacaggguuucaccauguuggccaggcuggucacaaacuccugaccugacaugaucuguccgccucggccucccaaagugcugagauuacaggagugagccaccaugccuggcuuugaauauauuuuaaacuugaccaaacucuaugccugauaagcauagucaauucagaugucugaaugccuuauauaggcccaucccuuuuuugaaauguuugucugaauuucauugugcuaacgggaaacugccccucuccuucuaguauccaucagcacaaugacccugcauauuuaaguaagcuuuaaaagcagcacaauauuacagauuacuacaauaauuaaaauucaucaugaugacucugagucaucaagaagagguggcaauguuuauuacacggaaacagggaaauaguuggccaagaaucaucaaaaguuuuaguacuuaaaaagguagauuuuacuguugcauuuucuuuguucaccaacucugauaguugaugaaugauuauuauaccuuauuuuucauuguuucccucauuuacccauuucucuaaugcaagguaguaccugaugacaucuuuguuauucucuaugguagagcaguacuggccauacaaguaauaaaugauuauaggccaggugugguggcucacaccuguaaucccagcacuuugggaggcugaggugggaggaucacuuaagccuaggaugacagccuggacaacaaagugagaccccaucucuauaaauuaaauuuaaaaaaauaauaaaauacagccuggacaacauggugaaaccccaucuccacucaaaauacaaaaauuagcugggcguggugcaugugucuguacuugggaggcugagaugggaggaucaccugagcccuggaguuucaggcugcaguaagcuuuaaucacgccauugcacuccagccugggcaacagagugagacccugucucaaaaauaaauaaauaaaauaaaaugaaugauuauuuguggauagguagaacuaggaaaaaaaugaagaacauugaauaauaggcauuuuuuaaagagcuguguuuaaccucuggcuaguauucuaauugucaucauuauuacuguuucuaaguuuucugaucuccacgcaacauuauuucaaucugucagccuuucgugauagaauuuauuuuuucuguuuuugucuacuacuuuuuuuuuuuuuuuuucugagacagggucucacucuaucaccagagcuggagugcaguggugcaaucacgguucaccacagccucgaauuccugagcucgggugauccucccgccuuagccucccaaguagcugggacugcaggcaugcaccacuaugccuggcuaauuuuugcaguuuuuuguagagacaggguuuugccauguugcccaggcuggucucgaacuccugggcuugagugaucugccuuguccucccaaaguguugggauuacaggcgugagccacugcaccuggaauuguuucccuagagagagacuggacuaagucgaguuuaaagaaaugaaggaaauuguuuaaguuggauagacuauugacagggcauagaaacuuuuaaauaggaaagucuaguccaagaauauuaagcuuacauuucaaguuacuguaagugaugaaaagggagccaggcagaagcccucagaauaagauugaggccccagagcaaucuuggagagugacuguuaugaugcuuuauuuuuauuucugcuuuucagaauguguuuuguuuugaaagcuauaaauuuuguuuuacaguaugcacugaaaaaaccauacgguguacuauauaaaaaguaagucaugauuucuuuuacuguauuuuaaaugauuuuguuucauuauaaaaguaaccacuuuauggaagauuuggaaaacaaaaacuuuuuaaaaagauauuaaaauuccuuacaguuauuaauauuuuaauuucuuucuuuuggucuguuuuuuucauuuguauugaauguccuugcauaguuguaaccauagcauauauauuuuauuuugaaauacagauuuacagaaaagugcaaaaauaaugcagaauucccauauacccuucaccuggcuuccccuaauguuacaucuugcauaaccguaaugcaaugaucaaaacuaauaaauuaacaccgauucacucauguuaaucaaaugacagacauauuugauuagcaccaguuuuucuuuuuuccuucuuuugagacggaguccuguugucgcccggcuggagugcaguggcaugaucucugcucacuacaaccucuaacucuggguucaagcaauucuucugccuuggccucccauguagcuaggauuauaggcacgugccaccacgccuggcuaauuuuugugugguuuuuuuuuuuuuuuuugagacggagucuagcuuuguugccaggcuggagugcaguggcaugaucucgccucgcugcaaccucugacucccugguucaagugauucuccugccucagccuccugaguugggauuacaggcaugcaccuccaugcccagcucauuuuuguauuuuuaauagagacaggguuucaccauguuggccaggcuggucuuaaacuucugacuuuaggugaucugcgcgccuuggccucccgaagugaugggauuacaggcgugagccaccccgcccggcccaguuucuuuuuucuuucuuuucuuuuuuuuuuaagacggaguuucacucuuguugcccaggcuggagugcaguggcaugaucuaaggucacugcaacaccugccuccuggguucaagcaauucucuugccucaaccucccgaguaacugggauuacgggcaugcgccaccacgcccggcuaauuuuguauuuuuaguagagacgggauuucuccauguuggucaggcuggucucgaacucccgaccucaggugaccugcccaccucggccucccaaagugcugggauuacaggcgugagccaccgugcccggcccuaguuuuccuuuuaauacucuuuuucucuucaggaucccauguugcauuuaguuuucaugccuccuuagucuucuccaauuugugacaguuccuuagucuuucauugucuuugaugaccuugacauuuuugacaaguacuugucaguuauuuuguaaauuaucccucaauuuggguuuaaauuuucucaugaauugauugagguuaugcauguuugucaagaacacuacaaaaauguugugcuuuccucauauauucuucuggauuauaauccaguguucuuaauuuuguugcuuaaauuguucuguuuggcaauugggaaccccccccccccccaccuuuucuuuuguuuguuuuuuuaguaugagacggagucucacucuuucacccagccuggagugcaguggugcgaccucagcucaccacaaccucuggcuccuggguucaagcgauucuccugccucagccuccugaguagcugggauuacaggugcccagcuaauuuuuguauuuuuaguagagacaggguuucaccauguuggccaggcuggucucagacuccugaccucaggugauccaccagcuucagccucucaaagugcugggauuacaggcgugagccacugcucccagcugggaacucuuuuacguugguuccuaugaccuuucaacaugccuccuguuuuugagcacuuccuuacuuucuaacaucacaaaauuaucuggguucaucuugucuuuuuccuuaccacagcccuggaauaagcuacagucaucccucaguaucugugggcgauggguuccagaaaccuccccuuauuaaaaucuggguaugcucgucucuuacauaaaauggccuaguauuugcauauaacccacacacuuccuccuguauccuuuuuuuaaaaaaugcuucccauaaaaguaaguugcauauacuuuaaaucaucucucgauuacuuauaauaucuaauauaauguaaaugcuauguaaauaguuauaaugcuguauuuucugguuuauccugcuuuuuauuguuccuuuuucuuuuuauuucuuaacuuuuuuuuuagagacggggucucacuguuacccaggcuggagugcaguggcacgaucauauuucacuguuguaagccacugugcucggcgcccccugcuuuuuuuuuuuuuuuuaacacacuuucuuugucuauugaauacugucaauccgugguuggucaaaucaauccauggaugcagaaggaugcagaauccauauguacagaggacuacuuauuuuccacgagccuauaaacuccaugaaagcaagcaucuuguuuaauguaguaguauaguaucacuagcuccuagaaugguagccuggcauauaacaggcacugaauaaauauuugaaugaaugaauauccuuucaauuguuuuaucaucugaauauaaaauuaccuuaauauauuaauuguauauacuuauuuagauuauuaaaauugucacuuuuuugauauucuuaggaaaaauauuacaagaccuuuugaggaucagacaucacugguaaguauaauaaucuuuaugauuuaagaaagcauauaaguaguaauuauucagacuaauucauuuguacuccaaauuugugauuuuuuuaaacauuagaagucauccugugugagggaauuuuguguaaaauggagaggaaauacuuuaaaaaauaucuauagagcuuucauuucacuauggcugggaaauguguuuuucauugccugcaaauauauugauaaaauuuuuaaaacuuggccgggcgcgguggcucacgccuguaauccuagcacuuugggaggccaaggcagguggaucaccugagauugggaguucaagaccagccugaccaacauggagaaaccccgucucuacuaaaaauacaaaaaaaauuagccgggcgugauggcacaugccuguaaucccagcuacuaaggcggcugaggcaggauagucacuugaccccgggaggcagagguuucagugagccgagaucacgccauugcacuccagccugggcaacaagggugaaacuccggcucaaaaaaaaaaauauuuaaaacuugaguugcauuuaaaggacauaaugaauuuucaaaaggaaguuuguuauagaucuauuuuuauaaagcaaguuugaguuuuaaaaauaugacucuuccuucagauguuuuuacuuuuuuuuuuuuuuugaagcuugggucuugguauguugcccaggcuggucucaaacuccugagcucaagcaauccuccugccucagucucccaaguagaugggacuacagguguacaccaucacacacaauuggauacuuuuaaaacaaggaacacuaccugaauuauugcuaacagaugucaguugcuuuccuagaguuaaucagauucuuauuugaguguauagucaaccaaaacuaaaugaaaaaacugguuagugaaaucaaagauuguuuauaguaaauggagaaugaugaauggacuuucaguaugugaugauauugguuucuuccuuaagaaaaucaucaggggccagacacaguagcucacgccuguaaucccagcacuuugggaggccaaggcaggaggaucgcuugagccuaggaguucgagaccagcuuggaaaacguagcgagacccugucucuauuuaaaaaauaaaaauaaaaaaacuuaauaugauuauguuuucuugauaggaacccauuguuuauuuugaaauagggucuggcucuguugccuaggcuggagugcauuggaaugaucucugcucacugcagucuccaccucccagacucaagccauucucccaugucagaagcagggacugcaggugcacgacacgaugccuggcuaauuuuuguagagauagggcuuugccauguugcccaaucugguuuuaaacuccugagcucaaaugaucugccugccuuggccuccuaaaguacugggauuauggguguaagccgucacacccaaccaggaacccauuauuuguuguuguuuuuuuucuuaaguucacuugaccuuuuuaauguuuuuuuuucuuuuaguuagugaauuuaaaagaaagaaauuaaucucaaugauaaauuagauuaaaaucaaauaaucuuauuguaacuaacugcagugaaaauuaagauaguauugauaaaaugcauuuuacucaguuuuuuucaaauuacuuuuauuugucucagguuuuuuacagucauuuguugaagagaucaugaaaguaaaaauauaagauuuaucucagaauucucuuucauauaguacuuaaucaaggccugguuuuguuuuugugauaccauaaugcuuuuaguugcaugaccacuuuguggcaguguuacauagugaaagcuguagcauuugagcuuuuuuagucuaguguugauaaaagcugacaacagcuuuucuuacacuugagguugugacauucccucuauuugaucucccaccuccaguuauaguauauauuuauuagcuaucugaaucccagaccuacggagcucaaaauggcuauggaaggagugguuguguuggaaauaguggucaauuuucuccuccugacccucuccacacauuuuuuuuacuacaaucuuggauaaaugaguuuugcugcuuuagagagggguuggcaaaaauauacugcuugcagaucaaaucccucuuugugugaggcucaugagcuaagaaugguuuuuacauuuuuaaagaguugguuaggcugggcaugguggcucaugccuguaaucccagcgcucugggaggccaaggcguguggaucaccuaaggucaggaguucgagaccagccugaccaacauggauaaacccugucucuauuaaaaauacaaaauuagccaggcgugguggcacaugccuauaauuccagcuacucgggaggugaggcaggagaaucacuugaacccgggagguggagguugcggugagccaagauuguggcauugcacuccagccugggcaacaagagugaaacuccaucucaauaaaaaaaaaaaaaagaguugguuaggcugggcaccgugguucauaccucuaaucccguuguuuugguaggaugaagugggaggauugcguggggccaggauuucuagaccagccuaggcaacauauugagaucccaucucuuaaagaaaauuuaaaaauuggcaggaaaugguggugggagcccaagugcuaacuaucugggagacugaggguggaggaucagcugagugcaggaguuugagguuauagugagccaugauugcaccacagcacuuuuagccugggcaacagagugagaccuugucucacaaaaaaaagaagaguuggcuaaaaacaaaacaaaagaaugagccuaaaauacuuauuauauggcuuuuugcagguaauuugacuaccccguucuagaauuuuaagaaauaaaaagcagacuuuguggagaaugggaugaguauauauacacacacacacacacacacacacacacacacacacgaguauguauguauauaaaacacucaaguauauaugagggguguuuuauggaaagcuuugagauguuagucauaccaugaaaauguuuuuaaaauuuuaagaaaguaauuccauugauuuagacauacaaaauaaauauauauauuuuaauugagacagggucucacucugucacccaggcuugagugcuauggcgccaucucagcucacugcaaccuccaccucccggguucaagcgauccucccaccucagucuccugaguagcugggaccacagguguauaccaccauacccggauuuuuuuuguauuuuuacuagagacgggauuuugccacguugccugggcuggucuccaacuucuaagcucaugcaaugcacccaccucagccucccaaagugcuggggugacaggcaagagccaccacaccuggccauagaaaauauuuuuuggacacccacuuuguucaggacauuguacaacuuuguacaagguguguucacauaugacaucgcauguggccuuugcaaguuuuugcaggaggugguauuaucccuauugauaaaguuaauucucagaaaagauuauuuguccagauauuuaguggcagagccugaauucuuggacuuucugacucugcaucccccacucugguuguggacaggccagguggguaguuguuugccauuuaugcuucuguuuagaggcuagaaugaaugauaaccaaacuaggggcccauaccuuggagagucuuguaaggaguaaagaaaaauggaggguuaugacucuuucaucuguuuuuuucuuuaauauuaaguuaagaggcuuuccaauugauuucuggacuaaaacauguugauucuaauuuucgugcuaaaaguggugaucucaguaaacugaaucaaagcaugcgggauguggagacuacaggcauaauguaaaaagagcugucuaggauuagaaccccacaccuagauuuuuuuaguacucugaaaucuguaauggaagucuguacuucugagaaccaaauggauaagaucucucucuuucuuuuuuccaagauggugucacucugucacccaggcuggagugcagugaugccaucacggcucacugcauguagccuugaucuccuggucucaagcgauccuuccucccaccucagccucccaaguaggugggacuauagaugcucaucaccauacccagcuaauuuuuuguauuuuucuuagagacaggguuucacuauguugcucaggcugguuucaaacuccugaucuuaagccauccaccuaccucagccuuccaaaguguugggauuacagacgugagccacugcacccagccagauaaguuuuuuuuuuuuuuuuuaagauagucuugcucuuauuguccaaacuggagugcaguggucuuguugcccagacugguaugcaaugcuuuuguugcccaggcuggagugcaauggugugaucuuggcucacugcaaccuccgccucccaaguucaaggaauucuccugucuaagccuccugaguagcugggauuacaggcaugcacuaccaugccuggcuaauuuuuuuauuuuuaguagagacagggugucaccauguuggccaggcuggucucaaacuccugacaucaggugaccucaggugauccgucugccucagccucccacagugcugggauuacuggcaugagccaccuuacugggccucguguguuuugaauguaugcaaugauaguagugauauccugcgaguaaaaggaauuuguucagcaaaugaaacacuuggugugcuauuccaaaaugacagcauaacaaaauaaaugguuucauuuuauuuauuaacugaauaguuuucauguauucuuagucuugaaaugcacaucuuuucccuaaguaccccaaaucaggaaacuugaaguaaaaagcuggaaauaccuuuccucuguauuuuucuuucugguucauuaagucuucauuaacuuccacuggaagaaaaaaacuguuagaguuuuuuguuucguuuuguuuuguuuuuuuuagacagagucuuacucuguuccccagguuggagugcagugucgcauucucagcucacugcaaccucugccuucuggguucaagcgauucucgugccucagccacuaagguagcugggauuacaggcgugugccuucacaccuggcugucuuuuguauuuuuaguagagauacggucuuaccuuguuggccaggcuggucucaaacuccugaucucaaguaaucaacucgccucggcgucccaagugcugggauuacaggugugagccaccgugccuggccugaagguaagauuuuuaaagguaagauucuuaaaguucuuaaauuuaugcauggacuaaaugggauuuauuugguuuuauaggaauucuuuucaaagaagucagauuguucuuuauucauguuuggcucccauaauaagaagcggccaaauaaucuaguaauagguaaguauaauuuacuuuuuaauguuuucacugauagagucaauuuguuagcagcagcgaauucauacgggucugcagcaacuugguucuugccucuucagaggaaauaauucauccaagaggcauaggcagaguaagagacugagggaaguauuugaacaggagugaaaguuuauuaaaaaguuuuagagcaggggccuggcauggugguucaugccuguaaucccagcacuuuggguggcgagguggguggaucauuugaggccaggaguucgagaccagccuggccaacauggugaaaccccaucucuacuaaaaauacaaaaauuagccagguguaguggcgcgugccuguaguccagcuacucaggaggcugaggcauggagguagcagugagccaagauggcgccacuguacuccagccugggugacagagugagaccuugucucaaggaaaaaaaaaguuauagagcaggaacaaaggaaguaaaaggaagugaaguacgcuuugagcgccaagcaggcaacuugagagauucaugugugcuguuugaccuuugacuugggggcuuuauauguguugguaugcuucagggggguuggugucucuucucccuugauuuuucuuuucuucuuuuuuuuuuuuuuuccugagacggagucuuggucugcuccaucacccagacuggagugcaauggcccaaucucggcucacuacaaccuccgccucccgaguucaagcaauucuccugccucagccucccgaguagcugggacuacaagugcccaccaccacacccagcuaauuuuuguaauuuuaguagagacgggguuucaccauguuggccaggcuggucuugaacuccugaccucaagugauccacccgccuuggccuccugaagugcugggauuacaggcgugagccagcaugccuagccuccuaccuugauuuuuccuugggaugagcugucugccugugcaguggccugccagcacugggaggggccacaugcacgguguguuuauuggaguuguacguaugcucauuugaagcauagagcaaguucauauaccaguugaagucagccauuuugccuccuagugugcaugcuugagcccacccacccaacuccugagaucuuauugggaagcagcugauuacuagcugcugauuacugcugauccacccaccuuggccucccaaagggcuggaauuacaggcgugagccacugugcccggccugaucuaaaaauuuuuuauucaaugucacaaggugaaaacaaaaccaaaaaaccccaccaaacuaguuuacagcuuauugauuacuccugauuccucaauaccaucaguuaaucugagucacagagcuuguuacaguagauaggcagacacgcacaggacaggagaggcugcccacucacccgaccccaaccaggaaugucaggcgaccaucaggugacagucaggcagcuguuuaacugucucucuaaaauaauaauugguugcagccagugccaaggagaggcaggcucccaagaaauagauuacacaccuguaauccuaguuacacaggaggcuaagacaggagaauuguuugaaccagggaggcagagguugcagugagccgagaucaugcuauugcacuccagccuggguaacagagcaagucuucaucucaaaaaaaaaaaaaaaaaaauuuaugucggucagcaaguaaagaauggggcauauaaauaugacccuaccaauacagugaagugccacaaguaagaaagaauaugaaaagauucccugguaauucauguuucuuagaaugccuuuuccuucugucucugucggaaucaaauucugguuuaaaugggaagcguggucucuucgggcucucagcaucccugccuacuuaguuguagaugcagcacaauuacuuuauacuugcauugagugucucugagcucccaaauagcauggauccauuggaauugggggggaaaauuauccuaaguuguagauauuuuuuucauaugaaauauauauauguacuaaaucaauauuagaaaaaaaaauguaucgacccacauaaauuaauccuucucuaauaucuauugaauaaauagauuugaaaaagaaccuuuaccucaguguauugagauugagccuggcaugcucacuggcuuaggcaagcccuuuaccuucuguaggcugucauuuauucuucuauaaaauaaaggaguugggcuaaguaauaucugagauccuuuccaugacuaauaucauaaaaaucaauaaguagaguugaaaauguaagaaagugggauauguuugcggggguauagggagaaaaaagaggcagauauuaggacauuuugaauacacagcucuuguggguauauguaagguggcucuuugggaaaaauacaugcuuaaaaauacauuuuccuuccaggucguauguaugacuaccaugugcuggauaugauugaauuagguauugagaauuuugucucucuaaaagacauuaagguaagauacucauagaaaugaaaaguauuuuguaaugcuucucuugaccaguagugacaucuuguggugaagaguacugauagaguuuuguagaucaagaacuuuguguuuuuauuuugacaugcuccaggauaaaaauacaauuuuauuuuaccuuucuuuuaaaaagaggaauauauuuguagugaauagcaacauauguggacuuuguggcuguuagacuucagacugugguuacuaauucuugucuaggccauaguuuuuuuauuuuuuguuuuuauuuuuugcuuuuuucauaguuugaauuuauuuuuuauuauuuuguuuuauuuuuuugagacagggucucacucugucacccaggcuggagagcaguggcaugaacauggcuuacuucagccuugaccuccugggcucaagcaauucuccuaccucaacccccaaguagcugggacuacaggcacaugccagcacgcccagcuaauuguuuuguauuuuuauuguagagacaggguuuugucauguuucccauguugccuaggcuggucucaaauuccugaccauggugugagccaaagcaccuguaggucuauaguuuaaauacuguccucuuccucugaauuaucacagcaccuauuuuauggaaccuuagaaaaaccuguagaauuuucaaauugaacccaggaagcucuggcugauucuauaguauguugguuacuaaccaccaaauggcaggucaguucacccuuggggaguugcaucuuuguuuuaaugauauuaugaaauagaaaguaguaaaugguaguaaaaauacucuuagaaaggcaggaagaguguucuaacucagcuccuggguacaaauugggcuucuguucccucagaacucugcuucaggcuuaaucuaucuuaucaaauacauuauuucaccuagaccucauagcaaucuggguaaggccuaaguaauuuucuuuuuuguauagauugggagauugaaggcccauagggguuucauuggugaacuagaaucacacauauggucaguauaaccaagauuaggacucuagggcuuugagagaagugauguuguugguaauagaagguuauauaacugcucucaguuuauggguuuuugaggcucauggucuaguuggaaguauuguagcaaaaauguauaauuacucuuuuccugacuuuaagaggaggacaugcuuuccagguuugguagaauuccuguacuaagcaacuuuaucccgugaguuuggaaaaaaagguucuuaccagaucccuauuuagucagucaccccaguuuccucagguacagguggaacaguggucugaaauuagauuuagaggcagaacacuuggauuugaggccugucuuggcuauuuagaugacauuugugaccugacaagucaauggcuuccuugaccuucaguugcaaucacauguaaaauaaguauaacaacaucaaaugagauaauauaugugaaaaugcuuaucaguaaagauaauauuuuguaacguauuuuguaaaguacauaaacugugaugcuugauuaugguggaagcccucauauuauuuuucuuucuguuuuuuuuuuucuuucgagacagggucuugcucugucacccaggcuggggcgcaguggcgcgaucucagcucacugcagccuugaccuccugggcucaagcaauccucccaccucagccucccagguaacugggacuauaggugugugccaccucaccuggcuaauuuuuuuuuuguaaagacaagcucucacaguguugcccagacuggucucaaacuccugggcucaggagauccuccuccucagccucccaaagugcugggguacccagcugucauuauuauagugucucuuugggaccaugcacgaaucucuggagaugaccagcauaaccccauuucaccuuuaccacugccacuagcuuaucaccagcuuagugggagggagcacuggcugaugagcaccuuccagucccucuacucuuuccauuucacuuccaaagcaaugaaauacuucagucauugugcagcuucuaaacuagaccacaguccaggcucucaugccuguaagcccaucacuuugggaggcccuggcgggaggauugcuugaagccaggaauuugagacaagccugggcaacguagugagacauugucucauauauguauaaaguaaaccggcuaggcgugcuggcucacgccuguaaucccaguagcuugggaggccaaggaaggcagaucaccugagcucaggaguuugagaccaaccuggccaacauggugaagccccaucucuacuaaaaauacaaaaauuagccaggcaugguggugcacgccuguaaucccagcuaccugggaggcugaagcaugagaaucucuugaacccaggagguggagguugcagugagcugagaucaugccacugcacuccagccugggugacacagcaagacuuugucuaaaaaaauaaaaauaaaaaaguaaacuggaccacaaaaccauuauuguuugucaggucucauuucuuuuuuuguuuuuuagagacaaggucucacucuguugcccagguuggaguacaguggugggaucaccgcucacugcagccuugaauuccugggcucaggcuauccugccucagucuccugaguagcuaggacugcaggugugugccaccaugcccagccacauuuuuuuuuaagaaauggggucucacuauauugcccuggcuagucucaaacuccugaguucaagcgauccucccgccuuggccuccccaaccacuggaauuacaggcaugaaccacugcacccagcccaggucucauucuuaacaagaaccauuuaaauugaacacuacauuuucacucauggagugcauauauaacuauaaauuuuauuaauugagaaugugcuuacauuggcaauuccuacauguacucagacuuauuaggcagucuuuuuuuuuuuugagagggaguuuugcucuugucgccuaggcaggaguacaguggcaugaucucggcucacuacaaccucugccucccggauucaagcaauucuccugccucagccucccgaguagccgggauuacaggcgcccacacucggcuaauuuuuguauuuuuaguagagaugggguuucaccauguuggccaggcuagucuugaaccccgaccucaggugauccacccgccucagccucccagagugcugggauuauaggcaugagccaccguauccagcccuagucuuucauuuuuuaccccccccccuuuuuuuuucuuuuuaauuuucuaacaccagugucaccaauaccccauuauuugguuacagguuuauauuuuuaauuuguuuugguacacuuucccuuauuuucccuuuacuucucccuugucuuuaagacguugugcuagauauuucuuaccucaccuaccuacuuuuguugccaacccucauuccuccguuaacuuguccuucuccuccacccucaccagacagagucuugcuccgucacccaggcuggagugcaguggcgugauuucgucucacugcaacaugcgccuaccugguucaagcaauucuccugccucagccucccaagugguugggauuacaggugccuaccaccaugcccagcuaauuuuuuuguauuuuuaguagagacaaugagaauauuuaacucuuuaaacaagcucauugagaauauuuaauauuagacucuaccaggaaauugagugaguauucuaggagccuguuuccucaagauggccauacgucaaaggaugauuauauucaaugaaguaagacuagccuggacaacauagugagaccccgucucuacaaaauuuuuuuuuaaauuagccuugcuugguggcaugugccuguagucccaucuacuugagaggcugaggugagaggauugcuugagcccaggaguuuaaguugcuguaagcuaugauugcuacacugcaaucuagccuggguaacagagugaggccucaugucucccccaccgacggaguuuuguucuuguugcccagacuggagugcaauggcgugaucucggcucacugcaaccucugccucccggguucaggagauucuccugccucagccuuccgaguagcugggauuacaggugugcgccaccacacccagcuaauuuuuguauuuuuaguagagacggaguuucaucauguuagucaggcuagucucaaacuccugaccucaggugauccacccaccuuggccucccaaagugcugggauuauagaugugagccaccaugcccagccagcucaucuauuguagacuccugccuaguucagggucuucaucaugugcaugugacuagcauuuuauuuuuauuuuuauuuuuauuuuuagauggagucucacacugucgcccaggcuggagugcaguggcgugaucucggcucacugcaaccuccgccuccuggguucacgcgauucuccugccuuagccucccaaguagcugggauuacaggcacacaccaccauaugcagcuaauuuuuuguauuuuuaguagagacagaguuucacuauguuggccaggcuagucucaaacuccugaccuugugauccacccaccucggccucccagagugcuaggauuagaggcgugagccacugugcccggccgugacuaguauuuuuaaaaaauggaauagaguaaaaaauaucagugcuguauguauuaaguauugggguuuuuuuuuuuuuggagacagggucuugcuuuguugcccagacuggagugcaguggugcuaucucagcucacugcaaccuccaccccaagguucaagcaauucuacugcaaccuccaccccaaaguucaagcaauucucuugccucagccucccaaguagcugguugagccaccacgccuggcuaauuucuguaguuuuaguagagacaggguuucaccacguuggccagguuggucucggacuccucaccucaagugaucuacccaccucagccucccaaagugcugggauuacaggugugagccaccacgcccggccaaauauuguuucacauaacuuuuauuugucuuuguaugauguguauacugggugacaacuucaaauuuuuuuuuuuuuauuacuaugcauuguggucaggaugguuugaaaaccaaaaguuguuguugaugaugcugugcuuuuuguucccuucuguacaccuaaauagacccuauaguccuagggucagacuggcgugguugaagcauggaagacuuguuagaucuggaacguccuuucagcuucuguaucagacagacagauguuaggcacaucuccaucuccuaaguauagaccguuaagguuccggguuuggaaguagagaaugucaacaagaguggucauggugagcagcaaagcaacaggugaccucugguccuagggcagaggguguuugguuuuuguacuguuuuuuuuguuuucuuuuguugcuggauuuuggauaguucuugauuuuuggucagaacagagaauuuauaggaagcucagaccaacagucauucaccuuccuccauaaauuacucauccaguuaaagaauuuuuacuauuucauuuuuuccucuuugguggcuucuaaauccucuuuuuaaucacaucacauucuauuugguguagaaaaucuacaacuggugaaaauacuuuuuauaguaagaguuucaacauugcugaugagaauuggucuauacuuucuauagcuuauguaaaauuauauuacuucucaugugaauguccagcugguaguuuaauuuagccuucauuuuauuuuuauuuauuuauuguuuugagggucuuacucuguaucccaggcuggaguguaguggcaagagcacggcucauggcagccuggacuucccugggcucaagugauccuuccaccccagccucccaaguagcugggaccauagaugugcaccaccacaccuggcuaauuguuuuguauuugguuuguuuguuauuguuuucuugagacggagucucugucgcccaggcuggagugcuguggcgcuaucucagcucacugcaaccuccaccuccuggguucaagcaauuuuccugucucagccccgacuagcugggacuacaggcacacugcaccuggcuaauuuuuguguuuuuuaguagagacaggguuuuaccauguuguccaggcuggucucaaacuccugaccucaagugaugcgccugccucagccuccgaaagugcugggauuauaagggugagucaccgugcccagccuguuuuguauuuuuuuguagagaccgugucucccaggcuggucucaaacuccugggcucaagcgaucugcccuucuuggccuccuaaagugcugggauuacaaguguaagccaccacaccuagccuauagccuucauuuuuuuuuuauugagauggcaucucgcucucacccaagcuagagugcaguggugcaaucucggcucacuacaaccucugucucuuggguucaaacgauuauccuaccuuagccucuggaguagcugggacuacaggcguguaccaccacgcccagcuaauuuuuucuauuuuuaguagaaacaggguuucaccauguuggccaggcuggucuugaacuccugaccucaagugaucagccccgucucugccucugaaaguggugggauuauaggcgugaaccacugugcccagcccauagccuucauuuuaaaauacuuuuuauaggguauagugggaaaggcacagugguacaaauaaauuauaauuaaacuuauuuauucaugagacaaggucuuacucugucacccaggcuggaguacaguggcacgaucauggcucacugcagccuccaccuucuaggcucaagcgauccuccuaccucacguuccgaguggcugggaccauaggcacucaccagcaugcccagcuaauuuuuaaaaguuuuuuuuggccaguugcaguggcucaugccuguaaucccaccacuuugggaggccaaggcgggcagaucaccugaggucgggaguucgagaccggccugaccaacauggagaaaccccaucucuacuaaaaauacaaaauuagccaggcgugguggcacaugccuguagucccagcuacuugagagguggagguugcggugagccgagauagcgccauugcacuccagccugggcagcaagagugaaaguccgucucaaaaaaaaaagguuuuuuguagagaugaggucucacuguguugcccaggcuggucuugaacucacuccuggccucaagcugucuuccugcuuuggccucccaaagugcugggauuauaggcaugagccgucacaccuggccuuaaauuuauuuugauucaggguugcuggccaucagaagucuauuuugguugcuugguugguuguguuguguuauguuuuguuuuguuuuguuuuccuuuugcaagaguaacuuuuaauuuuauucuuugcguagacuaauguuaaaaaagcccuuuacaucauucuuuugccaucuuuuauuugguaauguaaaugaauggaacaaauaauuuuuuuuuuaguauagaagucuagaagcuuaaaaaugucaucuuagccaggccugcaccuguagucccagcuacuugcaggaugccuugagcccaagaguuugaguccagccuaggcaacacagcgagacccugucucuuuaaaaagaaaaaaaaacccaccucuguuuuugccucuaauaucaguauucacagacaucauuuuggaacaguuaauaaaaugugaaaauaaauuaguguaaaguauugacuacuuuaaaaucaguauaggccaggcacaguggcucucaccuguaaucccagcacuuugggaggcugaggcaggcggaucauuugaggucaggaguuugagaccagccuaaccagcaugaugaaacccagucuguaagaaaaauacaaaaaaacuagccaggcaugguggugugcaccuguagucccagcuacuuaggagguugaggcaggagaauugcuugaacccgggagguggagguugcagugagcugagauugugccacugcacuccagccuggaugacagagugagacuccaucucaaaaaaaauaaauaaaaauaaaaaacaaaaucaauauauaaacaguuuagacuuugguaauuauauaauugcuuuuuuuuuuuuuuuuuagaacaguaaauguccugagggaacaaaacccaugcugauauuugcuggcgaugauuucgauguaacagaagauuauagaagacuaaaaagucuucuuauugguaaguauuuuaguauuuauuaucuucaggguagcucaggaagacagucucagacucucacugguggcacuuugcuacuuuagguuuguaacuucuuuuuucucuuauuuuaaaaauaauauuuauauacuuaaaauaauggagugcuucacaaauuugcaugccauccuugcgcagggaccaugcuaaucuucucuguaugguuccaguuuuaguauaugcgcugccgaagcgagcacaacuucuuuuuccuccuuuuuuuggaccuuucucuuuuuuuuuucccuuaccagcagcaggaaagcaccuaaguaucucgggagaguuaaagcagcuguuguacuguguagaugauuauuucuggauguguuaguaacuuagguauuacuuguauaguguuuuauaaaauuccugcacccaucuccugucauuccuagcaucauuuaaaauuaaauuuagaaaguugagggauuaaaauuucaagauuguuuguaucaccgacuuccaacucaaaaaccuuaauuaguuuuucugaguugaauauacaaggccuuucacaauauauaaccaauguagcuuggccuucuugaucuccuauugccuucuuuuuuuccauuagaaaggguuuauugccaauauauuauucacauuucuauuguguauucugauauugcucuuauuuauccaguuucuacuauucauuuaagugucagaucaucaaguuucuuuuccgggaagcccucagugaccuuccuggcuccuuuuuuuuuuuuuuuuuuaaagauagagucuugcucuguugcccaggcuggagcacaauggugugaucucggcccacugcaaccuccaccucccggguucaagcgauucuccugccuaagccucccgaguagcugggauuacaggugcccgucaccaugcugacuaauuucuuuugagacggagucucgcucugucgcccaagcuagagugcaguggcgcgaucucggcucacugcaagcuccaccucccggguucacaccguucuccuuccucagccucccgaguagcugggacuacaggcaccugccaccaugcccagcuuauuuuuguauuuuuaguagagauggaguuucacuguguuagccaggauggucucaaucuccugaccucgugauccacccgccucgcccucccaaagugcugggauugcaggugugagccacugcgccaggccuaauuuuuuuuuuauuuuuaguagagacaggguuuugcuauguuggccaggcuggucuugaacuccugacuucaggcgauccacccuccuuggccucccaaaaugcugggauuacaggcaugagccacugcgacaggcccuggcucauuuuuacuuuauuaccaucaucauccuaagugccaggcauauaguaggcacuucauauacacugcuucauucuaacaagaaccuugugagguuguucuacagauaacccacaccuagcaaacuaugcuaguucuaaaugauuuguguaaugaauauaaggacuacauccuuuucuauuuuuuucuccuuuaugaggcaagucguguucugaugcccaggcuggagugcaguagcucaaucauggcucauugcagccucaaccucccaggcucaagugauccucccaccucagccuccuaaguagcugggaccauaggcacaugccacuaugccuggcuaauuuuuaaaauuuuuuguaagauggggucucacuguguugcccaggcuggucuugaacuucagggcuuaagcaauccucccacuucagcccucagagugcugggauuacaggugugagcccccacacccagccuccaugauuuuuaaaagguuauuaguacuuagcauucugcaauuauauuugccagcucuuuuauaacucuggaaaguaauuuaauuuuccaagagauugguacuaauuuaaagggucuugggucugucucucugucccucaauuuuuuuuuuuuucuuuuuuuuuuuucuuuuuagacagcaucuugcucugucacccaggcuggaguguacuggugugaucacgucuuacugcagccuugaccucuugggcucaagcaguccucuaccuccugagcagcugggacuacagguucacaccaccaugcccagcuaauuuuuauuuuaauuuuuuguagagauaugggucucccuguauugcccaggcuggucucaaacuccugagcucaagcaauccaccugccucagcuuuccaaaguggugagauuacaggcaugagccaccacaccuagcucucuccaauuuaagaaaaucuucuuacugaauuuuuugcuucuuuucccucauggggauugagagauucagcuuuuccugcacaguacacugauacucucaaagcagcaguccuuuaugguccuauuucaccuuaguguugacagccgcgaggccuccaucugaugcucaguggccuugucuacuuuauuccauuugagcuuuucuugcaccaugcuuacaagcuuaugcuacacuucuuguuacccuuguuuuaaauuuuuauauacuuugcuguagaucacuuuugaaaaauugaugggguauaaaauuacguuguaugcacaugcuuuacaaaucugagcccaccaaaaaaacugugacaaauacauugcuuucauuuucccuuuuugggauuauuuauggucuuuauugucaggauuauaauuuuuaggggaaaaaaaaacacgucacccauucuugggauuauaauuuuuagaauuuauuucccguauuaguaauagcuacuuuuuaaaaaagaaacuaagaaccacuauuaucuguuuaaucuuuacaaaaguucuugaguuugaugacauucccauuucacagaugggaaaacaaacaggggcucugagaaguuaaaugagagcuauuaaguagguaaggccaaguugaaacccaacgcuuccaaagccugagcuuuucuuccccuacuguccaucuugccugugguaaacauauucccaugaucccuucuagaaucuuuauagguucuuauccauauuuuccaugaauuaaauucauacaugaaagacaaugacuaauauuuccuucucucaauauuauauaucccaaauuaucaaggguauuuuucuuucuuucuuucuuucuuucuuucuuucuuuuuuuuuuugagacauagucucacucuguugcccuggcaugaucucagcucacugcaaccuccaccucccagggucaagcaauucucuuccuuagccuccuuaguaccugggaccacaggugcaugccaccacacccggcuaauuuuuuauauuuuuaguaaagacuggguuucaccauguuagccaggcuggucuugaacuccugaccucaagugaucugccugcccuggccucccaaaagugcugagauuauaggugugauccaccgugccuggucaaggguauuuuuccagccaaaaugucagccagauuuucagcuaagauuuccauuacuuguacuccauugaccuagauuuucugccuuuuucucuuuccccuaggucucccauauaauuguuuauugucagugaggcagauacuuacaauuuguuauaacagagagagcuuuuguuugcauuuguuuaaauguuuuuuguauuuuaauaagccccaccuucucauuauuuugugcuuccacuagauggcaggaaugaucacauaaugcaguggugaggggaagggagugaaaaccaaaaaggaaucuggacagaagcagaaagguagaagaggaacagauucagacuguagggcaccaagggaaguugaguuuucaguauaaauaugaaguaaaacaacugcucuuugguuuauguuguguguucaaaugaaauaucaguagggagcaagaaauguaugaagggcuuucauuuaggaaguuccuuuuuuuuuuuuuucuuaauugaccagaaagaaaaguuaacuuuuuuucaugcaagauacccauuuuguucauucuuaauuuguuuacaucauuuuuuuuuuuuuuucuuuuuuugagacagggucucacucuguugcccaggcuggagugcaguggcaugaucauggcucacugcuguagccuuaacuuucuggucucaagcaauccuccuaccucauuccccucaguagcugggaccacagguacacgucaccacgcccagcuaauuuuuuuuauuucuuguagacaugaggucuugcugcauugcuugggcuggucucagaguccuaggcucaagcagcccuccagccucagccucccaaaguuggaggugugagccaacaugcguggccuauucuucccuucuuaaaugguagcauauuauauauaugguuguuuaaaaaaauuuggaguagaggaauuuuuaauucugauuuucauuauacaauugagaaaacugaggccuggacaggugaguagcuuuucuaaggucaugcauuuaccaaguggcauauuaaaguuuugaacuuaggucucuccaaaguacaugcuuuuauuucuuauuuguuuauuuuuugaaauggagucucacucugucacccaggcuggagugcaauggagcaaucuuggcucacugcaaccuccgcaucagcuguucaagcgauucuucugccccagccuccugaguagcugggauuacaggcauucaccaccaugccuggauaauuuuuguauuuuuuguagagacagaguuucgccauguucgcuaagcuggucucaagcuccuggccucaggugauccacucaucuuggccucccaaagugcugggauuacaggcaugagccaccgugcccagccaugcuuuuauuuauacaguauuauuauacuuuagguuaucaaguucauaaaguuauuuaucauacuucuuggucaaaauccuaacaguguauauaccacuugcaugacgucuuucccaacuagaaaugaucuuucucuccucagaacuuccagaaugguuuauacuguucuccuuuuaaugugcuacuuuaaauugcaguuguuuguauguauucauaucuaccuagaaugcagggccccugauagaaaaaugcuauaugucauuuaucacuuugcauaauaggugcucugguacaauuuauuaagugaauggauucuugccaaugguauucauguguaaacaauacucuguuguguucuagccagaaaauaucaugcuguuagacauauuugcuuuccgguuacuaaguacuaccauuuaugcccucccguuuucauucauuacuuguuuguguuaccuugaugauuugcaaacuuuagugaaauuucaguuuggcaguuaagagaaaauguuguaauaaaaggauggcugguuagaacuauuggauacagacugaaaauccuuuuauauucauagucuuagaaauuuugacuuaauaaagaguacuuuuccaugugcuuauuguguuccuaaaguuuucucccaaagcacagauguccugaaaauuuugcauuaugaaaguuguuucagagcagacuggaauguacauauuucguuucccagaaguacucugacuucaguaaugccacaccaaugagugagcuuuauuaacuuggccacugaaggagagucaggcuuuggcaaaaucaugggaaagcucuuuauuaugauauuuagauuaaaauaucuugaaaaguacaaacuuguuuuauaaaaaugucccaggccaggcgugguggcucaaaccuguaaucccagcacuuugagagaccaaggcaggaggagugcuugagucuaggaguucgaaaccagccugggcaacauagugagaccccauccguacauaauauauguauaaauauauguaguauauguacuuuuuuuaaauuaaaaauguucauuaguuuuuuuuuuuucuuguuugggggaguagaggagggugguguauaaaugugccugcccacuuguguuuguuuuauacaaguuaaugcuguguuuuuuguuuuuuggguuuuuuuuuuuuugagacugagucucacacugucgcccaggcuggaguacaguggcgcaaucucggcucacugcaaucuccgccucccagguucaagugauucuccugccucagccucccaaguagcuagggaggcacuugccaccacaccuggcuaauuuuuugugguuuuaguagagauaggguuucacuguguuagccccuauggucuugaucuccugaccucaugaucugcucgccucggccucccaaagugcugggauuacaggcaugagccacugcaccuggccugugauuuucuuuugguuaagcacaagaaaggaaaagcagacaacaaaagaugcguucaucugugcacauggagauaaucugcaucuuaugggcuaaugggaagcaggaaggaaaaugcuagguggcuacagaaugggacuagaacagaauuucccacuuacuacaucaccugccuugggcagcucuuccuaagcaaacuuggauaaacuuuuauauagaccuuuuaucuuagccaaauguuauucaugaauuuccauuuagccuccuugagguucgauuuucucagcuguaaaauuaagauaucacacuuguuuuccaaacuucuuucauagccaagucuguguaguauccuuagcgugcaguucacuggagauuuucuuuuaauugacuccucuuuuuaaguuauuguuugagacaggguuuugcucugucguucucacugaguccaguggugggaucagcaauccucccaccuuagccucuccaguagcugggacuacaaccuggcuaauuuuuuauacuuuuaguggagaugagguuucaccauguugcccagccuggccucaaacuccugagcuuaagcaauucgcccgccucagucucccaaagugcugggaugacaggcaugagccacugugcauggcugacuacucuuuuuaaaaggaaauuuuaugucccuauuguaaauggagaaugguacaggauaaaauaaauacguaguaaauuauaucuggcuuuguaucauuaaaaugcucucaugugccaccggugguaugauuaccacuuugugagaaaaaagacuaucacugauaugcaagguucuuuucuggcauuaacaguuuauaaaguuucuuauccuuuguucauauaaucaagauuucuuauuagaguuuuuuucuuguuggccucccucauagaaaaaaaaauuaaggcuaauuugauuuuaauagucaauuugaacagccauuuuuauagaaauuugcuaucuucaucuaccaguagauuaaaauuuuaugcuuugauuuacauuuuuuaaaaguuaguauuuuuaauggauaugauuuuuugaugcugagcugacucagaggaagaacuucaaaacagaaacauuaaaugucucagugaacugaacaccaaaauaccaaaauaaagucaugagauuaaaugcuuaaggggugggaccuucagacauuuuucaggaaucauuuuuugugcuuuuuuagauaaguauuggagcaaaacuguuuagagugcaguucuuuguaacugaauuuugcaaguauuuguuuuguuuuguuaauaauuuaauaugugcuuuuagauuucuucagaggccccacaguaucaaauauccgccuggcuggauuagaguauguucugcacuucacugcacugaaugggaagauuuacuuucgaagcuauaaguaagugcauuucuucacauauuuucuuaauccucaggguuaguguuuaaaacugugugacuguuuuuuagagcccaaacuuagaauugguaucuggccaaaagguuucuuggagaguuggcaggauagcagugacagcagcucugugcugauccucaguccuuugccucugaaacccuacuuuuccagugccccagagcaucugaugcugcacugucgcugagccaggugcaccaacccuuccuagcuuuaugcagcaucucuuuauuguucuugguuggauuuacagcacuaagccacaaauccuuggcuaggcaaagcaaaucucaaaacccuaagucuuaacaauugagucuaaaaggaauaagaagauucaguggcuagauucauuucacucugucucucuagccuaggccuucuaccccuaccacaauauaaauauaaaucuuaagcaggccgagcaugguggcucacaccuguaaucucagcacuuugggaggcugaggcaggcagaucacuugaggccaggaguucaaaaccagccuggccaacaugacgaaaccccaucucuacuaaaaaaaaccagaaaaauuagcccagcgugguggcacaugccuguaguuccagcugcucagaaggcugaggcacaaaaaucgcuugaaccugggagguggaaguugcagugagccaugauugugccacugcacuccagccugggcaacagagugagggcgcugaaaaaacaaaaaacaaaaaacucuuaagcagauucuauguuuauuaaagaguuaaugacaugcuguaauugugguucuuuuuuuuuuuucuuucuuuuuuuuuuuuuuaauugaucauucuuggguguuucucgcagagggggauuuggcagggucauagggcaauaguggagggaaggucagcagauaaacaagugaacaaaggucucugguuuuccuaggcagaggacccugcggccuuccgcaguguuugugucccuggguacuugagauuagggaguggugaugacucuuaacaagcaugcugccuucaagcaucuguuuaacaaagcacaucuugcaccgcccuuaauccauuuaacccugaguggacacagcacauguuucagagagcaccggcuuggggguaaggucauagaucaacagcaucccaaggcagaagaauuuuucuuaguauagaacaaaauggagucuccuaugucuacuucuuucuacacagacacagcaacaaucugauuucucuaucuuuuccccacauuuccccccuuuccacucgacaaaaccgccaucgucaucauggcccguucucaaugagcuguuggguacaccucccagacgggguggcggccggguagaggggcuccucacuucccagaagggguggccgggcagaggugcccccaaccucccggacggggcggcggcugggcggaggcgcccccaccucccucccggauggggcggcuggccgggcgggggcugccccccgccucccuccuggacggggcggcugccaggcggagacgcuccucacuucccagacggggcggcugccggaugggggggcuccucacuucucagacggggcggcugccgggcggaggggcuccucacuucucagauggggcggcugccgggcggaggggcuccucacuucuuagacggggcggccgggcagagacgcuccucaccucccagauggggucgcggccgggcagaggcgcuccucacaucccagacggggcggcagggcagaggcgcuccccacaucucagacgaugggcggccgggcagagacacuccucacuuccuagacgggauggcggccgggaagaggcgcuccucacuucccagacugggcagccgggcagaggggcuccucacaucccagacgaugggcagccaggcagagacgcuccucacuucccagacgggguggcggccaggcagaggcugcaaucuuggcacuuugggaggccaaggcaggcggcugggagguggagguuguagcuagccgagaucacgccacugcacuccagccugggcaacauugagcacugagugaacgagacuccgucugcaaucccggcaccucuggaggccgaggcuggcagaucacucgcgguuaggagcuggagaccagccuggccaacacagugaaaccccguccccaccaaaaaaauacgaaaaccagucaggcguggcggcgcgcgccugcagucgcaggcacucggcaggcugaggcaggagaaucaggcagggagguugcagugagcggagauggcagcaguacaguccagcuucggcucggcaucagggggagaccggggagggggagggggagggagagggagagggagagggagagggcaauugugguucuugagauaagugugugacuucucuuuuuuaaggcguugguacuggcugacagagcccacaguuuccuaaagaauacacugacucccacaaauugccuuucucuguacauugaguuuagacuuugcuguacauuuugagcuaugguguggcugguguugcagccugagagcugacagcuugguguugacagugucuucuguacaguaguguuguuuguccaaccauuuguaucuagcauuuuguacaucguuuuuauuuuguuuucuucacaaugaaaauacaugacugaccagcuuuauguccuaugaauguccaaaugaaacuuaaauauucaccucuuagcugauaauuuccaucuugggcucaacuguauuaaaucagagacauuuaguucuuuuucuccauauaauuaauaccaccgcuucuguuuuucuguuuuccucucacuaaaaauaaaugaggcaaaaugcaguaaaauacccaaugaucauaagauguaauuagagacuuuauaguaauuuuuagcugguuaagaucgaaagccccuuaagucuccuguuugaguuuccauaugugauuugggagcuucuaaguauguauuauacuauacaguagaugacuguuauuuagagaacaagaaauaaaagaugaaaaaucacuaauauaaaaaaguacucaggacggacaugguggcucaugccuguaaucccagaacuuugggaggccgagguggguggauugcucgaggccaggaguucaagaccagccuggccaacacagcgaaaccugucucuacuaaaaauacaaaaauuagcuggacaugguggcacuggccuccaugcuacuuaggaggcugaggcaggacaauugagcccaggacgcagagguuacagagagugggcggaucacuugaggaguucaagaccagccuggccaacauggagaaacccugucucuauuaaaaaauacaaaaauuagcuggguaugguggcgcacgccuguaaucccagcuacuugggaggcuguggcaugagaauugcuugagccugggccacacgccuauaaucccggcuacucaggcggcuauggcacaagaauugcuucagcuugggaggcagagguugcaaugagcugagauugugccacugcacuccagccuagguggcagagugagacugucugaaaaaaacaaaacaaaauuaaacuuauguuggcuggacaccuguaauccuagcacaugggaggcugaggcggguggaucaccugaggucaguaguuccagaccagccuggccaacauggcauaacaccgucgcuacuaaaaauacaaaaauuggucaggcauggugguaggcgccuguaauccuagcuacucgggaggcugaggcuggagaauugcuugaacccgggagacagagguugcagugagccgagcacuccagccugggcaacaagagugaaacuccaucucagacauaaaguaauaaaauaaaauaaaaauuguauaaaauuaccuucaggcuauguauauaaacuguauaugaaacauaaauggauuuuguguuuagacuuggaucucauccccaagauaucucauuauacguaugcaaguauuucaaacucugaaaaaaaccagaaaucuggaacaccuuucuuuucuuucuuuuguuuuuuuuuugagacggagucucgcuauguugcccaggcuggagugcagugacgcaaucucagcucacuucagccucugccucccggguucaugccauucuccugccucagccucccaaguagcuggaacuacuggcacccgccaccacgcccggcuaauuuuauuuuuguauuuuuaguagagacaggguuucaccauguuagucaggauggucucaaucuccugaccucgugaucuaccugccuuggccucucaaagugcugagauuacaggcaugagccaccgcgccugaccuggaacacuucuuuuuuugaggcaggaucuugcuguugcccaggcuggaguacaguggcaucaucucagcucacugcaaccucugccucccgcauucaagcgauucuccugccucggguggguauguaugcccucuguguuaaacauagaggggauacaagggagauaaaaauauaacgguaaaaaaucauugacaguaagaaaugagugguaacaguagccuaaaacucuucuguguugaacgguuucgcagaaaguauucacuuguauuuagugaaaaggguuuauuuguaaagaaagauacagagaaaauaaaacaaaauagagaauuaucaagucagacuuuagagcaagaauaaacuggcccagcgugguggcucaugccuguaauccaguacuuugggaggccaagauggguggaucaccugaggucaggaguuugagaccagccuggccaacauggugaaaccccgucucuacuaaaaauauaaaaauuagccgggcaacauggugugcaccuguaaucccagcuacucaggaggcugaugcaggagaacccgggaggcagagguugcagugagccaagaucgcaccacugcacuccagccugggugacagcgagacuccauuucaaaaaaagagaaaaaaaagaauaaacuagcaguaaggccgggcacgguggcucaucccuguaaucccagcagcccuuugggagacugaggugggcagaucacgaggucaggagaucgagaccauccuggcuaacacggugaaacaucaucuauacuaaaaauacaaaaaauuagcuggacaugguggcgcaugccuguaaucccagcuauucagggggccaaggcaggagaauugcuugaaccacggagucggagauugcagcgagccuagauugugccacagcacuccggccuggugacagagcaagacucugucucaaaaaaauaaaaauaaaaacaaaaauaaaaaacuagcaguguaacuauaauacauagauccaccaaaaaucugauugcuagaaucaccuuuacacuagcacgacaucuuucauaaugaaaaaaaguuugaaauuuuaaaaucagagacccuaguauguaauuuugaucacuagauguuccauaugugccuuguaauacuuguuagcuauuaauuugaaauaaaaaauggacacugugauugagagugagcugcuacuugaaagaaucacuaaacauguggaucagcuuagcuuccagaggcugugccacacuuggggagcauugaggaugggaggaaggggugguccagggauucagcaucaccucugagccuacugaccuggcucugagcugggcucagccacgugacaugggcaggucaccacuucucagggucuuuguuucuuccucuguaaacuauagcaauaccauuuagauaauucugaggucccccuaagauugacaguacugcuuuauaagaguaaagggguacucauagaugggcauauaccagaaaguaugucugacuuaacuuggcuccccaggcauucuuugggcuagcuauacuguggaacccuuucccucgcucuuacugcaaauuagcccuuaugcaauuugaaaaugguaauauuuaauauucacacacuuuauuugugaagauaaaugagguuuauaaaaugguuuugagcuuuuuggaugaaaggaacucuaaacaggaaauuauauuaauauaaccuuuaacaugaucuuuugggugaauaaaucauaguguuauugaccacuguuccuauacauccuauaguaauuauuccuuguaugugagugacuauuuauauccguugggaaauuuuauucacuauggagucagagccauuaauaugaaacaaaaucguuaguaaugccacaugugccuuugcacaaugguuaggccuuauggggggaaauaugcaaaacaaagugguagcauacuuugaaaagcaaacauaacauucuaauugaggaguuuacuuaaugaaaacagacuuucagccagagaaguguaugagagggagaaaaaugaggaaauuacaauuugaacaguagugguaaugucacucuuccucaagaaauagacaaauaauauuuaaaaauauguagaaauuaccaguuagcauaucuaccagcuugagcccaucugagagagaaagaacuggguucuguuugcagauaacuaaaagcuagagaauauuuccuuaaaucaguuugaucuuccaguaaacauacucacugaaaugauuaagaucagaucaucuacacagaaaaguaugacauuguacuuaauucuuuaaugaaauaacaacauagguaauuauacauaguuauuuggaaaucuuaauuuuauguaccacucaaaaaauucauuaggacgcuugugaauaaaaaggcacaauauuaaauuauuauaugcacccugaaacuauguacaucuauuaugcaucaauuuuaaaaauuauuuuuaguuaauuaaaaggugcuucaguuaauuaaaaggugcuuuuggcaguguauaguaguacuugggugauuugaaucuaucggauaugccaugagcuguuuugaauugacaaguuuucuaacuagcugaaaauuagcaguuuuaaguggaagaaaaaauuuuaguugaaaauuaaaauacaugucccugauuucuuuuuuuguuuguuuguuuuugagacggagucucgcccugucgcccagacuggagugcaguggcgcgaucucggcucacugcaaccuccgccuccuggguuuaagcgauucuccugccucagccucccgaguagcugggacuacaggcaugugccaccacgccuggcuaauuuuuugugucuuuaguagagaugagguuucaccauguuggccagcuggucuggagcuccugaccucaggugaucugccugccuuagccucccaaagugcugggacuacaggcgugagccaccacgccuggcugcuccaccaucacuuuauccugccuguauuccccaguucuccuccaccaguguuuccagauccagagcuguuuagacauaggguauucagaaaguugugguuuuguuauuuuaagauuuuaaaguucacuucaauguaaggaaguuaguaaaugucugugcuaugaggaaaaguugauucugaauggguugguuuaacuccuacagucuuagauaagaacuuguuaaucguauaaacauacuguuucaaagaaaaagccaauuauaauuacuuuuauacauacauaaaucuaugaguaagaugaagaagucaaaucaaaggauuuuauuucauuucugagaauaauuuuguaucucacuugcuguuucucaauaauauuguauaauuuuauuucugauuuuuaaaaauaagcaaacugcccuugaccucaaagagaaaaaaaaaauuuuuaauuugauauuugugugacccuuuagcucaaaaagggauaaaagacuuauaaagaaaagccgggcaugguggcucaugccuguaaucccaguacuuugggaggccgaggcaggaggaucaugaggucaggagagcgagaccauccuggcuaacacggugaaaccccaucucuacuaaaaauacaaaaaaauuagccaggugugguggcgggugccuguagucccagcuacucgggaggcugaggcaggagaauggcgugaaccugggagguggagcuuacagugagccaagaucgcgccacugcacuccagccuggggacagagcgagacuccgucucaaaaaaaaaaaaauuuauaaaagaagaugugaaccaaaggauauacuuggcuugaauaguauuaaguauuuaaguaagucuuucuaaacauuuuauaucauuuaauggaauuguaaauccccugaacaaaaaauauuugguggagaggacuuuuaugaaagucaaagcaacauuucuuuuuaccuauuuccuaaagguugcuguugaagaaaucugguugcagaacaccacggauugaauuggaagagaugggacccucauuggaucugguucugaggaggacacaccuggcaucggaugaccuuuauaaauuaucuaugaaaaugccaaaagcucucaagguauauaacuuagagcuugguaccacauuuauuuguauuuucuacuuuaauccuuuuucuuuccaaaaagaauuuguggcauauuauauuaaaagacaaggacaggccaggcgcgguggcucacgccuguaaucccagcacuuugggaggccgaaguggguggaucacaaggucaggagaucgagaccauccuggcuaauacagugaaaccccgucucuaugaaaaauacaaaaaauuagcugggcgugguagcgggcgccuguagucccagcuacuugggaggcugaggcaggagaauggcgugaaccggggagguggagcuugcagugagcagagaucacgccauugcacuccagcgugggugacagagugagccaaaaaaaaaaaaaaaagacaaggacauauauaaagagaucaauacaauagauuaaacuaggacucacagagccaggaaaaggagagagaaccaaauaagccaacaauaagggauaauaaaaaaagaguugcaaaacccagacaugagguuuggcuaagugccuucugauagucaagacuguuguuuucagcaaaagaaagagaguuguuugguacacuguaaaggcuaaggauuuagaguacaggguauauaaaccauaugugcauaaaauguguuuugacuuuuuaaguaguuuuaaaagacaagaagaaauguaaucucuaaaaugccaauagaaauugaaacaauagucacaacuucuuaagcuaaacacaggcuauuuucuugaugugugacagugguuaguguaguuuauaguuuuguuuuucaaaguguggccugacaguuuaccugggaauugugcagaauaucaggcccuacccuagacauacugaauuaggaucuguauuuuagcaagaucccaagugauuuguaugcacacuuaaguuugagaagaaaaguguauagggcuauauacugugucacugaaggggcaggcacuaauggaaauugcuacuaagauaguuguuacagacuagauuuuuacuggcucauuauaguagaaggccauuaaauauauacauauucuuuuaucguagccaaagaagaagaaaaauauuucccaugauacuuuugguacaacuuauggaaggauucauaugcagaagcaagaccuaagcaaacuacaaaccaggaaaaugaagggguugaagaagcgaccugcagaaaggauaacagaagaccacgagaaaaagucaaaaagaauuaaaaaaaauugauggaacuua

SEQ ID NO: 192131 - RNA, 205232 nt, Homo sapiens
cgcggggggaggaggaggagggacugagcggcggcggcccccgcgucccgugccucuaugggggaagcagacaauggauuaugauuucaaggcgaagcuggcggcggagcgggagcggguggaggauuuguuugaguacgaagggugcaaagugggacgcggcaccuacggucacgucuacaaggcgaggcggaaagauggguaagagcaggggcgggaggaguaggcucgcucggguccucgcccugcccgcgaccuggcgggaugggugggucggaucccagucgggccgugcccgaggggcgaggcggagggggucgcgggguugcguccggacaccgacuccgaggggcgcccguuccgcccgccucccccgcgcggccccgucgcguaccucgaacucccgcggcgcagcccgguccgaggcgucggucccgucccagaggggcgcccuccgagugcucggagacggcggggggacucgaguugggaccgcgguggaggaggaguuuguggggucuagucucuugggggaacgcagcgggcaggcagagcuccgcugcggaguugccgcuccggcccuggguagugacggucguuguggaacuuccaaucggcugagcgccucgcgggggcggcgguuugaaaccucgccggggagccugucgggcgaacgcggccugggguccucgccagccccacggcucugacccgcugggcaccgccgcccccagcagcgaucuccgcccuucgggcuggccggcccguuggcuucucuaugcaguccucccaucccuguuguaugcccggcgucccggguuucucauucucacauucugaauugcguaccuucccccuucgaaggagaccugaugggcuagcugcguuucgcaagcggcaacuuaagaguuggcugaauucucugcuacccacccuuuaccuugcagccccuuggguaucuuggguauuauguccuccacuccauccucugccagaugacugugggcuggggcuuauggaguaccuauauuaucaagaacggaauacgaagugacagagcugggccugaaccuuuguuuuccuaggaguugagggagaacuguaggaacaccuugggaagccuuuacugguuguccucuuaagaagagcuggauaauguacugagaauaccuguccuuucuugguccuggagggcagacagcagcuacagcaggacugguggaaccagcuuccuggcaggaauuacccucccccaaagcuagggacccaggaagaugcccuguccagcauagacuuuaaagagagucaaacucuacggaagaggauuguaacggaccauuucugaauaaagugaugaucagccacaaugacauuaguaaaauuugaagugccgcuuaucuuugugcgugcuguuauaauuugaugugguugguauaugaacucuaggacuaaaguacguugugugcguaugcacuaacuucauaaaacaacucuauuauaaaguguuuugucauaagguaucgugaaaauugcaaagugcuauccaaguguaaaggauuauuauuauugcagaauuuuuuuuuucuuuuguaacugaacaggccuuaagguacucaguuguuucucauaauuccuuuaauuaccagguguccuugaaugcuuaucauggaaugugagauacuauaauuaacauauuuugguuuuggaauauccacuccaccuguuauacuaguguucuugugggaauuuuaucaguuauauuuggggaaagcacauccaguuuuccguuuggacauuguuaauaaaucugagguggguuuuucccauacuccucaugcuaacuuugugguauacuuuugguuuuaaaaaauguaucuuaguguuuuuuuuguuaaaauagcuuucuuuuauuagggaacuuuugagaaguuaaaaauucugcuucugaauuguauuugaauaguaugggcuuacaacaaaaaccagauaauucuugcuucuauucuuuuugaauauuuuuccccucuaauaaaguacuugauucgaauacacuuccuuuuugagugaaauuuguuaauuagaauuaauaaagcuucuuuacuagaguaagauuaguuugugugucuucaaaauauaaugcuuuuuuucuaaaaaaaaaaaaaaccucucaggaucugaaagcauuaguuuaaaucacuguauuacguauaagaaaaaccguaauaaaggcuuuuuuccuggaugaaagaucugguugagauuugcaacuuuacaguaaacacccacgucucuuguggguugguagugggauuaauuuuauguucauugauaccagcaauuugaaagaacaucuguguccuuuggguucauguuaaauuuuuuuuuuuuuuuuuuuuuacuguuuuaaacagugggcagauuugcauaguaaaggauuuuacacuccgaucaugguagauuacaguuuagcucuuucuagauuuuauuuugguuaacucagaaaaugcauaaugcuauuuuagggagccagaaaucacauagguuacauuaaagauaaaugauucugguauauauaauguaguauauaaccaaaacauuguucaggucuuuagaagaaacauuagaagaaauaaaauaucauuagaaaaguuuaauacuacaguuagcaaaauguuauuucccuugaaguaugacuuuaggcaauauuaauuauaucacaaauuuauaagaggcuggaaaugcaagauuuacaucugaguuuuucaccuuuaauuaaaaauauucucugggucgggugcgguggcucacgccuguaaucccagcacuuugggaggccgaggcggguggaucacgaggucaggagaucgagaccauccuggugaacauggugaaaccccgucucuauuaaaaauacaaaaggaauuagccgggcaugguggcggguacuuguagucccagcugcucgggaggcugaggcaggacaauggcgugaacccgggagguggagcuugcagugagccgagaucccgccacugcacuccagccagggcgacagagcgagacucugucucaaaaaaaaaaaaaaguuauuuguucaccuuuuuguuuugcaggaagagaggcuuuugacccaacucuccuuuuuauuuaauauuuauacuuuugaauauuuuuuguagagaccgggucuugcuguguugccagagcuagucuugaacuccugggcucaagugaucuuccugucucagccucccaaaaugcugggauuacaagugugagccaucaugcuggaccuccaacucucuuuuacuuuaaaaaaaaaaaaaaauccgguuuaaaaguuguucuuuuuuuguuuuuucguuuuacagacagggucuugcuguguuguucagguuggucuugaacuccuggcuucccaaagugcuggcauuacaggcucaugccaccacacccagccaaauguuacucuugaagagaaacaaguucagaauauuucugaacuuuuuaauacaagcaagaauucauaaaauaaauuuucuucauuauuaagaagucgcacaugacaauuuaugguuacaaauuucaagacugcauuuuuccaguuagaaacauuuaaaaauuugaucgauaaaggaauauuguuaaaaaguucuuuuguuggccgggcgccguggcucacaccuuuaaucccagcacuuugggaagccgaggcagguggaucaccugagaccaggagaccagccuggccaacaagacgaaaccccgucucuucuaaaaauacaaaaauuagccgagcguggugccuugcauggcugacacagcuuacagaguuuguuuugucaggguuucaaaugagugguugaugacuacauaacuuaauguaugucaugaaauucuucacaaugaguacauguagaugcauauagcuaauagguacaauaguauuugccuguguuugauggguuuuucacaaucgguuuguaguuagauuauuguauuugcauuuuuguuggacacuuacagaagauuaaagauuugucaguaucaucagaggauuagaacuuuccaaaguuuuagaucaucuaguucaauuuccucuuuuuacaaaugagaaaccuagagcuuugagagguuaacugucaugcucauagugucacagcagagauagccuguaauccacaucuaacucaagaguucuugcauuuuccuuccuaauaccaugggaggaaaaacaaaaaaaggccaucuuaccuccagucuugauaacuuacuguauaaaccuuuuugcaugccaaaagugcauuuauaccaaaaaaaaauauggaaaagggaaauuaucacauauacaggacauuuacaaagugggagugcaggacuguagauucuacuacauguagcugcugcuuuucuuuuuucuuuucuuuuuuuuuuuugagauggaguuugcucuuguugcccaggcuggagugcaauugugcgaucucagcucacugcaaccuccgccucuuggguuccagcgauuguccugccucagccuccugaguagcugggauuacaggcaugcaccaccacgccuggcugauuuuguauuuuuaauagagaugggguuucuccauguugguuaggcuggucucgaacucccaaccucaggugauccaccugccucggccucccaaagugcugggauuauaggcgugagccaccuuaccuggccaugcugcugcuuuucaucuguuuuuuucuucauccucacugucaacacuuuuggccauuauuucugauuuggauaguagcugguuggucucucacuauaguccaagauccaaauugcugcuagugucauuuuccuauaaaaucaaucaugucauaucucuuuuuggaaagcuauacguuugcuauggcuuauacuaucagauccaaucucaucucuuucucuucucuccuugcaugauucauacuugagacuuagauccaauuuuaauuccuuaguuugucauguaaagacauuuacauucagacccugaagucuguagucuuuauaccugccaccauuucuuuuuuccaguugcauuuaagcuauauacuucuguagcauugaacucguauuuucugguacuuaaguccuuucaugucucauuuucuuuguucuacauucacuuuagaaugguguugcugugccauucuucccucccccuuuucccuuauccuuacaaaccuguaaaacucauacuucaauacccaacucaaauagcuuuccuccuugaagccuucucuuaaucacucgguguacuccucagcuguguuucuaccccuuuguucuuacauauguaaagucacuguaagugauacuaauaugccucauaaauuacuagcugcaaaaggaucaucauucuguccagugccuuguacagaguuggucacauaauacacaaaauuauauucaauuaaaaaugccuuuaauugguaaagaugcuccacugauuuuaaaagcagaccaaauuccuuuaaaaacgcaaguuuauuuacuuuucuuaaaaaacgaaguuuuuaguaauugcuuugaaagccugaaauacaguaauguuauaugaaauaggugguuagauguaaauacuucuaauguauuuuuucuaagaaauguacugcuuuuccaaacaguugauaaauuucuuuuuucauuuuuuucacuugagacugucucacucuaucaccaaggcuggagugcugucgugcagucguagcugacuguagccuugaacuccugggcucaagugauccuccugccucaggcucuugcguagcuaggaccacagaugcacgugcuggcuaauuuuuguuguuguuuuguagagacgaggucucacuguguucacuguguugcccaggcuggucucgaacuccugggcuccagugauccuucugcuucagccucccaaagugcugggauuacagacaugagucacugugccuggcccauuucuuuuuuuuuuuuuugagauggagucucgcugucucccaggcuggagugcaguggcgcagucucggcucacugcaagcugcgccuccuggguucaugccauucuccugccucagccucccgaguagcugggacuacaggcgcccaccaccaugcccggcuaauuuuuuuuuuuuuuuguauuuuuaguagagaugggguuuccccguguuagccaggauggucuaaaucuccugaccucaugauccacuugccucggccucccaaagugccgggauuacaagugugagccaccacgccuggccccauuucuuugaacagauauuagauauugcuaaggaaaauaggcauauuuuugagaaauaaauauuuucucuuaggccagcucuuuuagaauugcuagacuaguaaucugucuucugugcuuuuacuagcuauuuuauagagaugcuuagaaaauaccaguauuuaaauacauuuuaggacaaauuuugguuuuauggguuuaugguaaaaaauuaaguaucuuuaacacuuaguaaaugaaguagacaucuguuuauguuuaacugguuugucauuuuuguaaugcaagccuucaaaaacuuuuugaggccuaagggaaauuaauguguucuuuuucaaugaaauuugauaaucuagagcagugaucagcaaacuuuuucuggcagauacuaaauauuuuaggccuuuugggcuuuacugucucuggugcaauuacucaacucuauuguagugccaaagcaucgacagauaauacguaaaccaguauggauaaggauggcuguguuccaguagaccuuuauuuauacaaauaagcaguuggcugaauuuagucugcaggcuauaguuuguugacuccugguguagagcagugauguccaauagaacuuucugcagugaucugaaaauguuuagcaucugugcuguccaauaugcuagccacaagccacacgccacacauagguaucgauuacuggaauguaguuagugugauuagaaacuaauuaguagcuaucacauuggacuguguagguuuagagucuuuggaugaguggcuuagcaacaaauaauucucugauccaucaagugaccuuucaauaaaaauguuuaaaucaggguguggauaaauaggaaaacuguuaugucuuuuuucaaguuacaggagaaauauuaaggcugaaauagcuugauaaagcaaaccaauacuugaagaacuaucaauuuaugaauggaaucaaggauauuuaacuacuuuuucaaaaaaguauuuuauggccggaugaggugggaggauugcuugagcccaggaguuugaggcuauagugagcuaugaugaugccauugcacuucagcaugggcagcagaacgagacucucuuaaaaaaaaaaaaagguauuauaaaaaaaaguuuguaaauaguauaugugcguaaaaauauacaauguggcugggcgcgguggcuuaugccuauaaucccagcucuuuggggaggccgaggugggcagaucacuugaggcaaggagaucaaggccagccuugccaacagcgaaaacuccgucucuacuaaaaauacaaaaaauuagccgggcgugguaguacacaccuguaaucccagcuacucgggaggcuaaggcacaauaauugcuugaaccugggagguggaagcugcagugagcuaauauugcaccacugcacuccagccugggugacagagugagacucuguuucaauaaaacaaaaauaacaaaaaaccaccaguguaacguaagucaucccuuucccagccauucuuucccuuuuuuaggggcagucauucuugguuguccuuuaagaggauuuucuuuugggguaugugcauguguguuaacuuaaagaugucauuaaauaugacaugcuagugugcugcacacuuuucuauuuuuagaucauggcucacugcagcuuuggcugccugggcucaagcaagucugucucuugggcucaagcgauuguuucaccucagccuccugaguaacugggacuacagaugugggccaugcccagcuuuuuuuuuuuuuuuuaaauuauuuguagagaugaggucuugcuaugucucucagucuggucuugaacuccuggccucaaguaauccuccuaccuugaccucccaaagugcugggguuacaggcauaagccaucaugcuuggcccuauuuuuauuuuuauuuuuauuuauuuaauuuauuuauugagacggagucuuucucugucacccaggcuggagugcagugggaagaucuuggcucacugcaaccaccaccucccagguucaagcaauuuuccugccucagccuccugaguagcggggaccacaggcauauaccacuauaccuggcuaauuuuuuguauuuuuaguagagacaguguucaccauguuggccaggcuggucucgaacuccugaccucaagugauccaucugccucagccucccaaagugcugggauuacaggcgugagccacagugcuuggcccauauuuuaaaucuuaaacauugcuuaaacauuaugacauaucuauauacagagaugccuuguuucucuuaauaguuuuguuguaucucauuguauugacuuacaucauuggcugucuccagucuugcuaguacuaacacugaagugaauauccuaguaagcacagcauuuuguaccuauuaaugugucuguaaguuaaaguccuagaagcuguuuaccuuuggaaguaauggcuuggaaugguuuacuaauauggugauguauaagauagaaauaucugaagacuggagauggggggguuggcuaagaauaaggaagugaaauguuaagacaauaauaauuuuuuuuuuuuuuugagauggaguuucgcucuucuugcccaggcuguugugugauggcacgaucuuggcucaccgcaaccucugccucccggguuuaagcgauucuccugccucagccucccaaguagcugggauuacaggaaugcgccaccaugccuagcuaauuuuguauuuuuuaguagaaacgggguuucaucauguuggccgggcuggucucaaacucuugaccucaggugaucugcccaccucggccucccaaagugcugggauuacaagcgucagccacugcacccagcugacagugauaauuaacacauaaaaaugagcuauaaaucauuuguuaaaggaaguacaaguuacuuacuuuuuuuuuuuuuuuuugagaaguguuauccaggcuggggugcaguggcacgaucuuggcucacuguaccucugccuccugggcuuaagcuacuuucucauggcuacuguuuuaggagcauggaaaaggcaugucucugaguuuuacauaggaagaguagauccauggaaagguuuuuaaugcaaucuaugucaguguugaugaauuaaguauuuuuauuuuuuaaaguauauaaaauauaguguccuacauuuuugaacuuaauaugcuagacaaauaaguucauaugugguguuauaaauuguguacaguugacuguugaacagcaggaguuugaacuguguggguccacuuacacgcagauuugugaaaccugcguauaugagggccaacuuuuuguauagguggguucuccagggccaacugcaggaccugaguauauguggguuuugguauaugcaggggucccagaaccaacccuuuagguauacugagggacaucuauuuguuuugaaaaauuauucuauagugcaggguuagaugacaauauagaagauuuuaaagcaauauauuacaauuuguaauuuucuuggugguaaacuauuagaguauuuggauguuuaaaaacuaauguguuuuuuuaaagaucaacuuguuauaauguugugacuauauaauauuagugguacuuugggauucuaaaacaaagggacaagaugaacaacuagcaugacaauuucuuuaaaaccaguaguaucuagaaccauaaaggaguagcagacaaagcuauuuaaagauuuuuguccauuuacaaauagcugauuaguccaacacuuccuguaauagcuguuuugaaugugcacuguacaggauaaaagagagucucacgagagaagacaggauguaauucaggauacaagugugcagcaguaguuauuuauugaggguuugaguucuuauccagaagugagugaucaaagagaaauaaaaaccuguaaaguccucaaauaacaggugucuuuuuuuuuuuguuuugagacgaagucuuguucugucgcccagguuggagugcaguggcgcgaucucggcucacugcaagcuccgccuccuggguucacgccauucuacugccucagucucccgaguggcugggacuacagacgcucgccaccacgcccggcuaauuuuuuuguauuuuuaguagcgacgggguuucaccguguuagccaggauggucucguucuccugaccucgugauccgcccgccucggccucccaaagugcugggauuacaggugugagccaccgcgcccggcaacaggucuuuauaaaauaucuuuaacuuggcggggugugguggcucacgccuguuaucccagcacuuugggaggccgaggugggcggaucacgaggucaguucgagaccagccuggccaauauggugaaaccccgucucuacuaaaaaauacaaaaauuagcccagcgugguggcacgcaccuacccugaguagucccagcuacucaggggucugaggcaggagaaucgcuugaacccgggaggcagagguuucagugagccgagaucgcgccauugcacuccagccugggccacagaguaagacuccaucucaaaaauaaaaaagaaaaaagaaucuuuaacuugaacuauaauaugucuugcuaaaggaaaaauacacucuucuuauagaggcuuuaaaccuauuguguauuuucuauuuaaaaacauuuuuuucagugaggguuugugauggaugaucucaguuacuaagcugaaugugauuagggaauggauuuauuuaccaaguaggccaguuaacuuuguuuuguucuguaguuauagaacaaaaccuauucauggcaaaguguuuugcugauauuuguagauauuuaaauuuggacagaaagguaaguccaugguuucuggaaaacucccucccuccgucccuuucucucuuuucuuuucuuuucguucuguauuucuuucuuucuucucuuucuuuucuugagacagggucuugcucuugucacccaggcugaaaguggugcagccacagcucgcuguagccuggacuuccugugcucaaaugauccucccaucucagccucuugaguagcugggacuacaggcauguuaccaccaugccugauuaauucuugcauuucuuguagagacaguggauuuuuccauguugcccagacuggucucgaacuccugggcucaagccaucuacccgcuuuggccucccaaagugcugggauuacaaguguaagccacugcacccaaccucaguguaguuauuguaauugcauuuuaagagugacuuaaacacugaguaaauccuauuauuuuaggauuuaggugcaaauuuaaaaaaggacuuuucuguuuucugaaagguuuuauguaauuugaucuugucuuacuuacaaaaccagaauucuauuaacugauuuuucagcaaucuguugaucuuuguuguauauuuguaucaaaguggaaauaauuuuaugcuauuaaaauuaugaaacaaugguuacacaugguaaaaaaacuuaguauaguuguauauaaaaugaaaaguaaaagucuaggcuggacgcgguggcucacgccuguaaucccagcacuuugggaggccaaggcggguggaucacgaggucaggagaucgagaccauccuggcuaacacaaugaaaccccgucucuacuaaaaauaccaaaaaugagccgggcaugguggcaggcuccuguagucccagcuacucaggaggcugaggcaggagaauggcgugaaccugggaggcggagguugcagugagccgagauggcaccacugcccuccagccugggcuacagagcaagacucugucucaaaagaaaaaaaaaaaagucaaagccuuccuucuuacugucugugccggaggcuguccuugucacaucucagagguaaccaguguuaaccauuucuguuuaaguuuugcuguugcuuacuguugcuuaccauuauaacuuuaaauaauaugcauauaauucugcuucuugauuuaucaacuuuaggcaauuuuuguuaaguuuccaucagagaagcugagcaauuuugugaaaucauacuacccccuuuuguuuucucauccuaaccuucaaauuuauugcuucuauuuuaauuuguuucuaguaaauacuuuuauggcuuuaaauuauaaacuuaaauuucuuuuucauuaugugucaauuuagauacuaucucugaugucaaugugaauuuuuuucuucuuuuaaauuuuagauuuggggauacaugugcagguuuguuacauggguagguuuguuacauggguauauugcauaaugcugaguuugggcuuguauugaacccaucaccaaauagugaacauaguacccaguaggcagcuuuucaacccuuuuuccucuguuuuuccccuuuuggaguccccagugucugucguucccaucuuuaugucuguguguacccauuguuuagcucccacuuauaagugaggacaugcgguauuuaauuuucuguuuucuuacuuauuucacuuaggauaauggccuccagcccaacccauguugcugcaaaggacaugauuucauucuuuuuuauggcugcauaguauuccaugguguauauauaccacauuuucuuuuuaacuguugauagacacccaggaggauuccaugacuuuuguauugugaauaguguuaugauaaauauacgagugcaggugucuuuuugguagaaugauuucuuuuccucuggguagauaccuaguaaugggauugcugggucaaaugguaauucuauuuuugauucuuggaggaaucuccaaacugcuuuccacaggggcugaacuaauuuauauucccaccaacuguauauaagcauucccuuuucuccucaaccuugccaacaucucuugcuuuuuauuuuugauaauagcaauucugacugguguaagaugguaucucacugugauuuuaauuuguguuucucugaugauuagugauguugaguguuuucucccauguuuuuucgcuacuuguaugucuucuuuugagaaguguccauucauguccuucgcucacuuuuuaauaggguugucuuuuucuuauuuaaaaaaauuuaaaauaacuuuaagguugggugugguggcucaugccuguaaucccagcacuuugggaggccaaggcagguggaucacgaggucaggagaucgagaccauccuggcuaacacugcgaaacccugucuguacuaaaaauacaaaaaauuagccgggugcaguggugggcaccuguagucccagcuacucgggaggcugaggcaggagaauggugugaaccugggaggcggagcuugcaguaagccgagaugacgccacugcacucuagcuugggcgacagugcaaaacccugucucaaaaaaaaaacacacaaaaaaaccuguaauuuauuuuacuuuuuugagacagaguuuugcucugucacugaggcuggagugcaguggcaugaucauggcucagugcagucucaaucuccugggccuaagcaauucucccaccucagccucuugaguagcugggaccacaggcguacaccauuaagccuggcuacuuuuuaaauuuuuuguggagacagggucucacuauguugccaaagcuggucuugaacuccugggcucaagcaguccucccaccuuggccucccaaagugcugcugauuacaggugugagccagcuccuucccccagcccccggccaauauugcauucuugguuugguucucagcuugaauguuauugguguauagaaaugcgauugauuuuuauauguugauuuuuuauccugaaacuguacugaagucguuuaucgggucuuggagucuuuugaaggaaucuuuaggguuuucuagguacaggaucauauuaucaguaaauagauaauuugacuuccucuuuuccuguuuggaugccuuucauuucucucucuugccugauugcucuggcuagggcuuccaauacuguauugaauagggguggugagagugggcauccuugucuuguuucaguucuugggggaaugcauccaacuuuugcucuuucaguaugauguuggcuguggcuuugucauagauggcucuuauuauuuugagcuauguuccuucagugccuuguuuguugagcauuuuugucaugaagggaauguuagauuugucacaugcuuuuucugugccaauugagaugaucgugugguuuuuguuuuuauuucuguuuauguggugaaucacauuucuugauuuguauguguugaaccauccuugcaucccaggaauaaagcccacuugaucguagugaauuaucuuuucaaugugcugcuggauuugguuuguauuuugcugaggauuuuugcaucuauguucaucagggauauuggccuguaguuuucuucguuuguuguaucuuugccagauuuuaguaucaggaugauacugguuucguagaauaaauuagggaggaauccucccuccuugauuuuuuggaguaguuucaguaggauugguaccagcucuucuuuguacgucuggcagaauucaacugugaauccaucugguccagggcuauuuuugguugguaggcuuuuaauuacugauuccauuucauaacuugauauuggucuguucaggguuucaguuucuuccugguucaaucuuuagagauugugucuuucuaacaugaauguuaaaggaaguaauacaccuuucccacucuuuauugcuacuucccaauuuuuaaaguauaauguuuguaauaauguuuguaguauuuugguguauucagugcucuuuuguccguggguugauucuaaaaagugaacacuuaagcauucaacagcauuaaaauacuaugauuuuaaaauuuauuuacugcugaguagaugaauauguugagacucguggagaaggaaauguaaucuuuaguacagucagcccucucuaucuauggguucugcauccacagauucaaucaacuguguguugaaaauauucaaggucaggugcuguggcucacaccuauaauuccagcgcuuugggaggucuaggcggguggauugcuugagcucaggaguucaaggccagccuaagcaauauagugagacuucgucucuacaaaaaaguaaacaaaaaaacuagcuggguauaguggugcaugccugugguccuagcuaacuugggggcugaggugggaagaucacuugagcuggggagguugaggcugcagugagccgagauugugccauugccauucagacuuggcaacagagugagacccugucuccaaaaaaaaaauuagaaaaaacuccaaaacaauaaaaaauaaugcaaauaaacccagcauaacuauuuauaaaguauuuacauuguauuaaguauuauaaguaauuuagggaugauuuaaaguauacgagaggauacauauagguuauaugcaaauacugugccauuuuauaucagggacuugagcauucuuggauuuugguuuggaaggaacugaaaccaaccacaugguccgcauacuccuccccacaccauacugagggaugacuguauuaaauaagugcugcuugaaacaguguuccagguauuaaggccuaauuguugaugauaauuuauucugccuuuucuucaagucuucugggucauauucagcuaguaguuuuucuuuguauucuaugugugguuuuucuuggauucuuuucuuuugguuguuuuuagaugaggaauuuuuuuuuuuuuuuuuuuuuuuuuuaaauacaggguuuuacucuuaacacccaguuuggagugcaguggcaugaucacagcucacugcaaccucaaccuccuggcucaggugauucucccaccucagccuccugaguagcuaggcuuaaaggcacccacuaccacgccugguugauuuuuguauuuuuuuguagagacaggguuuugccaugcugcccaggcuggucuugaacucuugggcucaggugaucugccugccugagccucccaaaguacuaggauuacaggcgugagccaccgugccuggcugaggaugucuuuuuaaguagcauuuucauauaggauguguagauuuucugaguucuugcaugucugauaauguauuuuguucucauacuugauugauaguuuggcugaauuaauacuuaaauauuaagaauuuuuuuuuuucucagcauucaaaacuauugcuucaugucuucugguauaucuuguuguuccugggaaguuucuuucuuucuuuuuuuuuuuuuuuuuuuuucuggagacagagucucacucuuguugcccaggcuggagugcgaugucgcgaucuuggcucacugcaaccucugucucccggguucaagggauucucuugcccucagccucuugaguagcugggauuacaggugccugccaucaugcccagcuaauuuuuguauuuaaguagagaugggguuucaccauguuggccaggcuggucucaaacuccugaccucuggugauccacuugccucggccuccuaaagugcugggaucacaggcaggagccaucaucccuggccaggaaguuucuuuuuucaaacuuguauuuuuccucuccagaaucucuuaggauuuuuuacuuuuuuuguuuuccucauuuuucuuuaauacaguugccaucuuacauaauguacuauuaagugccuucuuaauagcuucuaaucuacccuucuguuacacuggguggcauccugggauggaacucuuguuaccacucauguuuguggaguacuguucuuuaguacgguacaucugacucauauggucaggccauauaauucauggguagugguauuaauuucuauaacugaauuaaugcacacauccaaaccauauauauuucuuucuuuuucuuucuuuuuuuuuuuuuuuuuuuuugagacggagucuugcucugucgcccaggcuggagugcaguggcgcaaucuuggcucacugcagccuccgccucccagguucaagugauucuccugccucagccucccgacuagcugggauuacaggcaugcacuaccacaccuggcuaauuuuuguguuuuuaguagagaugggguuucaccauguuggccagccuggucucgaacuucugaccucaggugauccacccgucuuggccucccaaaguguugggauuacaggugugcgccacugcgcccugccuauauauuuuucaacuuagaguucauacaaagucuguuuccuuucuauaguagcuauugcuucagauugugguuuaaaaauccaagaagugggaagaaugucuuuguuuguuuucauugcugcuuucuuccuuuuuucuuuucuaucuuccuucccuccauuuucuuucuuccguucauuucuuucuuucuuuuuuucuuucuuaauaagagguuaacagaaauggguuauuaaggaaaucaaagucuaguaaauguucaaaacaugagaucagaguagucacaaacucuucuuuguagugauguuaaauuacugacaaauguuuuuugaauacagaaaaagccuuuuuuuucuuuuuuuuuugagacgaagucucccucugucgccuaggcuggagugcaguggcgcgaucucgguucacugcaaccuuugccucccagguucaagugauucuccugccucagccucccgaguaccugggauuacaggcaccugccaccgugccuggcuaauuuuuguauuuuuaguagagacaggguuucacuaucuuggccaggcugaucuugaacuccugaccucgugauccacccaccuuggccucccaaaguggugagauuacaggugugagccaccgugcccagccaaaaauccaauuucuuauuucaauuuauguguauuuuuuuuuuuuuuuuugagauggaguuuugcucuguugccucggcuggagugcaguggcacaaucuuggcucacugcaaccucugccuccuggguucaagcaauucucgugccucagucuccugaguugcugggauuacaggugugugccaccacgccuggcuaauuuuuuuguauuuuucguagagacgggauuucaccauguuggccaggcuggucucgaacuucugaccucaaaugaucauccaccuuggccucccaaagugcugggauuacaggcgugagucaccgugccuggccauauauguauauuuuuucucacagcugaggcaaagaucaauuuauguguauuuuauuuuuauuuauuuauuuauuuauuugaaauggucucacuauauugcucagguuggggugcagugguacggucucagcucaccgcaaccucugccuccugggcugaagccaucuucugauuuuagccuuccgaguagcuggaaggugcaugccaccaugcccagcuaauuuuuguaguuuuuguagagaugggggugucaccauguuguguuggcuggucucaaacuccugagcucaaacaguccacccaccucagccucccaaagugcuaggauuacaagcaugugccaccacucccagccuguauuuuuauuuauuuauuuguuuguuuguuuguuugacggaaucucacucuguugccaggcuggagugcaguggcacaaucuuggcucacugcagccucugccuccugguucuagugauucuccucccucagccucccaaguagcugggacuacaggcgugcaccgccaugcccagcuaauuuuuuguauuuuuaguagagaccggguuucuccauguuggccaggauggucucgaucucuugaccucaugaucugccugucuuggccucccaaaguacugggauuacaggcgugagccaccgugcccagcagucuguauuuuauuuuugaauaauuauguguuguuuggacauaaguaguuacuaaauuacuuuaccuaauuauguaauaaauggaaucauuagguauuuccuuugccguaggguccugugaacaaauuacuaagauacuaaggguucugugaaugaguuuaagauccucuaacuguagauaugaucaguguuuaucuauauuaucaauuuuuuuuaagaacuugauuuuuaguggauguuuauacucuuauaugaauaugcaaugcuuuacugaacucucucugcuuguugaacauuuaaguuuuuccuaauauuuugauaauauguguaauacuaauagcuguuguugugucuaaaucuugguccuuaauaucuaauucuuuccuuaaaauagcgucuuauaaguuaauuugcugugucaaaggguauuaguuguuuaaggcucuuaguauuuauaaccuaauuuuuucauauauaguuuucuccacuacuacuaacaauauauaaaaagugccccucaucucaaccucaguggcugugaauguucuuuaucacaauuugacaguugaaaugguuucugcuuuagcaugauaguaauuagagcuguuucucuaugauuuuccuacaucugagcuaaagaucuuaccagucuuacaauuuacaucucucuuagcuccuaggaccuguaguucaugguugagguaccaccccucuuccaaccucacuagucuuuacccauuuuauaguugguaauuauuuuugacuuacuaaaaagcaggaaguuuaagcugggcauggugacucacacuuguaaucccagcacuuugggaggccaagguguguggauugcuugaguccaggaguuccagacuagccugugcaacaagggggaacccugucucuacaaaaaauacaaaaauuauccaggcauggugacaugcaccuguagucccagcuacucaggaggcugaggugggagaaacaccugagccagggaaaguugaggcuacagugagcugugaucgcaccacugcacucaagauuuggcgacagacugagacccugucaccaaaacaaaacaagacagcagcaaguuuuccuuggaauauuuuauauuuaucuaaucuugucauccacauuuuucuacuuuuauguuaaagauauguucuacaauauaauuuaccaggaaguuuucuagucaucuuaauuuccuacucuuaauuuuuauuggaagaaugggugauuuuuuuuuucacagauauauauauauuauucugaaaaguagugaagaauaaacaaaguuucauguuguguuuugguauagaaauuguuaaaagcauuuuaaaaaauaucaggccaggcgugguggcucaccccuguaaucccagcacuuugggaggcugaggcggguggaucacgaggucaggagaucgagaccauccuggcuaagauggugaaacccugucucuacuaaaaauacaaaaaaaauuagcuggacgugguggugggcgccuguagucccagcuacucgggaggcugaggcaggagaaucacuugaaccugggaggcagagguugcagugagccaagaugacgcuacugcacuccagccuggugacagagugagacgcgucucaaaaaaaaaaaaaaaguuucaaacuacuggagagaggagagugcaaaucuagcugucauuuaacacugggaagaacaggccaggcgcggucgcucacagguaauccuagcaauuugggaggccgaggugggcggaucaccugaggucaggaguucgagaccagccugaccaaauauggugaaaacccaucucuacuaaaaauacaaaaguuagcuaggcgugguggcagacgcccuuagucccaguuacuugggaggcugagacaggagaauugcuugaaccugggaggcagagguugcagugagcugagauugcgccacugcacuccagccugggugacagagcgagacuccaucuuaaaacaaacaaacaaacaaaaaaacugggaagaacacaacuaugcuguuuaucguguguggauuugucauucuggcuuugugcaacagaaaaaccaauauuguacaaauaagauguuuauuuuccucuuguaaugaaagguccagagauggggcaugcugggcuggugcaguugugccaggauauuaacaaguauucaccuccuuuccucugucuguucagugguuuuuguacauguggucccaaaugauuguuaugccuccagguauuucuuucacauucuagucaggaagaaggggaagaggcaaaggcugaaaggcaaaagagacugugccaaccaaaugguaagcaaaugccuucuauggauuagaggaacacaagggaaaacagguugugaauggcucuggggaagccagucaguaauagucucugccacaguguggaacaaaggguucaaugaaaggugggaaagaaaucuuugaguuaauguuaagcaguuaaaacccacauucuuaaugauaaguacaauuuaugaacuauaacugucucccacacuguguaaagacuuuucauaaucaaccaaaacacauuuuguugacuuucauguccauguaaguauaaagacuuaacauuuaggauaauuuuuuuuaagcaaagccuuauaaugcugauguuguccuuaucuuuuuagauaagugauaggaaaacaccacagagaaauuugguauuuauaauagugaagagaacagagucauauuagauuuuaccuuugcucuaagccaauuagccaagccuccuuguuuaguuuacugucacaaagacauuuucuuuuucagcauuugaauaaacaguauuuuuuggggacuaaaugauuugaauaauguuuauucccucuuaacaaacuacucauauuuuccguucucggggaaggauuuuugcuccugauuccuaguaaauauacauacaaaggaaaaacaaacugugauguaccaaaaucuuuugaaaaccuauuucaaaucucagcuaauaaauacugucuagcagugggauucugguaguuaaauaaucucucuguaucucaguuuccccaucuguaagaucuguuggaugacaaaauacuccucacugauuguugcgaggaguaauugagucaaaauguauaaaagucuccagcaaagcauuaguuuauuuauucgcuaaaucuguauagagggguuucaaugauaaauuucccugaagguuaaguuaguaaauaaaaaggguagauauugaguaaaaauuauagucaguuuuuugagagugaggauuaaucugguuagauucagcaggaagauagaauuuuauccacaucuguaaugaauuguuauaaaaaaguauucgccaugaauguccaucccucgccugucgcggcggguggaucaccugaggucaggaguucgagaccagccuggcaacauggcaaaaccccgucucuacuaaaaauaccaaaauuagccgggcgugguggcacgcgucuguaaucccagcuacucgggaggcugaggcaagagaaucacuugaaccugagaggcggagguugcagugagcugagauugugccacugcagugagccgagauugugccacugcacuccagccugggugacagagcaagacaacaacaaaaaaaguuuauuauauuaggaaagaaaaauugguuugaugaugggcucuuuuacuuuagccuugaaaauaaagaaaaaagguaaaggagaagaccuuaucuuuucucaaauuaaauuaaaaaaauaaauaaagggccaggcgcgguggcucacgccuguaaucucagcacuuugggaggccgagguggguggaucacaaggucaagagaucgagaccauccuggccaacauggugaaacccugucucuacuaaacauacaaaaauuagcuggacauaguggcacgugccuauagucccagcuacuugggagggugagucaggagaauugcuugaacccgggaggcagagguugcagugagcugagaucaugccacugcacuccagccuggcaacagaaugggacuccgucucaaaaaaaaaaaaaguuuaagaaaaaauuagaaaacaugcuggguggcugggcuugguggcuuaugccuguaaucccagcacuuugggagguugaggugggaggauugcuugaggccaggaguucaagaucagccuagacaacauagcgagacccuaucucuaaaaauaauaauaguaauuauuauuauuuaaaaaaccaagcugggcacagugugugugccugcagucucagcuacucagaaggcugaggcaggaggaucgcuugaacccaggaguuugaauucagccugggcgacauagugagaccuugucucuauaaaaaaaagaaaaauuaggaaacaaagauaagcaaaaagaaguaaaguuauucauagauaaccauuaugaauggugugguauguuuuucuacacuucuuucucaggaaauaccuacuuuucuccaaaaugcaaucauauucuacauacuuuuuaguagccuguauuuuacauuuuacaauauauaaugaauauuuuuccauuuuacuaaaccuucuuuuccaauaguuguguucuguccuuuuuuccuaaagaaaaucuauaccauuuacaucuacaacccuuccaucaauaauaucuuuaauuauaugcaguuauucuugugaguauggguaaaaaucugcuuucugaccuucuuuccucccaaaaucacuguucuacauuuuucuuuucuuuuacuuuuaaaauuugauucuauuuuucuuuuuuuccaugacagaucagaaccaguguucuacauuuuuauuuaauuaauuaauuaaugaauuaaauuuuuuuuuuuuugagacggagucucacucugucguccaggcuggagugcaguggugcgaucuuggcucacugcaaccuccgccucccagguucaugcuauucuccugccucagccucccaagaagcugggacuacaggugccugccaccaugcccggcuaauuuuuuguauuuuuaguagagacgggguuacaccauguuagccagguuggucuugaacuccugaccucgugauccaccuaccucagccucccaaagugcugggauuacaggcgugagccaccgcacccggcccuuguucuacauuuuuaauaacuauagucuguauacauguaccuuuauuuguuuaaccaguuacucuguugauugaugcuuauuuauaacuuuuuauuauuauaaauagcacugugaucaacagauguccaguuaaaacuuuguuuuucugaaagagagaacuuucuaaaguagaaauauguagagggauaggaaagaguauguaaaucaaaauguacuuuaauuugucaugauaauuacuauaaaauuucaaagugaaucuguggaucaauuucuuauuacuauauugguuuacauaaaguaggaguuuuaauaaccuauauaauuuauuuuuuauuuuauuuuauuauuuuuugagacagagucuugcucugucacccaggcuagagcguaguggugugauccuggcucacugcaaccucugccucccaguuucaaguguuucucaugcuucagccuccccaguagcugggauuacaggcaccugccaccacgcugggcuaauuuuucuauuuuuaguagagauggguuuucuccauguuggccaggcuggucuugaauccagaccucaagugauuuaccugccuccgccucccaaagugcugggauuacaggcgugagccaccaugaccagccuaagaaccuauauaauuaaaaacuuaaaaaucuccucuuggauguacuuacggguagcaguauaaauacaacauaagcguuuagagcuauguggaaucuuaucugguucaaauugcuugccucagaagaaguccagaaauauacaaugccuuccuuaauaucacauaauauguuucagcaucugauauauuggugcugaguacaugaauagcuauauauugguuuuucuaacuccuaccccaacguuuaagucuguaacaggauuuauaaagauaaugagaacuacaguugcucuuugaacaaaauuugaacugugcagguccacuuguaccugaacuuuuucugauaaguauguagaaaaauuuuuuggagauuugcaacaauuggaauaaauugguaaaugaauugcauugcuuagaaauauggaaaaaauuaagaaaaaauuaggugugucauaaauguauaaaauguauguagauacuagucuauuuuaucauuuacuaccauaaaauagacacaaaucuauuauaaaaaguuaaaauuuggccaggcauggugacucauuccugcaaucccagcacuuugggaggccaagcuggaagaauuccuuaagcugaggaguuugagaccagccugagcaacaugguuagacccugucuaaaaauaaaguuaaaauuuggcuggcaugguggcucacgccuguaaucccagcacuuugggaggccgaggcggauuaaucacaaggugaagagauugagaccauccuggccaacaugcugaaaccccgucucuacuaaaaauacaaaaauuagcugggcgugguggugcaugccuguagucccagcuaucugggaggcugaggcaggagaaucucuugaacccaggaaguggagguugcagugagccaagauugugccacugcacuccagccuggugacagggcaagacuccacuuaaaaaaaaaaaaaguuaaaauuuaucaaaacuuaggcacagaaacacuuaaagaccacacaugaugccauuugcaguccagagaaauguaaacaaauguaaagguauaguacugaaucauaacuacauaaaauucacuguuguacauacuguacuacuuaauauaauaauuucauagccaauucuucuugcuauugcugugagcucaaguguugcagauacacgcuuaaaaugcuaugugaugcuaaucaucuccacauaagcaauuugucucucugguaaguuggauguagcaguaaaaagugaucacuugugguucuuguguauuuuucaucauguuaaguggaauacuguaaaguuugaauaacaccauggcacccauauggagugccacuaaucaugccagaagugcucccaagaagcagagagaagucaugacauuagaaaaaaaaaguucaguuccuugauauguacuguagauugaagucugcagcugcaguugcucaccauuucaagauaaaugaauacagcauaaggaucauaaaaaaaaagaaaaagaaauuugugaagccauuucuccagcuaugccaaaagguguaaaaaccuugcacuuuuugcuaaauaacuuuuuaucuuguauugaaaagauacagcuucucugugggugcaggauugcuauaagagaggcauaccuauagauucuaaugugauuugagaaaaaaagaauucauaugacaccuuauagcaaaagaaaggugaaggaucuaaagcuggagaauuuuauggcagccaaggaugguuugauaauuuuggaaagagauggcuuuaaaauugucaggauaggcuggaugugguggcucaugccuagaaucccagcacuuagggaaccugaggcaggaggaucucuugagaccaggaguuugagaccagccuaggcaacauaaugggacccugucucuuaaaaaaaaaauuagccaggcauggugaugcaaaccuguaguccuagauauuugagaagcugaggcaggagggucacuugaucccaggaguuugagguuauagugagcuauaaucuugcaccacuucacuccagccugggcaucagaucaagagccugucucaaaaacaaacaaacaacaacaacaaaaaaacaaaaaacaggccaggugugguggcucacaccuguaaucccagcaauuugggaggccgaggugggcagaucacgugaggucaggaguucaagaccagccugacuaacaugaugaaacccugucucuacuaaaaauacaaaaauuagccagguaugguggcgcacgacuguaaucccagcuccucaggaggcugagacaggagaaucauuugaacccgggaggcagaaguugcagugagccgaaaucacgccacugcacuccagccugggcaacagagcgagacuacgucucaaaacgaaacaaacaaacaaaaaaaccgcaaaacccagucaagauaacaguaaaugcagcagauaaguucccagaugccaauaaggaaaucacugaauuauggaagcucaaaaccugccaggugucauggcuuacgccuauaaaucccagcacuuuggcaggccaaggcaggaggaucacuugagcccaggaguuugagaccagcuugggcaacauagucagacccuguugcuacaaaaaaauaaaauaaaauaugguggcacguuaccuagagugucagcuacuugugaggcugacguuggagaaucccuuaagcccaggagguagaggcuacagugagcugugauuguuccacugcacuccagccugggugacagagugagaccuuguuccccucuccaaaacaaaaaaacaaaacaaaacaaaaaaaacauugaggagaaaggauaucugccugaauaggucuuuguuuguuuguuuguuuuagacagagccuugcucugucacccaagcuggaaugcaguggcacaaucuccacucacugcaaacucugccucccagguucaaacgauucuccugccucagccucccaaguagcugggauuacaaacaugcaccaccaugcccagcuaauuuuuauauuuuuaguagagacaggguuucaccauguuggccaaggcuggucucgaacuccugacuucaagugauccgcccgucuggaccucccaaagugcuggggauuacaggugugagccaccgcgccuggcccugaauagguuuuuaauguggacaaaagggccuuauucuggaaaaaaugccacaaggaacauuaauuaguaaugaagcaagccccaggauuuaaggcaagaagggauagaaggauagaauuguaccauugugugcaaaugcaguuuggguuuaugauuaggacugcccuuaucuauaaagcugcuaaccccugagccuuggaaggaaaagauaaacaccagcugccagucuuuucauuuuacaaaagaaagucuggacaaugagaacccuuuaucuugauugguuccaucaaugcuuuguucccuaaggaaguaccuugccaauaagggacugccucucaaaguucuuuugguauuagacaaugccgugauuccccauagcccaaugaguucaacacuaaagguguugaagugaucuauuugcccccaaacacauuucuaauuuagccuguagaucagugggucauaagaccuuuaaggcucauuacacgcgguacccuauggaaaggauugucuacauuaugaaagagaaacccaauagggagaacaucaugaaggucuagaaggauugcaccauuuaagaugcuguuguuacagccacagaagccaucaagcucaaaacaauacauuccugcuggagaaaacagugcccagauguugugcaugacuucacaggguuuaugacagagccaguuaaggaaaucaugaaggaaauuggggguauggaaaaaaagauggagugaaggguuuuaaaauacagauccgagagaauuaaagaccuaauagauggcacaccagaggaauuaauaaaugacuugauggagaugagugcuuccgaaccaguaccagaugaugaggaaaaagacacacaagaagcagugucaggaaacaaauugauguuagacaagcuggcaaaaugguucugauuauuuaggcugcuuuggacuucuuuuacaacaucuccucuucuaugauacagacacugaaacuaaagcagacggaagaaggaaugguaccauaccaaaacauugcuagagaaaugaaaaagcaaaaaagucaggcagaaauuaugauguauuucuuuuuauuuuccuuucuuuuuuuuuuuuugagauggaguuucgcucuuguugcccaggguggggugcaauggcuucaucucgacucacgacaaucucugccuccccgguucaagcgauucuucugccucaggcucccgaguaguugggauuacaggcaugugccagcacgccuggcugauuuuguauuuuuaguagagacgaguuuucucuauguuggucaggcuggucgccaacucccaaacucaggcgaucugccugccuuggccucccaaaguacugggauuacaggugugagccaccgcgcccggccuaugauguauuucuauaaaguuacacuaagugugccugccucuucugucuccccuucuaccuccuccgccucugccauccuugagacagcaagaccaacuccccucuuucuucucagccgacucaaugugaagacaaugaggaugaagaacuuuacgaugauccacuucuacuaaugaauaguaaauauauuuugucugucuuaugguuuccuucgcauuuucuuuucuguagcuuacuuuauuguaagaauacaguauauaauaaaaauaacauacaaaauauauguuaauugacuauuuauguuaucagugagguuuccagucaacaguaggcuaugaguaguuaaguuugugggagucagaaguugcauguggguuuuugacugugugugggguaagcgccacuaagcccuguguuguucaaggaucaacuguuugccuguggagcaagcaaugaucucuaaugaagggagacugaugaaggcaaauuggcuaucaaaaauugucagaauguacuuuucuauaaacauucuaggauauugacugauugaugaauuagugcauuuuccauaaauguuuguuuagggcccucuagccaggggcuuuuuuuuuuuuuuuuuuuugacaauucagugguuuuuagcauaugcacaggauuguauaauuaucaccauuaucuaauuuuagaacauuucaucaccacaaacacucuguacacauuagcagucacuccucauuucccugguauccucuaaucaacuuuuuguggcuugucuauggauuuguuuauucuggacauauguaaaaaugaaaucauacuauauauguuauugugugucuugcugcuuuuacucagcauaaucaaaguucacucauauuguagcauguauggguauaucauucuuucagaugacuguguggauauaucacguuguauuuauccauucaucaacugaugaacauuugauuguuuccacuuuuaggcuauuaugauuaaugcugguaugaauauuuuuguagaaguuuuuguugggccauauguuucaguucucuuggguauauaucuaggaguggaauugcagcauaauauguuagcuguugauguuuaaccuuuggaagaacuaccagccucuuucccaaagcaacuguaccauuucacauuuccaccugaaauguaugaggguuucaguucucuacauccuugucagcauaugguauugucuaucuuucugauuuuagucauccuugugggugugaagugguagcucacugugguuuugauuugcaguucccuaauaacuuaugauguugagcauuuuuucaugugcuuagugaccauugcauauauucuuuggagaaauaccuauucaaauucuuugcucauuuuaaaauuggguuguauuuuuauuguuguaagaguucuuuuuauauucuuaacauugugcucuuaugugauguauaauuugcaaauauuucuuguuuuuuuugaguugccuuuucacuuucuuuuucuccuuuccuuuuuuuuuuuuuuuuuuugagacgaagucuugcucugucacucaagcuggaaugcaguggugugaucuugguucgcugcagccucugccuccccagcucaagcaauucucuugccucagccucccgaguagcugauauuacaagugugcaccaucaugccggcuaauuuuuguauuuuuaguagagaugggguuucaccauguuggccaggcuggucucgaacuccugaccucaggugauccaccugcuucggccucccaaaaugcugggauaacaggcgugagccaccgugcccagccugccuuuucaauuucuugaugauucacuucuuugauuuugugauucacuuugaaucacaaaaguuuuuaauuuugaugaaguccaauccaucucuuuuuuuucuuuuguugcuugugcuaagaaaccacugcuugauccaagguugcaaagauuuacuccuuuguuuucuucuuagaguuuugugguuuaagcucuuauauuuagaucuggaagugcuuuuuuuuuucuuuuuuuuuuuugagacagaaucucacucugucacccaggcuggagagcaauggugugaucucggcucacggaaaccuccaccuccuggguucaugcgauucuccugccucagccuuuggagaagcugggauuacaagugugugccaccacgcucagcuaacuuuuguauuuuuaguagagauggaguuucaucauguuggccaggcuggucucgaacuccugaccucuagugaucugccugccuuggcuucccaaagugcugaaauuacaggugugagccacagcacccagcucagauauucuuaguguuuucaaauuuaacuuuguugugcuuuuacuugauguggaaauuugcaacacuugaaguaaagcuauuacacuccgaaaaguugugcagcaaauuuaaugaugguccuugcccuauauuugucugcuguuccugccccuacccaaaguuaguacucugcauugugcugccuccucccaugucaucucucaggcuauggaugcaaagugucauuuuauuuuauccuuuuaaaaacaucaguuacccugaccagaaggaaagaauuuaguauguugguauaauggugggacuguaggccgcagacuguaggaauagugugcugcaggugagcaagugaaacuucauucuuagauuaauaauuuaugauagcuauuagugggagauagauugcuuauauggaacagacucaagauuauuguuuagucuaugcagaggaagcaaaauguauaaaauuguggaggaaagaacaacagcaagucauucaggaugucuagagcaaauacucaggauggagguuggagaugcguuugagagagagggagagcaugauaaugugugccaggcuauagaauuugguguuuaaccugauggagaaagggaguaauagauuccaaguggaauaaauuauuuuaguucccaaaauggaaauagugauuuuuuuuucugauuguaaagggaauacauguuugucauaacaugcaaacaaguaauaaaaaaauaggcagugaaaagucccuguaaucccauucacuagagauaaccacugcuuaacaguuugcuguauaguuuuacagaggagaauuuugugaucaguuuugcagcagugugguugguggaaaggacaaaaguuggaugacauuggaaguagauggcuguuagguccaaauaggaaugacgaggaccuguuucuuagugguagcuguggggguagaaaaggugcagaacuggggaaaaguucaagggauuuauuuaggagcuaggauucagugaucaguuuggcaacugagugaaggacugauaaguggccaggaugagaguugauuggauuucccagaaccugggaccaaacugugacaucauuugagcaggcauaaaagggacaaauagcaguuguugcuagcagcauaauuucagaguggaaagucuguccuuuuguucuuauuuuccuccuguguuucuggguuuauuuagaaggggaggguacaaguaagaauucaauuuuguuuggacagauaaaagcuauuauaucaugcccuuaucucuaauuguuucuuuuauuaguugaguauagcagauuucuuugagaaguugcuucuguuuugguguguaauuauagcaugagcuuuuaaacuucacaaaguuuaucuuggaaucuuuacaauuuuauucuggggaauugggauugcggugagggagccacuuuggcaaguuauugacagagauucuuugacucuaaaguaagagcugauuguaucucugaauagguuuuuuuuuuuuuuuucauuugagacagggucucacguugucaccuaggcagugacaugaucuuggcucaccgcagcuuccaccuccugagcucaagcaauccucccaccucagccuccugaguaggugggacuaccaggauguggcaacacgccuggcuaauuuuuguauuuuuuuguagagaugggguuucacaauguugcccagacucgucuugaacuccugagcucaugccaucugccuguguuggccucccaaagugcuaggauuagaggugugagccacugcacccagcccgaaucgggucuugcuuucaccaaguucugcuauguuucuuauuccugggaacaggcaacugucugauauaguuuggauauuuguccccuccaaaucucagguuggaaauugaucuccgguguuggaaguggggcuaacugggaaguguuugggucaugggggcagaucccuuaugacuggcuuggugcuguccuagguaaugagugaauucuugcucuaucgguucccagggagaucugguuguucaaaaagaaucugggauaucccuccucucuuucuugcuccuucuguugccaugugacacacuggcuccccuuccccuugugccgugauugaaagcuuccugaggcccucaucggaagcagaugcuggugccauguuucuuauauggccugcagaaccaugagccaaauaaaauucuuuucuuuauaaauuagccaguuugagguauuccuuuauagcaacgcaaaauggacuaauacacuaauaucucacacauuuucuguccuuacaacuuuuuggaugguuaaucaagauaaugugcauaaagaacuacauaaugcuauguaguaggcacuaaaagacacuggcuucuucuaucuuaccuaagaacaaacuugagauuauaaaaaaaugaaaaguuaaaaucucuuucuugcaaguuucauuuuuccuuuaaaaaauuuuaaaaguauaucuaaaugccaccuccugucugcuuucucaucucuggaagaugggaaaucuuccagagaugagaaauguccaugauacuccuccuuugcacucauaguaccuuggaacauucuucuuucaagcagcucaucauucaguauuuuaauugugcaguacaaugccuggcacauaauugauccucaauaaauauuuguuguagagaugucuugaaaugagauaaaauguucuccauugccuucucuugaacagcugaacaaccguacugaaaaaaauagguuuguuuauccacucagaagcuugguuuguuuuggaagaaaaaugguauuuuguuaggaaguuuaaguauuaccgucuuaaaauaaauuuaaauaaaaaaaaauaaauucugaugucuucugauauauaccuugauagaagauuuuguguugugauuugaaaugaaggcaacagugugacuuuuuuuuuuuuuuuuuuugagacagagugucacucugucaucaggcuggagugcaguggugcgaucuuggcucacugcaaccucugccucccagguucaagugauucuucugccucagucucccgagcagcuaggauuacaggugcaugccaccacgcccggcuaauuuuuguauuuuuuuuuuuuuuugagauggagucucacuccgucgcccaggcuggagugcaguggcgccaucucuguucacugcaaccuccaucuccuggguucaagugauucuccagucucagcuucccgaguagcugggauuacagacaugugccaccacacccagcuaauuuuuauauuuuuaguagagacgggguuuugccauguuggccaggauggucucaaucucuugaccuugugaucugccugccucggccuccugaagugcugggauuacaggugugagccauugcgccuggccuaacuuuuguauuuuuguagagacaggguuucaccauguuggccaggcuggucucaaacuccugaccucaaguaaucugcccaccucagccucucaaagugcugggauuacaggugugagccacagcgcccagccuccuuuaagugcuugagaauaugagauuuuaaaaaauuuauuuauuuauuguagagauggggucuuacuguuuugcccaggcuggccucaaacuccugaguucaagugauccucuugccucagccuuccaaagugcugggauuacaggcgugaggcaccgugcccagccaaggucuuugaaguacuuaagaaugacuguuucucugaacuucauuuauucaucuaacauuuauugaguucuucuuuaugcccuagucuagaccuugugcuaagggcuauggaaagucaaagaguuacaaaucguuuccuauccucaagaccuuucacuuugaugacagaggaagaccaaaacaucuccacauuacauuauaguuucauagguaagguaagcacaaaggaacauuguccauucauauuugguacacgaguuuguuguuuaugccuguguauagggugagugcagcaggaaagcuuuuuggaggagcugagacuugaaggauacauggagaaagacuggggaaaggcauuuauucccagcaaaguguauauaccugugcaaaggcagggugguauuagaagucuauaauugguucuuuauggcuggagguaaggcugcagauacaagcagaggucaaaggaaucaugaaagauaaggaaucaugugccaagauaaggaauuuaacgauucugauuuguauuuuagaaagaucacugauacagcaguguaaagguggguauauuagauuuagguucaccuacaguacaaaacagguggucucaacaaaauagagguauauuucucacacugaaguccaguuuuggcaugaugacuguaggaucaucaaagaccugaguuccuucugucugcuugacugucccuuggcacagcuuccauuacccuuauuguccagaaugacugcuggagugccauccaccauauuugaacuacagacacacuucuagcuaaguucccuuuaaguagcuaucuuggaagugucucauccagugacuuccacuucuagcuaauugaccagucguagcagcgaggaaggcugggaaauguacacuucaccuggauacaugccacccagaauaaaaccauggucuguuccuaaggaagaaagggagaauggguguaugcuaggcagccaguaguguugccacaaagaggauggauaauggaguuagggagaacaauuuaguacaauuuacccaaguaguaauacgugugauugcuuacacaagacugguuugguuaauaaugcaagaauugaaacucuguacuaacucugaguaaaagccauucugcugggaaaccuagaggacuccagugguuauuuugaugacauaacuguuuuaguggggcaaaaauuguacuuuaauuauuuuaaccuuugaauuaaaagacuuccaauuaaacuuuuaguaaaauuaaaucaguacuaaagagaauuaauguuuuuaagaaagacauugauaggaauuccuuuuuuaaaaaaguguguaguaugauuuuuaaaaacuauaugacaauauacauuaaacggguuuacagugguuuuuugggagaugaaauaauuuuauuuuucuuuuuugcaauuccuuuuuuagauuuucuauacuuagcacauguuacuuuuuuaaaaauugugauaaacauaacaagaaauuuaccaucuuaacuauuuuuagguauacaguucagugggauugaguacauucauauuguugugcuaccaucaccaccauccauccacagaccucuuucaucuuacaaaucugaaacucuggaccuauuaaagaauaagugcccauucuccccuucccccagcacauggcaaccacauucugcuuucugucucuaugaauuugacuacuguaccuaccugauguacaugggaucuauaguguuuguccuuuugugagggcuuauaugacauagcauaaugccuucaagcuuguuguagcaugugucagaauuucccuccuuuuuauggcuaauauucuguuacauguauaugcuaccaauuguuuguccacucauccguuaagggaagcuuggauugcucccacauuuugacuacugugaauaauggugcuacaaacauggguauagaaguaucuccuugagucccugcuuuucguucuuuugacuccauacccagaaguggaacugcuggaucauaugguaauucucuguuuaauuuuuuugaugaaccacuauacuauuuuccauagcaacugcaccauuuuaugcuccugccaacaguacacaaggauuccaguuuuucuacguccucaccaacccuucuuauuuuauuuuauuuuuuaguuuuuccuuuuuuaguuuuuugauaguaaccaucauaagguaugaggucguaucuuauuguauugagauuuuaaaguuuacaaaauguuugagugaguuauguaaccaaaugacagcaaguuuaaaaaacugaaauacuuagucuugcuacucuuacaccaauauuauuuguuauucggauauauugauuuuaaauuuuaaggccuuuuguuuugaaaaaguucuaauucuuuuaguuucauaucacauuucucauuuuguuacauauuuuauacaacaucauuuuaauuggaauuuucugagaaaauguugcauaugcugaggaauauauagcaugauugaauacuugagaacacauauaauuguuuggcuucugacauauagauagaugccgguuuguaugauuuuaauuucauaggcuggaugauguggugacgaagaacauguuucugggaguggucuggguuuaacuugccacuucuggcugcuugcuuuugggcaaguuucuuaaauucccugugucucauuucuucaucuuuaaaguauaauaguaccuaucucagaguugugaagaccgaaugaguuagugcuuguacaacucuuagaacugugccuggcacaucaaacauucuauguaaggcuuugcugcuauuauuguuuuaauggaugggaauuuaucucuuugguuuucaggauuauauguaauauucaaguagucacuguguuucaacauaguaugucaaaugcacuuaacuuagaaugucacaagcacugcuuuagaggagggugcagucuagaaggcuguuugggaauuaagagaagauacagcugaggcugggcauauugcuaaauuaguaauuugauauaaucaucucuuggggacugugcucuucuggcugccauuuagcuuucacaacuaacuauucuaggcucuuuuggccagcucaaacuuuugauugcuucuucaggcuuccuuacacagcuccccagauuauuuggcugggcaaagaauauuuuucucugguucuuuuuuuuuuuuuugagacagaguuucagucuuguugcccaggcuggagugcaguggcacgaucucggcucacugcaaccuccaccucccagguucaagcgauucuccugccucagccucucgagcagcugggauuacaguugcaugccacugcgcccagcugauuuuuguauuuuuaguagaggcggguuuuugccauguuggccaggcugcucuugaacuccugaccucaggugauccaccugccucagucucgcaaaaugcugggauuacaggcaugagccacugcgccuggcuauuuucucugguucuuaguuaacagcuuuuguuaagucgcuaauuuaaauagaaugcacuggcuuaaauuuuugcauaaaauagcacucugugauuuauaacauuuuuaaaaaccuuguuucacugauauucaguauaaaucugagagauggugaagguguccucauugaacaacucugguuauacugagggauuaagugccugaugucacaaagcaauuaaaugagcuaccuuggauuugaacucaagucaccuggcuucagggccaauguuuuaaaauacuguuuuuuccuugacgugucaucagauuuuaagacaauacuuuguuccuucuuuccuaauuauuugaugauacuuuuaaagauuucuaaauauuccaugaagauaauaugccucucucuuuuaaauuuaacagcugauaaaauuuaucugauucauuuuucucauacaucagcuauguuuuguagucuuuuaucccuauuaccagaaaagaaugaaauaaaaucugagaucuaaauauuuuaccugauuaaauccuuaauuuuuuacaugaauguuuucugaaaagccuuucauauuucaugauuauuuuuauuuugauauuggaacaagguagauuucucccauacugccuagcauauguaguaccuugcuuauuucaacauuacugucagaauuaaauuaaauuuugccacuagaauagcuuuacagugcuacuuucuccuuuuuucuuuuacguuguccucuucuaggucuguuuuuaauugcuuuucuccaauauucccaauaauuucugguucuaagaagagaauguaccuugagcugcaggauuugccauucucuauuuugugaaguauauuuuuccaccuaauuucuuuuauuuuuucuuuucuuucuuuuuuugagauggauucucacccuguugccaggcuggagugcaguggugugaucuuggcucacugcaaccuccgccuccaggguucaagcaauuuuccugccucagccucccgaguagcugggacuacaggcgcaugccaccacacccagcuaauuuuuguauuuuaguagagaugggguuucaccauguuggccaggauggucucgaucucuugaccuugugaucugccugccucggccucccaaagugcugggauuacaggugugagccaccgcacccagccuauuuuguauuucuuuugaaauagggucuugcucugucgcccaggcuggaguguaguggugugaucaggacucacuacagccccaaccuccuggacucaggugauccucccaccucagccucccaaguagcugggacuacaggugugcacugccauguccagcuaguuuuuguauuuuuaguagagaugggguucgcccuguuguccaugcuggucuugaacuccugagcacaagcaauccaccggccuuggcuucccaaagugaugggauuacaggcaugacccacugugcccagccuuuaauuuguuuuauauucuuuauauaauugucccuuuaucugugguuuugcuuucugcuguuuuaguuacugacuuguggucugaaaauauuaaauggaaaauuccagaaauaaagauuucguguuucaaauuguacccauuuugaguagugugaugaaaucuugugcuguccagcgcuguccuccucugucccuuuggggacaugaaucaucccuuuguccaguauaucuaugcuguagacacuaccugucacuuaguagccauuuuaguuauuagauuaaaaaacaguguguauagggugucugguacuaucccagauuucaggcagcuacugggggucuuggaacguauuccccauggauaaggggggacuacugcauauguauuggcucucacauaauuuaaaaaguugaauuguuacuuucaguguauauaaauucauacuuuauugcugcauuaguuuuuccaauaguauaaauugguucuuuucguaagaauauaauuaguuaaggcucaacuuuuggucuuuucauacaauaagcugcauuauauauaauuaauugugaauguuaccuauauauuguugauaugcucauugucaaaucuaaaaucugaguuccuuggcagauauguagacuugugauaggcauuuggcauuuuauguuuugggcaguguaacuuuaaaucuacauaaacuucucugccuuuugccucugcuguguucauagauuccaggagggcuucguguauggaccucaagcguuggagguagcagacuuuucagcagaagguaaagcagaguauugccuucuggugucauugugugugugugcugggguggguaugugacaggugagagcuuuucacaaguguaaucacuaaguaauuuauaaugaugcauuaaaugauucacuuucauaaaauuuaaaaccaagauaauacccguacaauuguauucaguauuacuaaaauucauuaaaaaaaguaacauuuagauagaacuaaagacucuaaauuucacuucuuugccauuaagaaauaguaggagugaguaggaaaacagcauuaguauaauguaugcuauauaccauguaauuuucucagaccuagcuuuacucugauuucuucgugggaacuuguccaagucauaauucauaugcugcuccuuuuacugaaaaauugcuucacaauagaggggcagccuaauccaugacucaugacuggaagauaggcauucaugcuauaggucccauuugccagaaauguuaguuuccaauaugcuaguuaccugucucuugauaacuuguuuuuuuuuuuuuuuugagacagagucuugcucuguugccaggcuggagugcaguggugcgaucuuggcucacugcaaccuccaccuccuggguucaagugauucuccugccucagccucccaaguagcuggaacuacagacacgcaccaucacgcccagcuaauuuuuguauuuuuauuagagaugggguuucaccauguuggccaggauggucuugaucucuugaccucgugaucugccuguaguuaguucucaucccacacacuuguaaaauauguuuuuauagagaccuuuuuuuuuuuuuuuuaagagacgggguuuccccauguugcccaggcuggccuugagccccugggcucaagcgaucugcccgccuuagccucccaaagugcuaagauuauaggcauuggccaccacgcccugcuauggagaccuucuuaaugagucucucuuuuuuuuuuuuuuuuugggacagggacucacuauuucccagccuugagugcaguggugccaucacaacucauuguggcuuugaccucccaggccuaagcaauccucccacuucagccucccaaguagcugggaccacaggcucacgccaccacaccugacuacuuuuuaaguuauuuguagagacagggucuugcuuuauugcccaggcuggucuggaacuuguggccucaaacaacccuccugccuuggcaguuuuguuuuuuauuuuuagaaagagaucuauagcagcuaacaauguacucuuagacauaaaguuaguaaugugacuaguuuuuagauagauucugaaugggaaucagaggaaugguuuucuuaggggcuucuggaaauuauaguuguuuagauaccaaguaagugugauaugguuuggcucuguguccccacccauaucuccucgucuugaauuguacucccauaauucccacguguugugggagggacucggugggagauaauuugaauuaagggggcgguuuccccccuacugcucucaugguagugaauaagucucaugagaucugaugguuuuaucagggguuuccguuuuuggauccuucucauuuucucuugcugccgccauguaagaagugccuuuugccucccgcuguaauacugaggccuccccagccguguggaacuguaaguccaauuaaaccucuuuuucuucccaaucucagguaugucuuuauuaacagcaugaaaacggacuaauauaguaaguugguaucaguagaguggggcgcugcugaaaagauaccugaaaauguggaagugacuuuggcagagguuggaacaguuugaagggcucagaagaagauaggaaaauguggcaaaguuuggaacuuccuagagacuuguugaguggcuuugcccaaaaugcugauagugauaaggacaagguccaggcugagguggucucaaauggagaugaggaacuuguugggaacuggagcaaaggugacucuuguuauguuuuagcaaagagacugguggcauuuugccccugcucuagagauuuguggaacuuugaacuugagaaagaugauuuaggauaucuggcggaagaaauuucuaagcagcaaagcauucgagaggugacuuggauguuguuaaaggcauucaguuuuacaagggaagcagagcauaagagguuggaaaauuugcagccugacaauguuauggaaaagaaaaacccagaaaaugggagccagcuguaaaaauuagcauaaguaacgaggagcagaauguuaauucccaagacaauggggaaagugucuccagagcaugucagagaucuucaaggcagccucucccaucacaggccuggaguccuaggagaaaaugguuuugugggcugggcuaggggucccugugcuguaugaagucuagggacuuggugcccugcaucccagucacuccagcugugacuaaaaguggccaaagugcaguucaggcuguugcuucagaggguggaagccccaagccuuggcagguuccaugugguguugagccugugggugcacagaagucaagaacugagguuugggaaccuccaucuagauuucagaagauguauggaaaugcuggaugcugaggcaaaaguuugcugcaggggcgaggcccucauggagaaccucuguuagggcagugcagaagggaaaugugggguuggagcccccacacagagccccuaguggggcacaggcuaguggagcugugagaagaccuccagaccccaaaaugguagauccacugacagcuugcaccaugcaccuggaaaagcugcagacacucaacaccagcccgugaaaguagccaggaggggggcuauacccugcaaagccacaggguuggagcugcccaagaccaugggaacccacuucucacaucagugugaccuggaugugagaccucgagucaaaggagaucauuuuggagcuuuaaaauuugacugcucugcuggguuucggauuugcaugggccuguaacccguuuguuuuggccaguuccucccuuuggaaugccuguauuuacccaauuccuguaccccauuguaucuaggaagugacuagcuugcuuuugauuuuacaggcucauagguggaagggacuuaccuugucuuggaugagacuuuggacuguggacuuuuggguuaaugcugaaaugaguuaagacuuugagggacucuugggaaggcaugauugguuuugaaaugugaggacaugagauuuggaggggucaggaguggaaugauaugguuuggcucuguguccccacccaaaucucaucuugaauucuacagccauaauucccacauguugugggauggagccagugggagacaauuugaaucaugggagcaguuucccccauacuauucuugugguagugaauaagucucaugagaucugacgguuuuaucagggguuucugcuuuugcauccuucucauuuucucuugcugccaccauguaagaagugccuuucgccuccugcuaugauucugaggccuccccagccauguggaacuguaaguccaauuaaaccucuuuuucuucccaaucucggguaugucuuuaucagcagcaugaaaacggacuaauacaaaguagcugcauauuauaucauauauuuaggauauacaccuuaugugaaguuggauaguauguauuuaugaaaucucuacugugugcccaacacaggagcacaccauuuuacaaugaaccaaguuucacuauucuuucacuuccuccuauucagagaagcuauuuuuuuuaacuagaagagauaggugaauuucaggcuauuuauugggguaagcuacaauuuuacuucccaaaccuuuuugccuuuauuuuacuuuuuucaguggcuauuuugaggauauuuucucuuuaccaauaauagguuggaagcaauuuaaagccuuucauacauuugcaggcuaguuggccauuuucaucacuguugaauuaugcauucuuauauuuguuuagcuaaucugacugugguguauuuugcuaccaguugagaaucucaauagaguaucuguaucaagacauaggaauacuccucacccagcucccaacuccaacucaguuucuaugagaaagaugagauuaaauggaugguuaugaaaauauuaaaaaaauuaauugacuauuuucuugagcaguuuuagguuuacagaaaaccuggaguagaaaguagaguucccauauaccacccccugcuccccaguuuucccuauuauuauuauuauuauuauuuuuuuuuuuuuuugagauggaaucuugcucucucacccaggcuagagugcaguggugccaucucagcucauugcaaccuccagcucccggguucaagcgauucuccugccucagccucccuaguagcugggauuacaggcauguaccacuaugcccggcuaauuuuuguauuuuuaguagagacaggguuucaccaugguggccaggcuggucucgaacuccggaccucagaugauccaccugccucagccucccaaagugcugagauuacaggugugagccacggugccuggccaauuuucccuauuauuaacaucuugcuuuacugagacacauuuguuaaaaucaauaauucaguaucguugcauuauuguuaacuaaaguucauaguuuacauuaggguuuuuuuuuuuuuuuuuuuuuuugagacagagucucucugucacccagucuggaaugcagugguacaaucuuggcuuacugcaaccucugccuccaggguucaagcaauucuccugccucagccucccgaguagcugagacuacaggcacgugccaccaugccaggcuaauuuuucuguauuuuuaguagagaugggguuucgucauguuggccaggcuggucucaaacuccugaccucaggugauccaccugccuuggacccccaaagugcuaggauuacaggcuugagccaccaugccuggccuucauuuggguuugcucucuacacauuagguauauucuauggguuuugauaaauguguaaugauauguauuuaaccauuacaguaucauacagaguagcucacugcccuaaacaucaccugugcuacaccuuuucaucccugguucccucccugcaagccccugacaaccacugaucuuuuucugucucuacaguuuugccuuuuccaaaaugucauagaguugaguauguagcuuuuucagguuggcuucuugcacuuuguaauaugcauuugagaauccucuaugucuugucauggcuugauagcucauuucuuuuuagugcugaauaauguucuauuucuggacauaucaaguuuauccauucaccuacugaaggauaucuugguugcuuccagcuuuuggcaauuaugaguaaagcugcuauaaacauuuguaugcagguuuuucuuuagacauguuuucaucuucuuuggguaaauaccaaggagugcaguugcuggaucacauggcaugaacauguuuaguuuuguaagaaacugccaaacugucuuccaaaguggcuguacuacuuugcauucccaccagcaaugaacgagcauuccuauugcuccacauccuugucagcauuugauguugucaguguuuuggauuuuagccaugcuaguggguguacagugguguguuuuaauuugcaaccucuaaugacaugagaguugagcaucuuuucauguguccuauuucccaucugcauuucuucuuuggugaggugucuguucagaucuuuugcuuauuuuuuaauugaguuguuuguuuucuuuuucuuuuuauuuucuuuucagagcuccucucaagaaaggagggcugucuguuuucuuauuguugaguuuuaagaguucuuuguuuauuuuugauaccacuucuuuaucagauauuuguuuugcaauuauuuucucccagucaauggcuuguauuuuugccuucuugaaaauaucuuucacaaagcaaaaguuuuaguuuuacucaagucuaacuucccaaauuuaaaaaauauuuuuaauugauauauaaugauuuuacauauuuaugggguuacaugugauacuccaguacauguauacaauguguaaugaucaaaucaggauaauuagcauauucaucaccucaaacauuuaucauuuauuuguguugggaacauucaaaauucucucuucauggcugggugcuguggcucacaccaguaaucccagcacuuugggaggcugaggagcguggaucaccugaggucaggaguucgagaccagccuggccaacauggugaagcccuaucucuacuaaaaauacaaaaaauuagccaggcauggugacguaugccuguagucccaguuacuugggaggcugaagugagagaauugcuugaaccugggaggcggagguuuuuggccaggcuggucucgaacuccugaccucaggucaucugcccaccucagccucccaaagugcuggguuuacaggcuugagccacugcaccuggccaauuauuauuaacuauagucacucuucugugcuauggaacaccagaacuuauuccuccuaucugugauuuuguaccuguuaaccagccucuccuuuucuccccauccccuggcccuucccaaccucugguaaccacuguucuacuugguacuuccaugagguuaacuuuuuuuuuuuuccuauuuauuuauuuauuuauuuuugaggcagagucucacucugucgcccaggcuggagugcaguggcacaaucuuggcucacugcaaccuccaccuucugguucaaaugauucucuugucucagccucccgaguaacugggacuagagacacgcaccacaaugcccaucuuauuuuggaauuuuuaguagagacaagguuucaccauguuggccaggcugaucucgaacuccugaccucggugaucugcccaccucggccucccaaagugcugugauuacaggcaugagccaccaugcccagccuuauuuguuuauuuucuuagagacagggucucacuauauugcccaggcuggucuggaacuccugggcucaagcagucuuccugccuuagccucccaaagugcugcgauuacaggcaugagccauugcacuagguaggaucaacuuuuuguacuccuacacauaagugaaaaugugguauuugucuuucuauacauugcauauuuuacuuaaaauaaugcccugcagggucaaugaugcugcaaaugacaggauuucuuuuuucuuucuuuuuuuugagacagagucucgcucuguugcccaggguggaguccagugguguaaucugggcucacuggaaccucugccucccgguuucaaaggauucuccugccucagcuuccugaguagcuuggauuacaggggccugccaccacacccagauaauuucuuuuguauuuuuaguagagaugggguuucaccacauuggccagggugguccugcaccccugaugucaagugauccgucugccuuggccucccaaagugcugggauuacaggugugagccaccaugccuggccugcaaaugacaggauuucauucauuuguagcugaauaauuuuccauuauauauaugccacauuuucuuuauccauucaucucuugaaggauguuuagguugauaccuuaucuucaguauugugaauagugcugcaauaaacauaggagugcagcuaucucuuugacauacugauucucuuuccuuuggguauauaccaaguagugggauugcuggaucauaugguauuucuauuuucaguuuuuugaggaauguucauacuguuuuccauaauggcuguauuaauuuacauucucaccaacaguauauaagaguuccccuuucucugccuccuugccaacauuuguuauuuucucuuuuugauaauagccauuuuaaacuggugugagaugauauauaucauugggguuuugcauuucucugauaaugagugauguugaacauuuuucguauaccuguucgucauuuguauaucuuuccuugagaaaugucuauucagaucauuuaccuauuuuuuaauuggauuuggguguuaaauuguucaauucuccccauguuauauuuauauauauaauauucccuuccccuccccuccuugucuuuuuuuuuuuuuugagauggagucuugcuguaucaccaggcuggagugcaguggugugaucucgacucacugcagccuccgccucccggguucaagcaauucuccugccucagccucccaaguagcugggacuacaggcacgugccaccacacccagcuaaguuuuuguauuuuuaauagagacgggguuucaccauguuguugggcaggauggucucaaucuccugaccucgugauccacccgccucggccucccaaagugcuggaauuacaggcgugagccaccgcgucugaccuguucucuucuuuucguugauauggauucucacucugucacccaggcuggagugcaguggugugaucauagcuauuugcagccucaaccuccagggcucaagugauccuucuuccuaaaaugucaaaaauuuuuaauuuuuuguagagacgugguccugcuauguugccuaggcuggucucaaacuccuggauucaagcaauucucccacuucagccuuccaaaguguugagauuauaggcaugagccaccaugccuggcucuuuuuauuuucuuuaaagugccuuucacagagccuaaguuuuucauuuuagucaagucccacuucccaaauuaaaaaaaaaaaaugaauuguguuuuaguacuguaaacccaaggucaucuagguuuucuucuauguuauccccuaaaauuuuuauuuauuuauuuauuuauuuauuuauuuuugagauggaguuuugcucuguugcucaggcuuguguacaguggcacgaucuuggcucacugcaaccucugacuccugaguucaagcaauucuccucccucagccuccugaguagcugggguuacaggugccugccaucacgcccagcaaauuuuuguauuuuuaguagagaugagguuuugccauguuggccaggguggucuugaacuuccgaccucaggugauccaccugccucggccucccaaaguacugggauuggaggcgugagccaccguguccggccuucucuaaaaauuuuauaguuuuccauuuuauauuaagucagcaguccauuuugaguuaauuuuugugcaggguguaaggucugugucuagauucuuuuuuuuagcauaugcacguccaguuguccagugcuagaacuagcacuguauguugaaacaacuucuuucuccauugcuguuccuuguuccuuugucaacgaacaugugaguauauuugugugagucuauuucugagcucucuauucuguuccauugaucuauuugucuuuucugucaccaauaucacacugucuugauuacuguggcuuuauaauaagucuugaaguuggguaguaucagucuuccaacuuuguucuucuccuucaauauugcauugguuauucugggucuuuugucuuuccccaugagcuuuagaaucaguuugucaauguccacaaaacaguuggcugggauuuuguuugggauuauguuguaucuauagauuaaguuagaaagaauugagcucuugacaauauugagucuucuuagacuuauauguggaauaucucuccacuuauuuagaucuuuuuugauuuguuuuaucacaguuuuguaguuuaaguuuuccuuauauauauuuuauacuuuuguuagauuuauaccuaauauuucuuuuuuggguugcuaaugugaaugguauuguauuuguaauuuccaacugcaauuuuuuauugcugguauauaauaaaacaauugacuuuuuauauuaaucuuguacccugcaaucuugcuauaauuguuuauuaguuccaggaguucuuuuuuguugauucuuugggauuuucuucguagacaauuacgucgucugugaacaaaguuuuauuuuugccuuuccaaucuguauaccucuuauuuccuuuucuugucuuauauuagcuaagacuugcagucuauguugauuaagaguggugagagcaggcugggcguggcggcucaugccaguaaucccagcacuuugggaguccgaggcgggcgguucaccugagguugggaguuugagaccagccugaccaacauggagaaaccccuucuguacuaaaaauacaaaauuagcagggugugguggcuuaugccuguaaucccagcuacucgggaggcugaggcaggagaauugcuugaaccugggaggcggaggcugcagugaguugagaucgcaccacugcacuccagccuggugauagagcaagacuccuucucaaaaaaaaaaaaaaaaaaaacauaauaagaguggugagagcagacaucuuugcuuuguuucugauuuuagggggaacguguuuaguuucucuccacgaauuauaauaaucucaauauauuauucuauauuugguaguauaaaaauugucaaguacugcuuauaucagaucauaggagcacuccauucucuuucccuccauuccuucacuuugccuuaacuuuuaugagaaagaugggauuaaauggauggucauaaaaguuuuuuaaauuaugggauucaggcaguuuuaauauauaauaccuucuauuuucuuuaguuucucuauucugaacuucuggagggcaaagacuauaccucaguauauuguugcaagcguuguaguucccaauauguacuacaaugcccuguugaauguaaaaccuaauucuagacucuuacuguaaaccucuaucuuauuugaaaaggcagauagccagugaagucagucaucuaaucgguuaaucaauucaucaaauauuugauuguuagcuccaagguauuacauuggcuacaaagauacacaugauaaugauacuuccucucuggaaacuuauuauucauauaagaauaauuucaagugcuguguuccauuuuuacugauauguauuugucaaaaacucauauuccuguaucucuucccaaguauucuaauugaaaugccuaugugugaacuucuuccauagucccuaaaagguuuacaauuuuguuggaggaacugauauuaaugaaccuauaauaggugcuggacacugugcuaggugcuuuacguauucugccuuaucucauuuaucuucaaagcuguugaauaagguaaauauucuuaauuuacaggugcaaaaacgauaauaugaagguauaaguaaccuauucgcugugugacuuagugggauagguauaugagguauauaaguccauagcccaaguucuuuaugucacacacuauggaaaaguuaccauacaaagugguauaugaugaaugcuacuuguauagugcauacacaugcuuggugaaugcagagaagagagcuuugaccucaggcuaggguguucacaaaauuucuggaaagcuuaaucuugucugauaggaggaauaggaggaaagagagaucagggaaaucaaucagugagaagaagauggagggccaaaaacagugaauauuuugugauugacaguauacaaauuucuacuguggcaguaaaauacacuagaacaaauuuugucuuuuauuuucaaugaggauccuucuucuccauuuuucuguuaaacaaaauaauuuuucccuaauuugcuuaugggguauuggguaugagaaaguagaucacagaaccuuugcauaacuccagaguuaucaguccccaaauucaucuuuuuccauuggauuagcacagucagggcagcaguaauugagggagcaaaagccuggggggaaaauggaagaucaaaggaauccuaagaaaaggauuuuccuagugucaaguguauuuuauuuaucccuucuccauaucucaguugguuaaguaccucacaaauacccauaaauaugugaaaagcuguggaguuacagaggcuuguaggaggcaucauugcuuucaaugaacuuaguauuuaguuggaaagacaaaaguaaaguaaaauaauugguaaaccacugagcauccuuaagugaaauuuaaaugaaaaacauccuuaaaugauguuuuucaggauucuuuucuccuagucucaugacuucaauuucuaaauacuuucacaucucuaucucuaguccacaucuccugucuaaacuauauguguguccagacgccuuuuggacgucuugguuugcacaauaccacagucuucucaacuuauuuaaaacuugcccaaucugcucuucuuaacucagugaaugguaucaccaucacccauugcccgagcuagacacugggaaucaaguuuuugcaguucuuucucuuguuucuucaccacauguucuguugacacuguuuccuaauuaccuguaagauccauccacuucuuuuuauugccucugcuacuauccuaauuuagacuauagccaccucucauuuaaauuauuugcaaaggccucuuaaccaguugccugugcuaucuucacaccuucagacuacaaaaaucacagauugugugcugggcaggguagcauguaccuguggucccugcuacucuggaggcugaggcaggaggaugacuugagccaaggcauucgagaccagccugggcaacaaaaugagacccccuccuaucaaaaaacaaacgaaaacaccaacccagauugcuuaaaauccuuaccuguguuccuacuuguucugcuucaucuggccuucuugcuucuccagcuuuaacuugcuuuccccuacuugaaaccagccuuacugaacuucagauguaucgugcugucuugccugugagacuggacaggcauauuccccgucugagaagggaaauaaucacuauagcgauuaaagcacagacucuuuagccagacuacuuaaguuugaauucuggaucgccacuuaaugagcuuugugauauagagcgaguuacuuagucuaccugcuuucaguuuccucaucuguauaauggggaugguuaauaguaccugcuucauagcacguuguagggauuguaagaguuuuguaugcuuugagacaaggucucgcccugucgcccaggcuggaguacaaugaugugaucacagcucacugcagccuugaccucucaguucaagcuguucucccaccucagccuccugagucacugggacuacaggcaugugccaccauguccaacucauuuuuguauuuuuuuguagcgacagggucucauuguguugcccaggcuagucuugaacucuugggcucaaguaauccucccgccucagccucccaaaguuuugaauuaacaggcaugagccacugugcccagccuaaaagaguuaauauaguugaggcuuuuuuuuuuuuuuuuuuuuuuuuugagacaaagccuugcucuguggcccaggcuggaaugcaguggcacaaucuuggcucucugcaaacuccaccucucaaguucaagugauucuugugccucagccuccugaguagcugggacuguaaggcacgugccaccaugccuggcuaauuuuuguaguuuuaguagagauggaguuucacuauguuggccaggcuagucucgaauuucuggccucaagugaucugccugccucggccucccaaagugcugggauuacaagugugaugcaccgcgccuggccuaguugaggcuuuuagucggucccugccauauaguaaguaccauacaaguguagcuauuauuauaaaucuuauuguaaauguguuguauuggauaguauuacuuuuuguuuuaauguugauuuaaugguaaauggaaaaaugcuguugcccuccauaaguucccaguugauuggcucauuauuauugguauuuauucugcuuuggcaguagcuuucuuuuccuaacuucuuguuuuucagcuuuuuagugacuagaauuuggucuuggguuggcauuucuaugaaauggaucauuuaacgaggucagguuaaccugaccuuucauacaggugaauucaggucaauuuauauggaaacuuuuaaaagaaaaugauuauuauacaaguaguuaauauucauuauggaaaaaucaaaaaguauagauaagcauaaagaaggaaauaaaauuaucuccaguguuaauauuuuauuuuacuuauuuauuuauguuuuagagcuggguuuugcuauaaugcccagguuggccuugaacugcugggcuagagugcaauggugcgaucauagcucacugcaacuucgaacucccaggaucaagcuauccuacugcugcagccuccugaguagcugggacugcaggcaugugcuacuaugccuggcuaauuuauauauauauauauauauauauuuuuuuuuuuuuuuuuuuuuuuuuaagacggagucucacucuguugcccaggcuggagugcaguggugccaucucggcucacugcacgcuccaccuccuggguucacgccauccuccugccucagccucccgaguagcugggacuacaggcacccgccaccaugccuggcuaauuuuuuuuuuuguauuuuuaguagagaugggguuucaccguguuagccagaauggucucgaucuccugaccucgugaucugccugccuuggccuccugaagugcugggauuauaggcgugagccaccaugccuggccaaaauauuuuuuuaguuuuuguagagacagggucuugcuacguugaccaggcuggucucaaacuccugggcucaagugauccuccugccauggccucccuaagugcuaggauuacaggcaugggccauuauaccuggcccaucauuuuuuuuuuuaaguauuuauuuuucauugauauuuauauuugagaugauuucaugaagacuuaaaucuuaaaaugcaccuaaggggagaagauuuuugauucaguacugucugaucugaugaucuagcucuaucugaucugacagggugggauuuaagaauggcaaaauauuuauauuuuucuccuucccuccagaaggagguacuugcuuuuaggugaauuucuagauauaauuaccuuuacaauaaaaauacugauguuugaucaucacugucauuuuaauuuuauuuuucagaauauauauauuuuuaucuuuggaguguaguuaaaagacaguuuucuagauuuucuuauuacugugaaaauauuuuuuaaaaugaccaagacuaaugaacaaguuuauuuugguaacauguuuaguuccuacuguuugcaaaguacuuagcuccuagagaauauacagaaaugagcaagauagucuccuuccucauuuggggaugggguaagggagaugaaucaauucuaacuaauuauaauaaaguaugguaagguccuugagagaguauugaacaaagcgcuugcucuacuagugaugcucucacaaaugucauuaacuguuaaauucgaugagcucuuuuccauucucuccuauuugaccuugcuucuacauuugacacuuuugcccaccuacccuuuaaugcuuguuucuuugcuucuguacaccccuuucuuauuguuuuucauuguuuuucuuuuuaacuccuuuuuguugcggggaggugggggacagggucuugcucuguagcucaggcuggagugugguagcgcaaacaugacucacugcagccucaaccucuugggcucaagcgguccccaaccucaacauccugaguagcugggaccacaggugagcaccaccaugcacagccaauuuuuaaauuuuuuuuagagauggggucuugccacguugcccaggcuggucucaaaacuccuggccucaagcaauucacccaccuuggccuccuaaagugcugggauuacagaugugagccaccauacucggccuucucuuuaacucuuuaacugcugcuuauucguuauuucucucuucaauuuuguuauuaagaaaaguucuguaaaagcagaaaaguuuacuuuagaacagugaacaccuacauucagcugccuugaaugccuagguucaauuguuauuaucuuucuauaagugcuuuauuucuauguacauauaugaaugguuuuugauguacuugaacaaccugaaauuaauuuguuguugucauuacaugucacacacaaauaguugaaccuauaucucuuaagaauaagaacauuugcuugcauuaccauaccauuauccuauauuugacaguuaauaaaaauuaaaaaauaaaauuaaccauaucauaauaauauuauguaaauucugguucauaauuaaauuuccccaggugucccacaaguaaacuuuuauagcuauuuuuauuugaaccacaauuuagucaaguguuucgugcauaguauuugauuguuauaugcuuugagucucuuuucaucuagguuauccuuuuuuauggcucuccuuuucuaaggggaggggagucaacccaauuuucuuagcauaucccacauccagauuugcuacuaucggggaauuuuaauaguuucccuuucuucagccuuuuguaggaugguguuuacugaagaagggcgccuguggcaugggugcugugaauggguuauggguccuguuaauuaauccucuaaauucuuuggcaaccagugggguuuagggcaguggaagcccauggguccuuuucucucugcccgugugugguuuugucuguuucuacccugguguccagaguagaaauaauagcauuaugugagugccaucaugugaaagagguuugguugcacugaccacuaucuuuagcccuuugguucuguguucuuucccuuugugaucacaguuacuucugugguuuuaacagucaccucuauggagauguucucuuuucugaacuccaguucuguuauuuucuuucauucauauucuacugccucuucaguugcuacuucaaaaucaacauguccaaaacgaauuuauucucuacuuccaaacuagcccauugucaguauuauuuuuucuuuuuuguaaauggacuuaauuucacugagacaacacuuugacuagaaaucucaguuaccuucagcuguucuuuuggcugucugcccaagaaacauauauauacacauacacacacacacacguaaauauacacauacauauauacacaaacaugugcacacauaugcauacauauucauuaaauauuucuugaaugccuacaauguaccuaaauauauuuggccacaguagauaauuuuuuuuuuuuuuuaagacagggucuugcccaggcuggagugcaguggcgcaaucuuggcucacugcaaccuccacuuuccuggcucaagugaucuuccagccucagccuccugaguaucugggaccaaggggcgagccaccacacccagcucauuuuuguacguuuuuuuuuuuuuugagacagagucucgcucugucucccaggcuggaauacaauggugcaaucucggcucauugcaaccucugccucccgaguucaaguaauucuccugccuuagccuccugaguagcugagacuacagacacgcaccaccaugcccagcuaauuuuuguauuuuuaguagagacaggguuucacuauguuggccaggcuggucuugaacuucuaaccucaggugaugugccugccucagccuccuaaauugcugugauugcaggugugugccacgccuagcuaauuucguauuuuuaguagagacagaguuucaccauguggcccaggcuggucuugaacuccugaucucagugaucugccugccuuggucucccaaaguguugggaucacaggcaugagccaccgcaucuggccauaauagauauauauuuuuuucucugaaaugccucuugaguccauucccuccauucugacuacauuuacucuaauuuuggcccucauccacccuccucaaacuucuacauugaucccccugccucuggcuuuaaaucuucugaucuacccugcauacuaucugcuuacugagaauaccuguuugaucauguuucucuugcuggaaaaccucugauggcuuucgauaguacaggaaaagugccaaguuuucagcauaccauacaaaacuaugcugauucugucugcuuugcucuuuucuuguguuuuuucaccucuuguauucuagcuguauuugucuuuggcuaauugcuuggauauagcauggaucuuaaucuuuggacuuuguccacacguuucuggugucuauaaggcccuguccuuuccuccuuugcucagugaaauccugcuuaucucucgggacccacucaaauguuccuuugaaaauuguuuaccugauagcagucccugucuauccccuccaccacaaccaagcccuucuauucacucauuaucugauguucuuugcauguuuuucuguuauagcauuuauuagauuguacccuuugcuugugugucucucuguauaaagacucacaaggggcuaggcaugguggcucacgccuauaaucccagcacuuugggaggugaggcaagcgggucaccugaggucaggaguucgagaccagccuggccaacauagcgaaaccccaucucuaccaaaaauacaaaaauuagcugagcaugguggugcaugccuguagucccagcuacuuaggaggcugaggcagcagaauagcuugaaccugggaggcggagguuguagugaguugagauugugccacugcacuccagccugggcaacaagagcgaaacuucaucucaaaaaaaaaaaaaaaaggauucacaagggaagggaucagcucuuucugaaauuccaucucaaaaaaaaaaaaaauucacaagggaagggaucagcucuuucuuccuccuguuccuggaaccuagcacagugcuugacacauguuaugugcuuaguaacauauuucugaaauaaaugccucacaucacuuauuauauuaccuucuguugcaaguaagucugacuuaagauucaugaauucucaaaguaagauaauguuuucuauaaaaaauuuaguuuaggccaggcaggguggcugacgccuguaaucccagcacuuugggaagccaaggcgggugcaucacgaggucaggagaucgagagcauccuggccaacauggugaaacccuguuucuacuaaaaaugcaaaaaaauuagcugggcaugguugcgcgugccuguaaucccagcuacuugggaggcugaggcaugagaaucgcuugaacccaggaggcagagguagcauugagcugagauugagccacugcacuccagccuggugacagagcgagacuccgucuugaaaaaaaaaaaaauuaguuuaacuaaauauuuacuaaugauugcagucuauuaaucauuaauguuuuaagccuaagccuuaaaagcaaugccugaagucuuaagcauuacugcagauacauuuuuuaaaaauucauuucccagcaauaagaauuugccauuuuuaggccaggugcgaugucucaggccuguaaucccaacacuuugugagguggagaugggaggauugcuugaguccaggaguuugagaucaaccuggguaacauagcgagacccugucuuaaaaaguaaaaaauaaauaauuagcugggugugaugaccugugccuguaaucccagcuacuugggaggcugaggcgggaggauugcuugagccugggagguugaggcugcagugagccgugauuacaccacugcacuccaaccugggugacagagcaagacccugucuaaaaaaaaaaaaaaagaauuugccaauuuuagaaacaaauuaagcauuaaauauugaugauauguaguaauauauuuaccaaugcaacauugaacuugagauuuuggaagugcacugacaguucaaguaguuguugacuaaaaaguaagaagcuuggggaaauauuaucaacauauccuaauuaauaagauuugaagcauuaguggaccacuggugaaguauauugaugugcaaauucaauucaguaaauuguuuuucauuaaaacucuccaagauaugguugcauacaaaugucaaauaaauaugaacaccuuaaaaaaaaagaaauuauacaauuaauucaucaauuaaaacauuauucuaagccaagcauugugguucaccccucuaaucccagcacuuugggaggccaaggcaggaggaucucuugagccuaggaguuugagaccagccugggaaacauagugagaccccaucgcuacaggaaaaaaaaaaaaaaaaauccaggugugguggugcacaccuauagccucagcuacucugaagcugaggugagaggauugcuugagucugggaggucgaggcuguagugagccaugaucgcgcuacugcacuccaaucugagugacagagaccuugucuaaaaaaaaaauaaaaaauuauucuaguuguuuugaaaguuuuuuuuggcuaaacuaauagagauuucuaaaauuuuauaauuuuagagcuuuuaaaauacuaaauauuuaucugacuuggaauucuaaaugaaggaaauaguauauaaugaagaucauuuuuaagagaaagauaacuagcuaggugugguggcucacgccuguaauccuagcacuuugagaggccaaggugggcggauugcuugagcccaggaauucgagaccagcuugggcaacguggcacaacccugucucuacaaaaaguacaaaaaauuagccuggugugguggagcaugccuguaauuccagcuacuugggaggcugaggugggaggaucaucugagcccggaggucgaggcugcagugaguugaggucguaccacugccuuccaaccugggugccagagugaagcucugucuaaacaaacaaacaaacaaauaaaaaaccaaaaacaaaaaaaacccgagauaacuagucaaucaguuuguaagaaaaaggaguaggcuaggucaguggcucauacuuguaauuccaguacuuugggaggccaggaaggaggauugcuugaggucaagaguuugggaccagcuugggcaacauagugagacccugucuccauacauacacaaaaacaggaguaaauaaagguagucuuucuaagaaaugaaagcaaagacauaaucaaacuguugucacauuuucauguugcgagggaauucuuaaguugaauaaagaagaauaguacuguauuuuggugauguuuagagauagaauaggugaaauauuugguggaugaaagcauaauuuuugaagcacauuuuugucagaaaaggaaaggaaagcauaaagagugugcuaguauuaucugacaucauucauuaauaagaagaaaacaaaauaauagcaguaccuuauguuggaagauuuuaaauguuucagaauuacuuuaaaagacuauucaaacuagaaaaauucuugauauuaaaguguuacgacauugaacuauuuauaaaugaaauggaaagaugucugggauuuguuucaaaauaauuaagaaaaguagaggcaguagaaauaaggcuguccacgaguugauaauugugggauggguacaugcagcauuacugucauuuauuuauuuauuuuugaaaaauuucaucauaaaaaauuuaaauauguuauuauguaauaaagaauacuguuuccaaauaagggaucauuacuacuaggcuggcugaauauugggcucaugaugauacugaauaauucagaaugauacccauaugaaacaagaugaucuuuuuuuuuuuguuauuucaaauuuuuauuccacauuguguuuuaaaauuauuuuuccauguuguggaagccuccuacucggcuaagccaaaucaucacauaauaaaggaaagggauacaacauugauuuauuucaucauucuucuugaagaaaaaaauaguuggcucagaugucauaugauuugaagaaugucuuuuuuuuuuuuuuaaucugaccaauggaugcacaucacauaguuugaagaaugucuuacuaguaacaccuaguuguaaaaacugguaauacugucuuauuuuagauacuguauuucugaugauuucaugauuugaauuugacucauaagguuuagaaaaagcaaacuucauagaauuguuugucuucuaaggcaguggucuccaaccuuuuugggaccagggacggguuucguggaagacaguuuuuccacagacccagcaggguggggaugguuucaggaugauucaagugcauuacauuuauuuugcacuuuauuuguguuauuauuacacuguaguauauaaugaaauacaacucaccauaacguagaaucagcaggaguccuguguuugcuuuccugcaacuagauggucccaucugggggugaugggagacagugacagaacaucaggcauuagauucucauaaggagcaugcaaccugucucuugcacgugcaguucacaguggguuuugcacuucuaugagaaucuaaugccgccacugaucugacgggagguggagcucaggugguaaugggugugauggagaguagcuguaaauacagaugaagcauugcuugcucgcccaccacucaccuccagcuguucagcccuguuccuaacaggccaccaacugguagggaucugugggccaaguguugaggacccuguucuaagggauaugaaagagaaguauugggcugggugugguggcucaugccuguaaucccagcacuuugggaguucaagguggguggaucgcuugaggccaggagucgagaccagccuggcaacauagugaaacccuaucucuaccaaaaauacaaaaauuagcugggcgugguggcaugcgccuguaaucccagcuacuccagaggcugaggcaggagaauugcuugaaccaggaagcggagguugcagugaagccaagauugcaccacugcacuccagccugggugacagagugagacucugucucagaaaagaaaaagagaaguaucuucagaacuguuuccuucccuuccucccucccuccaguucuuuccugggcacucaaaagucuucuuaucuaugugcuacuuccucuaggcaauaucaucacaucuauggauucaaaccuuucagucugaaacucugcuauaguagacgcuuaguaaauaaauaucuucaggacaucuccuuuuugaacuuccgagauauuuucauuuuugguugggguuucuuucuauguaaaggaaucauuuauaagcuacagaaucuucugagaucugauaugaaccuuguucuuaguggcaucauccuugcaucagccaagcucaaaaccucagacucaucuuugacucuuccuucucaaucuuuucuguucauuuggucccaucaauuccuccuuuaaaaugacuaucacaggugucccuucuuuucuccugucuuauuaccccucugucaugaagaauuggaagagcuggucuuagcucugccucuggcugcuggccuaguuucuucaucacugaagugaacagauuauacaggauugucuuagaucccuuucagagcuaacauucuguucuacucauccagguuuucaccuucucacacuuacaucacaguaacuuccuaauuguuuuucaucccuuuaaucuuaguccucucuaauaagauuaaccuucauauguaauuuucauugcuuuuaggauaaaaucuuagguuuccaggucuucauuuaggucaugucaucauuucuuugguuaauggugugaucauuuggcugggcgcaguggcucacgccuauaaucccagcacuuugggaggccaaggcgggcggaucaccaggucaggaguucgagaccagccuggccaacauggugaaaccccaucucuacuaaaaauacaaaaauuaucugggugugguggcgggcaccuguagucccagcuacucuggaggcugaugcagaagaaugcuugaaccugggaggcggagguugcacugaacugagaucaugccacugcacuccagccugagcaacagagcaagacucugucucaaaaaaaaaaaaaauaguguggucauucauaugaugaggcaaaauaaugauuucuguuuuuugcacagaugugugcuuuuuauauuuucuacucucuauagaauuguuugcaucaaaaauuuuccagagccaggagggcgcggugguacaggccuguaauccuagaacuuugggaggcugaggugggcggaucacuugaguucaggaguucgagaccagccuggccaauauggcgaaaccccaucuuuacaaaaaauacaaaaauuaccugggugugugguaugugccugcagucccagcuacuugggagggugaagugggaggaucaucugagcccaugaaguugacacugcagugagcccagaucgugcuacuguacuugggggacacauuugucucaaaaaaaaaaggaacauagugucucagauggaagaccuaauagaauuggucugugucaaauuuauuuguucuauuuuguuacguaauguucacaucaaacaauuguuuuucauugugacugcugagagugaaguuuucaugguguugcuacauguuauagacauauagaagaaacaucuugauauuuaaaaauucuauauagcauuuauccauguuuauaguacaaauacauguauuuuuaauucuucuggaugcauuuaguaaauuccucugauuaauuucaauaugcaguugcucuaaucauacuaucuaauauacacgaaaauguagaaaacaguuucucugaaggcuuuggaauugcuuugucuaucuuuauguuauuuagaaauaaaaguaauuuggaaaugaaauaguuuuaaggaggaacuaagcugccucuaaaagcuggauuaucauagcaguguaggcuaggcagguucaccugcuuuucagcuuugucauguaaaauaaaaaauuguucuuuuaugauauuuaauauuacaugugccugaaacaucuaagcugugagguaugaauuccucuacuuggaggaacuccuggagaggggcacucacgugggaugagagcaauaaagcuucccugucucaugugccuaaucauugaaauauuucuagacguuguguuaaaggaugcauguuuugucuucagacuaagguguuggcauaugcccaaagauuggcauucacguaguacagugccaagaagucccauaugcccucugggaccuugcaacuucuucauauggugaaccuuagagaugcugcaucaucacuuaccaucugacaguuaguuuacaaagagaaauaguaaugauauauguacuuucuuucauucucaauuuaaauguugcaaauaaaucuuaaaauugcaaauuuuuuaguauuuuauuuuagcagguggaaguuauauuuaaacuuauuaagugaaauaauuacuggguuuguuccuuguuccuguccacauaauuuagaguaaaaggccuaugcucagucucuucuguucaagcuuucaaauuccuuugacagccuggaugugaaauucaaaagccauuaauuugauguguuaauuuugcacuuuuugacuuacugcaaagaucuuauaguuuccauagcaacuauaaccuauccagauuguguaauauucuuuacaguauuaaaaauaaaacuaugcaauuacaugagcuucuggacuacuuugucuaggggaacugaggauugaaauguuucuguugaaaaaauuauaguuucaugugaaaaauuuuuuagaaagcuuuuauaauuuuguuucaagaauacaucaaacuuaaauauuuagcaauagauaccugauagauaacuuaauuauuaaauguauaaaauuuacaucguaagcauuguguugagcuucucaggcacaugugcucucacucuguacccacaaauacauuuaaggcacaggagggacacuuggcuuugauuacauucaaucaccugcaguuuaugcuucuuaauggcuucugaguggucugaaaaagucugguuuuaugucugggcaaaaaacaggauggagaaaaaggaaaaaaugaucauuuaaacuuuccuuauuuuugacuuugcuuuuuaaaacaugccugagcuaucacuuugaaaauacuaaagauuguuuuaguagguauucucagaguaucaauuuauuuuggcuuuuuaaaggcaauauaauauuagcacuaaaguuaguugacauaacuuccuauaucuuaacguaacuguuaauuuuuuguauugccuucaacauauuuguagauguauauuuuuauauaguauaauuuguguauuuucucaguaguauaugguaaauauuuuccauguuucuaaugaccuucuagccaucauuuaaaaaauugcaucauaguccaucuuguugacauaccuaguauguuuuauuugucaaaauacuguuuaauuauuuccugaaugcuaucuguuggaagaaaaauggauauaauuuucaaacucauugugagggaaaguaaccauaacucaauuauuugcuugaagaugauugugaaaaucuucaaaagggauuuaaaaugguguuuuaaaauguggauuuugaauaacauccuaaacugcucuaucugcagguaaacauagaauggggaaaaugaggaauagcuaagacagauguggcacuacuuuggcgcuauauuugacaaaaacaucaugacauggugauacuuugcugaggcucuaauaugaucaaaagacaaaacuuggaaggcauggauuuaacuucucuuauaagaacagcucacaauaugaacuauaguuaugacauucagcugagaccuuuguguggcugguucugguaucagcacccuugagaaugcuuacuguacuuacuguauuguacuagcugcuuaucucauacuguuaauauuuuaacagaauguuucaccagauuuugaacugcuguauucucuugguuaagcaacuuaguaacuguugggauuucccaggauuccuaauacuauguccauuguuugaaaaauccacuuuaacuacuggguuucuccuaguguuccugagaaugacauguugguggcuagagcuuugaaaucuuuaaaaggcuuuugauugagguccucgggcuuuugaauguccccaugcuaggugagauacaguguguuuuaguggguuaugauuccuauaaagcuucuuauacuaugaaauuacuuuaaaugaaucugggaguuuaugucugucaguuuuuuauagugaaugucuauaacagaaugcuuuuguugacuccagguaauuaagacaggaguggaauuaucuugcaauauguuugaguuuauauuuaugcuuguuuacucuuugaaacuagugcuguguuuaguauccuguucuguuucaauuuugaauuuuguguuuucgcugugucugauguuuucauugugacaugaauuucuuuugguaucucauauuucuguaguugaaauauuaucaaaaauaauaagcaauacaugguauaaugagaauguuuacauaucacugagaaauuaagugcauuuccauuguuuuuguaguuauaauuuugaaucugaaagugauauauggaaaaaugauguuuuuuuguuuaugugcagaaaagaugaaaaggaauaugcauugaagcaaauugaaggcacaggaauauccaugucggcuuguagagagauugcaguaaguggauacaaauacaguuauuuauuuuauuauugauauugggugaugauuuauuuuaauauaaaaguuucauuaauauauauaaugaauguuuauuuuacauauguuaguuuaagaauauuuuauguagagugagaaaaucugcauaaacuuuuuauuuuauuuuuaaauuuugagacaggaucucauuuuguugcccaggcuggaguccacugcagcgugaaccuccuaggcucaagcgaucuuccugccuuagccucucgaguagcugggauuacaggcaugugccaccacaccuggcuaauuuuuuaauuuuuuuguagagaagaggucuccuuguguugccuagguuggucucaaacuucugggcucaaaugauccucucuccguggccucccaaauugcuggaauuaaaggugugagccaccauauguagcccauaaacuuuuuaguuacuugaaagucaucuuugaauauccucuuaaugauauuuaagauuugugaucucagaaauacugaacaaaaugauuuaauuuauuaaaauugugauggaauuuuauuuuaauuaguaauuuaauuaaugucuauuuuucuguagcuuuaggacugauaaggucuuuauagaggaaggggucauacuauuaaaucuuauucauuuuaaauacuauuucugaaauauauaauauagugagauguuauuagucaccagaaaauaagaccauuauaauaauaggauaaucccuuaaagaaaauaguucccuguuuuggucuuuauauaucauacuaguacauuuaagaaaugauuguucacaagaauacuaaacauuuaaugaguguguacuagauaccaggcuuacuaaaugguuucaaguauuaauucacuuaauuuucacaacaaucugugaaauaaaauuuuaauauccccauuuuacagaucagaaaacagaggcaaaacuaauuauagcucagaaggcuuacuauuauauuaccuuauuuuaguucuucaguaaagauugcuaauuagggcuuuaccauaauaucacaucuauuagagauguuugucucuaaauuguuagaaauuuauuuaaauaauuguuacuuaauaauuguuaaauaauuauauuguccguauccauuagggauuucucucucuaauuuaauaacuauuacauauauugcccacaguuccauguuucugcuucaccugcauggaaacacuccuucaucgcuuuuagucauaagaaguguggugcaaagaacacauggggugggaaaucucuagaccuggaugucugucugccuuaguagcuaaguagugaucaguuccaguuucaucuguuaaauaagggaacuauuaggucucuucuaaucauaccuucuuuaauucuagaaugggagccucucccuggacuguguguacuuugaggggcagaccuugucuuuuuaucucuaguuccuaccauagugucugacauagcaagugugcuauaaauguuucuugaauaaauaaaugaaugaacagaaugaaaaaauucuaccagugguccacaauucuaaguuuguguuacuuuuauuuuuaaauuuuuuuuuagagacaaggucuugcucugccacccaggcuggagugcaguggcuuaaucauaucucacuguaaccuugaaccccuggccucaagcaauccugccuuggccucccaaagugcugggauugcaggcgugagccaccaugcuuggaccuauguuugcuuuaggaugcaaauuguuugaaaaaauucuaauuuggugauuuuccauugauuauaaagugguauuuguggcugggcaugguggcucacacuuauaaucccagcacuuugggaggcuguuggggggguggaucaccugaggucaggaguucgagaccagccugaccaauauggggaaaucccaccucuacugaaaauacaaaaauuagcugggugugguggcaugcgccuguagucccaguuacucgggaggcugagacaggagaauugcuugaaccuaggagguucagugagcugagauugugccacuguacucuagccugggugaaagagcgagacucugucucaaaaaaaaaaaaaaaaaaaacguggggagguauuuguaauguuuuaccagauaagcauuugguaagugauuugucacauuuuaaaauccuuacauguuauuauaucaaccaauauaaauauuauuggugggcuauuuuucuauguuagaguaccauaauuuagcacagcauuuucagcccuaccuuccaugaauuaauuggguaaauagcugaaauuuuagguauugauuaauaggaagugauaacucaauuauaaauguccuuuuugaaacagagacuucuaugugccagggaauccaugggcaugugugucuuuauauaaauuuggaaugugauggagaaacuuaacucuuaaaaucuguuacagccuucauucuuuuuuuuuuguaggagacagaaucucacucugucacccaggcuggguugcaguagugcaaucuuggcucagugcaauuuccgccuucuggguucaaaugauucuccugccucagccucccaaauaacugggauuacaggcgugcaccaccaugcccagcucauuuuuuguauuuuaguagagacaggguuucaccaaguuggccaggcuggucuugaacaccugaccucaagugauccacccgccacaaccucccaaagugcuguaguuacaggcaugagucaccacucucagccauagccuucauauucuuauugagaguuugccuaauagaacuuuagaaagugugcaguuucuagguugaauagcauuuuaucaguacucuaaauacuuaaccccaacaugauagggauuuucacacaaguuuaccauggaugguauugcacagugacugugcacauaugucuuauacauuaagcccacuaacacaauuuuauaauuauuguuuuauugggggaaccagcuccuaauauuucaacguauguucuuucuauuuuccguaagugucagccggucugagaaauaaagagaaagaguacaaagagaggaauuuuacagcugggccuccggggguaacaucacauaucgguaggucugugauguccccugagccgcaaaaccagcaaguuuuuguuagggguuuuaaaaggggaggggguauacauacagggaguaggucacaaagaucacaugcuucaaagggcaauaaagaucgcaaggcaagggcaaaauuagaauuacugaugagggucuaugucccgcugugcacguauugucuugauaaacaucucaacagaaaacaggauucgagagcagagauccggucuaaccaaaauuuacugggcuguaauuucccaauccuaguaagccugaggguacugcaggagaccagggcguauuucauuccuuaucucaacugcauaagacagacacucccagaguggccguuuauagaccuccccccaggaaugcauucuuuccccaggguauuccuugcugggaaaagauuucagcaauaucucuccuacuugcacguccguuuauaggcucucugcaagaagaaaaauauggcucuauucugccugaccccgcaggcagucagaccuugugguuuucuucccuuguucccugaaaaucacuguuauucuguucuuuuucagggugcacugauuucauauuguucaaacacacguuuuacaaucuauuuguacaauagugguccugaggugauguacauucuuggcuuacgaagauaacgggauuaagagauuaaaguacagacagacaagaaauuauaagaguauuauuugggaacugauaaauguccaugaaaucuucacaauuauguucagagauugcaguaaagacagguguaauaaauuauaaaaguauuaauuuuggggacugauaaauguccaugaaaucuucacaauuuauguuccucugcugcggcuccagccggucccuccuuuuggggucccugacuucccgcaacauuguuuuauguauuuguccuuuacaucauauugaagaaaagaguuacagacaaaaauacauuuaugauuucuuuucucuuuaccuaugucauuauuuuuacugguguucuuaauuuuuuguguggauuugagcuacuguauagaguccuuucauuuuagcugaaagccuccuguuaguauuuuuuuguauaucagguauaccagcaauguauucuuucaguuuuuguaucugggaaugucguaauucuuuuucugucuuacccagcucuucuugaguuuugcaguauuaguguuguuggauguagaauucuugguugauagucuuuuucuuucacacuuugacugugucaucucugcuuucuggccuucgugguuucugaugagaaaucaacuguuaaucuugagaaucccuuguauaugaagaggguuuuuuuuuucccucuuguugauuucaagauucugucuuugucuuuggcuuugacaguuugccuaugaugugucuuggugcggcuuucugaguuaucuuacuuggaguuuguugagcuccuuggauguguagauuaauguuuuucaucaaauuugaaaaguuuucagccaucauuucuuuuuuuuuuuaauuuauuuuauuuuauuuuguuugagacaggaucucacucuguugcccaggcuggagugcaguggcauaaucaugcucgcugcagccuugaccugcuggguuuaagcaauuuuaccaccucagccacccaaguagcugggacugcagguaugcaccaccaugcucagcuaauuuuuuuuuuuuaauuuuuuguaaagaugaggucucacuauguuguccaggcugaucucaaacuccuaagcucaagugauccuccugccucauccucucaaagugcuaggauuacauguaugaaccgcugcaccccaccacagucaucauuucuucacauaaucuuucuuuccuuuccuuucucucuucucuuauugcagcucucauuauacauauguuuauaggcuucauggugucccauggaucucucuccaaggcucuguucauuuuucaucauucuuuuuguuggucagacuggauacucuuaauugucugucuuuaaguuuucugauucuuucuucugcuguugagccccucuggugaaauuuucauuuuaguuauuauuuguuuaguuuuccuggugguggaaggacagaguauauaagggaauugagagucagagaggcuaagagggacugauagauuggggagaauggaggcaacaccauaaagaguagauagggcuuguucucugucaucuuccuucuacauaccauuauauuaccuaaugccuaguauuuuguaguucauauaggcacacauagcugagaggauuuuaaggcggaaauaauuaggaaugaacauuucacucauuacuuuaaaacuugggacuaugauugcagaauaacuguugaggauauagugggaugcugggaaaauaaguuaaagagcuuguaaucauggaauaaacuuggaagaaguacaaguuuacagaaaggaaaaacguuuaagaaugaaauguguuauuaccucgucucacuaaaaaagaaugucaugucacguuuuaauuucauuugaaccuuauugaccaaaggcuaauuauaaccucauaccuuuguacagugcuuuacacuuuacauuaugccacaacaggaaguaauucugggugauuaaaauaccaggaucaugugaacgucagcauuuuuagccugggauuacagggaaguucuaauaugaagucuauuacauuuguggccucugugaucuuaagguugguagguugaaaacgugguaaaugcuauuaauucaaccauuaauuuguuuugcgauuaugagauuaaaauauguuugucguaaaauuagcagacaauauagaaaaaggcugguaaaaguaccuguuaugucaacacucaaaaguaaucauuuuuuuuuuguauauucuucuagacuuuuuucuuugcaaaaauacagagaauuuuuccccccacaagagcagagaguccauuaauuuucaugaaauauaauuuaaucuggaauaauacaaauauaaauuucaaauuuauuaaucauucuaguuuuguaggauauaaagauuauaagauuauuacccuugagucuaggugugguggcccccaccuguaaucccagcacuuugggagacugaggugggaugauugcuugaggccaagaguuugagaucagccuggacaauauugugagacccugucucuauaauaauaauaauaauaauaauaauuagcugggcauaguggcacucaccuguaguccuagcuaccugggaggcugaggugggaggauugcuugaguccaggaguuagagguuacagugaguuacgauugcaccacuacacuccagccugggugacagagugagaaccccaucucaaaaaaaaaaauguauauauauaaaauacaauaaaauauuauuacuccugaguacuucuaacaacaucgagauauuuccaaaugaagugaagaguggcugaagggaaaauuagggggaaguagggugaagggcauagguugaggaggugucuuagucuguuugggcugucauaacaaaauaccauagacuugguggcuuauaaacaccuauuucuaacaauucuggaggcugggaaguccaggaucaaggcccauucagugucuggcccauucagugucugguaaggguccacuuccuaguucacagauggacggcugucuucucccugugucuccacaugguggaaagccaaccauuucucucggcucucuuacauaagggaacuaauuccauucaugagggcucuguccucgugaccuagucaccucccagaggccucauguccuaauaucaucacuuugguuaggguuuaggauuucaacauacgaauuugggagggcaaggggcauaaacauucaguuuauugaggagggaagagaaauagggaaauacugacuucuucagacugcuggcagcagcagucuggcuuggguugcugauuaacuccacuuccucauucaccucugcucaguucuuucucaguguauauauccaucaauaucccagcauugauguuucuguggugagaggcaggaucagcugaaaggggcugucacuugcaguucuuccacauagugcccagcaggcaggguggaguggagcagcacuuuuccuucuuucuuucuuuuccucucuugccaccauggugguguagcaggcugcuuuguaaacuucaguggaauccuuggaacuuuccucuuggcauaaaggaauaaaccuuugcuuuuuuaaauuuaugaaguggaauugauagaauguauguuugcugaggauuccucugagaaaaacucuaaaaugucuauaagccaaggcucuaauucuuuuuaauuuaauuucuaccaagcuuaaaauuauuuuauuaaauuauauguauagugagaaauaucuauuuaguuuuauuaagauuauuuaauuacauuaucucaguuguuuuuauauuuuguuugguuguuuauuuauuuauuuuugagacagagucuugcucugucacccaggcuggagugcaguggcgcgaucucggcucacugcaaccuccgccucccagguucaagugauuuuccugccucagucuccugaguagcugggauuacaagcaugugccaccaucccuggcuaauuuuuuuuuuuuuuuguauuuuuagcagagaugggguuucaccguguuggccaggcuggucucgaacuccugaccucaagugaucuggucaccuuggccuuccaaagugcugugauuacagacaugagccaccacaccuggcuuguuuuuauguuuuacacugagugcaaguuucuuuuucuuuuuaaauaugcgugcaacuuuaugaaaguauagauuaguggaaauagaugugugaaucaaguauuuuaccuuuucugugaaagggacaaaaucaaaguuuaguacugagauuuuuguaaaaaacacucaaaguagaaaaagaauuuuuuuuucagacuuuuaacaugauguucuguaacaguuauuuucuuuaaaauuugguaugguguuaagagaauagaacuaaguaaaugugaaauuucccuugagcaagaucuguucuuuggugugauccuuguguuuuccuuaaaaacaaacaaaaauuuuacuuuuggaguugaagacucagcauggauauuuccuuaugaaaaauguggguuuuuuuuccuugcaauauauggugauaguuaauauuuuucucaaauauauauuuagcuuccuuggcaaaauaaagacuuucugccaacuccuauacuuaaaaaugaaaucuuguaagaguuugggauuggaguuugcuauuauuuuaggaggauucugggaaacuaauacaaggucagugccuagggaggaacuacacuguagcauuuuuuauuuccuuuuaagaccugaaaagguacaaggagccagcgagcaaauagaaccuccaguccuaucguguaucugucuguugucugcucuacuaugccuguuaagucaugagacucuuggaagauguguguguguguguauguauacaccuauuggacuauuuuucaagcuacuauguuuccuaugagaagacuaagugacauauuuuuguauugucagaaggugauuuaaacaccgauuauugccaguaauagaaaagaggugggccauacagguuucugggguuuuguuccuucucacuuuuguguuacucacuuuugugagaaggaacaguuugaaaaaagauaucagcuuugcucaucaguuucugauguguguguguauuuguguguguguuaugguaagggaagaugggauggugugguaacacaagucauagauguagcugaaaacuuuuccauuuccgccacccuaagggaauagacuaguuagcuguuagcacaaccuuuaggcucuugugguagcugcagaugcuuuccuucuuugaagaauugguggcuuaugauggaaaaguuggcuuucugcugugucaguaucccucccuacugaguacaucaguagaguuauuuuaguucuccuaaaaauauaaaaauuaucaauuuaauauucuugcucuaagcaguuagauuuaauuggccauuaauucccuauuuuuaguguuuauuuuucucuugaauaauauugaagcaaaguugugcuagugauauaaaugcagagugaagaaagacugaaaauaaaucugauacugguaugugaggggcuuggcuccgagucugaauauaaaugugcaguaaauggugcugguuuuuguuguugguauuauuauugguaauaacuuuuucccauuuaaacucuaagcaaagaaaauagcuuaacuuguuuucacuguggucaaaguaaguuauucuuaagaccauaaauuucauuuuaaaauguguucuuauagaagauaccaaacuauaaaauuuaacauaaacuuaguaauucuagauuaaaaauaggagauugaagugauaaaacuaaaaaaagauauauuuuuaaauaugccuuuggcuucagaucguaaugugggaaagaacuugaacuuuggauucagauagacuugggguuguaucuggauuccacuauuauccuguacaucuuuggcaaguuacuauuaguaccuggacccauuugcuagguagcaauagagaugaagauuuauuuauuuauuuauuuugaaauggaauuuugcucuuguugcccaggcuggagugcaauggcgugaucucggcucaccucaaccucugcuuccuggauucaagcgauucuccucucucagccucccgaguagcuggcauuacaggcaugcgccagcacgcccagcuaauuuuguauuuuuaguagagacaggguuucuccauauuggucaggcuggucucgaacucccaacuucaggugauccaccugccuaggccucccaaagugcugggauuacaggcgugaacuaccacgccuggcugagaugaagauuuuaaaggggaaucagguauguuuugauuugcuaguaaggcuggcacugcugagggaguaugccgugcagcaguucacagguuccucagauucucagaaucucuuuccuugcugaacuuuccggucauucucagcuccacccucuaacugcaguaucaacugaaucucaugaaauguuuuggcgaagcacuucuuuccaaggaugucaaaaaucuucugaguuaccaggaggaagugguugccugucagggcagagucuuacucuugcauauauuuuagugauauauacuauauauaaacucuuggauuacaauauggaugaguucuacuuuuauucuaguuuguucuucaggcuacuuauucugcuuaauuucgguuuggaauuaaauaucucagucugugcaaccuguuuuuuaguuucuugauuuagaagaauuauuaaucccauaagcaacugucaauagaauguaucuaauuccugugaaucuuaguuucuucaugucuaaaaugggggauuuuuggcauagauucacuaugacuucaugaaauuuagcucagaguuuguaucugauauauucacuauugaauccuuggaaucugucuauauggugcuuggaacaaagugggcuguuaauaaauuauuaaauaaaugcaagaauuuacuugaaauuguuacuuuaacaauauuaguaacauuauaagggagugguauuuguuuugauaaaguuuuuuuuuguaguagaagauuuuaaacuuuguguucaggcauauucuuauuugaaauauaaaauuaaaauuugugugcugggcgugguggcugaugccuguaaacccagcacuuugggaggcugaggcaagaggaucgcuugagcucaggaguuugagaccagccugggcaaaauagcaagacccagucucauuaaauaaaaaaaaaaaagaagauuaaaaauuaaauuuuguggacuauuaucuaaaauuuuugauccauucugauuuuccuuuccauaaccaugugugauuuaaugaauaagggguggaaaauagucauuugaauauacauuacuugaauaggaauuugaggucauuacuaaucaaguaauuauuugaauaauauuuacuauuguaccaauuacuauucaaguaauuuaauuuugcauuuaauauuugaguaucuauuauaaucuaggcauugugcuaaaugcugaggauguaguagugaauacaguuuuucccuuucccucaagaaguuuauaguuuuggaggagacagacaagaaagccauuuucaacacuguauaaucaagacugugacaaaguuaagcacagugugcuggagaagcauccagcucauacuuggcagucugggaagacucuuuggggauuuugugguagcauaaauuucaaagccuaauaggggcuagccagguggagaagggagaauguagaaggauauuuggucugaaacagcauggaggaaagcccagacaugagagagagagagagagagagagagagagagagagagagagcagugcucacccucuuaguuuuaucaauaguauuugaggaguugacuguuuuaauuccuuuaagccuaccaaacuguaguuauuaaaacagcaauguguaaauuuuuguuguguuccacaaguaaaauuuuggggcuuauuuaacugcugcaacuaggguuacccucacuaauguguggagaauagagguaccguuaaaaguugaugaaauggcugggugugguagcucacgccuguaaucccagcacuuucggaggcugaggcggguggaucacuugagcucaggaguuggagaccagccuaggcaacauggcgaaaccccaucucuacuaaaaauacaaaaauuagccugacgugguagcgggugccuguaaucccagcuacuuggcaggcugaggcacgagaauugcuugaaccugggagguggagguugcagugagccccuguccuccagccugggugacagagggagauugucucaaaaaaacaaacaaaaacaaaaaaaccaaaguuggugaaacaaaaacuuauaugaauaauaauuuuuaaaguaaacaguagaugaacuaaaaaugaucaaaaggagaggaaugcuggaaauggaagguaaaugagcuacaguuucauccauuauaccggaaaaucaauaaugcuuaaaguugguaagucaagaauagugguauaaacacuugaagauagaaaauacucaaacaaaaaccagaaaaaguuaauaguugcauaugggaaaggugaaguaugggucagaggauuauuuauuugauuauaaucucugcuauguuuuuuguguuuuagcgauauauauaaaauauauuaaaauaauuuaauaauuaaacugaacuagauuuuaaaaauauacuauaccuccaccagaauggcuaaaaugaagaagacugauaauaccauuguuaaugaaguuauggaguaacugguacugauggaagcaugaaacgguauagccacuugggcaaaaaguuugcaguuucugaugaauuuauacauauaccuauugcaugauccagcaauuccauuuuuaaguaauuuguacccaagagaaauuaaugcacaugacuacaaaaaacuuguacaaggauguucauaacagcuuuauucauaauagccccaaacaagggaaaauccaaauguucagccauaggagaguggaucaauaauuuaugguguauccauagacugcauuaauauuaaacucuaaaaaagaaaauugauguacuuaauaacauggaugaaucucagaaacauuaauuuaaauaaaagaagccagauacaaaauaacacauauggguaugguuuuauuuauaugaaauuuaagagcagacagaaauacguauugugauagaaaucagaauagugauugccuugggugggcaggaggguugaguggaaaggaguucacagaaacuuuacaggguaaugaaaauguuguaugucuucuguugcccaggcuggagugcaguggcgccaucucagcucacugcaaccuccaccuugcuggguucaagcgauucuccuuucucagccucccaaguagcugggauuacaggcgugcaccaccacaccuggcuaauuuuuguguuuuuaauagagaugggguuucaccguguuggccaugcuggucucaaacuccugaccucaagugauccgccugccucggcccuccacaaagugcugggauuacaggugugagccacccuuccuggacaaaauguuguauaucuugguuggugguuacacagguguuuauaucugucaaaauucaagcuggucacuuaagacuugugcauuuugcuguauguaaauugugccacaauaaaauacuaguaauauaaaaaauacaaaauaaagacuagagagauugguucuuuaaaggaaugggaaaagucuaauaugguugcaaggaagaguugaggguagaaagguuaaaauguuagccuggggccaucuugaaugacuuuuuuucuugccuuguugcccacgcuggaguguagugguguaaucucuguucacugcaaccucugccucccagauucaaauguuuugugucuccuggguucaagcgauucuugugcuucuugugccucagcuuccugaguagcugggaauacaggcaugcaccaccauacccagcuaaauuuuuuuugguauuuuuaguagagacaggguuuugcgccgugacagccaggcuagucucaaauuccuaaccuaaagugauccaccugccuccaucuccgaaagugcugggauuacaggcaugagcuaccaugcccggcccuaccuugaaugacuuuguaaaaauggaggaauuggugagaaguauuugagauuuaagagagauuuaggaaacaaaccuuuuagugaugauuucucuguuagcuagauggcgcaguuuacugagcaaaagagccaaggugggugggaugggaggguuggguaaaaauggugaccugaauuucacagaucugauuacuuaguuuugggaaagauauagaagauuauauaauaguaauauuacaacuagaaauauaauaguacuaucaccuuucaaggcauuauuauuguguaaauuauuguguguccccuucuguuccagcuauucauuaucccuucucauuugucuuuaugaagagauacaugauuugccauucauagucuauacaaaauacaacuauugaacauuggauagucuaugcaaauaggauagucuaugcaaauaggauagauugaaugguuuuauucaagagaaugacugucaguauaagucuccauauuuaauuuuaauggccagucauguaguauugaaauagccaguuagacucuuucaugagagagacuggaaaagacccagugcuaguauauuuuuccuuucuaaaaauugagauacaauucacauaccguaaaaucaguccuuuuaaguuauauaauccauucauuuuuaguguuuucacacgucgugcaaccaucaccacugucucauuccagaacauuuucaucaucccacaaagaaacucuguacccaguaguagucauuucccauuaccccuuccccuccccaacucagcccuuggcaaccacuaaucuaaaucuacuuucugccucuauggauuugccuauccaguauucuuuuucaauuagccagucuccagcaucaucacagccagugaucccacacugaagguugugaagauuguuuuuccuugagucauucuauaauccagugauuuucagauuuuauggcccuacguaucaccuggggaucuuguuaaaaugcuaaaaugcagauucucauucagcaggccugggaaagagcuugauauucuaaauuaauuucuuuucuuuucuuuucuuuuuucuuuucuuuucuuuucuuuuccuuucuuuucuuuucuuucuuccuuccuuuucuuucucuuucuuucuuucuuuuuuuuguuugagauggaguuuugcucuugucgcccaagcuggagugcaauggugcuaucucagcucacugcaaccucugccucccagguucaaaugauucuccugccucagccucccaaguagcugggauuacaggcaugcgccaccaugcccggccaauuucuguauuuuuaguagagaugggguaucaccauguuggccaggcuggccucgaacucaugaccucagguaauaggccugccuuggccucccaaagugcugggauuacaggugugagccacugugcccagccgauacucuaaauuucuaauaagcucuuagguaaugcugaugcugcugguccaaaggugacacuuugacuacugagguucaaagaugccucagaagaagaagaaauuuaauuacaaacauacaugaauuguugaauagcagcugguacuaaucuagaaaaauuauuccaaucuguugaguuuaauaguguuucuuuguuaauugccuuucaaagugauuacuucuccccuacaucguaacuaucuacauguuaugggacaguuuaugggcuuauuuguauccauaauuauguuagugaaaucaaauaguaaagaaagcugaguuagaaccuguuccacaaguauaacuuuguuguuuaaacuucuucugauauucagcucuaauuccuuuuugaaagaaacuuuucuacagauuuuguguuagauuacugguagucucaaaugaguucucuaaccauccaauucugcauggcuuccuugcauugucuuuggguugauuaggauugccaggaaguaaaauagccacuauagcuacuuccuuuuucaagucauucaaguuaagcuuaauguagaaaaacuucgugagauuucauuaaaauucuucccuacucuccaauuggaguauaauaaauccaaucaagauaggcucuggauuuugcuguuaguacuccaaugaaggcagaaauggggacauagcaaacuacagcaaggcuuauuuuauaccaguacagagccuugcuuauaacaguggagguauguagcuauuuagucuugggccaucuauuacucucagucugagacccaguuauacaacccaguuguauaacucaauggauuaauauuuccaaauuaaauaaaacugaauuggguacaguauugugcuccuguaguccuggcuacuugggaggcuaaggcaggaggauugcuugagcccaggaguuugaggcugcagugugcuacauuugugcuugugaauagacacugcacucuagccugggcaacauagcaagaccuagucucaaaaaauaaaaauaaagucuaggcgugguggcucacgccuguaaucccagcacuuugggaggcagguggaucacuugagaucaggcguucaagccagucuggccaacauagugaaaccccaucucuacuaaaaaaaaaaaaaaaaaaauacaaaaauuagcugggccugguggcaugugccuguagucccagcuacuugggaggcugaggcaugagacucacuugaacccaggaggcagagguugcacugaacugagauugugccacugcacuacagccuggcuggcagagcgauacucugucucaaaaauaaauaaacaaacaacaaaauaacauaaaauaaacuccguuuaauuuuuccacuguucuuuaucuuaguguaaaagugucuuaauauuuaucauaguaugaguacacaguuuuuuucaguaaccucuuguccaauagaagguagacauuuuaaauaaucaacauauauuuauuuaguucuacaagcaaugguuugggggagcaaauucaguuaacgguaaaaagcauggguuuaguaccugacagauuuagguuccuguccuagcucuuuuacuuacuaggucugugaucuuguauaaauuacuaaucucuuuucaccuguaaaaauagggagaauaauaauuauuuaucuguggaaagcacuuaacauagugccuggcauauaggguucauuaaauauuagacuauuauuauuaaucauucaggagguauacauugccuauucuaugugcuaggcacugucuuucagaagagauuguuaaugaacaaauauucacacgaauauucacacaagaugauaagagcuaaggaaaagcuaguaucauggcaggauaacaagagaaagauuaucuaacuuuagggcaucaaggaggauuuccccaagaaaguaacauuugugcagagauuugaaggaugagugggagcucauuaggcagaguagagggaacauuguguauaagcaugacgcagcaugccacauuugagaguauaggagaugcuggugugccugaagugaugagugaggaugaaagugaccugagaggggaagacccccuaacagggccaggucacaugcagcugugugggcuguguuaaugaucuuggguuuuagcagggaaaugacacagucaaauuaguuuuuuuuuuuuuaccacucugacuaugguaucaauagaugagaguaaagauagaggagaagauguagggagaguaguuagaaaaccucugcagcaaucagacuagggaagauagacagaaguggaaaaaaacuuagagauuuuuccugagggcagauggguagaaauugaugaauuggauauaggcagcaagggagagagguggcaaagauuuccguuuuuucuggcuuuggcagcuaauuugacuucuaauagauagcaugugcucuuucucucucucucuuuuuuuuuuuuuuuugagauggagucuugcucugucacccaggcuggagugcaguggugcaaucucagcucacugcaaccuccgcuucccagguucaagcaauucugcugccuuagccuccugaguagcuaggauuacaggugcacgccaccaugcccggcuaauuuuuguauuuuuaguagagacaggguuucaccauguugcucaggcuggucuugaacucccgaccucgugaucccccaccuuggccucccaaagugcugggauuacaggugugagccaccaugccuggccuuucucauuuuuuuuuuuuuugagacagggucuugcucaguugcccaggcugcagugcaguggcaggauaauagugcuuugcagccucgauuuucuggccuccaaugauccucuucaguuuccugaguagcugggcugggacaauagggauuuaccacuaugccuggcuaauuuucuuucuuucuuucuuuuuuuuuuaguagagaugaggucucgguauguugcccagguuggucucaaacuuccgggcucaagcagucugccugccuuggccuuccaaagugcugggauuacaggugucagcuccugcaccuggcccagucgcucuucuugagagaggaauucuagaagagaacuaagauggagagggcagacagagauuuucuuuuaaaaaagacaucuugaguuugagaguccauugaaacauuuaagaggaggaagagacaauuaugaucucaguaaugaagaggauuauacaagagcaauauaugacaugcuucuuuccaucaugaaccuuauaugcugguccagaagauaagacacauuuuugaauauaauuaauacuacaagacugugauugaaggcauucugaaagaguagguacaguaaguggagugaggccacuuuggacaugaugaucucaaaguuucaaagauaaggaaauacuuaagaugggcuuuaaaggauuaguagugugggagggagggaaaagcacucuaacaguaaauggaaaaauagguaguuagugaaagggguauggcgagggucugggugguuaguuacuaguuauagagcaauuuaguauucaucauagcucaaccaagaaucuuuuguauguaauaauuugacuuuuauaauguguuuucauauaucucaugagaaauggucuuauauaaccuaauucugucuuaugucucugucuuuccuacuuauugaaaaguucauauuauugaaacccaguauucuauuguugaccuauaauaaaacuauaaauauuauucucugacagaauguuaugaagaugugccacugaauaauaguuguucuuuccagcuugauuaucuuagaggaaaaauggcaugugauuuaauuuauacgagaguaccuuguagacuuuaugggauuaugaaaaugcaaaguauuauuauuaauccuuccauauauuccauguuacucuucagaacuuagaaguaaauauuuuuugcucuguagcaaaaugacugcaaucaguggacuuuuuuccagcaccuuuguaaagucuggagucuaaaaagcccagcucucuguaggccagguucauuuuuggaaguguguagugaucuaucuuucccacucaauugugguuuuguuugcuauuaacaaaaauauaguuuuuuuguuaacagauaaaauuauaaguccaaaccacuaguucaaaauauuuuucuaaauuaauuaagauuuaagaucccuccccacccuauucacuuagguaucuauaacuggggccauuuucuaaauggaaccuuuucaggcauuacuuguauaucaauuauuacuuaauaauccccccauuuucuuuaggcuugaguugaaagaacacuuauauuugauucagauggcuuucuaggacuaugaauagagauaguguuucagaguuucaacacacaucaguguccuuuccuuucugauuuucugggacaaggaccugguaacaucuguuuauucuuacucaaaaugcuugcauuaauuuaccuuugcuaauuaucuccuaaaguauucccuaauacuuuccuucccaucuacagaaaaaguaugugaaaugcuuuugcugcaugauuauaacaugauuauaacaguugcaucaugaaauacuaggauuaucuuuuuuucccaaucagauaagauaguuuccuuucauuuuucuuuaccuuauuguucuuugaagcuacugguguuuuaaaaaugguauuaaaauguuguucccauagcaacacccuacuaguuucuuauggaaaacauggcguguuuuacaaguuggauugaaaaaaaaagaaaugcuuucugaaagaguuuauuuauaaaaucaagcccauagaacauaacuguuuauuucuuuuagaagcauuguuaagcagaauguaacaaaggauuuuacacuuugauguaaauaaaguguguuuccuaucuugcuuauguaaaaguuuaucuuugaauuuguauuaagucaacauuuccccucucauaauuagacuugaacaauuuaaauaaaaaacuuaaguacugccaaauuuuagugaaauaauuucuagguucuauuuaaaggugcuuauugucuguacccagaagcugauuggcugcuuaugagacuguuagugcaaugcccauauuacccuugugaugauuucucagccaauuaggcugcacgagggaugauggauuuuguucaggaucuguuucucucucucucucucugccccucucucucugucuacugauuuuguaaaaucaaugcuaagauauuuuaaaucuuuuugcauuuaaauuauauaaauuguguuacccauuuuaugcuguuucuuacuaucuguguuuaguaauauucaguuucaucucaacauuugagucauuauuuuucugagaggguuuagggaagauauuauauuuauaauuaaaauuauuaaucccauguuuuccucuucuguuugcuuaguucucucucacuaaauuuaguuuaauuucuauuaccucagucuuuugggauuuuuuaacauccaaaagcauuaucuauuccauauucuaguuuggcuacuguucucuauccuuuguugcugugguuuuugaaagcuacagagccauaagauauccuuugaaacuaacauaaauuauauuuuauggagauuagagauuuaauguacuuuaauuauuugcucauucaacaaauuccagaugcuggagauauaauagugaaaaaugcauacaauaauaauucuguacuuuuggagcucacauaguagguaucaguuggagacacuuugauuuugcuuacuugguuguauucauuucuguauucacagugccauuuugaaagacuccaauagcugguacccuucccauaucuguauaauuuagaauucugaguaauuuuguauauuucauuuuccaccuagguguuuauauauuaauacuucugauauugcacuguaguuuuagacauacuuaauuccggcacagaaacaauaaaaaaaaaagaucuuaucuagcuaucuaauaaauuuagaagagaucuuuuauguaauaguugaagauucaccguacuugauugccaagucuucuauguuuuuucuuucaaaaagcuuuucaacuuuagcuuuuucauuuuuacuuuuagugcaccuuuauuaucuuguugugccuaaacuuuagugucuguucuccuugccucucugccagccuauccuaaacaaagccacuggacugaucucaaauuuuagauacaguugugucacuauucugcuccagaacuuuuccagguagaccgagaaccauacaguaaaauuuggggaggaagauuggacaguccaccuuggugucccuaaggaugagcagggcagugcggucagucauacucccuuaccacauuauguacuuguuuuguugguauuuuuuuuuuuaagguggaguuucgcucuuguugcuuaggcugcagugcaauggcgugaucucagcucacugcauccuccgccucccggguucaagugauucuccugccucagccuucccaaguagcugggauuacaggcaugcgccaccacgccuggcuaauuuuuguauuuuuaguagagacaggguuucucuguguuggucaggcuggucucgaacuccugcccucaggugauccacccgccucggccucccaaagugcugggauuacaggcaugggccacugugccuggcccuauaauggcuaguuuuuaaaauuacuuucuuuuaaacuaguuuuuuuuuuuuuuuuaagaauguugguauguuuuccagucuuagcuugugcaguaaaugauuacuaucaauuguagaccacauauaaaagauauauucaguauuauuggauuuuguuaaucauuuuuuucuagauaacgggaagagaauauucuacacuugaucuuagccaaaaggccgagaagcgaugagaauauucuaauacucagcaagggaagaaacaucacaauuuguauuaacaauuuagcuagcuagcauuuaagccugugggcauggcuuuguucauauaauuucugugagacuuauuuaagagcugaaguauaaaaaggccuuuaauugucauuugugaaaaucaggagugauuaguguaaguuuguuuuauuuagaacuuuuggugguggacacaagagaaaauccguauguaauuuuauugcauuuacuuuguugguauuuuguaggucaggaaccuagcauuguuuagacuaaaaaauauccaauuuuagagaugggguuaacuuuuuccccuaauauauuuauuauuguuaauacugcuguuuaacacucauuccaaaacuuaguggcaugaaacacuuuuuauuaugcacaucgauucugcaaguugugcccucugaaagggcacaguggggauagauuuuucucagccauguggugacugggaucucaguugggaagacuggaaaguugagauugacacacuugacuccugggggccaaaauaguuugauggcuuuuucaccaacaugucugguaccuaggcuagcauuguugaccagacugccuucauguggccuugcuuguguauaaccuggcggccucgaauguuaaagugaacaaggacaaaucugcguuuuuuuuuuuguuuuuuguuuuuuuugacaaagccuugaaagcugagcauugucauuuccacagccuucuauugguuacaagugcacacucagacagaggaggggaauuagacuucaccucuugcugagggaguugacaagguuuuggaagagccugugguacaaagauacuguugugaccaucuuuagaaaagacauucugucacaauaguuaaauaguugccacuguuguuuguuuugaauauguauuuuauaauaacauuagagauagaagaucaggaauccuuuuuuuuuugagauagggucucacucugucacccaggcuguaguacauuggcacgaucauggcucacugccaccacaaccuccccagacucaggugauccucccuccucagccuccuuaguagcugggacuacaggcaugugccaccaugccuagcuaauuuuuguaaggacugggucuccuuauguugccuaggcuaggaauucuuuaucuuauuccaggacuuugaggagaggucuguaaacugaaauuugacaguauuuuuuuagaaaguauuuuuuaaauguauuuuccuauuaauuugaaaauuaaauauuuaaaacuuuuuuuuuuuuuuuuaaacaaagaugagaucucacuauauugccuaggcuggccucaaacuccugaguuccacugauccuccugccuuggccucccaaagugcuaggauuauaagcaugagccaccguacccggccaaaacauuuuuuuuaagucaaaauugcuuaggaauuuguuucccaucucuuacuuuaaauaaguauagguugcuuauuuuggcagcacuaaaauuggaaugauacagagauuagcauggccccugugcaaagaugacaugcaaauuugugaagaguuccauauuuaaaaaaaaauaauaaaaauuuaaaaacuccacaaguguaggguauuguggauugcuagcauauccauuuagauuaugugcaguuuuaauuauugcuuuaugugaagacuguauaaaacaguuuuccauugagaggaaucguuuaaaauuugccaugucauauguuauuuaugcagguucuaguuuaaaucuaaaaaaauccuacacauacacagauaagagaaauuauaagaagaaaagaaaaaguaggauaaacuuguguguccuuugaucuuacucuuuuuuuuuugagauggagucucacucuguugcccaggcuggagcgcaauggcgugaucucggcucacugcaaccucugucucccugguucaagugauucuccggccucggccucccgaguugcugggauuacaggcgcgcaccaccacgccuggcuaauuuuuguauuuuuuuguagagacgagguuucaccauguuggucaggcugaucucaaauccuugauuugugaucugccugccucggccuccaaaagugcugggauuacaggcgugagcugccaugcccggccugaucuuacucuuaagaaugaaugugcaaggaaacacaagucauguuuuucuuaucuggcaaggguuuuauuaauggaagcaagaggccaacaaagcugaagaaacccuuuuaugugccuagccagaaacuaaugggccuugggaauccuuuuaucugguaagaaggugacuuaauuugaaaaggcugggaaccuuaccuaaacuugaauuugcgcccccacaaaaguuaucuuagaaaaucuugcaagcaaaagaagugauaugguuggagaggccuuggugaaguccuccaaacucuggaugguuugugguugggugcaggggaaaaaugaaggccucuaacauaugauauuacuccucuagaauuguugacuuuuuuauuuccuuggagucucucaaaucaagguuuuauuaauuaauuaauuaauuucuauuuuuauuuuuugagacagucucacucugucacccagacuggagugcaguggugcaaucuuggcucacugcaaccuccgccucccggguucaagcgauucuccugccucagccuccugaguagcugggacuacaggcgccugucaccacgaccagcuaauuuuuuuguauuuuuaguagagucgggguuucaccauguuggucaggcuggugucaaacugcugaccucaggugaucugcccaccuuggucucccaaagugcugggauuacaggugugggccaccacgccugaccccaaaucaagguuuuacaggaauuggcaacugugacauuugacguguauagcauguaaccaaaugaaauuuuuuuuuuuuuuuuuuuugagacagagucuagcccuguuauucaggcuggagugccagucgugugaucucagcucacugcagccucugcuucccggguucaagcgauucuccugucucagccucccaaguagcugggacuacaggugugcaccaccacacccugcuaaguuuuguacuuuuguuagagacaggguuucaccauguuggccagacuggucucgaauuccugaccucagguaaucugccugccuuggccucccaaaguguugggauuacagacaugagccacccuugccuggcccaaaugaaauucugauguaucuuagugaagcuagcuucucuuuuuugucguuuaacagcaugcuaaugccaucaaauaauuacuguuuugugaacacauuuuggaaacuggaaagaccauugagacguaaaacagugaaaaguggcuugccagcaaaacugauugaguaccugacagcacaucugguuuugcugcuuuggugaagggagaagcuccacgagccacuaugaaucauugcuuuuacauuggcaucaaagacucugccaaagaucgugaaagaagucuugucuaaggucucuaaagucacauuuuaaccuagucagggcuuugaaucacugccuugucaagaacuucucuugagaaauaggagaggauuaugagguuauuuucuauugcagagaaguucauugauucuguaaagaacaaguaucaaaguacugggaauucugguucucuuugcugcuacaugacuucaugaaucaggguuuucagaacacuuggggcaaucaguuggauuguuaaacccacugccauggcagagcacaguggcucaugccuguaaucccagcauuuugggaggccgaagcagggggggggugggggggggggggcggaucacaaggucaggaguucaagaccaaccugaccaacauggugaaacgccgucucuacuaaaaauacaaaaauuagcuggacaugguggcgcaugccuguaaucccagcuacucaggagucugaggcaggagaaucgcuugaaccugggaggcggaaguugcagugagcccagauugcgccacugcaccccagccugugugacagagugagacucugucucaaaacaaaacaaaacaaaaaaaccauacugcuuacuauucuaacucuuuauuuaagagaaacaguagcagcuuucuaauugaaauagguuuuuguggaaucuguuuuuauuuuccuuuaacuguauuaucuuuucuagucuaagcaucuuuuuuacauuaggagaguuuaaucuguuuacaugaauguauuuauucauauguuuagauuuauuuauuuauuuuuugaguuggggucucacccugucacccaggcuggagugcagugguaagaucauggcuuacugcagcuuccaucucccaugcuaaagugcuccccucaccucagcuucccacauagcugggacugcaggcauaggcauagugggacccugucucuaccaaaaauuuaaaaauuagccaccaugccugguuguuuuuaaaauuuuuuguagagacaggguuuacuguguugcccaggcuggucucaaaacuccugggcucaagugaucuuccuaccucagccucccaaaguguuaggauuauaggcaugggcuaccgcaccuggccuagaauuauuucugcuaucuugugguguuuuuugucucaugcuuucccuccaccuucuuuucugacuuguguaacauuaauugaauuuuucuuauuucuuuuuucucccugaacuaaugauuugaaaaugacuuauacucuuucuaauuuaguaguuacgcuugcauuuuuacauacauauuugacuuaaauauucgaguccucccagcuucugccagaguaguacaaggacuuuagaacucuuuaccucauaucuuucccuccugcuauuucuuucuauuauuuuagcucuaccuuguuuucacuuaacugcuccacacucuaccccaacuuuauauauuuuaguuccuuuacagucagggcuuauuuggauugacguauaugauuuugcuuuuuugcauauacuccuuauuuugguauaucuuuuagugauucuuucagcaacuaucugugaauggcaauuuuuuucacuuguugccugaaaaugucuuuauuuugcccucauuuuaaaaaauauaauuuagcuugauaaagaauuagaaggguuuuuuuuuuuuuuuuuuggacuuugaagauuucuccgugguucucuggcuuugguuauugcugauaugaugucagccaucaguguaauagucuugccuuucuagguaaauuuuucucucugugugugauuuuaagguuuucucuuugcuuuuguucuacacacuauacacaacacaaucccaggacauacaacaagcuuccuuacugccuccccaggccaggccaguugauagaguuuuccuagucuuguuuucacugacauaguagcucuuccuagggcucuggacucugcaggaggcuaauuccacaccucgaauauauacaccuaaggcgucgucaucuguuuuugaguggcgguuuagacccccagcuucuagggccuauauccaaauuucaaauccuccugggcuuuauacaucagcccacugcauuauuuuggcuuucauuuguuccugguaccuggugucuuaguccauuugggcugcuccaacaaaacacuuuggacuggguaacuuacaggcaacagaaauuuggggucaagaucaaggugccggcagauugggugucuggugagggcuugcucucugccaucauaaauggagccuuuuuaugguggccucacguggcagaagggacaaacaggcuccuuuaggccugcuuuacaaaggcacuaaucucuguaaucccagcacuuugggaggccgaggcgggcagaucaccuguggucgggaguuugagaccagcgugaccaaaauggagaaaccccaucucuacuaaaaaugcaaaauuagcugggcauggugguacaugccuguaaucccagcuacgugggaggcugaggcaggagaauugcuugaacccaggaggcagagguugcggugagccaagaucgugcccuugcauuccagccugggcaacaagagcaaaacuccaccugaaaacaaaacaaaacaaaaaaacaaaggcacuaaucucauucaugaggaugccacccucugaacuuaaucacccccgaaaggccccacuucuuaauaaaaccauaguaaccaggaauuuuccuuuuugacuuuucacauguaccguuuaaaauguguuuaaugagggaaauaaagaaaaugagacagucuugaaaagaugagucauaauggaauuagagaccuuugaaacauggagaauuuauuucucuaucucaugagauuucuggagcguuaguauaaauguauauacuacaaauguauguacuaccugucaguugaaauauauaauauguccacagcucuaagggcucauugacugauugucugcuuuauuccauaaaaagauuuaaagugguauuuugagauauauauaucaaaauauaucaauguauauacaggggcccaaguauaucauucauaagggauauauacauauguaucuauauaugugauauauagauauauaucauauaagcacuccuguauaaaaaaauaaagcaagccacaaaacucauacguucuauuuauucauuuauuuauuauuuauuuuugagagagagucuugcucuguugcccaggcugaagugcaguggcaugaucucagccccaaccugugccucccagguuccagugauucuccugccucagccuccagaguagcugggacuacaggcacaugccaccaugcccagcuaauuuuuguauuuuuaguagagacgagguuucacuguguuggccaggguggucucaaacuccugaccucgugauccguccaccucggccucccaaagugcugggauuuuaggcgugagccacugcacccugccacauucuauuuauuaaaagugucaaucacuggaccacuggaucacuggaccaauauauauauuuauugauauauugauauacagagaagaauauauagagaguagagauacacguagaucucuuucucucucuuuguucucuauauaucuauaucuauauaucccuuaugaaauuaccugagcacuguuucauguuuaacuugaggaauuuuucaaagccugggacuauucuaggcauguucagauaauguuugaauauucuagaaagauuauuuaauacuucuauaaucuuuuuguagaaagauucuuugccaugaucuaagacagugguuuucaaagugugguuuccgaguccucagcaccagcaucaccugggaucauacaguguguacuguuccuaagucauuuguuagguuuuuuuuucuuuguuacaauuuuucaauuaaaguuugauaaaauauuugaacucauaggugguccagugauuaauacuuuuaauaaauagaaaguaugaguuuuguggcuugcuuuuuuuuauauauagaaaugcuuauuaauucuacaguguaauaucaugcuacguacucuaauaaaaauuauguauguguuugcauauuuauguuuuccuuauacuugagcauccuucauuuuuaaaagaacauuuuuuaaaguuaaauguuagauauggaauuaaagaaauauguuauaucuuuaaauuaauuaucuuauuuuaaaaauaaucugccuacccuaagcucagaagagaaauuauaauauuaguuaugugauuccucuuaaugagccucauggauuuaaaacauaauuagcauuguuacacuuccuuccagacagaaaaugcgugcuuuguuaguaaauguaguaugcuuuuguucaugaagaaugccauuaaguagugccauacuauuuuagggugcuuauaaaagaaggauguuccguuguuuucuguuacuuaaaucauauaaaaauguuuugaaaugcaaacugcuugauguuuuaggauucagagacuuugaugaucauuuacaaaaaguuucugccgaagauggcagggugugauggcucacgccuguaaucccagcacuuugggaggccgaggcagguggaucaugugagguccacgaguuugagaccagccugaccaacauggcaaaaccccaucccuacuaaaaauacaaaaguuagccagguguguggcgcacgccuguaucucaaguacucgggggacugaggcaggagaaucgcuugaagcugggaggcagagguugcagugggccaagaugccccgcagcacuacagccugggcaacagagcgacuagucucaaaaaaaaaaguuucugccaaagaacugaauacacaaaaugaaugacagaguaguuaguaccauuguaaagacauuaaagacucauuuucugucugauucuuaaauauuuaaacaaagccccauauagcgccuuaaauauaggaguguucagaaaauguugguuuaguuuaaaugaccaaguuauuuuugacccuauuagucuauuagcauaauguugucuuuuucacuuaaugauuaagcuacuuuuagguauguuagguaucaugagcugguccucaguguccuagagagcauuauaagaugugaauucagaggagggugaggaaauguuaaacguuagcaaaauguggcuaaaaccagucugcagacuugaagaauucaagaaaaggugauugccuaauagauuuaaaaaugaauauucacaaaaaagaaaccccauuaaaaaccgggcaagggacuugaaaagacauuuuucggccaggcaugguggcucacgccuguaauuccagcacuuugggaggccgaggcaggcagacaaccugaggucaggaguucaagaccagccuggacaacauggugaaaucccguuucuacuaaaaauacagaaauuagccgggcgugguggcgcaugccuguaauuccagcuacuugggaggcugaggcaggagaauugcuugcaccugagagucagagguugcagugagccgagguugugccacugugcucuagccugggcgacagagugagacuccaucucaaaaaauuaaaaaaaaaaaaaaaaaaaaagaaaagacauuuuuccaaagaagauauaugaaucaccuuuaagcacaugaaaagaugcucaacgucauuaauuauuaggaaaagaaaugcaaaucaaagccacaagauacuacuucacacccauuagaaugguaauaauaauaacaaaagggaaauaacaacuauuggugaggauuuagagacauuggaccccucacccauugcuguugggaauguaaaaugguacagccacuauagaaaacauuuuggugguuccucaaaaaguuaccauaugacccaggaguuccacuucuagguguauacccaagagaauugaaaacagauguugaaacaaaaacuugcaugugaauguuuauagcagcauuauucacaauaacaaaaaauuagaaauaacugucguauccaucagcugaugaauggauaaacaaaaugugcuauauccauauaagggaauauuauucagccauacuggccacacauggaugaaccuugagaacauuaugugaaaugaaacaacccagacaccaagagcuauauauuguauaguuucauuuauaugaaauguccagaguaagcaaauccauagacauagcagauuauugguugccaggggcugggaugaagggagaauggggaguuguugcuuaauggauaugcuguuucuuuuugggggugauaaaaauguucuggaauuauauaauugugauucuuacacaacguugggaauauacuggaagucacugaauuccauacuuuaaaauggugaaguuuauguuaugugaaauuuuaccucaguaaaaagaaagaauacucaguaagguuuucuuuaagacaaauuuuuuuaaguuuaaaacauuuuaaaauuuuuuguagagauuggggucuugccauguugcccaggauggucuugaacuccuacccucaagcaguccuccugccucaaccucccaaaugcuaggauuacaggccugagugcccagccuauaauucuuuucuuaguaaaauauuaccaaaguaaaaaauuuaaaacuaaagggaauuuuauuucaauauuguuguuuugugcuuagaaaaauuacaaaacguuauguuuggugaaaauauauagaaaucagccugggcaacauaguagaccccaucucuacaaaaaaugaaaauauuagcugggugugguaguaguccuagcuacucaggaggcugagacaagaggaucacuugagcccaggaauuuuuuuuuuuuuuuugagacaagaggaucacuugagcccaggauuuuuuuuuuuuuuuuuuugagacagagucucucucugucacccaggcuggagugcaguggcgcgaucucagcucccugcaagcuccgccucccggguccacgccauuguccugccucagccuccacaggcaugcaacaucauacccagcuaggaguuuugcuaguuacaaacaacccuaggauaaaucaccacaagguagucucaugcaggguauuuuauugugccuaguauguugcuuuuuuuuuuuuuuuuugagaugggaucucacucugucaucaggcuggagugcaguggcacgaucuuggcucaccgcaaccuccaacucccugguucaagcgagucuccugugucagccuccuaaguagcugggauuacaggcgcgcgccaccacgcccagcuaauuuuuguauuuuuaguagagacgggguuucaccauguuggccaaucuccugaccucaugaucugccugccucagccucccaaagugcugggauuacaggugugagccaccacacccggccauauguugcuuuuuaacugugaugaacaguaugucucaaacuguuuacacuuucccugccaucuuauucugaaucuacuuaacuucuuaccguuaguuucauacaugccuuucugaccugaaacuuuauucuguucuauuggcacuaauuuuugacucucuuuagcuaaccuacuccuuuaaugacaugguuucuagccacuguggauaaauauccuguuuauccugcuucgccacacuccugcuggcuucccuagaucuuuuuacguuucagcaucucugcauccucugccuuagcaaggaaaccugggcggcaagaaccccaaagacaagagugaagugggauggggaaugagaaugagaucuaauaaggcaaaggcccagacuucuuuugugaaauccacuagaagagaaauuguccauagcaguuaguacuauaguuccauagaagucugcuuuuucuaaagaucaaacauuauuuaaugcugauucaguaucuuuaucuaguaaauugauguuucuauccaacguagaacauauagacuaucuugagggugguguuucuuucccaaauuauguuccauagaguauuaguaccuggaaaugcgaaaagaagcucugcuuuggaagagaggagaagauucuaugcucaaauauauuuagcaaaguuugcuuaccuguucuuggaggcccauaacaccuuagccuguuaagugcuguauuacuuacucagucaagaaaccuguuggagucagcauuucccaaacuuauuugaacucagaacuuuuuuuacaggaggaguagccugucuguuaauggccuacauaacaucauuuggggagacacuguccuagagcauuguaaauuugugucacugcaguuaaaaaaguagccaaucuuacuagcuaguaccaaaaacuaccugaaguucguuguaauuuauuuauuuauuuuuugagacggagucucgcagugucacccaggcuggagugcaguggcgcaaccucugcucacuacaaccuccgccccccagccuggguucaggcaauucuccugccucagccucccaaguagcuaggacugcaggcacccgccaccacgcccgguuaauuuuuguauuuuuaguagagacaggguuuugccauguuggccaggcuggucucaaacuccugcccucaggugauccacccgccuuggccucccaaagugcugggauugcaggcgugagccacugugcccaacccauuguaaucuauuuacuauucauguuauauauuaguucauauauaaauucuccaucaagguagaccugauauuuuccuuugacuuacaagugucauauuguugucuuccagcgauuuuuuuuuucuuuuugcuacacaaaaauauuucuugagguuugaauaaagcacuaggacauuccugguuuuaauugauacguaaauuuguuuaccucuuuuaaaacuguuguauguaagaguacauuuguugauccugguauaaaauguaagacuuaaauaauucaaauacccuuuugaaauccaaauaaugucuucauuuacuaaggauauugucaagccaagcucuucuuuaagaaaguaauuagcuuuaaauguugaagguauaauuaauaaauaagcacaauuuauuucuuuguuaaccccucucuacagaaaauagcugacauucagugucuaaccauucuuaacaaagaaauauguagacauuaauauuuuauaucacaauauauuccuaagaaaccuauuguagguaucauuccucuuuucauuagguuuuauuaguguaggauuuuggcuuuuucguguacuugaauuuuuuuucuccauaaaauaacucauuuauuacauugcuuuucuugcuuuugagaacuuuauaguuuuuaauggaugucucuaauauucauaacugauuguaagcucuuauuauagacgauaugagauuagaucaguugcggcuaaccccucugcccuuuuuguuguuuuuuacaugcaauauaagaaucuaaugcagaaaugaagucuguagccuuguagauuagauuacccuugugucuucuacgggagggaggauauggucugaauguuugugucccuccaaaauucauauguugauaucuuagccuucaagaugaugauauuaggaggugaagccuuugggagaugauuaagucacuacagcuucacacucaugaaugagauuggugccguuauaaacaggaccacagaaagacccuuucccauuccaccaugugagguuacagugagaagauggcagucucugaggaaguggcccucaccagacagcaaaucuccuggugccuugaucuuggacuuccugaucuacagaaaugugagaaauaaauuucuuuuguuuauaagcuaaccguucuaugguaauuugccauagcagcccaaacagacugagacaaaggguauuauuauauuuccauuuaggcuugcuaugucuuuugacugaugaucccagguucuuucauaguuguuucuguguuuggcuccugauccuuuagacaagucagccaauucuggcagugauagaacauaaugguuucagagccucucccacauaagacaaaaaugacuccccggugaguugcugaagagccagaacagaucuucucucacaugagucuugacacuucgacaaagcaugaagugaaggcucauauaacaaaacuguguuugguugaguuggcuucaagauuaguuuguuauaaaugacuacuuuucuauugcuuuuacuuuuucuugucaugagccgccuuucuucuuaaaugguguuuaguacuuugcauuguuaugugugaucuaccaguuauauaccauacuuucaauucuguauauauuuuauugacugaaaagagggaguuugaguaugaaauuauaauugauacuauagucuuuuuugugaugauaaauuucuaaagucaaaccuauuuauuagcuugggaaaauaauacauagugauauucagaugugucacuaacacauagaugauuuguguauaagaaguuuuauuuuaauuuuauuagguuagauucuacccuuguauauauauuuugaugguguguaaacauuucaagaauacuacagcuucuuaaaguaggguuucuagcaugauugugaauuagaauuacauuagaauuucuauuuuuuagucuuuauucauucuguaauuacauguggguuguuauuuauuaucuugcaaauguaaauggaaaauacauuuuuccuuucuaccucaaagaaauugcauuuccaugacuaaagauccuguagaaagucuauuugcuauuuacauaauaaauuuguaacaguuugcuauuucuugcuuauuacauugugacccuuaacuaaggcaaaccuuucuuuuuuuuuuuuuuuaauuauacuuuaaguucuggaguacauguguagaaugugcagguuuguuacauagguauacaugugccauggugauuugcugcacccaucaacucgucaucuacauuagguauuucuccuaaugccaucccucccccagcccuccaccccucgauagguguuauuucugaggcuucuauucuguuccauucaucuguauaucacacucuguugaacaggagugaugagagagggcauccuugccuugugccgguuuucaaagggaaugcuuccaguuuucaguaugauacuggcuguggguuuuuauaaauagcucuuauuauuuugagauaccaucaauaccuauuauuuugagguuccaucaauaccuaguuuauugagguuuuuaguaugaaggccuuuucugcaucuauugagauaauaaugugguuuuugucauugguucuguuuaugugauagauuacauuuauugauuugcguauguugaaccagccuugcaucccaaggaugaagccgacuugaucaugguagauaagcuuuggauaagcuuuuugaugugcugcuggauucgguuaggcaaaccuuuucuaggugcuuauuucuuaagcagauuucaaauggaaaaguaaagagagccaguugagauaucaaguuguuacuuaaaaccauuugaaaugccuauaagcuuuaaaagcuuuuacuucuuaguccaagguggugagucaucuuucacccucuuaccaguuuuuugcugaaacacccaaaugauagaaugcagaagaauuuacaucacccuugcaaaauuaaaaaaaguuuucacucacagugucauguugaagagcuuugguagaaaacaguaaaguaagaguagagggaaguuacacaucagccugcccauuguuagccagcacacuugagggaaacuugcuuagagguuggucggagagccugcccuuccauacaaaccuaguaacauaugcaggcugggagcuggggcuggaaacaagaguaggaacaaugaugucugcagguaaaaucucuguagguaaaaucucuauucuccuagccuagguggagcuauagggggagggaaccagcucuccagugcacauccuaugugcugcagcugcaggguuagcagaaaucacuguggaggguggccuucaggaguaggauagagaggggcuccaauaucaggcugaagugggaggccaugccccaagauucaacagugaucugcauggucuggaacaguguggaccagcaccguugaauagaacccuuggcaaugagggaaaguaucuguacuguccagugugguagucacuagucacaagggcuuuugaacacuugaaauguagcuagaaacugaaucaguaccaaaagccugaaaagagcgcuuuccucuuuuggguauuuuuaucuuaaggaguuaaucaugcagauguacacacuauucauuauagcauuguuuauaauauuaaaaaacauacuauaauauuagaguaacauaaacauacuauuuauuuauuuuugagucauagucucaccgugucgcccaggcuggagugcaguggcaugaucucgucucacugcagccucugccucccggguucaagagauucaccugccucagccucccaaguagcugggacuacaggugccugccaccauguccagcuaauuuuuguauuuuuaguagacaugggguuucaccauguuggccaagcugcucucaaacuccugaccucaggugauuucaccugccucagcuucccaaaguguugggauuacaggcaugagcugcugcgccuggcugaaauauacuauuuaaagcaauuucauacccuggcaguggaguacuaugcagcuguuaaaacugcuguuguagauagguauuuguugacagaaaaguuguuuacaauaugcuaagugaaaaagggcugguuacaaaacuaugugguuaguguguucccauuuuuuagugaaaauauuguauguuugugugcauauacagauagaugauaugaucuguauccugguaaaacacaucuuuggauacagguauccagguauccaaagauguguuuuaaugccuguucugccauuuauuggcuguguacuuagccuuucagccuucucaguuuuuuuguuuuguuuuguuuguuuuugagacagaggcucccucugucacucaggcuggagugcagugguaagaucuuggcucacuguagccucugccuuccggguuccagugguucucuugccucaaccucccagguagcugagauuacaggcaugugugacuacgccuggcuaauuuuuguauuuuuaguagagaugggguuucaccaucgucucuacuaaaagauugucauuguuuggccaggcuggucucaaacuccugaccucaggugaucggccugccucagccucccaaagugcuaggauuacaggugugagccaccgugcccggcugccuucucaguuuuuuuuuuuuuuuuuuuaacuguaaaagagagauguaaaaauaaugucuucuggccagaacugccaucuuccacuuugccaaauugacaaagggaaagaggaguagcacugcuauauuuucuuuaaaaauauagccuuuuagaaaacguggaguuauuccuuuggccacauacaugugaaucuacaagaaaggugauauuguagacaucaaggguauggguacuauucaaaaauuucaaacaggagugucccacaauguuacucuggcaaaacuggaagagucuaucaacaguguuacccagugggccaggcgcgguggcucacgcuuguaaucccagcacuuugggaggccgaggcagguggaucacaaggucaggagaucaagaccauccuggcuaacauggugaaacccugucuccacuaaaaauagaaaaaucagcugggcgugguggcaggcgccuguaaucccagcuacuuaggaggcugaggcaggagaauggcaugaaccugggaggcggagcuugcagugagcugagaucacgccacugcacuccagcaugggcgacagagccagacucugucucaaaaaaaaaaaaacaaacaaaaaaaaaacaacaguguuacccagcaugcuguugacauuguuguaaacaacagguuggcugggcaugcacgguggcucacuucuguaauccuagcacuuugagaggcugaggcagguggaucaccugaggucaggaguuugagagcagccuggccaacauggugaaaccccuucucuccuaaaaauacaaaaauuagcugggugugguggugggcgccuguaaucccagcuacucgggaggcugacacagaagaaucacaucaacccaggaggcagaggcugcaguaagcagagaucacgccauugcacuccagccugggcgacagcaagacuccgucucaaaaacaaacaaacaaacaagaaaacaaaacagguuaagguccagauuuuuuuuauuauuauuauuuuuauuuuuuauuauacuuuaaguucugggauacauguguagaacgugcagguuuauuacauagguauacaugugccauggugguuugcugcacccaucaacccaucaucuacaucugguauuucuccuaaugcuaucccugcucccuaccccugacaagccccagugugugauguuccccucccuguggcuauauguucucauuguucaacucucacuuaugagugggaacauguggcauuugguuucuguuccuguguuaauuugcugagauauuucucuuaauacugaaauuguuaucuguuuccgcuucugggaggaagguaaucuuucuugguuuucauaacaauauccucuccugagagaaggaugcuucgcuucugugaacguaccuucggagucuguguaauccugugccuuaaauagcucuuuuucagacgcuuauaauguuuuuauuuuccaaaagagcucucuccugaaugcccuucccauuugcucccuuacaaugcuucugggcaaucucuucucuauguuuaugacucccaaguucuuuaccugcaguugagcacucucuccugagcuucagauccagauaaccaggaucacuaacuguaugccccaugaacaucuugagcucaucacaucugauacuaaaaucuacauuucuggccaggcgcaguggcucacgccuguaaucccagcacuuacggaggccgaggcagguggaucaccugagguugggaguuugagaccagccugaccaacauggagaaaccccgucucuacuaaaaauacaaaauuagccgggcgugguggcgcaugccuguaaucccagguauucgggaggcugaggcaggagaauugcuugaaccugguaggcagaggcugcggugagcugagauugugccauugcuccagccugggugacaagagugaaacuccaucuccaaaaaaaaaaaaaaaacuacauuucuucacaccuuaaaccuguaaugcuuuuccuuaucucuaaauuguaccaccaucuuuuugguugcuuguaccauccugggucauuuucccucagccuaucaauuacuaaauccuauucacucuuucuugcccucuuuuuaucuaaccccuccuuucuauuuuuauugccauugcccaugccagguccuauucucccucccuccaucucccucucauugcuuccagaauuagccuuggccuaugaucccacaguccuggggcacguguagauuaccugaaucuauauaguuguagaacacaugcccugaacaacuuuugacuucuggguuauaugagaacuuaaaaagauaacuaaaaagauuuguugauauugacugcauucauaacauggaaugacuuuacacuuuaccaaauaguuaauauaaguguauguaaaaauagguuauguauaaaaaagauaaauaauacaagagaucauuugcugacuuccaaaugagugguauagauaauccccauagggauuuggaagagugagagaucauuaagaguaauggauuuaaugaauggaaaggaacaaaggaaguaaaaagcagacaaggguugguggggaggagggguggagaguuggauaaaagggagaaaaagauaauguaagguaaguaguaaagauacaugacauugggguucaugaaauuaaaaaaagauagggcuucccaaggcugcucugacugcaaaauacacaguacaugguuugguugcuguguuaaugaaaauaaagucuuuugauuucauacuccacuaguccuuuaauuuuacuuaauuauugacugaacuauguucccaauccuggcuagucauuuuggaguuaucugucuugaccaaacaggagauugggcaauagauuguguuguaaucagaacaaacacauccuuugacaccaaaaacaacaacuuaaaaugcaugcccugauuauuguuguauguauauuugaacuauguggucuucugucaauauucuggaauuuucagauagccuagcauuuuaaaaauuuauuauuuuggugaccucuucauagguaaacacucuaacuuuaauuucaagcuuaucuauuccaaagacaugaauguguauaauuuauaaugugggacuauucuaaauauauguauauagguucauuuuuaauuuuuauuuuuuagaaacagggucuugcucugucaaugaggcuagagugcaguggugugaucauagcucacugcagccuugaacuucuggguucaagcaauccucccacuucagccucccgaguugcugggacuacaggugcaugccaccauaccuggcuaauuuaaaauuuuuuuguagagacaaggucucccuguguugucaaggcugguuuuuaaugccugggcucaaguaguccuccuuauuuggccugguaaagugcugggacuagaugugugaaccacugugccuggcagguucauuuuuucaguuucauucaaaucaguguauguuguauagcuguccuuuuagaguuuugccucugaauuuucagaaauuauguauuuucuccauuaucauuucaauuaauaguauuuuuugaaauuggucauacuaagaauugacauauaaaaacuccauuuaacauaaaaucauucuugguuuugaaauauuaauuauaacauaauuaauauauuucccuaagcacccuauucaaaguacugcuaacauaauaucuuagagcagugguuuucaaacuuugagucagcuugccuauucuuggucuggcucuuucuugcucauaaucuaugaugugcacugguguuuucaauuauuuucuauuuuaguccaguucagguuauuucacuugccggggguagggugggggaaaugcugguuucaacugaauagauggauuucaugauucacuaaugggucauaagaugcaguuugaaaaacaauaccuuagaguagacuuuuacaaaaaauaauuugaaaaauacagagcaacauaaaguagcaaaccaaauuugauucaccaguuaacuccuguugacauuucagaaauagaaauauaugcauaauaagaauucaaacaauaucacaauugcuauuuguuauauuaauacagaaagauacaaaaugaaaaauguuaaaccuuugucuucuuuaacaccuggucauucugcacaaaaguagcuaguaaaaauggcuucuuauaaugacguuuuuugugcauguaccauuacauauguaucuuuuaaaaauaccaaagagauagauauauauauucuuuuccaucuuuaucacuuaauauuaugucuuagugaucuuuccauaucgacaauacagaucuuauuuuuuuaacccccaagucaaaggucauuuuuuaaauuuauuuuuauuuuuggucagagucuuucucugucucccaggcuaaagugcagugaugcgaucauggcucacugcagccucaaacuccugggcccaagcaaucuucccauuuuagccucucaaguuaacuaggacuacagguacaugccaacacacuuggcuaauauuuuuaauuuuaauuuuuuuuuuugguagagcugggguuuuacuauguugcccgggcugcagugcaguggcacagucacaacucuguagccucaaccacccaggcucaagcaguuguccagccucagccuccugaguagcuaagacuacagguaugagcaaccaugcccagcuaauuaauuuuuuauauuuuguagagaugaggucucacuauguuguccagucuggucucaaaauccugggcucaagcaauccuccuaccuuugccucccaaagugcuggaauuacaggcaugagccaccuggccucuuauuuauuuuuauuuuuauuuuuuugagacagaaucuugcucagucacccaggcuggaguauaguagaacaaucucggcucacugcaaccuccaccugccggguucaagugauucuucugccucagccucccgaguagcugggacuacaggugugugccaccaugccuggcuacuuuuuguauuuuuaguagagaugagguuucacuguguuagccaagcuggucucgaacuccugaccuugugauccaccugccccggccucccaaagugcugggauuacaggcgugagccaccgugccuggcccauccaccuggccucuuauugcauucuuuuuuaauggcuauauaauauuccacuguagggauggacuuuaauuucuucaaccaguuccuuauugaugcugucuggaugcucuuaagcuuuaaaauuuuucccaaucugaucagugaaaaauaugucuccauugcuucaauuugcauucuucaguugagauagucauauuguuagauaauuuuugacuauuuuaauuuauauuuauuuuugugaaaugucuguucguauucucugcgcauuggacucugaaggguuuucuauuuuucuuuuuuuuuuuuugagacagagucuugcucuguugcccaggcuggagugcaguggugcaaucucggcucacugcagccucugcuucccggguucacgccauucuccugccucaguuucccaaguagcuauaacuacuggcgcccgccaccaugcucggcuaauuuuuuuuuuuuuuuuguauuuuuaguagagaugggguuucacuguguuagccaggauggucucaaucuccugaccucgugaucugcccacuuuggccucccaaagugcugggauuacaggcuugagccaccacgcccggcuccauuuuucuuuuucuuuuuucuuuaacaacugguaauuaauuaauuaauuuuuuuugagauggagucucgcucugucacccaggcuagagugcaguggcacgaucucggcucacugcaaccuccgccucucagguucuaggaauucuccugccucagccucccgaguagcugggacuacaggcgccugccaccacgccuggcuaaguuuuuauuuuuaguagagacgggguuucaccaucuuggccaggcuggucucgaacuccugaccuugugauccauccgccuuggccucccaaagugcugggauuacaggcaugagccaccgcgcccggccaauuaauuuauuaaaauaguugacuuaaacaucugcauuggugacuucagaaucgauuccuggcgcaacacugauggaaauaaucugcuugacaaucuuggaaggacugugcaagucagugagucacuuuuggauucucaucuggaaaccaucccagugccuuagaacuuucaccacaaggaguuuuucuuguagugauuuucagagucuugguaggcauacagacugguccuuuuacuugagauuuuuaaacuuuuugccugugaucaagucagcacacaccuucuccagggguuuuauucuaauuccaugaaccaccaccccuggcuccacagcuguuuuucugguaucuuuaaaggccauggauguggcacagcuuccuuacugaccuguuccucagugagagugaacagcauugagucaugagcgggaguggcagaccagagcucuccagcaccugugaccacaucuuucucaaaaaaaaaagcugaauuuuauaagcucuauaagcuagcaguccccaaccuuuuuggcaccagggacugguuuuguggagacaauuuuuucacauaccgggguucgggggaugcuuucuggaugauucaaacacauuacauuuauuaugcacuuuauuucuauuauuacuacauuguaacauauaaugaaauaauuauacaucucaccauaguguguaaucagugggaacucugaacuuguuuuccugcaacaagaugauucuaucuggggguacugggagacagugacagaucaucaagcauuagauucucauaaagagugcacagcccacaucccuugcacaugcaguucauaaugggguucgugguccuaugagaaucuaaugcugcugcuuaucugacaggagauagagcucaggugguaaugugagcaguggggagcagcuguaaauacagaugaagcuucgcuuacuuaccugcugcccaccuccugcuguguggcuuguuccuaacaggccaugagccaguauggguccauggcccagggguuagggaccccugcuguaagucagcaaauuagccgucuacuuucuuaugacuugaugauuuccaaacauuuuguuagcuuuuugacuuuguucaggauguauuuucuguacaagauaguucuguagucaaauuuauugacccuuuucuuguguauuauauuuuuaauauuuuaaaaauuugaauagcuugugggguacaaguaguuuuugguuacauggaugaauuauauaguggugaauuuugagauuuuuagugcaccucauacccgaguaguguacauuauaaccaauauauaguucuuuaucuccucccacccucccuucuucugaaucuccaauauccauuauaacacuuugaauacuuuuguguauccauagcuuagcucccaccauaugguauuugguuugccauuccugaguuauuucacuuaaaauaauggccuccagcuucauccaugcuuuuuuuuuuuuuuuuugagacgaagucuuacucucuugcccgagcuggaaugaaguggcaugaucuuggcucacugcaaccuccgccuccuguguucaagcaguucuccugccucggccucccauguagcuaggauuacagacaugcaccaccacaaccagcuaauuuuuguauuuuuaguagagacaggguuucaccauguugucgaggcuggucuugaacuccugaccucaggugauccaccugccuuggccucccagagugcugggauuacaggugugagccacugugcccagccccaaguuucugaaaagacauuauuucauucuuuuuuaugacugaguaguauuucaugguguauauauaccacuuuuuuuuuuuuuuuuugagacagggucucacuuugucacccaggcuggagugcaguggcaugaacauggcucacugcagccucgaccuccugggcccaagcaauccucccaccucaacccccuaacauacagguaugugccacuaugccuggcuaauuuuuuguagagaugggguuuuaucaucuugcccaggucaguccugagcuccggaaaucugcccaccuuggcuucccaaagugcggggauuucaggugugagccacugcaccuggcuaucuaccacauuuucuuuauccacucauugguuaaugagcacuuagguugguuccauaucuuugcaguuguggauugugcugugauaaacauauguaugcagcugccuuugauauaaugacuucuuuuucuuuggguagacaccugguagugggauugcuggauugaaugguggaucuaugcuuaguucuuuaagaauuuuccauacuguuuuccauagagguuguacucauuuacauuccaaccagcaguguuaaguauucccuuuucaccauauccacaacaacaucuauuguuuuuuggcuuucuuaauggccauucuugcagaaguaaggugguaucucauuguggucuucauuuucauuucccugaugauuagugauguugagcauuuuuuucauauauuuauugaccauuuguauaucuucuuuugagaaaugucugucauuugcccacuuuuugauggaauuauuuguuuuuuuuuucuugcugauuuguuugaguuccuuguagauucuggauauuaguccuuuguuggaugcauaguuugcaaauauuuucucccauucuguggguuguuuacucgugauuauuucuuuugcugugcagguacuuguuaguuuaaucaggucccauuuguuuauuuuugcuuuuuuuacauuugcuuuugggcuuuuagucaugaauucuuugccuauuccaauguccagaaggguuuuuuuaagguuaucuucuauaauuuuuaugguuucaugccuuagaguuaagucuuugauccaucuucaguugauuucuguauaagguaagagaugaggauccaguuucaucuucuaccuguggcuugugaauuaucccagcacuuuuuguugaauaggguguccuuuccccacuuuauauuuuuguuugcuuugucgaagaucaguugacuguaaguauuuggcuuuauuucuggguucucuauucuguucuguuggucugugugccuauuuuuaugccaguaccaugcuguucugguaacuauagccuuguaguauaguuugaaauuggguaaugugaugccuccagcuuuguucuuuuugccuagucuugcuuuggcuaugugggcucuuuuuucauuccauauuaauuuuaggauugcuuuuuuuuuuuaguucugugaagaaugaugacgguauuuucaugggaauugcauugaauuuauggaucgcuuuuggcaauauggucaucuacacaauauugauucuacccacccauaagcaggggauguguuuccauuuguucaugucaucuaugacuucuuucagcaguguuuuguaguuuuccuuguggagagcuuucaccuccuugguuagguauauuucucccuugguuagcuauauuccuaaguauuuuuauuuuauuuuuuugcagcuguuauaaaagggguugaguucuugcuuucauucucagcuuggucacuguuggugcauagcagugcuacuaauuuguguacauugaucuuguaauuugaaacuuuauugaauuuauuuuuuuauuuuuauuuauauuuauuuaauuuauuuauuuugagacagaguuucgcucuuguugcccgggcuggagugcaauggcucaaucucagcucacuguaaccuccgccucccggguucaagcaauucugccucagccuccugaguagcugggauuaugggcacccaccaccaugcccagcuuauuguuuguauuuuuuuuuuuuuuuugagauggaguuucgcucugucacccaggcugaagugcaauggcgugaucucaguucacugcaaccuccaccuccuggauucaagcaauucuccugccucagccucucgaguagcugggauuacaggugcucaccaccacaccuggcuaauuuuuguauuuuuagaagagacgggguuuugccauguugcccaggcuggucucaaacucccggccucaagugauccgccccacccucagccucccaaagugcugggauuacaggcaugagccacugcgccugacaauuuuuuguaucuuuaguagaggcgagguuuugccauguuggccaggcuggucucgaaauccuggccucaggugauccgccugccucagcuucccaaagugcugggauuacagacgugagccaccacacccggccuagugaauuuaucagaucugggagcuuuuuggaugcaucuuuaggguuuucuagguauacaaucauaucagcaagcagcgacacuuugaccuccuuuuuaccaauguggaugcccuuucuuucuuucucuugucugauugcucuggcuaggacuuccaauacuguguugaauagaaguggggaaaguggguauccuugucuuguuccaguuuucaguggaaaugcuuucaacuuuuccucauucaguaucauguugccuguggguuugucauagaugccuuuuauuaccuuaagcuauguuccuucuaugcugauuuuguuggugguuuuaauccuaaagggauacuggauuuuuucaaaugcuuuuucugcaucuauugacaugaucauaucauuuuuguuuuuaacuaugauuaugugauguaucacauuuauuggcuugcauauguuaaaccaucccuguaucacuguuaugaacccacuugaucaugguguauuaucuuuucgauaugcuguuagauuugguuagcuaguauuuuguugaggauguuugcauuuguguucaucaggaauauuggucagugguuuucuuuuuucaauauauccuuucuugguuuugauauuagagugauauuggcuucauagaaugauuuagggacgauuuccucuuugucuaucuuuuguaauaguuucaguaagauugguaccaauucuucuuugaaugucugauagaauucagcugugaauccaucugguccuggacuuuuuuuguugguaguuuuuuuuuuaauuacuauuuuaaucucaguacuuguuauuggucuguucagaguuucuauuucuucccaaguuaaucuaggaggguuguauauuuucaggaauuuacccauauccucuagguuuucuacuuugugcgcauaaagguguucauaguagccuugaauaaucuuuuguauuucugugguaucgguuguaauaucuccaguuucauuucuaauugagcuuauuucgaucuucucucuucuuuucuugguuaaucuugcuaauggucuaucaauuuuguuuaucuuuucaaagaaccaguuguuucauugaucuauuguaaauuuuuuuguuucaauuuuauuuaguucuguucuaaucuuuauuuguuuucuucugcuaacuuuggguuuaguuuguccuuguuucucuagcuccuugaggugugacuuuagguugucaguuugugauuuuuucagacauuuuuaggcauuuaaugcuaugaaugucccuuuuagcagugcuuuuucuguaucccagagguuuugcuagguugugucacuauuaucguucaguugaaagaauuuuuaaauuuucaucuugauuucauuguugacccaaaggucauucaggagcagauuauuuaauuuccauguauuuguauaguuuugaggcuuccuuuuggaauuaauuuccaauuuccuuucuccuuuccuuucuucuuuccuuuccccuuuccccuuuccccuuuacccuuucuccuuuccuuguccuacucucuggcucagacuggagugcaguggcgccaucucaguucacugcaaccucuguguccuggguuaaagugauucuucugccucagccuccugaguagcuaagauuacaggcaccugccaccaugcuuggcuaauuuuucuauuuuuaguagagaugggguuuugccauguuggccaggcuagucucgaacucuucaccucaggugaucugccugccuuggccucccaaagugcugggauuacagccauaagccaccaugcccagccaauuuccaauuuuauuuuaccauguucugagagagugcuugauauaauuucgauuuccuuaaauuuacugacacuuuuuuggggccuaucauauggucugucuuggagaauguuccaugugcuaaugaaaagaacguauucuccgcaguuguuggguagaauguucuguaaauaucuguuaaguccauuuguucuaggguauaguuaaagucccuuguuucuuuguugacuuucugucuugucuagugcugucaguggaguauugaggucccccacuauuacuguguugccaucuaucucauuucuuaggucuaguaguaauuuuauaaauuugggagcuccaguguuaggugcauauaucuuuaggauugugauacuuuucuguuggaccgauccuuuuaucauuauauaauguccgucuuugucuuuuuaaacuguuguugcuuuaaagucuguguugucugauauaagaauagcuauuccugcuggcuucuaguuuccuuuugcauggaaacauaguuuccuuuugcauaucuuuuucuacugcuuuacuuuaagcuuaugugaggccuuauguguuaggugagucucuugaagacagcagauacuugguugguggguuuuuaugcauucugucauccuguaucuuucaaguggagcauuucagccauuuacauucaacauuaguauggagaugugaguuacuguuccauucaucaugcuaguuguugccugaacaccuuguuuuuuuuuuuuuuuucauuguguuauuguuuuguaggcccugugagauuuaugcuaugaggagguucuauuuugguguauuuugagguuuuuguuucaagauuuagaacuccuauuagcauuuauuguagugcuugcuugguaguggcgaauucacucagcaauugcuuguuugaaaaauacuuuaucuccccuucauuuauggauaaauauucagguuucucaggcuauggguggggccauugagcucccaagcauuuaugucuuuugucuucagcuacuugggcagguagagaaaaaccaucagguaggggcaggguuaggugggucugagcucagggcaggacuugcuguggccaguaugggggauggggugguucuuaagccaaugggauuauguuccaaggggaauuauggcugccucuguugugucauucaggucaccagggaaguaggggaaagccagcaaugacaggcuucaccuagcucccacacagccagcaaggccaaccucauuccuguugugccccacuaacagcaccaaguuuauauccaggcagccagccuauagggcugcacucucaccccagggcauaacuccacugagaaagcaagcagggcuuuccagccuugccccuucccaccugccggagaccgggagugccugcagggcucuuuccacugcuucuucuacuuuuauauuuugcuuagcucacuaaauccaguucggcucuagguaaagcuaaauccuucucccaugaucuggauuuucagguuccccagugaggauauguguuuggaggcagacuuuucccucucucacacuuuuggaacugcaguggccagcugcuucuuucaaagggucugugaauucuuucaguuuuccugguacgcuccugcagugagugguucuuggagcaaaaguucacggugugagucuccacacgcuguucugucuguccaagugggaguuccacauuaguccugucuccuauccgucagauuuuaacgcuuuugcucacuuuugcuuuacauuuguguggaauaucuuuuuucaccccuuuaccuuggguuuauuauuauuauuauuuuuugagauggagucuugcuuuguugcccaggcuggaguacaguggcgugauccuggcucauugcaacguccuucucccggguucaagugauucuccugccucagccucccaaguagcugggauuacaggugcccaccaacaugucuggcuaauguuuguauuuuuaguagagacaggguuuugccauguuggccaggcuggucucaaacucuugaccucaggugauccacccacuuuggccucucaaagugcugggauuacaggcgugagccacugcgcccagucucauguuaacuuuagagagccuguugaccgacuauaugccuuuaugaugaccuuuuugcaaugaauuuuccaggaguucuuugugcuucuuauauuuguauaucuaaaucucuagccaaaggccaggaaguuuuccucaauuauucccucagguaaguuuuccaaacuuuuuauugucucuucucccucaggaacaccaguuauuuuuaccuuugccuauuuuacauaaucucauauuucuuggagacuuuguucauuuuucaaauucuuuuuuuuuuccuuuugugauuggguuaguucaaaagccuuagcuucgagccugaaauucuuucuucuacuuguucuagucuauuguuaaaacuuucuacuacauuacauuuuguaauucuguaagagugucuuucuuucuuuuuuuuuuuuuugagacggagucucacucugucaccaggcuggagugcaguggcaugaucucagcucacugcaaccuccaccuccuggguucaagagauucuccugccucagccucacugguaccugggacuacaggcgcucaccaccaugcccagcuaauuuuuguauuuuuaguagagacuggguuucaucauauuggccaggauggucuugaucucuugaccuugugaucugcccgccuuggccucccgaagugcugggauuacaggcaugagccaccgcgcccagccagugugucuuucauuuccagaaguucugauugauuuuucuuucuuuuuuuuuuaaaauagagauggggggccgggcacaguggcucacgccuguaaucugagcauuuugggaggccgaggcggguggaucacaaggucaggaguucaagaccagccugaccaacauggugaaaccccgucucuacuaaaaauacaaaaauaagcccggcaucguggcaugugccuguaaucccagcuacucaggaggcugaggcaggagaaucacuugaacucaggaggcggagguugcaaugagccaagaucaugccauuguacuccaaccugggcgacagagcgagacuccaucucaaaauaaaaagaaaaaauaauaauaauaaaauaaaauaaaauaaaauagagaugagguuuucucauguuguccaggugggucuuaaacuccugaggucaggugaaccgggagccugccuugaccucccaaaguucugggauuacauguguaagccacugcaccuggccuagguuuucuuucuuuuuuuuuuugagacggagucuugcacugucgcccaggcuggggugcaauggcaugaucucagcucacugcaaccuccaccuccuggguucaagcaauucucuugccucagccuccugagcagcuggaauuacaagugccugccaccacacccggcuaauuuuuuguauuuuuaguagagacggguuuucacuauguuggccaggcuggucucgaacuccugacuucacgaucugcccaccuuggccucccagagugcugggauuacaggugugagccaccccaucuggccucggguuuucuuuaagaugucuaucucuuagaaaauuuuucauucauauccuggauuuuuuuuaaaaaauuucuucauguugguuuucacauuucucuggaaucuccuugaguggcuuaauaauuaaccuuuuggauucuuuaucugauauuucgaauauuucaucuugguuuggauccauugcuggagggcuaguguaaucuuuuguggauguugcugagcucuguuuuaucauauuaccagaauuauuuuucugguuccuugucauuuggguaaacuaucuuuccuaauuauucuugaauuuauuuuuuauuugacuuuuuauaaaauuucuuuuucccuuccuuaaggaugugacuuuaauguuuauaguuuauuauagccuaauuuggcuuuugguauuuucaggggugaugacucuauaugaguucugucauuauagagagucuuugaugacugucucagaugcugguuguaguagcaaugugcucagugugugagcaaauucauugucuccuauaggguuggaauggcaguggucucuugaagcuuaucuuauuccuuugugguguggacuuacuuauuuauuuuuuccccaguauuuuauuuacuagggugacuauuuuaagcuucaggccaguaggggagguguccuuggguagaaacccauugugcucaagcaguuggguaaaugcaauagccaaugaugggcagaagucacagccuugucagagguggcuggggaagcuuucaguggaaugcacugaggucuuacgggggaaaggugggagccaucucagcuccccugccaggucagcagggaagcuaucuaucuccuagacccacuucugacccaguagucuggcuauuuaucagaugggcgcuucuucaucugcaggaauguugauguucugaguagagaggaguugugacucuaccucuuaugcaagccugaaccuggcagauacuccuccuguggggaugcagucaccaugaagaguuccagaaaggcugucuauaggugcacacauacugagcuccugugggggaagcccuaacugucugcaguguugaacgagggggaauagaaguccccuucuccaagacccuucaugagcaccagggccaccugacuguugggguagagcugcagacuuuccccacugagcccagcacugcaacuaugccucugcugaaagaaauuuaccacuaguggaaagaucugggacucaaagccugcugucgcaaugauuuugucccacgggauguuccuuugauauggugcacuuccccuuccccuaggaguaggagucccugagagccagauuacugugaaugcuguugcuccugugggucuagcugcccaguggggcugccacacuccaggcuggugcugcagaaugucugcaaagaauccagugaugugaccuguccucaagucuuucagcaguggguaccagcaccaagucugaugaggguggccggggagugacgcagacuccgagauuccuuagauauagauagccuuaguauguuggcuuucucaaaugcugauuguaauaguaaugaaccugucaugugggcagauucaggaccuccugguuaggcagagugguacaggcaguggugaugcacaaguuuuuuccuuccuggccacaaugucaauguuauucuaccuggagaugcuuuaauggacuguguugauuggccucuagccaggaagugacgcuugcaagagagcaccaccugugguaguaguggugggauuuuuacuugccuuguguuacccaggggagguacucugauuuuucaggugauggguggggccgaaaagcucccagaaguuuuugucuuuuguguuaagcuaccaggguggguggaggggcaaagccaggugggggcucagucagguaggucugugcucugauucccugcaugcaaggaaagcagcggccucugugggagucaggaggugguucucuggccucugggguaauguuccagagaggaacauagcugccucugcugcacagaagaguucaugcagggaguggggaguaguaugcggcaguaagccccacccaguucccaugcacuuggcaaggcagaucugacacccaccguauucugcuagcagcaaugagcuaaguucaggcuguguaugcucagaacucaaaacugccccaggguauaagccuuaccuggagauagcaacugccccucccagucugcuggcaaagccagggcacccagcuccugcacucauggcugcagcacacuucccacucgucgccuaguucuggccaaggggguuuguccccacuugagguuacauugugaaauucaguugagggcuucuuucaaccugcagccacugccugaguuagcuggcugacuuccacgagguccccugugagguagaauggcuucccucagucugcauuggagaaugcaugcaaggcucuucccacugcugcuccuaccuuucuauuccucaccacucccuaaaucagcuccugugcugggugggguuaaggcccuucucuguggccuggauuuccagguucccugguggggauguauaucuuggaggcagucuuuccccuucucacacucaggagacuuacaguuuuuugccugguucacgguguaggcugcagccugacacuucuuucaaagggucuguggauuuuuucagguuuccuaaguuccugcguugcuucuuggaaaaaaguucccagagugagucucuacacacuauuuugucuuuccuagugggagaggcaugcuaacacugccuccaaucugccaucuugggaaaaaaaacuucccugcauuuuauauauauauauauaguuuuuuguuuuuuuggacauggagucuugcucuguugcccaggcuggaguacaguggcacgacuccggcucccagguucaggugauucaugccuggcuaauuuuuuuauuuuuaguagagaugagguuucgccauguuagccaggcuggucucagacuccugaccucaagugaucugcccaccuuggccucccaaagugcugggauuacaggcaugagccaccaugcccggccuucccuguguauuuuauuuaaaagaaccuuuccccguuguggguguuuguuugaaguguaucgaaguaugugaccagaacuuacacuggagaacauuucaaagaggagaguguaugugagauuugaccccucccugcaaaaaauauguacauaauuuauuuucaagcagcuuugaauagacaguaaauaucaaagcuuagaaauucaaggaaagcuuacuuucagauuaauguuguccuuaggugcacugcaaaacacaaaauuaucgaaaguuaugguguuacuuauucuucauuauuauaauuuagugauuucuagauucuuuuucuagucauuguuuaacauuuacauaaaagccacacauguaauaauauagcucuuuuaaaaaauuaaaguuaucacucuuaguggaaauaccauuuuuaggauuuauugauuaaaauuaguaaaugcuuaguauaaaagaaaucauuuacuucauuguggaagcucaucccccucuguguuuucucauaacacguacccaguuuucuuagcagagugggaaggaaguggcauuuuuguuuaauggaaacaauacaguaacuauuuccuggacuguauuugggucagaucauuuagcugcuuuccuuauuacuacuguuaaaauuccugugaggucuucaggaacuacaaauggauaauuugucugagccuugacuucacuguguuuaucuucucuagaagcauagugaucuaaaauacauugaaucauugguacugguaauuuagccauuaauaauuaaaacccuuggcuguaauuuguuaaaguuaguaccauuucuugugucugggguggggugucugaccacugauaaugcccaauguccugaaaaguggaacuuucaacauguguuagguaaguuccaucagaaagcugaccuccuccucucccuucagauccucagccagugccaucugggagguagagaaagguaugaauucuagggggcuuuaccugauagcuuguuuaguaaaagcagaaaaugcaaacuauauauuuuauuuuuaauuaauuaauuuuaaauguagauaugaggucucacccauguuucccaggcuggucuugaaugccugggcucaagcaauccuccugccuuggccucccaaagugcugggauuacaggcacgagccaccgcaccuggccgaaacuauguauuuuagaaguguaaguuauaaagauauggguuagguauaaaaccaaauagcccaaguuugcacugacauaaaacuaagguuuacuauggccacauaggauaaaauuacacuuuauuaugcuuaauuaaucaaaugucaauuucagauuauuuuucaaaccuaugauuauuuccuugagaaaucuaauuuuuuugaauauuuuuguaggugcuugauaauggcaguuuugaaaauaauauuuucucaauauggaauaaauuucauuuaaccaacguguuugaaaaccaguucauguacuguuacuuucauuuacucaucuaaaauuuguugagucucuacuuuguuagguccugugcuagaugauuuuauuaauauucauauggaaagauaagagauacacccuaucauguagugauggaaaucugccauagcaaauuuagaauaaaguagggauuuuaucugauguuugcacccagaagaugaauaguuaaggaguucuuuuagcgucuguguauucaugauauaaugaaaauaacugccagcacucauuucugcugauuaaugcucaaauucucaauuuccucuucuuuccaauaaggcacacuuccuaaggagcaucuuuucugacuuucgugacuagguuagguuuccuacauaugcacucuguauuuuuccuuaauagccucaccauaacuguaauuuaaaaauuguccauuuugucuccucuucaguuccuuuuaggcuguaaaguccccaaggcucucagugccucaaauaugcuuggcacucaaauguuuucuaaugguagauuuuuagacuuuuuuuucccauugcuaucugcuggguauuuuccaucaugcuucugccucauucccaugucccagggcaaggcuucaugggacguaaugggcagaauucugugcagugacgacuuagaagccaauucaugaugauugcauauggagcauccugaagguaaaggccauacauacgccaauuaugauacucccuuuugcaggggaaagcccacuuguccuuaacuugaucuuagucaccugccauauuuuugguuaaaaucuuuacaguauaguuuuagcuugagccucagguccuccaaaauaaauuauuuacaggaaaaauaguuuuagccuuuggggugaauagcuuugaauggucuauuuaggaguuuuaacuuugaagccaucuaaaauuucgaaguaggagaguuaacaauuuaucagacuuuuuaucuuaggaagauauucugaugucaauacauagaguauauuagaagagauaggagauggauuaucacuuagccaacauuuguugaaaaucuacauguguuuggcuugugcaagacaauggaaauguauagauggaagacacagucccugcaucuuacaaucaguuagggggagacaauuauacuaugucauaacuuuauuuaauuagcaguguguuaaggguaauucaguauggaugggaacauagaagagacacuucagaagaagaguuucagggaaggccucuuagaagaagugauaaaugaguucuuucuaaaaaguaaguaggcauuuaucaggcaaagaagauaggaaauauguuucuguaccuuucuaggcagagagaagagcaccuguguauauacuaguuaaggguuuauuuuaauuauuaaggugagaauuaaugaaugauauuuaagaagcagaguauguagcacuuggugagugaacacugguuauaagguuuucuuuucuuuuuuuuugagacagaguuucgcugugucgcccaggcuggaaugcaguggcacaaucuuggcucacugcaaccucugccuccuagguucaagagauucuccugccucagccucuuggguagcugggacuacaggcacaagccaccaugccugguaauuuuuguauuuuuaguagagaugggguuucgccauguuggccagccuggucucuaacuccugaccucaggugauccaccugccucagccucccaaagugcugggauuacaggugugagccacugugccuggcugaugauaagguuuucagccugccuugaugauugggaaauguuggcaucauugcagguauaguaaacacacuaggagguaaaguugggcaagugauacucaguuuuggaucuguggauuuugaguuacagugggauauucucuugguuguauuguaugaugcaucuugggaaauugaugucaguuuaggagugacauuagggcuagagauugagauuugggauucuccauagaaggagcagcuaaagcucagguccauggguaagauguuaagaaaaacuguggaauggagaaggacaagaaaacuagggacagaauuuggagaauaagucgauacuuuuuucuuuuaagccagaaucuaaauaaggaauuuuagguuaguuucacccacgucccccaccccuuauuccccaccccccaccccaccauucuauuucaaggagagaaaaggauaaauaagaaggacauaaacauuuguuaguaguugauuaucgaaaucccaagggacugaaagacugccuagggucuuauagcaaugcaaaaucaacaacaacaacaaaaauaaauaaagaagacuacauagagucaaaugcaaauuucauuuuguuuaacugucaagguaggaagguuuuugacaaggaggguugcaagcaaaaguuuacuuaaugaaucaguaaaugaguuagaauaccccucagaauuccagguaauuaagauuuuacuuuguaaacucuuuguuuuaguuuguaucuguuucauuuuucauauuuaaauuguguauauucagagugcccuugauuuauaagaaguauauccaauuuucucaugggauauguuaauaaaagauuaaggcugggcaugguggcucaugccuguauucucggcacuuugggaggcugaggcagguggaucaccugaggucaggaauuugagacuagccuggccaaggugaaaccccaucuccacuaaaaaaaaaaaaaauacaaaaaaugagcuagacaugguggcaugugucugugaucccagcuacucgggaggcugaggcaggagaaucacuucaacccgggaaguggagguugcagugagcugagaucacgccacuguacuccagccuggcaacagagugagacucugucuccaaaaaaaaaaaaaaaaaagauuaaauacuuauacuaaaaaagaauagguaugcucucauagucaaggagaugugaauuucuuauuuaucgcaaagcuuacuugguuucagauaucucucuuagaccaaguacaugcagaauuuaaaagucagagagaaaaugaaaccagauuguugaaaaaugggaaaggaaauaacuuucauauagccauuuuauuauuauagaaacuacuaaguggguguuucauggacuuuggcaaggaaaugcuguggcauuuuccaacucagccucacucucuaaguaucucugaugucaaagcuaaccggagugguuagcauugaaauuuucacuuaaguacaacaaugacaacagccacuguuuaucaagaacaaugccaggcauucuaccuggauuauccgauuuacucuucauaacauucuugcaaauaguggugguuaaaaaugauaauaaaagcuauaauuugucaaaugcuuaauucguuccaagcaucgugcuauguacuuuuuuuuuuuuuuuuuuuuuuuggagacagucuugcucuguugcccaggcuggagugcaguggcaccaucuugacucacugcaaccuccgccuccuggguucaagugauucuccugccucagccucccgaguagcugggacuacaggcgcccaccaccaugccuggcuaauuuuuguauuuuuaguagagauuggguuucaccauauuggccaggcuggucucgaacuccugaccucaggugauccaccugccuuggccucccagagugccaggauuagaggugugagccaccgugccuggcccacugugcuguguauuuaaucuauuuauauuaauuuauucuuuguggaaacuguuuauguuuguaaguagacaucuuauucuucuaugagauucagaagaguuaagcaacuugccuuaugucuuaacugcugcuaguaagacaggauucaaacucagccucugauucuaaaaccuauauuuuuugcauuuuacuuacugccucacugucauuucaacuggguggcaaaggggaacauugaccucccuggagcuuaugacugguaaccaggaagugucacugaaguaaaaugaagcagaagauuuagggccaccuugaaccagagcuguguuagucuguacagaccccuuuucagaguaugagugccaccugcuggaagguuaugaugaaucucauguguuuauaaagagcagcuuccaaaaggccugucguaggugugaaagugucaacuuucaaauacuaauucuuaauuuacaguuuuaggaguauuggaacauuuuggaauuaggcaaaucuccuauuugccauaaaacacccuacuucauuuaccuucaguucuuugggaaggggaaagagguguuaagacauuuuaaaaaaugauacucagugcuuucuaaaauaaagucggugauacuguucucacugaggggaaagauugauggucaaaugaaucacacuguuacuuaaaagagaucaaaaaagaauagaaaauuggauuuacuuugagauaagugaguaauugaaguauaagaggaucuuuccauucagaaugcccuugaaaaaggagucagggacccaugagggcaucauagacuuggagaacagaaagugaaaagggaagaaagauguauacauaaaaauacgaauggauucuggaauuuuuagucuaguacagacucucuaaauugagucaggaucuagagaaaguuuagaauucuaacuguagauuauuuuacauuuaggacagugaaaaguggacacuuuaaaaauagcuacuuacaugcuuugaaaggagcucagauaaaauauuggcauguucauugaacauucuucauuaggcuccagugggaucauguuacuaugcugugaguaucuggcauggaagauguuaucauauaauaugagacacaggaaaauaauggucuacuuaauugcuguuuaaguaugauuacacguauuuguaguuguaugaugucauguugaacaaacauuuguuagacaagagauuaaaguccguugguaaaaucugauuuugccaagagauggggaaaguacaaguauggccaucuccuuucacugugucccuucucagauaaccauguaaaaagaagcugagauaguaugauagugucuuauuuugguagguggauuucuggaaaguucugucuucugguguguguauguauuuguuuuuaaauuauaagaguaaugcucauugaagaaaacuuguaaaauagaaaaaauagaaauauaaauuaugcauaaucucacacccagaaauaacuauuguuaauguuuuggcauauuucuguuuguuuuuuguuuuuuugagacagagucucacucuggugcccaggcugaagugcaguggugcgaucuuggcucacugcaaccucugucucccggguucaagcgauuguccugccuuagucucucgaguagcugggacuacaggcaugcgguaccacgcucggcugauuuuuguauuuuuaguagagacgggguuucaucguguuggccaggccagucgugaacuccugaucucaagacaucaagugaucugccugcuucggccucccagacugcuggcauuacaggugugagccaccacgcccagcccauuuucuguuauuuauaucucuuuauauuuuauuuuauuuuauuuauuuauuuauuuugagacagagucucacucuguugcccaggcuggagugcagugggacgaucucugcucacugcaacuucugcuucccagguucaagugauucuccugccucagccuccugaguagcugggauuacaggcauauaccaccacacguggcuaauuuuuguauuuuuaguagggacgggguuuugccauguuguccaggcuggccucgaacuccuggcuucaagugaucuguccaccucggccucccaaagugcugggauaacaggugugagccacugcacccagccugugguccuuuuacauuauaucacaacguuauagucuuuccucgaguaauuaaaauauuuuaguauauauauuugaggcuacaauauguggcuauuuaccauaauuuacuuaucaguuuucuuauuauugaacauuuagguuguuuacuguuguuguucauuuguuucuuucaguaaacaacaguaggaaaguuaacuucuuuguuuuuuucaguaaacagagguagugaauacacucuugugugauguuuaucuagagccuagcauuuucuuaguaaacuggccuuggacauaacuacuaauaagguuaauaucugcuucacuuguguuccccuguguccccuguuccuuuguguuauuuucuuuaggauuuuguagcacuuauugugcucacagcccuuucaggaaauacccucauagcacuccuuugcucuucgaauuauacaccagguuaaagaucccauccugagauauucagagcuguguugcugcucuuuaccucaagccagcacucuuauucuucugguagaguaggugcuaauuuaaagaagucuuccuuuuuaagccuaaaguaaauggagcuuguggaggcuuagcgucccuggaauaauuauuuuagauauugucuauucaauuuguugaaaacaaaaucauuuaaaacaccuuuugaaaaagaauaacuuaugaaaggguagcaaaguuuuauuagguuacaggccauuacugguuauuuugugaguaagaaccgguugaguagauuuaauuuauuugacaaauauuuauugaaugcuuauuaugugcuagguaccauuuuaugcauuggagauauaaagucaacaaauaccuuugccuucauggagcuuauauguuaguggagagagacagacaauaaauaacauauaaacaguuucauguccauuuaauagcuucaugucagacaauaaacagcuucuugucaguuuaagugacauauuucuguacaaugaguauuaaaugauuguuuucaaaaaagguaaaauuaugacuguuauacagguauaagaugaacacauuuuaaugauuuuauuuaacuuucuuuuuuuaaaaaaauuuuuuauguuuuuagagacaguuuugcucuuguugcucaggcuggagugcaauggugugaucuuggcucacugcaaccuccgccucccagguucaagggauucuccugccucggccuccugaguagcuaggauuauaggcacccaccaccacgccuggcuaauuuuuguauuuuaguagagaugguguuucaccauguuggccagucuggucucaaacuccugaccucaggugaucugcccucuuuggccuccccaagugcugggauuacaggcaugagccacuguaccuggacuuuuuuuuuuuuuuagagacagggucucacucugucacccaggcuggagggcagugguacgaucauaacucacugcagccuugaacucgugggcucaagcaguccucguaccucagccucccuaguagcugggacuacaggccugcaccaccaugccuggauaauuuaauuuaauuuauuuuuuuguagagauagggcucuugcugugugaccagacuagucucaaacuccuggccuugagugguccuccugccuuggccucccaaagugcuggaauuacaagugugagccacuacauccagcuuauuuaacuuuuugaaugaaggaaccaagcugguauuauagcccauucaaaggagaaacuuuaaaacagguacguguacagaucaggaauauugaaauggauaugcaaauugaggcaaaaccagcuucuuccacuauuggggagggaagucagugaaccucuaccggacagcacauaauuuguaugcuuauaguugagaauuauucugcaucguuaucaguuauguguaauguacagaguuguaaaauagcuucucuagaaucagaaucagguaacugaaaggaugugccccuaacaaugcauuuuuuucuauugaauuacaaauaauuuuucuaccugaguuacuagaaagcuuuugauuuucuacaguuucuuuagaauuguagauaagggauauagaguuaugguauguuugaaaguguuaguacuugcagaaagauaaagugcagaauggugguugcgauuuuaaauagaaaggcuagggaagacucacugaggaggagauauuugggaaaagaguuaaaguagaugagguuuuugccugaauaacugcaaugauggaguugcuauuaacugaggcgagggaagagcagugggaauagagguacuggagguacuggaauagaggguaguggagguagagagcgcaaccucaguuuuggcuuuuagacauucaaauggagcucuugaggcagcuggauacacauagcugguguucaggggagauggguggacuagagguaaacauuugggaguuaaugcauaugggugacauuuaaagcccgcagacuagaugagaucacuuaaagagcucuuucaaugugucaggcauugugcuagucccuaggaauauagaaauaaauuuuaaaaugucuuucugggcuagugugguggcucacaccuggaauccuaacauguugggaggccgaggcaggaggaucacuugaagccagaagcucaagacuagccuggacaacaaagugauaccccauuucuacaaaaaaauaaaaaaaucagcugggcaugguggcucacagcuguagucucagcuacugaagcuaaggcaggaggauggcuugagcccaggaguuugaggcugcagugagcuaugaucgugccacuguacuccagccuaggagacaaagugagaucuugucucaaaauaaauaaguuaguaaguaaaaauuguauuugucuucaagaaccuuauggucuaaugcaggaggagggcaggggagagaugcaaacaguuaaaacauugaaagauacucuaauauaauucagugaggccaaaucugagagucauaaaacauguacagaagguaaucaaagggugguaccuuuucuaacagcuggcuucuccacugacccauuuacccuaccauguugccagugauacuagagaaccucaauggugacacuucuucuucuucuuccuuuuuuuuuuuuuuuuuuuauguugagauggggucucucucugcuucccaggcuggagugcaguggcgcgaucucggcucacugcaagcuccgccucccagguucaugccauucuccugccucagccucuggaguagcugggacuacaggugcccaccaccacgcccagcuaauuuuuuuuuguauuuuuaauagagacgggguuucaccauguuagccagaauggucucgaucuccugaccucgugauccacccgccuuggccucccaaagugcugggauuacaggcaugagccaccgcgcccugccaauggugacacuucugcauggcuuacaaggcuccuuuuauauggucuuugccucaucucuugcuuugauuccuuagaccuguucauagugacagaugaucaguuaaggauuuuugaaauaucacuccuggcugcagagugaaaggugaauuagaagaaguaacaaaauagauauagguaacauuaguuugcuauuucuuugccucagucggccuucauguugauauuuagugacuuauagaaacccauaggguagaaaaagcauaagagguacacagaaauagaaagugcauauugacgcucuagaaaaugcaaauuuggggauuagggaagaauuucuaguaaaugcauguaguuauaaacuuuacacucuucccucuuacacaggcagacuuuagagauauugcaaguuugguuccagaccacugcaguaaagcaaauauuguaauaaagcaagucacucaaaguuuuugguuucccagugaagucauauuuauuauacuauaguuuacaguauaaauauacacugcuauaaguguccaguagcauuauguauaaaaauguauauaucuuaauuaaaaaauacauuauugcuaaaaggugcuaaugauuaucuaagccuucagugagucauaaucuuuuugcugguggauggucuugccucaguauugauggcugcuaacugauuagaguggugguuacugaaggcugggguggcaauuucuuaaaguaagacaauaauacaguuugcugcaucaaugaacucuuccuuucuugaaagauuucucuguaacaugcaaugcuauuugauagcauuuuacccauauuagaacuucuuucaaaauuugagucaguccucucaaacccugccacuacuuuaccaacuaaguuuauguaauauuccaaauuauuuguuguuacuucagugguguuuacagcaucuucaccaggaguagauuccaucuuaggaaaucacuuucuuugcccauccauaagaagcaacuccuuauccaaaccuguuugaucaugagauggcagaaauucaguuaauccucaagcucuacuucuaauuguuguucucuuguuauugcuaccacaucucauuuacuuccuccacugauaccuugaacuccucaaaauuauccaugaggguuggaaucaacuuuuuccacauuccuguuaauguugaugccuugaccuccuugaaggaaucaugaauguuuuuaauggcaucuagaauggugaauccucucuacaagguuuucaauuuacuuugcccagauccauccgagaaaucacaaucuauggcagcuauagcuucaugaaauguauuuguuaaagaauaagacuuggaagucaaaaugacuucuugauucacgggcugcagaauggauguuguguuagcaaacaggaaagcagcauuaaucuccuuguacaucucaaucagagcuuuugggugaccaggugcauuguuaaugagcaguaaucuuuugaaaggaaucuuuuuucuagguagucaguccgaauagugggcuuaaaauguucgguaagccaugcugucaacagaugcacugucaucuaggcuuuguuguuacauuuauggagcacagguagaguagauuuagcauaauucuuuuuuuuuuuuuuuuuuuuuugagauggagucucauucuuguugcccaggcuggagugcaauggcacgaucuuggcucaccacaacuuccgccucccagguucaagugauucuccugccucagccuccugaguagcugggauuacaggcaugcgccaccacacccggcuaguuuuguauuuuucguagaggcaggauuucuccauguuggucaggcuggucucgaacucccgaccucaggugauucaccugccucggccucucaaagugcugggauuacaggcgugagccacuguacccggccauuuagcauaauucuuaaggguccuaggauuuucagaaugguaaaugagcauuggcuucaacuucaaaucaccaguugcguuaaacccuaguaagauagucagccuguccuuugaagcuuugaaaccaggcguugacuucucucuagcuaugaaaguccuacacggaaucuguuuccaauagaauucucuuuugucuacauugaacaucuguuguuuaguguagccaucuucaucaaugaucuuagcuagaucuuuuggauaacuugcuguaucaccuugcacuuuuauguuauagaggugacuucucuccuuaagccucaugaaccaaccucuguuagcuucagccuuuucuucugcagcuuccccaccucucucagccuucacacauugaagagaauuagggccuuguucuggauuaggcuuugucuuuuuuuuuuuuuuuugagacagagucucgcugugucgcccgggcuggaguacauuggcauaaucucagcucacugcaaccucugccuccuggguucaagugauucuccugccucagccucucgaguagcuagcauuacagguaccugccacuacgcccagcuaauuuuuucuauuuuuaguagagacgggguuucaccauguuggucgggcuggucuugaacuccugaccucgugauccaccuacuuuggccucccaaagugcugggauuauaggcgugagccaccucgcccagccagcuuugucuuaagguaauguugcagcuaguuuaaucuucuauccagaucacuaaaacuuucucccuauccacaauaaggcuguuuugcuuucuuaucuuuguguguucaacagaguagaacuuuuaauuuccuucaagaacuuuuucuuugcauucacaacuuggcuaacuggugcaagaggccuagcuuucagccuguuugaacuuucagugugccuuccucaguaagcucaaucauucuagcuuuugauuuaaagcaagagauaugugagauucuuccuuucacuugaacaguuggaggccauuguaguuuuauuaguuggccugauuucaauauuacuguuucucagacaauagagaggcccgaagagagggagaaagaugggggaacagcuggugggugaggcaaucagaauacacacaacauuuauagauuaaguuugccaucuuaugugggugcaauuugugaugcuucaaaacaauuacaauaguaacaugaaagaucacugaucacuguaacagauauaauacugaaaaaguuuuaaauguuguaagaauuaccaaaaugugacacagagacauuaagugagcuucaugcuguuggaaaaauggugccaguagacuugguugaugcaggguugccacaaaccuucuacuugggaaaaacacaguaucugugaagcaacgaaguaacuaucuguaugacauauggaaaggagaccuaggccaggcacagugguuuacaccuuguaaucccagcacuuugggaggcugaagugggaggauugcuuaaggccaggaguucgagaccacauuaaaagaggugaucuagaaauaccaugcuacuguaaaaaagaacaagaaauauuauuuuuauuuuuuucuuuaaaaaaauuuuucuuuuauaccaaaucacuucucaccugaaggaaguauuucuaauauugauauuguccuaauauuaauggcaaacuuaaucuauaaauguuguguguauucugauugccucacccaccagcuguuccaccagccuggacaacguagugagacucuaucucuacaaaaaaaguuuuuuuuuuuuuacaaaaaugaccuauauggugguuccucaaaaaauuaaacauagaguuaccauaggaucuagcaauuucacuucuggguauauauacaaaggaauugaaaguggggauucaaauaguuauuuauacaccaauauauagagaacauuauucauaauaaccaaaagguagaacacccuaaaugucuguugaggggcaaauggacaaacgaaauauggucuauacauacgauguaauaguauucagcuuuaaauaggaaugaaauucucauacaugcuacaacacaaaugaaccuugaagacauuauauugugugaaaaaaaggcagacacaagugggcagacacuguaugguuccacuuauaugagcuacauaccaagaacagucaaauucauagagacauaaauuagauaaugguuaucaggagcuggggguagggggcaaccuggagauauuauuuaaugguauagauuuucauuuugggaugaaaaaguucuggaaauacacagugaugaugguuguacuuaaucccauugaacuaguauaaguagugggauuaaguaaauauacuaaguauaucuaguauacuuaaaaaugguugaaaugguaaauuuuacauuauguauauauuuuaccacauuaaaagaggugaucuagaaauaccaugcuacuguaaaaaagaacaagaaauauuauuuuuauuuuuuucuuuaaaaaaauuuuucuuuuaugccaaaucacuucucaccugaaggaaguauuucuaauauugauauuguccuaauauuaagagauuuccaagauagaguaaggguaagaaaacaaacaaagugcagaacaguguguauauuaugcuaucuuuuguguaaacaauggaggauaaaauauauauucauauuuguuuuuauuugcauuaagaaacauugcaaggaaaauaagcaauuaauaaaaguuguuaccuccagggaagcaagaggagugguagugagacauuucaauauauaaccuuguauauacuuugauuuuugaaccauaugaauguauuaucuagucaaaacaaauuuuuuaacacaggacuuaaaaugaauuuauucuagugggaucaacaauuggaagucacagaaaauguaguuuuuuagaaguguugauuaaauauugcuacugugacaaccacuuucccagacaagugagguccaggaaucagggaucugugccaguguuggguguuucaagagccugguuuagaugcggaaguggaguucuacuuucccaucuacuucaggcugcaaagagaacauauuuugcauagguaauaaaggcaaacucucuacguucaucaauaucaaggagucagaaagaaggagacagucauugugccuggggugaagucucuugccacaguguaagugcuucaaggcuggccauagcaauggggucauuaaaaacaggguuugccagagccagagauccugaaguguucaaaauggcaaacucucuagauuuugggaggccaaggugggcagaucacuugaggucagcaguuugagaccagccuggccaacaugguaaaacccuaucucuacuaaaaauacaaaaauuagccgggcaugguggugcguaccuguaaucccagcuacucaggagguugaggcaggagaauugcuugaaccuuggaggcggagguugcagugagcugagauugugccauugcauuccagccugggcaacagagcaagacacugucuaaaaaaaaaaaguuacuaaaguuauuagaauggguaagcaguuuauuuuucucugccucauugaucuauuuauaugucugucuuccuuaccacauugugggaauugaagacaugaacuuuagcuguaguggaaaaagcauggacuuugcaaucaggcagaucuauuuaaguccaaaccccuucucuuucuagcuauuugacuuuggucauguuauuuuuaucacacugagccuuggguucugugugcaucauaaaauuguucuaaagauuaagugagagaaaaacauuuguauauaaucaucuugcacauauaaaauauucaagggaaguuuugucuuucccuuuuugcaucuuucacagagcuuuacauuuaaaagguauucaaaauauuuauuaaauugaauauguuucucuuuaccugugaaaucugaacccuguuuaaggacagccugagggaggcauauuucuaaggcuuuuaccuugagcaauaaugucauuguugcuaaauauuuuaucaaacagcugucuguuaugcgcaaagugcuguuucugcuugcugcucuggucuaucuuuccuacauaucgucagaguccagcuuaaagcuuuuacuuugugaaguccuauuucuuuuuuucuguuuacaggaccuguucucaacuucaguuuuuauaagugggcaugacagucauucccuuauacucacuacucuucaaaaaaaaacccucaaccacauacucuagggauggauaaguacagggauuguuaaauaucuuuccuuguuuugucgccuguuucuugagcaccaauacagugcuaggguagauauaagcaguauuaauacaugaguccugccucccaaggaacaguuucuuuaguaaaaaagauaugcauguacaaaaauguaauuaauuauuuaaugauaugauauuacuuuuguuugcuguuuuacauuuuaccauuuaaaauccuauuuuuaaaaacacauuccugcuugcagucucugacaagaaagaaaguaaaacaaaacaaaacagauauaccuaagcacauagaaaaaggauuggaaagauaugcaccaagauauugacagagcuuaucucugaaugccaguauuuugggugguauuuuuuucuuucauuuugcuuaccuggauucucuagauuuucagaaauuucguuuugaaguuauaagacauucaucauuucccccuccuugcuaacacaacagugaccccucucuuucuuuugcauucagcuuuugcgagaauugaagcacccuaaugugauugcauugcagaagguguuccuuucucacagugacaggaagguauggcugcuguuugauuaugcagagcaugacuuguggguaaguauaaucucacuguauuucuaggauuguuuuauauagguauggagcauauuuauauaaaauacauauuguuaaugcacagaaaggaaagcuugcucuguuagccauauuucaaagucaauauaaacauaaauguugauuuugaagaauuuaagcaauaaacucacauuuuacugagaagauaguauuuguaauauuuagaaauuuuacuucagaaagauuuuaaugaaugggagacuauacuuuuuuuggcccgggggagacgaacggggaagggaguuuugcucuuguugcccaggcuggagugcaguggcacgaucuuggcucacugcaaccucugccucccagguucaagcgauucuccugccucagccucuuuaguagcugggauuauaggcaugcaccaccaugccuggcuaauuuuguauuuuuaguagagacgggguuucuccauguuggucaggcuggucucgaacucccaaccucagguaaucugcucaccucggccucccaaagugcuggaauuacaggcgugagccaccaugccuggcgggagacuauacuuuuaugcaaguaauuaauggcaguuuacuaauauguauagugaagauugcuuuaaggauguuuuuaucaacguaugaaagaagcaaaaaauucuaauuccugucuuuucaaauuaggaaucagaacauuuaaacacuuuaucugaggaacugcuaaaaguaacaaacuucaaaucuggcacuaaguuaaaauuauggauaauuaauuuagcaccacuaugccuggcuaauuuuucaaaaauguuuuauagagacaaggucuugccaccuugcacaagcuggucuugaacuccugggcucaagugauuuuccuacuuuggccucucaaacuguugagauuauaggcaugagccaucacacccagccuuuuuuguuuguuuguuuguuugagacagggucucgcucuaucacccaggcuggagugcaauggcacaguuaugguucacugcaccuuugaccuccugggcucaagcgauccuccugccucagccuuccaaguagcugggaccacaggugcaugaccacaccugacuaauaaauuuugauuuaauauaaugugguuugucaucuauauaaguuauaaaucuguugaggaauaacuuuaacagacucaggucuuaaagaaacuuucagaguguaugcuauuauagcagauauggacaagaauuuccaguguguuuuuuuuguucaauucuuuucauggauauucacagacauuguauuuucuccauuuuucuauauuccccuauaugucaaccaaggcuuacuggacaguguauguacuuuacuuugaacaucaguggggugaugaaagaagaugauguuguacauuggaauagucagauccuguagaacuguacuguccaauaccauauuucaaaauaaauauaaucauaaauguugauuuuaaagaacuuaagcaauaaacugacauuuuacugagaagauaguauuuguaauauuuagaaaauucacuucagaaguaucugaagugcacacauugauuuuaccuguuucuuuuuuuuuuuuuuugaaacggaguuucacuuuuguuguccaggcuggagugcagugaugcaaucucagcucacugcaaccuccgccuucuggguucaagugauucuccugccucagccuccuguguagcugggauuacaggcauacaccacuacgcccagcuaauuuuguauuuuuaguagagacgggguuucaccguguuggucaggcuggccuugaacuccucaccucaggugauccaccugccucggccucccaaagugcugggauuacaggugugagccaccacacccagccucuuuuuuaauguagcuguuaaaaaguggaaaguuauacauguggcucccaguauauuucuacuggaaaucacugcuguaguauaaacucuauuuuucuauuauuucuuaaaaucaaaucaauguuauuacugaacaguuuauaaaaauaaaaaagcuguauaaauagcuuaauaauuuuacauaccauuuggucaucuuaaaguuacuggagcgcuauugacaauuucaucaguauuguuugcauaggauuuugaugguccucaguguccauuuuauguuuuggacagaggcaggggugggguagggauggagguggaggugggagcacugcgggggcagguagcauuuuuucccuuucaguacaauguuuuuauaacccacaauauaacguggauauaaaaauuugaauauggugacccaguuguauuuauuucaaugggaucgaauuuccuauuuuuucucucucuuccuuuuuagcaauuucauauuuaacauuaacuccuaggaauauauucuaauuuauucugugccaaagaugaaacuuuuccaauaauucaaauauacaccugaucagugauguuacccaaguguacuaagugcuaacuuuuuauagaaagugaagauuuacaguuuuucuuucuuuuuuaaaucuuucauucugucaguagagaauauaauacucuucuucagcagcuguuucaauaucaguccuuuuuaccuuuugguccuauuuaaugaaaaucuuaaugguuucaguaaauuuagucauuauaaccccucauuaacauggucacagucacccucaaaauagauuguuuugguugaacuuauuacucaaauuauuuuucuuugugucauuauuggccuuuaauaaguaauuuuaaaauauagagcauuuguuacagcauugauuguguuuuauuggcauagauauuagcaaagacuauauuauuauguuuuuuuuuaauuuuuagcauauuauuaaguuucaccgugcaucaaaagcaaauaaaaagcccaugcaguugccaagaucuaugguuaaauccuuacuuuaccagauucuugaugguauccauuaccuccaugcaaauugggugcuucacagagacuugguaaguauuuuucuuuuaaauucaucaauauguuuuucccuacucuuuuaaaaaauauauuuucuucuugguaccauuauaauaaaacauuaauuauagaaaaacuugaaaauauacauaagcaaaaaagaagauaaaaaucacccauaaaccuauaauaaaaagauuaacacuauuuaacauuugguggguaucauuccauuauauuuaugcauagcuguaaaauaucagugugauuuugaacaaaugauuacuguacaauuuuaauggaguagucacaugugaagcaugcacauuucaauccaauuuguucuucauauuauugcucaucauuaguaaaaauguaauuaauacugaguucucauuuuucuuucccuuaagaucuaaacugaaauaaugacauugcaucuaguaaaaagaauguuaucaauauuaauaaacaaaugaauaaauaaaucuaacaggugguauauacuuauuaggcaaauuagcugcaaguuaguguuugauuuuacuuuuuuuuauucaguauacauguaaccauuauuuacugauaucagauuauauugcuagauauucaucuucacauuguuguuauuuuaguuuauguugaugcaaguuucuuuuguuuguucuuaagaagauaugguuauggaauagcuguaauccucauuuucuccucaguuuauguuggagguuuuauuuuggccccacaacgugauuucaugaucuuuuguuucuuaggcuuuugagaauucuggggauaugguagggauacaucuagguaaauuccauuuuauuaacugaugagcaguguuuauugacgaaaggaucuaguuaguauccguugggaccuugucagucagggcuacucaucugacuugaccauucuugcugugauauuguauaaauugggguuaaaugauagugaccacaaaagaugcauuuaccauauuaauggaagcauuucuccuuauaauuuuuuuuuuuuuuuuuuuuuuuuuuuuuugagacagagucucucucugucgcccaggcuggagugcaguggcgccaucucggcucacugcaaccuccgccuccuggguucaagcaauucucugccucagucucccaauuaacugggauuacaggcacccaccacuaugcugggcuaauuuuuuuuuuuuuuuuguauuuuuuaguagagacaggguuucaccaucuuggccaggcuggucuugaacuccugaccucgugauccacccuccucggccucccaaagugcugggauuacaugugugagccaccgugcccagccucucauaauuuuuaacuguaagauucuuugaggcuuccauguguccacuuuacuauuagcucugaaucagcauguuuuaaaaugauuauugggcugggugugguggcucaugccuguagucccagcacuuuggaaggccgagguggguggaucacuugagcucaggacuucgagaccggccugggcaacauagcaaaaccccaucucuaacaaaaaauagaaaaauuggcugggcguggugugcuccugugguccucgcuguuuggaaggcugaggugggaggauggcuugagccugggagguggagguugcagugagcugagaucacugcaaacucugccugggcaacugagccagaccguaucucaaaacaaauaaacaaaaagauuauuggguacaugauguuguucuagaucaugagaagaacucuuucauaaacgggcuuuuagauuuuaaucugcugugcacuuaaugaaacuuaugcagguuauauuuuugagguuauguucauguuugaaucauugaucagaaucuuuuauugaagauuaauuuaucugagcuccucucucuuuuucauaaaauucuauauuuuguucuaaacagcauagcuuaacauauuuuauucaugauauugucaccugaauguccacugauaccaaaauuuaguaugcccaggacucaguuuccucccauucagauuugcugcugcuuuaguguccucucuuuugguuauggcaccacccucuuccuagccuagaaauuuauuuuaccucuuugcagacccuucuuugcacuccacauucagaacuugucaaguucuuucaguguugucucuaaaauaugccuugcacucaucuauuuucaucucuaguccucauuccuaguucaggcuuuuauuaccucuuucuugcauugugauacuagccucuauacuugucuguugucaacaaucuguuucccuuccaaucuacuuucgaccuucugacuaauuacucagcuccugcucaagaacuuugaaauaguuccucauugcuuacagacuaaaacucuacuuccuuauuuggcuuucagaguuuuaccaauuauaacuuuaacugccuuuaaaauuuuucucuaucccugucaucuuucauguauacuuuacuacugaacuauugaguguucccugucuccuccugggauuuccugccuuaauggccuuuauuuccccuaucuuaaaaccccuuaucccugucucaacauauucaaauacuaucugucuuucagggcccaacacaaauguuaauuaaaacuuacccucauauccaugucuacuuggaaccaaucucuucuuguuguugguuccuguuguacugcaucuuuacuucuguuauggcauuuaucuauuaguauuauagcaguuuagagaucucuuagaacaucucguagccugugaacuucuugagagagcaagaucuaugucugacucuuuuuguacacuacugccccuguacacaauagguguugaggaaguauuuccucagugaaugaguauuagggagaauaguacugacauuuuggggaucaggcauuugaauacacuauccuuaaugaacauuuuuuguuuucuuguauguguaaagcacagagggaugggaacaacacaaauaugaccaugucaaacaccuucuucucaaggagccuugaagaaauaugacauacacacaaacaauuauacuauaagauagaugagagagaaugugauuguagcuacaugagaaguacagacugaaucuaugcaaggccagaagagcuucugaguaggggauaaggguaaguuugaaagagcagguugcauuugagcuggacuuugaaggaugacuagaauuuaaauagagacuugggugaugaggguaacccaagggaguuuuagauguaaaacuucugagguaaagaagcacuuggauuaucucagaaaggaugugcaguucugguuggcucaaauauggauaagcugaauugcaguaaugugaggucaugcucagaagauauggguuggagccuacuagaguuagagaguuuuuggggucuuuuuguuuguuuaaguacugacaguuugugagcaacagaaugauuuuuucccccacuagaaaagccaccacugauuauuauuaccucaucaauggcaugaacacaauguugaaaaugcauucugaauaugguucuuacguaguauagcacugguuuauauuuuacccacacauuuacugaaugccuccaacuccucaagugaguaacucuaauaagauuugaaauuuugaacugacugggcaugguggcucaugcuuguaauuucagcauguucggaggccaaggcaggaggaucacuugagcccaggaguucaagaguagccugagcaacauagugaguccccaucgcuacaaaaaauaaaaaauuaacugggugugguggugcauaccuguaguuucagcuacugaggaggcugaagugggaggacugcuuuagcccaggaggucaaggcugcagugagccacgauugugccacugcgcuccacuccagccuugggcaacaaauugagacccugucugaagaaaaagaaacuuugaaccaacaggaaucuagucugugauagccucuucaauucuugauucacuaaucuugaguccugauaucugugccauauugucaugguuuugccaaaguacuuucaggaguagauuuaaacuguaugcuugcuuuauaaauacauucuguaguagauacagaaauauaaaguauaugaaauaugaauauggucuuaaaaagaggaugauggagacauuugaaaaauuauguuuugugaguuuaagaguugcuguuguagucagugacuaguuuuguuuuucuuaaugcuucauuuucuauugcuguaagaaauuuggcuugacacuauuugauagucacaacugagugcucaccaucucuaaauuucauuugaugugagaaaccuggaaaauccauauaauuaaauguguuagaguaaauauaaauuuacaguauaauauaaaaaauuuaaaguaaauaaaagucaguguuuuggacaucacacacagaggcauuacaucaucauaaagguugguguuuuucauuaugauugauuuuauaucugaaucaauauuuuaauuaugucauucgaauccuagaauuuaauacagaaauagagaauguaaauaaagucaccaaaaauaacuuaaaaugaagaauugcuuuaaaaggaaaggagaaagagagcuaaauauguucaucuuggcugagagacagugaaguagaggcauaagucuauaaauauuuggaacuuguaaacaccaagggagaaaagauguauuuuaauuuuauagcaggauauagcuaagaguaagaaaaugaaauauaggaugacucauuuuuaugggauuacuauuuugguagauuggaagaaugccaagauauaguuuaucucuuuuucaaaauuaugagcuucuugagagcaagguucauaucucaauaauuuuuguagucccagcauuggcauauuguuugugcucauaaguuauuugaauugaauuucagcaaggcaucuggcaauuucacauuauucuuuagcaaugauagagaaaugccagcuaaaugauaauauuauuaaguggauuuaugacuccuucauuucagaaucuugcuacuagaucagugauauaaauugaacuaucaguuagacuauuucuuuuucauuaucauaucccagaaccuaguacacaauaagcacgaagucuuuauugaaugaaggauuugaaugaaugcuuuagggucucaaccuuaggucugucuuuuaaaaaauauguguggaggccaggugugguggcucaugcauguaaucccagcacuucaggaggccaaggcggguggaucaccugaggucaggaguuugagaccagccuggacaauauggugaaacccuaucucuacuaaaaauacaaaaauuagcucggugugguggcacaugccuguaaucucagcuacucgggaggcugaggcaggagaaucgcuugaaccugggaggcagagauugcagugagccgagaucgugccacugcacuccagccuaggcaauagagcgagacucagucuccccccccaaaaaauaaaaauacaaauaaauaaauaaaauguguggaguugccaucccaaagcucuuuucacauuagugggugaauuugcagucuuuugaagucugugggcacaaauaaguauaugaucugcaaacaugguacaguauaucaaaauuuugugagauccaguugagagagaaaauaauuuuguauccaggaaucuuuuggcuuuuauuguuaauuaacagcuauuaaaaugucuaguagcuguuacuucugucacagaaguaaaaacuuauucuauuagaggucuauccgaaugaaguaacaaaaaaccuugccaauacuuugagucagauaugauuucuucaucugauuaaaggaaaugaugcaaacuggguaggguggcacauaccuguagucccagcuacuccaaaggcugaggugggaagauugcuugaggccagugguacaaggcuguagugcgcuguuuguaucugugaauagccacuauacaccugucuggcaacauagugagaccccaucucuaaauaaauaaaauaaaaaagaaauguugcaauagauauucuaguugcagaggaaaguacagauauuccccaauuuuucauagaauuacaucucauuggaaccaucauaaguugaaaauauuauaaggcaaaaguauguuuuuaacuucuaguaucuucaacauacaaugggccuauccagaaguaaccucuuuguaaguuaaggagcuuacugaauguguauugcuuuugcaccauccuaaagucgaaagaucaguacauugauccauuguaaguucagugauuuucagaauucaaaauauguuuccuaauuuuccccauugaaaguugggaaccaucuauauauuauaugacuuuggauauuuuuucauacuuauuagaagcaaguuauuagguauaguccacacucaaggagaggaguuuacacaauaguguguauaccaggaggugggaaagauuggaaacuaugucugaagcuaccuauugauagggacaggaggcagggaaauucugggcagaagagggugggucccuggugaaguuccuacccucaagccuaaaggccugauacuguggcccaaagugagaacuuacaucccuguuuucccacuugaauguugccuuuuccaaaaccacccaugacuugcccugcuccccauccugugcccauaaaaaccucaggcucagccggcagagaggagaagcagcuggagguuggagacugguugcauauuggagauaagcagcuugacuucagaaggacagcuugaugguguagcuuuggagaagagucuaguuggagauggcuggacuuugggggagauuagcuuccugcuccauccccuuuucagcuccccuuccugcugagagccacuuuuauuggcaaucagauccccuacauuuaccaucuucaguuugcccaggcgaccucauuccuccuggaugcuggacaagaacucgggugccacgagugcaggugcaaaaggcugucacaccaacccuccacugagcuguuaacacuuaagcugucuacagauggcaaagcuaaaagggcacuguaccauuccuucuguggcuuaaggggucaugggcacaccccuuagacacugccaugggccccgcacagaguuuugcuccugcuggcacccaaaaguacucgccccggcuccuguacccacucgccugcaugcuuccccuccugagagcaggucgagugaguggaguuugccccugcuggcacccaugcacuccaguuccagccugcgaaggggucagggaaauauccuguuucacuaucagaguugaggaagguuuuaaaugauauuuggggcuagcugugauggcacaugccugcagucccagcuacucaagaggauaaggugggaagauaccuugagcccaggaguuccaguccaauuugcauaacauagacccugucucuaaaaaacaaaacagagcaaaaauuaaaugauaccuggauccuguuauugucauuuuuuauuuaguggaaaugcaaugaagaaaaugcaaaaaguccccaccuuucauauauaauuuuuucauguguaaaaguuacauggaugguaagaucuagcggcgguucugguuggaaagagcuaaaaaauaguuauaauguacuaguuaucucuucccuuuuagaaacauuguucagugauuuucagaauucaaaauauguuuccuaauuuuccccuccucuccucuccccuucucuucuuccccucccugcugucgaaccacagauuuaauccacuuaaguucagaggauauauucaauugagguccagaauuuaucacuuugaacauaccuagacauuuccaucuuuuuaugcagucugaggccugugcuuaucacuaguauuaguacuuucuuauuucuauauucuacucuuuuguguaaagcagaggcaaaaaugcgaagaaaaauuuaaauaauggcaaaacauuguuuuccaaagcugguauuucugcugaauuguaacagcuagccaagaggcauugaaaggacacuaugcagaaacaugaaaaagaccuuuagcugaagagagugaagauaucucuguaugaaagucuaauacuauguaugcaaaagucaaagaccacccucuguuuucacucagcuguaagaaaaaugcuguacuguucaucuuucugaacauuugauuaaaaauaagugcuuagaaaucucugcaugcagcauagcuucucuucauaaguugucugacaaggagauacagcaggucuuuaauuuugucucugcuaaauagggccugauaaggcaaaacccuuaaaaucuuacuguaaccauuaugccagcauuuugcaggcauuuaauaucguucucuagaguuuuagccuuacuuaguccuuaagauauagaaacuuugagaaccuacacuuuaaaaaauuauuucuaagauuuugauccuuaagccuuaguuuacucaucuguaaaauggggaauacugagaaguaauuuauaugguuguugacccucaguuccaccaaaguuccugaauguagcuccagaguuccugaauaucucauuuucuuucugcagaagcuucuguacauucuuucuugauccugccaguaauccaaagaugcccuuucuuuaaccucuuuuuccccccagaaugccugucgucucauacucuuccuagccccuucagcuuuacaaagcagagaucuaguguaaauaugugaaauaugccuccugguguuaaaacaaaaaaaguaggcuguguuuuauccuguuuauauuuaaauauuacaaauauuuuugccaagucuucauauuuaaaauauggaaguuuuuaaaaagcuugauuaaaugagaucacaauuagcaacugcuucaaauguacuuuucauucuuccuucuugaaugauauauuacuaagagaggcuuuggagguagcaauuccaugcuagucaaaugacuuaauuauuuguuauuuuuauuugauuuaucaguuaacauucuacuuaaagaggauuaugacaagaaguaguauuucuuuuaauaugacuuaaucauucugauuucuuuuaaaaugcauaguuagcaaucagaaagcaaaguauggccuggauaucuucugaccugcuauuuuaggugauuuuggacaauugcaaaucuugucaugcugaagaaucauacuaguguuccugccagugaccucugguuccuaagaaguuccuuaaagcugaguccuugauagucuagggcuuagccauucaugucugcagucuggaggccuuugaugguagugaugccauccaugcuccugucuugcugccucuacacaggccuugugaagaucagacacaauguuucuuacagugcucuggauauggugacacacaccuuacauguguaagaagguaauauugauguguuuucuagacaugggcuaugauuuuucuuuuuggcaugacaguuuuuuucaucaucugaguucauagcccuguaguuggagcuuucaacagaguccugcacaucuaucugucaguuugaauuaaugcuucaccaguuauuccauagugagaggguacacaccaagaaucccacuuccaagagggccagcuugcaaggagccaugguuugacucacagugacauacaaacucucuuaagguuuaacucagggucagggcucauuugauaaucacugacuuaagcauaaaguuuuaguggccugugcugacaaacacauguauuaagaagacuauuuaccaaacuaacuucaaggucacuaagagggucuaauuaagauacaucccacauugauagcaauggcaggaacuaguugagaaccaaaggcuacagacagagccccaguacuuugaggccuuuggcuauuacugaagaaucaauuuaggcacgcuauuuuauuaaauuaauuuuauugagguggaauuuauauacaguaagguauacccauuuuaauuacaaauugaugaguuuugauaaauauauaccugggcaauuaacaccacagguauucuauuagacuagcaacauagauaccuuauaagaauaagggaaucuugcaugcaaggacugaugauucauuuuaccaagagauuacauaugauaguuauuuugugggaucauauccucaacuaagcacacaucagguagaagucuucuauagggagggccauaaucaguuaaguacuguucauuuucccagggugcuguggcugucacaacucuggcuuggagugcaucucugagagaacuggguuuucaucuggaccugcuacucuccgcacagagugaacuuggucaaguuguaggucuuucucuucucuaggccucucuuucuucaucaguaaaacaagagagcucagucugagaauuucuaucucugacauucuuaauuucucaugauaauaagaccaaauuauuugaucuggauguggguauuccaaacauaaauagaaagcuacucucuaccaguguugcuucucuaaggaugaauuguacuuauuaaugaacaggaauaaauccaaauaccuuuguagcauuauuccuaccauggauguuaauguggaauauaucgcgauuauacucgcauaaugaccuuuaaguuaguuagguaaauagccuucuacauacauguauuuguuuuacauugaacuuuuuauaaugguugcuuuuuauugguucuuguuagagaaaagaaaaccuuaucucuguuguccaggccaguaacuacuccugaaagacaaagaaacacauuguuaacuguuggcagugcuggguuggcaagcauuguuuacugugaauacugaaguuugauuaacauagguguuauauuacagauacuguuaaaccaguuuaagcuaaaaugaaauuagucauagcauuuaauauuacagguuucuccugauuuacagauagccuacauauaguuguaaauacauaauuucaaacuggaaaggcauuuucauuagaaauaacauuuuaaacaguaguuagagucucugaauagaaagaccuauuuagccuauaguguaccuaaaguuaugacacuaauguaauuauggaaccuaauugucauuuuuagcuauuuauuuauuacuggauuucuguggggggaaguagugguuuacagacaaaauacagaauauuugcauuacaaacauauuuggcuucuuaauauguaccagauaguaugcuggguacugggaauacagaguuaaugaauacgaucccuucccccaacgaguacaugguggggaagagccaacaaacauaaucauaaagcaacaagguuuacaaaagaaauuaugagguacauucaaggaugagcuaagcauaagguacuaaguaccuuggauaauucauacugagcugaauaggaaaggauucauagaaauugguaagaugaagagagguggguggggagagcauuccaggcagaggaguaugaauaagggcauagagaagaaaguacaagcacuuuauauuacugggacaaggcaagaaguaguaaaagaagaggcaggagaaagaggaccagauuaugguggaucuuaguuguccuguuuagaaguguggauuuuuccuguguccaguuuccugagcuggucagguuuuuguuaaagaaagaccacucagacagggcuauggagaguugguuugaggacacagggauaguagccuuaucaggugguugaagucagcugguggagaaauaaggaaggcuugaacuaugacagaggugauccaaauugagaggaggggagauaguugacaaaaauguaggauguaaguagucagaucugaggauugguuagauuugagggagaaaagagagcgucaaugcaaguucagacuucugcuuuuguugacuuugugacugagaaaggauuaaccaaaaaaagaggaguuuugacagggaaaaguaaaaauuuaguuuggacaaguugaguuugaggugacugugguaauggcuacugucaacauaucucugagauauauggaaaguuagagaccuagagguauagauuuuggugccauuagcauauagaggauuuuuauuuuuauuuauuuuuuuuuuuuugagauggagucuugcucuguugcccaggcuagagugcaguggcgcgaucucggcucaccacaaccucugccuccuggguucaagcaauucuccugccucagccucccaaguagcuaggacuacaggugcgugccaccaugcccgacugauuuuuguauuuuuaguagagacaggguuucacuauguuggccaagcuggucucgaacuucugaccucgugauccacccaccucaggcucccaaagugcugggauuacaggcgugagcuaccgugcccggccuaucgaggauuuuugaaaccccagaauaaaguaaaauaauaacuuuuaaaaaccguuauucagaagugagcuuggcauguuuuggaguauuuauucuaguuuccuucaacuucuguucuuucuuucuuucuuuuuuuuuuuuuggagacagaguuuuguucuuauugcccaggcuggaaugcaauggcaugaucuuggcucaccauaaccuccaccucccggguucaagugauucuccugccuuagccucccgaguagcugggauuacaggcaugcgccaccaugcacgcuaauuuuuuguauuuuuaguagagguggguuuucuccauguuggucaggcuggucucgaacuccugaccucaggucaucugcccgccuuggccucccaauguucugggauuacaggcaugagccacugcacgcagccaucuucuuuucaaauugggaacuugccucucagaggacacuuauaccuuaccccauagcuggauggauuaugaguacaaaccacuggcaauuuagcucauucacuuauuuguuuacucauucaacaaauauguauuaaacacaguauguaccuaguucucagcagacguauaaaguugugacagaaugacucucccugcccucuaggaaguugcaaccacaaugaucagauucuccauauuuuaaaucaucuacuaucuaaucaaugaaguuguuuuaagggguaagcaguuaugauagacuaaugcuauuagcaaauaacugcuuaagaaaaaaagaagaaaaaggcauagauuuuacucuuagguaguucuuugcccuauuuguuacagugcagaaucuuauuuguucaggguaaacaaugaagaacaguguaaagaaaggagcaugaacugaggguuuuuuccugggaauguauguuuguaucaaaugugaggaaaguugugucaccacuaacaauauuuaaauaaaaguauaguuguagccauuaauaucaagccggcacuguucauuguuucagaaacuacuccaauugauauucugauugucucuguuccuauuauucaggauuguagacaauuguguuugucuuuuucucucuuuauugguacugauaagagucauauuaugaguuucauauuuuugucccaaaugucuuggggugggagaaagcaaauguaguaggaagauuguguaucuuuaggcugugcuacucauaaugugccaauuaacugaaauauauuuaacccugugaaaaaauugauucuauagaaggaaaaagcaaaucuggaguacauguuaaguaucaugaauauaaauuaaagcauuaaguaaauucugcuaaaaugcagauauuucaggaguagcuucugaguaaucauauuacuuaucacauuauuucccugacuuuugccuuuaaaauacaauuuaacuaaaaugaacccugggcauugguuuaucuaucugauuuuauugccgauaacuuaaaugugaggcauccaacucuugccauuucuacuguuucuaugguaaccaaagugugcaaacccagcaguaucacuuucuuucacagcuggcauuuuguguucacaguaagaagaggaguuuuaguaaagcauagucuguguuacuugggauguaacuaggucagaacaauuuugguauccuuucuucauccuuuuagguuuuuuaugugggugaagguguguaugcaugaacuguaguuuucuuuuuuuuaaaaaagagcauauacuuucacuaaaauuaaucaccauuagucuuuugaaaauuaagcauaacaucugcaaacacaacuuaauauagaaucuugaggauuggauggaguugcccugagacuugacccauagccuuguauacccuugaauauuuccauuaagaaagaugaaaugauggaugugaaaugcuuugaaaaauuaaacacacuuugauggugauuauauuauucauuuuguuauuauucauauuuugaaacaucaaguaucuugagaccuuaacauuuauuuacuuguucuaaagggaacaggcaaucccaguaaagaaaugcacauuuaaaaaugacuuccuucugcaauuccaggucuuaacuugacuacaggagcccuucucugugguuacugcccaagcucuagguucuguucucaaacugugcaaaagagcucauaagcuacuacucccuuaaacgaugucacugccucugcccucaucucagacuuuacauggagaguccacacuuagagcuuccauaggcuucaaguauguuaaaucaaagguauucucuacuaacuucaguacuagaaaagagauauuccuccuuucucucucugugucuucauuccauuguguugcucauauucucuguuucgacauagugugacugcaagaacuucuaucaagagauagcugagugaucuaaaaccaccuuccuguacuacuugcguucagcagcuuauaaucuauguucauuucuuacaugaagcaauuuuugcucucagaucucauacuucguaguguuuuuaucuuacuaucuuuauuuuuaaaggguuuaagcucaaacuuaaggaaugaaaaauaauuaaaaaauaagauagcuuauuugauaauuuuacaauuaaaaaauuguuauguccccuagagaucccauucucacuaaggcuuucaaaaauguacucuaaaaucugccuuuaccuuuuccccauuuauuuggaucucauuuacugugucuggcuucuguaaaugcacagaaauuauuuuuuuggaaucaccuaugacccaauuguccauuccaauagccuucucagcuuucauuauguugcaccugauggcuacuuuuuagguucucuuagcuucgagaacccugugcuaucuagguuuucuuaccuuuguuuucuuuuuuagcuuauuuauuuauuuuuuacuuucuugguuuucuuaccuuugauguuccuucacaggaucuuucucuuuuuuucuuuguuuuuguuguuguuguuuguuuguuucuuuuuugagacaggaucuugcucuguugcccaggcuggagugcaauggcgugaucucagcucacugcaaccuccauguccuggguucaagugauucucccuucacagaaucuuucaucgacucuuguuccuucaacucccuuuauucuccuuugcuugcuugcuuuauuuauuuauuuauuauuucuuucuuagacugaagaagcuaagaaaugcuaaauaaacuaaaacuguaguuaaaaaucuuucugagaaaacaucaaccccagaugaucuuagaggcagguucucaaaauuuucaacugauuguuuugauauuauucaaacauugucaaauaauagagaaagagggaaugcuccaaacauauucuagaaagccaguauaaucuugauagcaaaaccagacaaagcaugaaaaauaaaaauuucaggucaaccucaccuaugaguguaguuguaaaaauauuaaaauacuaguaaaccaaauccaggaauacgaauguauuuuuuuuagagaugggguuuucaccauguugcccagccugguuucaaacuccugagcgcaagcaaucugcccuucucggccucccaaaguacugggauuacagaguugugccaucgugcccggccuauuuuuuauuauguguuuuaaaaugccauuucucuaauuauaagcaauaccaaaauagacaaaagcaaacauuagagaaauauuuaguguacuagaagugauagucucuucaaauccucugccaucagaaauugggcaggaggaagauaguuagacagacagauacauaaauagguguuagacggauagauagauagauagauagauagauagauaguagaucuauuucaacuauuuaaaaauuauggauaagacagaagauaauauaacaagugaugauaauucuagucauguaaaacccgaagucucuccaaguuaugugauucuguauaauugacaacccccuucccaacccuuugccugagcucuugauuuccgguccuuacucuccuguucuuacauugaccucuuugcuguuucucucauuagccagucugcucgcucacccaaguuuuuccuaaccacucuaaacaccaugaccuugaccuugcccuugcccuccugcaaaccuuguagcaguagcaguccuccccaacugccaaagcacaggccagaaggugcucgagaaccugcccaauucugguacuaaaaugacuuggaugaaaacagaaccauuugaaacagcaagcaagcccuuccuuggguuuccucucuuuauaauuacuauugcugugucacucuauuuuuccugacccguucuauucuccuuagucuugucuccagauaucccccguuuugcuuugggccuuccagcuugcuccucccucugccaggacugcccuucccuuagacacccagcugacucagguguuaucccaaauguuaucuucucaaagaggcuuucuccgaagaauuuaaaauaaugcuuaaauaaugcugacaauuauacccucccaucccacucccaacaaugccuguccccaugccuugcuuuauuuuuugucuuuguuauuauaugauacauauacaagaauauuugaaauauuuauggauguuacaaagcauaaaaauacagugaacuguugagaaccugucacuuuacccaguaaguggaagauuaccaguagcaugcauaagagaaccugucacuuacccaguaaguggaagauuaccaguagcaugcuuauguuuauguuuccccuguucuauccuccuggcuccucccaagagguaacauauauccuggauuuugaaucuauuacuuucuucuacuuaaagauagauuuaucacauuuuuauaaaugucuaaacaguauauucuuuagcuuugucugguuuuaagcuuuaugaaauggcauccuguucuauauagucuuaaaucuugcuuucuuuucacccaacauaaugcuucuaagauuugaacaugguuuuacauuuauuuguaauucagugauuuuuuuauugcuguuuuaaaauucauugugugacucuaccacaauuuuuuuaaaaaauuguaaucuggcauuuuuaaaaauggaauuacugauucaaaggcuauauauaguuguuccuuuugcaaggucaugccaaauuguuuuccaaagaaguuguaccaacaacuauucugccaccagcuauguacuggaauucugacugaccuacuuccuauucaguaguucuaaauuuugaacccaucuaguagguauaaaaugguauguuauugugaucuuaauuuauauuucccucauuauugaugagguugaacauuuuuuaauauguguauugguuaaaccugucuguacuuuaguuaaaugcccguucagacauuuugcccauuuuucuauuuuguuguuuuucauauugacuuguaggaguucuuuauuuuggauacuaaaucuuuguugcuuauauguguugcauauauuucugccaguuugugcuuugucauuuauuuucuuuaucuuuugauaauuggaaguuauuuuaauacagccaaauuuaucagucuuuucuuuuauuauuaggauuuuuuuguaucuuguuuaagaaauucuucccuaacuuaggaucaaaaagauguucuauauuuuuuuccaaaaguuuuaaaguuuugcuuuuucacauuuacuuuuuuaaucugccuaaaauugauguguuuaugguauaaggugaagauucauuuaauugauuuuuuccacauuuagauaacuuguuguaccaacaccauuuauugaacagauccuccuuucucuacugaucucagguuuccuuucucuugguaucaugauuccauugagggucucugcucuaucccacugaucaauuuguuccauaggaacaaaaucccugaugggauuuugauggaaaugacuguaaauggaauuuacaaauaaguauggggagaauugauuuuuuuuuuuacuguaucgaaucuucuuaucuauauauauggguuaauuuauuuaagacuuucaaaaugucauuuaagauaagguuucggccaggcacaguggcccaugccuguaaucccagcacuuugggaggccgagcggaucacgaggucaggaguucgagaccagccugaccaacauggugaaaccccgucucuacuaaaaauacaaaaaaugagccggguauggcggcgggcaccuguagucccagcuacuugggaggcugaagcaggagaauggcgugaacccgggagguggagcuugcagugagccgagaucgcgccacugcacuccagccugggcgacagagcaagacuccaucucaaaacaaaacaaaacaaaaaaacaaaaauuagccaggugugguggcacaugccuguaaucccagcuacucaggaggcugaggcaggagaaucgcuugaaccuggaaggcagagguuguagucagcgaagaucgugccacugcacuccagccugggcaacagagcgagacuccuucucaaaaaaaaaaaaaaaaaaaagaaaagaaaaaagauuucaugguguucugcauaccaaucuuguacauucuuugauauauuuauucuuaggcauuguaugguuuuucuugcuauagaaguguuaccuuugaaaaauuauauuuccuagcucuuuuuuuccugguauauagaaaaacaguugacucuuucauauuauucaguuagccagacaucuugcuaagcucuguuacuauugccaacaauuugucuguaaauacuuugguuuucuauguagauaauuauagcaucugcaaauaauaauacuuuuguuucugcccuucaaucuauauaccuuuaauuauuguuuuauaguaccggguuuauauuacaauguugauuuuauaaguggugauaguaggcauccuuguauuauuucugauuuuaaaggaaauacuucuaauguuuccuucuuaguuuuuagugugugccuguugucagguuaagguagauuuuuucuagccuaacuugcugaaaauuuuuaucaugaaugaguguuaaauucuaucagcuguuuuuuuuccccagcaucuaucaagaugauuuuauaauuuucuucuuaaucuguucauauggugauaaacuuccauagauuuucucauguuaagccaucuggauggauuugguuuacuaauauuuuguuuaauauuuuuacaacuauauucaugaguaagguuggccugaaguuuuucuuuuucauucuuugguuuugcaaccaacauuauauugaccuucuagaauauguuuggagcauuuaaucuuuuucuguuauuugacaguguuugaaucauauugaaacaaucuguugaaaauuuugagaacuccccucuaagaucaucugugguugguguuuucucagaaagauuuuuaacuacaguuuuaguuuauuuagcauuucuuaguuucuucaguuuuucuaauucauugugaaucaauuuguagguuacauuuuugacuuuacauuuucaaauuaauagauaugaaguuauucaugggauuuuuagauuuuucuguccucuacuggaucuaauguaguuuauuugcacuuucucucuucuugcuccagucgucccaaaggcuucauaauucucucugguucauggauuucuacccuuuaucuucccucccccccaccccccuucacaacuccuuuguaguucuaaaacaccagaggaaggaggggcuuggguuucgcugguucuacuuaaacacaucauggcuuucuguuccauuguugggggauuuuggugaagucgcuggucucuugcugcauagacaaggcuggggugcaaggagagagacaccgucgcaugcuucgagguuacuggccggccggaccccagcuggacggugcgcuaccucguaccaccaccaggaggcgguuguucccucuggcuuuuccuuugggggugauagaggggagugcaggggucgggaggcaggaggguguagacagcgcagaaauagugucgggucguggugggugaagcaagaucgcgaaggccuggggcauagguggagacccuccucugucucuguggggaguccuugcagccacgaggauuucaggauccuggguucccuccacaaaagacuggaggcgggcggucacgcggcccgaggcagcaauuacagcagugggagauuuuccuucucucaccugccggggagccccuuccucccacuugggaggaccaggaaacacugcugccuuccaagguuugcccgccaccccacgaugagucagacgccagaacucaaccgugcgcaguggaacaggggaggcagccgagguggguuaacugcaucgauagggaugaugaacgagauuccagaaauucccagagagacauauagcaaagccaaagggaaaagggaguaguaaaacuaacuuugucuuuuccgaauccccccuccccgcccccuccgccguuggcccgguugacccccugcagguggccguacucagcacgacuuaagcaccuguugcagguggaggcgcacgucgguuucccagggcaccacgcuggcacagaacgagcugggcuccgccuucugggccucagggaugaggcggugcaugggguagcugcggcgcgggaaggccaugucgccgcccgccagcagccccaugggcagaagucguuggcgcugucgcccacauggaagaggcacucgaagugcaugccgucgugggcccguucgcgcagguagucgcugagcaccuugugcuugcacauguuggcggggcagcacacgcaacuauguguguggaacggccacagagccagcagcuccugcgcgucggaccccgacgaguugcugaggaugcggaggaacaggcucugguggccgguggcgcgcugcgugcucuccaugccgaagguguuagcaucagagaugagaaucaccucgaaggaggugccuugcuuagccacaaacugcagcaggucgcccaugccuggcaacaaagggauagcuucguagauggcacgcaggucccgcgaccgcacacccugcuugcccagauacuugaagacgcgcugcaugugcucguuguagaagcccucgcggucgguggcucgcaggcucuccugcaccugcugucccggcacaguucgcaggacugagucgccgcuguuuucgucuacgauagucucuucgaaaucgaaggucaggaggaagcgcggcgcgucgugcgcggccaucccuccgucucuagauaggcaccagaggccagaaacuggaaaacagccgcucauuguccaugcauuaccguggacaccaccuguagggacucuguuggccuccagccgucgucaagaguucggaaauuggaggggacaaagugucuuauccaccccuggauuucugggcuccggcucgugagucccuguagucccgagggaccgaggaugaugugcaucugaacgguccccuccacuugcccacccauccuacccuuuaucuuucuacuucuacuuucuuuugguuuauucuguugaccuuuucucuuucucuauuuuuuaaacuuauugagcacauaacucauuauucucagccuuuuucucuuccuaacauauuuaaggcuauacauuuuccuuguaaguacuguauuagaugucuuccacaaaguuuuuguagauaguauuuucauuauuucaauucugaauauuuuaaacuuuuaugguuucuccuuuuacucugaguaauuuagaaauauuuaaaaauuuucaaauauguagaguuuuaauuguauugugguuagagaacauagucuguuugauaaaaaauuucuugaaauuucuugagaccugcuaguauaugaucaguauuuguaaauguuccaugugugcuugagaaaaauguguacucucuaauuacuggauagaaaguuguguauaugcucucuagaucauccuaguuaauuguauccuuuggauagucuauauuuuacuaaucuuuugucuguuugacauaugaauaauugaggaaaguauguuaucauuggccuuuuuacucccugaaguuauauuuauuuugcuucauauauauauuuuucaaguacauaacagguuuaggauuauugccucuuccuggugaauugaacuuuguaucauuauauagugaucaucucuaccccuaauuuguuuugaaauuuuuuaauuuuuacagacacauaguagauuccuguccuuuaucuuccccccugccuccccucccccuggcccccuucaccuccucuguaguucuaaaacaccagaggaaggagggacuuggguuucgcugguucugcuuaaaaacaucauggcuuucuguuccauggucgggggcaagaagugugccgagguuccagccugcgagggacuggguguauaguagauguguauauuuauggguuacaugagauauuuugauaaaggcaugcaauguguaauaaucacaagaggguaaaugggguauccaucaccucaagcauuuauccuuuguguuacaaacaauccaauuauacucuuuuaguuauuuuuaaaaguacaauuaaauuaguauugacuguagucacccuguugugcuaucaaauacuacuucuuauuuauucuuucuauuuuuugugcccauuacagccccacuuccuccucucuccugccccuacuacccuuccccgccucugguaaccauauuucuacucucuaucuccauaaagucaauuuuuuuaauuuuuuuuuuuuuuugagaugaagucucgcucugucacccaggcuggaaugcaguggccucaucuuggcucacugcaaccuccgccucugggguuaaagcaauucuccugccucagccucccaaguagcuaggacuacaggcacgggccaucaugcccggcuaauuuuuguauuuucaguagagacaggguuucaccauguuggccaggcuggucucaaacuccugaccuugugaucugcccgccuuggccucccaaagugcugggauuacagguaugagccacugcgccuggccaauuguuuuaauuuuuaaaaguuuaauuuuuaauaauguuuaauuaaauuaaauuaacuuaauuuuuaauuaauuuaauuaaaauuuuaaauuuuaauagugagauggggucucacuauguugcccaggcuggucuugaaauccuggguucaggugauccuucugccacagcuuugcaaagugcugggaucacuguccugucuuggcuuugccuauagaguaaauuccaauuucuuuaaugcgguauuuuauucccaagauaguuuuccaguugcauuucuacaccaaacauucacugcucuugucacaucaaaauauauauaaacucucaacaugccaugucuguguuuuuaugugacuguguccuuaccuguaggguuccaugagccugaaaacuuuuuuguuguuguuguuguuuaugcuuaucaaaaucuuaguuauccuuagcuauaaccccaaaaucuuaguaucccuuuuuuauuuauugagccacuucauccagccaauuguuuuaauuuuuagcucccacaaauaagugagaacauacgaaguuugucuuucuaugccugguuuauuuaauuuaaugugaugaucuccaguucuauccuaauaauguuuuuguguuaaaagcuauuuuaucugauguuaccauaguugacucagcuuuccuuuggcaguuugccuuuuacuuucagcuuuuaugguucuuaccuuuagguggaccucuuuuaaauagcauggauuuuguuuuuaauccacuauggaaauaccugugucuuuuagcuggaaaauguauuguuuuacucgucaggccuaaguugguaaguguuuccuccagaagggguuugcuuuggcuucuacugguagcaucuagguuuccuuuagugcccuugaaggucuuagugauugugggguagcaggcucagcuuccuuaccuugcugguggcccaaggcucaguguccuugcugaagugcauuauuggcagcugcucucaggccuaccuugccuuuccuuaacucuccagccauaaggauaccuuauuuggagugaggguaaaguuuguuaucucuugugcaaucugggaugcuucaaggaauauuuccuuucuuuuuccuuuuucucucuuuucccucuccucugcugucucucucccucuucccccuuuccuucucccuucuccucuacucuccuuuccccuuccugacuccuccccuccccuccccuccuaucaaagacaggguuucucccagccuggccuugaacaccugggcucaggcaauccucccaccucagccucuggaguaacugggauuacagguguggaccaccgugccugguuuguuucuuauauagcauauagcuguucuguuaaggggagggucccucagagcacuuagucagccauaauagcagauuugacaaucucuuguauucucuuuuuguuuucuuuuccaugguacuuaucaguauaugauauguuguauacuuauuuauuuauugccuuucucuucucacuagacuguaagcuccacgagggcaaggauuuuuccuguuuuuguuuucugcugcuucuguagcaucuaaaucacugccuguuacuuaguuugugaucaaacaauauuuguugaaugaaugaggguugagaagauagugugaaaaggcaaugccaagucuugaacccuuuuuuuuuuuuuuuuuuuuugaaacagagucucacucugucgccuaggcuggagugcgguggcacagucugagcucacugcaaccuccgcuuucccgcuuuccggguucaagcgauucuccugccucagccuccugaguagcugagauuacaggugcacaccaccacgcccagcuaauuuuuguauuuuuaguagagacgggguuucaccauguuggucaggcuggucucgaacuccugaccucgugauccacccgccucggucucccaaagugcugggauuacaggcgugagccaccacgcccagccuccaauuuccuuaaucugguauuuuauucccaaaguuguuuuccaguugcauuucuacaccaaacauucacugcucuugucacaucaaaauaugucuaggcugucaauaugccaugucuguguuuuuauguccuuaccuguaggguuccaugagccugaaaacucuucauuuuuguuguuuaugcuuauccaaaucuuaguuauccucacuuaaagucauccagagucaucuuccuaaagacuauucugauguucaaugagaagaaucauucauuccaugcaauuuuucuuucuauauugauaguuuucauaaucugcccucugccuugucccuccuuccuuccuuccuuccuuccuuccuuccuuccuuccuuucuuucccuuuccuccuuuccucuccuuucuuuuucuuuuuuuuuuuuuuuuuugauggagucucacucuguugcccaggcuagaguacaguggcacgaucucagcucacugcaacauucaccuccuggguucaagcgauuccugccucagccucccaaguagcugggacuacaggugccugccaccaugccuggcuaauuuuuguauuuuuaguagagaugggguuucaccauguugaccaggccggucuugaacuccugaccucaggugauccacguaccucggccuuccaaaguuccugggauuacaggugucagccacugcacccagccucuuccuuguagucuuaaaagcugucugucuuuuccuccuggauuuaagcuccuuaaagucaagaucuucauguuuuauuuccuguuguuuccuaaaggccugaaguacaacacuuuuuacauaauggaccuuugauaaauaguuuuuuuuuucuaguauggugaaccaaucucaucucauauggugaaccaaucuuuuucuuuuucuuucuaguauggugaaccaaucucauuucagguaucacacucuggugauaauaacuuucaaauccaaaucuuccucuucucacuccucuggcuaguaugacuuaggcauuucacauuucucaaacucuuucauuuuauuuaauauuuuuugagacggggucucacucuguugcccaggcuugagugcaauggcacgcucacagcucacucuagccucgaccuccugggcucaagcaguccucucaccucagccucccaaguagcugggaccacaggcaugugccaccaugccuggauaauuuuuuuuaauuuauguuuuauagagacagggucucuucagguugcuuaggcuggucucaaacuccugggcuuaaacgauccuccugcuucgacuucccaaagugcugggauuacagguuugagccaccacgccuaaccauuuuucaaacucaauauguugucgccuucucuuuauuguuccuuauuuuuaaaccauuaccucuuauaacuuuucuguguccaugaaaggcaccauuauucuuccagucacauaaacuuaaaaccuugguaaaaucuuuaccacccuuuuucuuaaucuuuuagcuuaagccagucacaaaguccuguuaauuuucuccucuaaaaugcuucucagcuccauaccucccuugccauuucugcugacaagacauuggacagagcucuuaccaccucacauccaauuccacucccucauccucuccuguaaacucacugacuguaauauaacggucugauuacuucacuuggcauuuaagacuauccagagucuagguucauccuacuacccucaacaugagcccuuuucagauuuuuuuuuuuuuuuuuuuuuuuuugugacagggucuugcucugucacccagccuggagugcaguggcauaaucauggcucacaguaguacccugguagccucaaucugcuagacucaagcaauccuuccgccucagccuccugaguagcagggacuccaggugcaugccaccacacuaggcuauuuuaaaaaauuauuuguagaaacagaaucuuacuauuuuguguuuugcccaggcuggccuugaacuccuagacucaggugagucucccgccucggucucccaaaguccuaggauaacaggugugagccacugcaccuggcccaagucagacuucugcgucuuaugcauaccuggucauauccuuuuuccacuuccuaugguguccuugcccuuccucuacucugccaugaugguuccuguucauuuucauauccgucuaauggacaccauucccacuuccauccccagugagcauuucccuuaacaguggaaucuuuaauucaucacuuccuccuuugaauuuguuuuuuaagugcuuuuuguuuucauugaaacauuuuuaacaaucagcaaauugaaagggaucuuuaaaguaauccaguuuaaucuugaacacaaaaccucagucuucucuauaacucauacauagcacuagcuucuaauauuauacaauccuucuuaguuuucuuucuacuuauguaguaagcgucuggagguuaggaacuugguuuuuacugugcuuuuguuuucccucuuaaagauuggcaugguucuuuauccuuagaagauacaaaaaaugcauucguugauugaauaaaugaauccaguaaguuaauaacacauacauuuuccuucaaagacuuuacaaaggagacucacucucucccccuuccaaagccuaucucaacaguuucucuguuuccaagugucuacagauaagggugacugaaaauaugguagauacauuugcagccuacucuuuucuuuuuauaguucuguauuagccuugguuuuuauuuuccuacaucuugaaauuauauuuggaauuuccuacuuuugcauguaugauagcugaugcaugaauuuuaauagaguuguugaaugcugaucauguuuuucuacgguaguuuagaaauauuuaggaaggaauauuccauucaacuuauucauaugaaggcgauuauguugugguuugaaauuuuauauaaaauuuuucaagcacauaaacugugcagguuuaaaaauuauuauuaguuuuuucugcgggaugaaucuauuuagaaaugauagcuuuaauugcuuuguaauuauuuguaugauauaauuuugaaaauaagguguguuuccauagcaaggauguucauauaaaguuagugcugacuucaauuaugucaaaugcuuuaacuauguagagggugcuuaauauuugauuuacuuuugaugaaaauacagaaaugauuuuuuauaugauaagaacuuuucuccauuuuagagcaugucaaaagaauaaacaugguaauuugaaugcucuauuuuuauuucuagaaaccagcaaauauccuaguaaugggagaagguccugagagggggagagucaaaauagguagguaauuauuccuaaaauaauuuauuuaaaaacugaaguuaacugcaaagaugguuucccuuuuuaaugcccuuauuuagguaguuaauuuuaaaauuacuuucucauuauuuuuagaaaagauauuggaaaauguagauagauagucuacaaaacuccuagguuuuuucccaaaauaagauucuuuaguucuaaguugaggcaucacuggaaauugacaagcuaguucacaaaagcauucauucccauacaguaacccaagcauguguuuaugucaccaccacuguccugcacagccaccuuaaauauaauccucuaaaucucacuucuguuucagguuuaccaacuauucucuuccugaauauuuuccuccccacccugagcgaauauauuuaaaccuucacagguucucccuacuucaccacaccuggccugcaugucuugcaccaaguacuaacauaccuuuuccaaauagauauauauguuuacagacucucuuagcugccucucuuagauugaggcacuggcaggauucuuauuuguauauuaagauuuccuuuauaauccugaauguucuaaaaaaaaaaaucagcaucauuuauaccuauuacauauuuggggagaagaugagcuaagaaaugcuuuauucuaauuucuuuuuuugagacggagucucgcucuguugcccaggcuggagugcaauggcgcgaucuuggcucacugcaaccuccgccuccuggguucaagcaauucucccugccucagucucccaaguagcugggacuacaggcucccgccaccacgccuggcuaauuuuuuuguguauuuaguagagaugggguuucaccauguuggccaggcuggucucgaacuccugaccucaggugaucugccugccuuggcuucccaaagugcugggauuacaggcaugagccaccacgcuaggccuauucugguuucuuuuacuagaaauuauauuuauugaaaguugaaugcuuuuuagaaauauguuaaaauguguuaaucagccugguuucuuugcuauuagaauauaccaugcuaaaggugaugcaaaauugugcucacuugacccacuacaaauucaugcugcccuauuucaagcccacccugcuguuuaguuuucuacuuuuucaguuaacucccuagcccaguugcuaaauaagcuguucuaaaccaacuuccuuuucuuuaaacaccucuagccuaaguuugcugagauuaucagauucauucagaaguuuguugauguuaauuaaguagcugguagcuuuccuucucuucccucccccacuuccaccauaauuucucacuugucuauuuuuauuuuacucuugcacuccuuuucuuagaggcauuuauugagugccuacuuuuugccagauacaggcgaaagggagauaaaggauggucccuucugugagagacaguaaaaugaacaguuuacuauacauugcaauauguacuuugauguuaccgcauuuauuuuacacaaccacccucugaaaauaaggaagacaagauuuagagagguuguagcuuccucagccugucaaagcuagaacuugaauucuaaguccugaggcucuuucccuacaaacaucccugccuagugauaucagagcugucuggugugaucucacugaccucuacucuuuggcuguacagcccugcccuugagaaagccucugugaaagacagacuuuccuuuccuaaguccuaucuacuagugcccuuccuagcuucuaaaugucuuccuaccucauaguacaauauugcuauuuccccuucucaaguuucucuuuuucaccuuuaaaccuucaucguccuuuucccaauuuaaaauacaucuuauauccaucuuguuuuucuuuagcacuugcucuauucauuucccuuuuuguuccucuacuuuuagaacacaugauguucacucuuugguuccacuuacucuaauuuguuauaaccuggccucuaauuccaucccucuaucaaaaguccucucugaaaggacaccugugaccucuacuuuaccaaaucaaguggccuguauuaaucaacuuucuccuuuacugcaguaaaccauuuguucuucugacaguccuggcuuugagggugucuucuccgcuggucuauauggcauaccauaauuccauuuuucugccucccacuuuugcugugacuuugccuucuguucauucuugccucuuacuucuacuaaccuauuguuucaaggcacuggcuuaggacauggcuucccucuaaaauuacuucuuuaggaaauugauaaguuauggccucaggaucauggauuuaugaaaaugauucuaagaucuugauaccagagucuaaucucucacccuagccgaagucuuuauuucuauuuggauaucuugugguaacuuauccuccauugucccaaaccaaauucaucaucaucaucuuguauuccccuuguuuguaccauucgucacauuucucccagucaccccaaucuaauuuguucucuuaguacuccuuagcaaaauucuguacucuggccaggccaguuaguuaccuuacuauuaagaguuuuaagauuguaauucugccaagauuagggauaaaacuaggguuaaaaguaaguaauaauuaaugauaaagaucuaauggacaaucaagauaguuuauuaaauagauuuuaaauuuuguuuuaguagccacuauuguuuuuuaaacauuaguaauaccaaugccuaugccuaaugcuuugauacaguguuguuuuuugcuuaaaagaaaaggauaguugggcugggcacaguggcucaugccuguaaucccagcacuuugggaggccaaggcgggcagaucaugaggucaagagaucgagaccaucuggccaacauggugaaaccccgucucugcuaaaaauacaaaaauuagcugggcgugguggugcgugccuguaaucccagcuacucgggaggcugaggcaggagaagugcuugaacccgggaggcggagguugcagugagccgagaucaugccacugcacuccagccugggcgacagagcaagacuccauaugggaggcggugggggagggggaguggguaagaaaaggauacuugcauggaaaacacauuuugcccuuugcuguaucuaagccuucccauucucagcaaccuaaaaacuucccaggucuuaccuaaaaugcuuauugccuuccucuuuugcuauucaaaauaauucauccugcaggauccagcccaagucccacuuucaauuuagucugcuuuuacaaauguuuauuauacauuguuccagauaacauaauaaaagagaaauagaccuucccccaggggacuuagcaucuaguagaaaccgguaacaacuuccuuuauucucacaguacuuaucacuuuuuugcuucuacucuguauauuuugucaucucaccuuccuguaaacuccuuagugguagaccuuguuuguugcugcuuuucauuugauacuaauuagcacucacaccagaauuuuacuaaccuuaucugugaacuggaacaauuucauccauguguaauuuuagaaagucaacuguuacaguaaucuuuaggcuaauuaccuuuugucuaaaucaguauuuauuugaaaaguaguuugaaacucuuuuaaaguucauaaaauagaugggaauuguuuuuaaaaguauguauuuuuuccuucuggccuugauugcaucugcgagugaguagaugaggcuuagguaaaacugaggagguagagaauaaggggagaaauacuggcuuuagcuaacuuuacuuuagaauguuuuucaauggaugaaacagcauuccaucauauuacuuugucaucaacaacaauuggcaucuauuaaauauauaaaacagugccuugaauauuguguaauauuguagaauaauagguguaauauugguagaaugaauuugaauauuuuuguuugcuguagggaaauguaguuuaaaaagaguagguaucagcacaggcuuccuuuggauagcuuuaguuuuuaagagcuggauacuccaaagcauucucaaaaaagucuuacaaauuauucaaaauccaaagaaacaaaaucacuacaggccgggcucaguggcucaugccuguaaucccagcccuuugggaggcugaggcaggcagaucacuugaggucaggaguucaugaccagccuggccaacauggugaaaccccaucucuacuaaaaauacaaaaauuagccaggcauggugguggcgcaccuguaaucccaucuacucuagaggcugaggcaggagaaucgcuugaaccuaggagguagagguugcagggagcugagguggcaccacagcacuccagccugggcaacagagcgagacuccaucucaaaacaaaaacacaagacaaagacccgaaauuucuauaaauuaaaaagauuuuuugccuguucugcuuauguaaauguaaauuaaaauuuuaauauguuauaccguagcacauuaguuuuagauuaaaugacauucugugguugaaaguuuuaugugcauuuaugcauuuuauaguacauuggggccccuuauacaaucaacauuuguuauguauauuauguauucaaauuauagaggcuuauucuugugacuuugccuuugugacuugcaauuaucauauguauaauuuguuggaugucagauuuaguaguuaaggagguagcuccuaaauuauaacaugguuuuuguuugaguacuggcauguuuauuuacuaucccugugaccacaggcaagucauuuaacugcuuugggccuuagauucuucaucucugaaauagggagcaaaauacugauuaaaccaguguucuuaugaggauucaaugaggugaaauaugauguauaugaaagccauuuguaaacugcaaaggacuuuguagauaaaagauguugguuauuuaugauaucuuaagaaaauuaguuuccaggaucuuauugcaguaguaauuuuuuuuauuacuuuuauauacccccaauauuucaauugauuagcuuugguuuagaccuuuguuaaaugccgaauuauaacaaauuaucuuuuauguguucuguguaugcucuugaaaacaugcauguaaugugcugauuaccauucagcaacuggcucucuggagcaaaaaaugucccaauuuguagcauuugcuguuuuccauguuguagauacuccuaccauagccaauuccaaaucaucaguaugcugucauugaaugcagaauugggaaaagauauauauaugucagcucuugugaguuuguuggaucuggcugcagcacacacugaacuaagacguagucagguuuuguuuguuuguuuguuuguuuugagacagucuugcucugucucuuguuuguuuguuuugagacagagucuugcucugucacccaggcuggagugcaguggcacgaacucggcucacugcaaccucugccuccuggguucaagugauucuccugccucagccuccguaguggcugggacuacaggugcgcgccaccacgcccagcuaauuuuuguauuuuuaguagagacuggguuucaccauguuggccaggauggucuuggucucuugaccucaugauccaccugccucggccucccaaagugcuggaauuacaggcgugagccaccgcgccuggccauagucaguuuuuaaauguauaagcauacagaagucauuauuaaucagggauacuuuugaacuauuuuagauuucaaaaacacuuaagaauguuuuuguaacucucugaaagccaggaaucuaaagucagaccuggauucuaauucugccucugcacuuacuagcugugugaccuuaggcaaaucagaauaucuuucuugggggacaggggauggagucucacucuguugcccaggcuggaguacaguggugugaucuuggcucacugcagccuccgccucccugguucaagcgauucuccugccucagccucccgaguagcugggacuacaggugcgcaccaccaugcccagcuaauuuuuguauuuuuaguagagaugguguuucaccauguugugcaggcuggucucuaacucuugacauuaggugauccgcccaccucggccucccagagugcugggauuauaggugugagccaccccaccagcccagaauaucuuuaagcuucaauuccuucaucaguaaaacaggcacaauaauaguauguccuucugaugguagauaauaaagguaaaugaaguuaauuccuuucugguacuugguguagaccucugguuaaaaagggaggaaaaggauugcuuuauaaggucagcagcuauuguugucaaccuugcaugguucuaauagcaugucaaacugaauuuuacacuugaucuuagccaaaaggacgagaaacaaucaaacugaauuuuauguuaauuuauuuuauuuuuuuagcugacauggguuuugccagauuauucaauucuccucuaaagccacuagcagauuuggauccaguaguugugacauuuugguaucgggcuccagaacuuuugcuuggugcaaggcauuauacaaaggccauugguaaguuggucuaaaaugauuuacuaucuugucaucuaacgaucauaaauauaaaaugguauaauaauaaagcuacuugauaaaaaccauuuuauacauuuuuguaaaaguccuauugucuucuguauuccuagauuucugguagauuuagauuguuaacuguauaggagaauaugguuauuuuaaaagaagaaaacauuuucuuucagagaauagagguaucaguaucugauccuguugaguugcuauggaaacaauaacaugcacauuuuauuuuguacuuaguagcuguugaucagaagaacuggagagaaguugagaauuguuuucuucacaaaaugaaaaacaaaaacaggaguagugcaguauuggaaagaaccccuucuauuuggggaaaaguuagucacauuguuuccuaagcaagaagcaauauaacuaaucuuucucucuugccauuacaguuaugagaauggcaguuucuccauuaagguaggaaauagagucuggguagauuagcugugcucagcgucuugccaucucaucaaguuaaaaaaacugaguaagaaaaucuguuauaaacacacuguguaaaauuuaaagucugccucagaacaguggcuucagagauuugcuaccuggugacugcaguauccucacacggcccagcugugaauggagggagucaguaggagcuggcccuccucaaaccuagagauuucuuuaaaggaaggaaaaggagagaguaggggagaguacauuguagcuguuagaagggauaguucuacaagguauccaaauuuccuaaguauauuucuuuaaauuuuccuuuuauugaauuuucuguuuacuggcauuagucucauaucaguuuuggcuaccuuuagcugcuuuuguugaauucuauuuaauaaaggcacugcaaguauaaaauuauuaaaaauagacaagcacaauccuuucucugcuaaacaagcuuaugaaaaaccuggugauacccaaagagcuacaaaggaaacucucacacuuggaaagauuagacugauaauuagccuacucauggguuaaaaaagaacacaaaaauuaaaauauaguaaguccucauucaucaagacgucugauuucugcaaaacucagacaccagaacacauuuagauuuuguccagagacacagacucuagcacagugcugcaauauuguaaauuauugauaaauacugcugaauaguuuuguuaaauuagugaaaaagccucugaguaaacugguauguguuugacaguagagaaaugugagagugacauaaaacccuuaccugugcagcugggccucugguaaggcagcagaucagaggcuaccaaggccaggcugucaucaguggacaguggcagccgucugcaaaaggugagggaagaacuacagacagcaaguggaagggauggaguggcccugugauccugccuguguacauuccaaccagugacuuuuacuauggagcuguauuuuugagacuuuuagaaucauaaguuuguuuuuucugucauuuaggucucuccuuacccacuauugaaaacagucauaucccuuagacaaccucagaaggaaccagaggauaggaagagacugaaaguaagccagggaagggaagaguguuaguugaaaguaaaaggugaugccuuagaacagguuaaugacagauaacccaggacacgaggaagggagaagaggaugcaaucuccauagaaauccauauaccuuagacuuaauccaaacacuaggacagucuagcucuagaagggagauuuccuuuaggaaaagacacauucagucaaaaccuucuguuaagcuaaaugacuucccaccaaugucugucccacucucagagaagcuaacacagcggguccaugcccuuagguaggugauucuguugugcgggacccauauacuuugagagcccacacuuugagaagcacaauuuuaugaauauuuucugauuuauuuuucucuuguugaaaugaaaauagaugcuuuuuuuuaaauaaaugaaaucggauaugaguugaaaaccaauuauacuucuuauuuccucaggguaaggaaaaaugaaauugaauuuuaaccagcuugcaacucacuugcuugguaaaugaaauuuaccgcuuaaagauaaaaacauaaucacuaauuucuaauuuuagucaauucccaauuauccauucuggauagaagguaggagaaaguuaagacagaaagaaagaauaauccccaaaucaguuaucuuagggcuucaaauauguuaauagcagauguuuauaaguacauacuuauucacuuuuucguacucuucuccauacaugguccauguuagaaaugaguacuuagggccgggcaaggugccucaugucuguaaucccagcgcuuugggaggccaaggcagguggaucacuugagguccggaguuaagaccagccuggccaacauggugaauccccgucucuaccaaaaauacaaaaauuagccaggcaugguggugugugccuauaaucccagcuauucuggaggcugaggugagagaaccccuugaacccgggaggcauuugauaucaguggagguuuguggagugacaguuggggaggggaguggcagugauggugacaagcaguguuggggcagguguguuuaugggugugucaggagaacaaaucauugauagaggaaagaaaccugagaaguagcuacagauggugcaggagccagauggccuuuugaaauuauaggcuaauaugaggcagaaaaccuuugaauguacugccaccugcuaucugagguuucuuauguuagcaguucacugggaacucaagacccuggcucuuguccuuugaauggaggacaaaccaggaauuggcaugaccaggcacaugcaguaguaguccugguauacugcauaguagaggugguaaugaggaagagagaugggaccaucagaggcagccauaucgggggaagagugacaaccaguaugacaugggagacagaaaagaauucagaaauggaugcugagcaguauuauuacucuacucuguagugauggauguucaugaugaugaugaccuugcugcaucauuaaggaggauuacauuuuuuauagccuuuuaugguggcaggcaaugguguaauuaaaaaauggucgucaaaggaauauguuuccauuauccagaaggcuaaauuauguggaaggaaacuguaccugaauguggucaaauaaguaaggcauuacuguauggauuuuuccauuugacaauuuguuuuaggagagagcauucugaugcgucuucuagcuaauggauauacaguaguccccacuuaucugcugggaauaugucccaagacccccccaggggaugccugaaauugcagauagcaccgaacccuguauauacuauguuuuuuugaucuaauaacccagacgaccacuaagugacuaaccaguggguagugaguauacaguguggaugaacagagggaugauucacaucccaggaagauggagagcguagcaugagauuucaucacacugcucagaaugguacacaauuuaaaacuuauaaauuguuuauucuggaauuuuccauuuaauauuuucgaacugcagugguugacugcagguaacugaaacuggagggcaaaaacuuagaugaggaaggaauaguguaauuaaccuuuuuccuuguuuagcuuauugcagaaugugauucacauauuuaauaggcuacuaaacacaguacuuuuuuaugcuauaccauaguuuuuuguuuguuuuuuccaagaugguguuucacucugucgcccaagcuggaguacgguggcaugaucuuggcucacugcaaccucuguccccuggguucaagagauucuucugcaucugccuccucaguagcugggacuacaggcgugugccaccacacccggcuaauuuuuuguauuuuuaauagagacaggguuucaccauguuggucaggauggucucgaacuccugaccucaagugauccgcccaccucagccucccaaaguacuuggaauacaggcaugaaccacugcacccagccuccccaauucuuuuauauggucuauacugucugucuagacucaaaacuuauaaauucuacucuaucauuauacauuggauggcuuuaaaagaauuacgucaccaugucugaugaugauauuguuucaguauaucagaucuguguauuacgccugguauuagauuaucaauugaguacuuuaaugauuaaauuauuaacagugguuagacaugguaagaccuugucucuacaaaacaauuuuuuaaaaaauuagccagguacaaguagcacacacccauagucugaacuacucuggaggcugaggcaggaggauuccuugagcccaggaggucaaggcuucagggagccaugguuacaccacuguacuccagccugggugacagagacccuaaaaacaacaacaaaaaaagugguuagaaagaccuuugccuaaaucuaaagaauuuguugcuugcuaaauugacuguccccauuuauugucaucagaaaauuuacaaguaaauguuuuuuauuacuuggcuuucaauuuguuacaugaugauauagcuauuucaugucauguauauauauauacacauacacacacauauauauacauaccuauauauacacacauacccacacauaugucaaaauacaaaguacaauaauguucucuuaauguacuuauuguacuuuguauauugauuuacugaaaaguauuuuuauaaguaggcugggauuauaucuaggaauuauaaccaaggaaauauauacaaaaacuuauguuucuuccuucccagauauaugggcaauagguuguauauuugcugaauuguugacuucggaaccuauuuuucacugucgucaggaagauauaaaaacaagcaaucccuuucaucaugaucaacuggaucggauauuuagugucaugggguuuccugcagguaauuuauuuuccuuuuuaaagucauauuuugagucauauuucaaaaucauuucuucucaaaagcauauuuuaauguauauuuauaaacuaacauaauuaggagauuuuaaauuaacacauuauuuucuauaacaauauuuaauuuuuuuguaagauaaagacugggaagauauuagaaagaugccagaauaucccacacuucaaaaagacuuuagaagaacaacguaaguaauuccacacagucuuagucuuuuugugcugcuauaaaaaaauaccuuagacuggguaauuuauaaacaacaggaauuuguuuucucccaguccuugaggcuggaaaguccaaggucaaggcacuggcauguuuguaaucccaugaagguugcuuucugcuuccagggugacaccuuguugcuguguccucacauagguagaagggcaaaaaggggcagaugcugugugaugccucuuuuacucuuuuacaaggcauuaaucccacuccucaaagcaaagcccucaauucuggaaggccuuaucuucuaauacuguugcauugagaauuaaguuucaacaugaauuuuggaggggacauaaacauucaaaccauaguguacauuaauuauagguaguaauuucaaugagaauaguuaaauuaaucuuuuuaaaaaacagauguagauuguuauuuaaacuagaaacugagauuuuagcauauuaauuaugccugugauuuaaagaagauuuuccagauacuguuaacauauauaguucagguuuaggcugcaguauuaaaaacuuuuaagaauuuaagggucaauagguaguuuauaucugcuauguuuuagcaugaauaaaguucucaguucuaggccacaguugugguuuuaucuuuaucugaguaaugacuggugacugacaugcuggacuaggaaaccuggaaggcuggcagaaggaagaacacguggccuggaauaugaguaaaacaaacugaugaaggcauuuacuuugagcagaaaugagauuaagggugauggcaugugagguguuuguuauaaauaugcacacuuaccgaaaauuguggaagagcuucucuaugggcaacuuaccaggaaaauuucaggacaggauggcuuauaggaacaaaaucagacaucauaaagagaaauagagaauggcauugaucauuucuaaccccuuuuucucacaguccuuggugggguccuuugccuguauccaucucuuaaggacagugcugguaucaagguucuauccugggcucuuuucucacucuagguauuuucccauucagacucuaugauuuugauggccacaauuuaccaucaauuauguggauaacucccaauauguaucuuacucaguucacuuuuccaaguuucaaaaucauuuaucuaauugccuuauggaaucccaaccugaauguucuauaaauucuucaaacauucaaaaccaaacuaguuauuuucauuuaacauuuuauuguacccuuguucgcaaggguacaauaaaauggacauucuggccaggcacaguggcucacucacgccuguaauccucacacuuugggaggcugaggugggaagaucucuugagcccaggaguuugagacuagccugggcaacauaguuagacccuaucucuauuuuuauuaaaaaaaaaaauuauuacgcauaugcuacuggugaggaugaguacuucucaaacuucaguguaccuacaaaucaccuggagaccuuguuaaaaauguagauucugagucagaaucaggggugagaacugagaaccuucauuucuaaugcaggcucucaggugaugcucagguugcugguaaaagcuacauuuguguagcgagauucuagagcaccuaaaaaaggcuuuaaaauauguaugcccuuugaccugauaauuccuggaauuuauccuguggaaguaaucagagcugccacaaauagaugaguacuucuuauauaccaggguggugcuaaacccuuuaccuacauuuuuucauaugaucuuccuagcaaaucuauaggauaggcauaauuauaauuuccacuuuucagauucagaaccuaaggcuuucuuagagguuaacuaacuugcccaagaucacacaauuggugaaugacaaucagggucuaguaggggucucugagucucaccugcuaggcaguauuggcucccugccaugcacaucagauuuagcuacaaggacuuguaugccacagcuauuaugaaacaaguaauacccguaccaguaggagauaggcagccacucaaaauaauaaguuugaagauuauuugacaaaagaaaauguuuauggaacaauauuaaauaaaaagcuaagacaauuuuuuaguaggauuccaauuuuauaaaaacaaagcaaaaauuccuguguuuauaccauauauguauaugccacacacacgcaaaacaccaaagggacauuauaaaaauuuugucagugguuuuuuugucacugaguggcuugauugugagugauuuuaauuuucuucuauacuuucuauauucuguaauucuuuuuaucaugaacauacauuaccuauuuuuagaccuuuuaauuugaaauauuucauauguaggaaagaauauauaaugaaaaaauaucuaguauauuuagaauaauaaaaugaauaccccuuugcucaccucugaaccuaggaauuagaacaucacuaagauuacuaaaguacccugugugccccaccucccuauccacaucccucccagaggguagacucugaguguucugcauuuggguuuaucauccccacaguuuuuauuauaguucuaguccacauguuuauguaccucuaaaaguuauuguucaguuuauugucuuucaacuuuuuauaaaugguaacauauuauguauuuucuucugcaacuugcuuuuucuccucacugaaccuugcauauucauuuuuacuguuguauaacauuccauucugugaauguauaaaaauguacccauuuuucaguugauggacauuuggauugucuauauauauauacacacauauauauauauacacguauauauauauacguauauauauauacacacacauauauauauacguauauauacuauauauguauauauauguauauauguguauauauauguguauauguauguguauauauguguauauguguguguauauauguguauauauguauauauauguguauauauauauguauauauauauauauuggccauuacuaaaaggcugcuaagaacauuuuuaucccuguauccugauauacauguacaaaaucaucucuuugacucagguaugugccuagaaauggaguugcuaggucauaagcuauacacauuuucaacacuaaugguuaaugcauaacuguuuuccaaagggauuguaacaguauaaacucucauguugugugugacaguuccuauuucuucacacauuugcuaauauuugguaauguguuucuucuuauucagaaaaaacaaugacuuaaacacauaccuuauaggaaagccaauccuggagcuuaucauuaagaaauaucaauuggaugaguguucccagugaugugugacugugcguguccuugcagguaugccaacaguagccucauaaaguacauggagaaacacaaggucaagccugacagcaaaguguuccucuugguaggugcuucucucccagacuaaaaucugauucucagcacaaaucucgccuucuauuuacucagcuauuccuccucuuuagaaacaaaagaaauuaguggaugcugggguaaaauuaaauauuuuuuuuguugagaugucacccugucuuucagccuucacuuuaaaugauuuaucagcagaaaaugaacuuuauaagggcuuuaaugcugaugauuucugccaauuucacauaaaaguauguaguaugcauaaucugcagugagcuacaccaaauguauuuuauauuaauccuguuacacaguaauacaaaagacaagguguugacuuguaaauaaccuuuucaugugcuguacauuuccugugugucacucuagcuucagaaacuccugaccauggauccaaccaagagaauuaccucggagcaagcucugcaggaucccuauuuucaggaggacccuuugccaacauuagaguauguauccugucuuuucuguguccuuugcuccaggcugaggaggcugcauggugguugaaagcaagggaagcacuugcuacugaaguauuuaacuuuuucaaugauaccaccuaaagacugcucaagagcaagcuuccacauuuugaaacaggcaaagcugcagagagggaugaaugaaaacaaguauuuuaggaacgaccauuugucaguuuuacagaugaaaacuaaagcugauaacagauaagaccuuuacagaccaauuggccagaucagaaauucagccaaaccaguaggcaacagaaguuaaucugucuuucagagcauguccacugcacuacaaaaccucucuacuccuucauccuucuuaaccccaaguauagacuuuguguuuucaucuauaagagguguaguuuuucuuguuaaggcaaauacaaauuaaguuauuuuuggcgcuaaugaaguuaguauagagaaacuucuguguccuauaugucaacuagcuagcagcagucaagauuugaacacuagccacagaugaagaguaggaaauaagugaagaaaaacaaauuggaauuuuaaauuaacaagguaaugauauuacagauuuuagaucaugauauguuuuuucuuuuuaaugauuuuuaguguauuugccggcugccagauuccauaccccaaacgagaauuccuuaaugaagaugauccugaagaaaaaggugacaagguauaaacugcacgguauacuuucacuuccaaagagcaagggaggcaaaaagauaguuuagguaucguuccauaauuccuauacauuuaaccaccuuuucuaauauuuaauuaaauuugaauguaucuuauuuucuguggaaguuuggggauuguaaagguaccuugaaguuugaaguaugaccagcucacagauaccugagcuuccgguguguguuacagccaguucuacucccggauucccacuucuugcucuuucuguuuguuuggugucacuaccaccccuuuaugcaggcuggcuuuugcuagcaucacucuguucuuucgucuuaacuggauauauuggcucacucuccagaccgcucugccuuuccagaaucacgauugaaaagauuucuucuagcuguuuuaaugagcuauaagaaauguauuucuaaugugccuguggccuucagugagaugucugugacugauuuggaggaucacugugcagucuaaaugaacuucagggaaagaguccuguuuggggcucagcgccuugcccuuugggaacacuguguucccuggcugcuccauucuccaguccuccccaucacucuagugucccacauagauugcucccccagguuggucagcagccacaugugcauaucaaauaauuaaagaaagcuccuguuaauuugguuucauaccaagcuugcuuuuuuccccuuaaaagaaucagcaacagcagcagaaccagcaucagcagcccacagccccuccacagcaggcagcagccccuccacaggcgcccccaccacagcagaacagcacccagaccaacgggaccgcagguggggcuggggccggggucgggggcaccggagcaggguugcagcacagccaggacuccagccugaaccaggugccuccaaacaagaagccacggcuagggccuucaggcgcaaacucagguggaccugugaugcccucggauuaucagguacucccugaaugucuaauguucauaugcuuuaugaaguggggaaaagauuuauccuagauccuuuuagaguuaaguaacacuuaacucuuacauuugacugugcaauccuguuucuagggcauucuaugaagaggaagauuuucaucauauuucauguaauuguaagauaucucguauucugacuuguuuauccugacacccgaggagaggaagguagggaggccagugcccccauccuuaaagaaaauuucaucauuuuacccuuauagcugccuuagcaguucugguguaucagaaaaagauacguagauacgcaguugaaaagggaaggggaguggugucuuacuuuggacaaaauuaauugcauucuuuagaaagauaugcucuuucugggaggaaguagcuacauagauaaagaagagaagggggcuaagacugaggcuuuucugaaauaacuguuaagucucauuagaaauaauuuugagacuagaaaauacuuuuuguuauucagauaaaaagagaacaccaauugcagugcuaauucaggaaauuaaaggagcuaagucuaaggauugguauuuggagagagguaaaaauacccauugugauaaccauaggaaauuuugaaaaaaaaauuuuuuuucaagguaguaacaaguuaagaaaccaucuaggaagaagggaaaacuuaaguuuuuuguuuguuuguuuuuuuguuuguuuuaaguuuagaaccacagucccuccgggaacucuugcagaugagugcauaggauagagauaauagaaaacaaaaccucuggcaagggaaccauaaacucacugauaaggaacugcaauaaagagaaacuuuaacaagaaagacauaacaaauagcugcauaaacugccuucacauuuugaauagcucaacaaacuaauguguuuccacacaacuacucugaaaaacuucucuucagaauaucccugcaagcagaagaguacauaauacuuccacuugguuccaauuaaacaaauuuaggcuucaguuugaucuacuaaaaacagcuugcuagcuggguaguagcaugagcauauuugaauuuuguuauaaaaucuguuuccccuccauuauaugagcaacaaaugcuuacuauauacugguucaucuuugugugucugauugaauuauauuaaccuguguuaaaaaauaauaauaauuugccuaaacacuuguuaaaguugguaaggcagacuuuauucaaggcggggccauguuagugcauaaagggaccacugcaacaggggcuggcaguuggggaggaagacuggacucaauucagacuccuacaugacaaguggagagguauagccaaagagcaggguggggaucaguggauggaaaguuaccaagaggaaacauccaggauaaaaggucucuggcuaaacugacugcauaguauuaggcugaagggaggccuggguaauaagcuuuuaaaggugggggauuuuugccaagccaacuuagcaagauucuugcucuaacaggauucuccaaggacagaggaaagcccaaggucaggccuagucaagcagaagacucacagagcucccuccaacacgacccuguaaaacuucccuccagccucuuugcagacaacaccuccucuacugugcugccccaggcaacaacauguuuucauaccuucuguaauaaaccugccuuucuuuacccaaaaccaucuugguuaaaaccuugacugccugagagcagccugacugcaguuuuugucaaaggaaagagucuuugucacccaauuguagucaauuauagacagauuacuguauuucuuuuuuuccccaaauucaaacauucuuugaaaugcuuuucuauguccauauuguucuguugacuuaaaaauaaaccuuucauagcugaguccugaugucuguggaaaaaaauaauaaaccuuccaacauaucuauuaaaugaauagauacagcuauuuaguuggagagacuggcaugaggggcagucaggugucccauuacaccgaacuugcaacucauacaccaucuaggggccaagggaaaaacuuuccuuucacucucugaaaguucgcugaaaaaucaacucacaaaaggcagguuaauuggagaaaaugucaugggugugacuagcuagggccagugucucaggcagucaagguuuuuacuaagaguucuggguaaagaaaggcagauuuauuacagaauguaugaaaacauguuguugcaacagacagcauagcagagggaggggcugucugcaaagagcaggggcuggaaggaaguuuuacagggucuugcgggagggagcuaugugccaaaugaggucauugugcccaccaguuguuugugacuagcagugucucagaacaauuguucauuguuuuuccccaccuggagccccuuccuccuuguugcuuacuuaucaggacagaaaggcauacaacuuugauaccagugggcugagggagguccccagaugcuggugggaccucaaccccacccuguguccaggcuccuaacaccaucgggagaaggaauuaaaggaugagucaaaaauagcaaaaguauggagauuuauugcagagggaaaaguacacaacucaagaaaggggaguguggguauacgcaagagagaaucuggcuggggacaguggcucaugccuguaaucccaacacuuugggaggcugaggcggguggaucaccugaggucaggaguucaagaccauccuggccaacauggcaaaaccucgucucuacuaaaaauauaaaaauuagcugguugugguggugcaagccuguaaucccaacuacuugggaggcugaggcaggauaauugcuugaaccugggaggcagaggugcagugagccgagaucgcgccacugcacuccagccugggugacagagugagacuccaucugaaaaaaaauaaaugaauagagagucaugcagucugguuuggguuucuaucuuuauggguuucuuuaaccaaaggguggaauauucaugaaaauuccuggaaaaagggggagauuucuuggaacuguggugccacccauuuuuaugccaaauauggauguucuuggaacugucauggugcuggugagugugugauuuagaauguuaaugagcauauaaugauguccuagguuuuuaagcagaaauucaaaguguguuucauguagucuuuuuuuuuuuuuuuuuuuuuuuuuuuuugagacagagucucacugugucacccaggcuggagugcggugacgugaucuuggcucacuacaaccuccaccuccuggguucaagugauucucaugccucagccucccaaguagcugagacuacaggcauguaucaccacucccggcuaauuuguguguguguguguguguguguguguguguguguguguguguauauauauauaaauaauuuuauuauuauuauuauuuuuuuaaguaaagacaggguuucgccauguuggucaggcuggucucaaacuccugaccucaagucauccaccuuccuuggccuccuaaaguguugggacuacaggcgugagccacugugcccggccagaaauuguccauuuuuaugguuuagggucaacaaaguguagacagccauguagaaacaugauuggacagaagggguaugaucugaugcuaauagacugagggggaaacccaacauggccugucuagguuccuguuggucucucuaagcgugcauuccugccucuggguguggggcaggacccccucugggacaggagucucaugaccuacagucagacaggauaugccagaucauuucuuuauguccaguuuuuacacagaaagguagggggaaguuagaguaauauuuuuagguuucacagcugguguuggggaagugggguucugguuucuauggcuugccuuagggaaggggaauucuaguuucuauggcuggcucugaggagaaugggacugugagacaagagggcacaaaaaggucagagaaaaacuuuugcuccugaggccuucauuuugggguauuguuuucugugccccaacaguuccauuaguagaguuucaaggcuuuugagcugcuucaucaauguauuguaagcaaguacaauuagcgcuuugaaaagcgggacauuggcuuauuuucugucuaaaaaacccuuugucauuaaaaaagcuauguuacagcacauuagauucuuacauguuuacauuauacuuuauggcaaaauugccccaaauaacguaugaguugaaagaacauuuuucauaauaaacuucaaaauaaaacacguaauuaaaauuuggaauuuuuaaagacuucuguaaccaaugugacuauucaguugugcaacuuaggaaggggcaaaacuaaguuuuguuuuguuuuuuuuuuuuugagauggagucucccucugucgcccaggcuagagugcaguggcgccaaucuugacucacuacaacuucugacuccuggguucaagcgauucuccugccucagccucccgaguagcuggaacuacagggacccaccaccaugccuggcuaauuuuuguauuuuuaguagagaugggguuucaccauguuggccagacuggucuugaacuccugaccucaggugaucugcccagcucagccucccaaagugcugggauuacaggugugagccacugugccuagccacaacugaguuguuuuuaaccaaaacuaccuuagugcccuguuaucuuggaccagauauuccaagucguuuggcagccuuugagcacugagcaggaggaccuugcugaucuguucuuuccuaaacccccagugccaccucaagauaauuuacauguuuaacucaaaguguaaccgcccgacagguucuucuugcucgcugcccagauagagccaauuuaucaagacaggaauuucaauagagaaaguuuaauacacauagggccagcuaaaugggacaucagaguuuuauuaucagccuccucaaaauuuggaggcuaggauuuuucaaagauacuuuggugggcaggggucuagggaaugacuacugcugcuugguuggggaugcaaucaaaggggugugaaaaauggucuuccugugcugaguccacuucugggugggggccacaggacugguugagucaugagucucagucuggguggagucauccgaaaugcaaaagucugaaaagccuucugaaaagguugacaauagugauguuauuuacaggaguaauuggggaguagccaauugaccuccagaacaaugacugguaauuguuuaacugcaccuacaucuuagcagaauucaggccucucucauaauccuaaacuuguggccuuuuaguaguuuuauaaaggcaguuuaguuuugggauggacuauugucguuuaaacuauaaacuaaauuucucccaaaguuagcuuggcccaugcccagcaaugaccaagaacaguuuggagguuaaaggcaagauggaguggguuaaaucagaucucuuucacugucauaauuuucuugcuguuuaauuuuugcuaaggaaguuucaaaaguaauagcuuuauuacauauauucuuucccacuuugcuuacaagaaaaaccagccuucugaauauagccaaagauacuacuuccagcuaugcuugucucuuacauacuguucuuauucuauagaugauuuuuccuuuuacacauuuuuuuuguauuugcguuagguacuaugaagaugaagguuucauuuaauguaauaaaaauacauugaauugaaaugcauuuuucugucuucucuugaagacaaucauaugugaaaauugcuuuauucuaaauguuaccugaaguuuauaaaacccacauguugcugccgcaccccaccuaaucuugccuuacuuugucucguagguagaacuccugauaccccuagcuucuaccucugaaaacccuuugcucuaaaauaaugauuucuuaaucacagcuuuguuauuuauaaugggaaaaauaauagcaugucaguauacauuaugaauacuauugauuucaguaugccaaauugauuauucuuguuugcacgucucaguuaugcaaaggauuguuacaccccagaauuggaauaaagagaaauggguccgcugaaauuuccccuuuuccuuucuuuccaguguagcuuaucucccacaaaaaucuagccaaauuucaugccugccagaaugugugguuacagugguggcaggcugugauuucaaauaagcaaaauguguuaacaacuuaaguuagcugucagcuaugugugucugaaccaggaaccuaaugaaaacggcuuauaucucuauccuacugugaugagcaucuugagucauccucuuccuccaucaguaauucccuuuuccuguuuccuucuccuagcacuccaguucucgccugaauuaccaaagcagcguucagggauccucucagucccagagcacacuuggcuacucuuccucgucucagcagagcucacaguaccacccaucucaccaggcccaccgguacugaccagcucccguugggccaggccagcccagcccagagcacaggcuccagcaauaugucugcauugaaaagaaccaaaaaaaugcaaacuaugaugccauuuaaaacucauacacaugggaggaaaaccuuauauacugagcauugugcaggacugauagcucuucuuuauugacuuaaagaagauucuugugaaguuuccccagcaccccuucccugcauguguuccauugugacuucucugauaaagcgucugaucuaaucccagcacuucuguaaccuucagcauuucuuugaaggauuuccuggugcaccuuucucaugcuguagcaaucacuaugguuuaucuuuucaaagcucuuuuaauaggauuuuaauguuuuagaaacaggauuccagugguguauaguuuuauacuucaugaacugauuuagcaacacagguaaaaaugcaccuuuuaaagcacuacguuuucacagacaauaacuguucugcucauggaagucuuaaacagaaacuguuacugucccaaaguacuuuacuauuacguucguauuuaucuaguuucagggaaggucuaauaaaaagacaagcggugggacagagggaaccuacaaccaaaaacugccuagaucuuugcaguuaugugcuuuaugccacgaagaacugaaguaugugguaauuuuuauagaaucauucauauggaacugaguucccagcaucaucuuauucugaauagcauucaguaauuaagaauuacaauuuuaaccuucauguagcuaagucuaccuuaaaaaggguuucaagagcuuuguacagucucgauggcccacaccaaaacgcugaagagaguaacaacugcacuaggauuucuguaaggaguaauuuugaucaaaagacguguuacuucccuuugaaggaaaaguuuuuaguguguauuguacauaaagucggcuucucuaaagaaccauugguuucuucacaucugggucugcgugaguaacuuucuugcauaaucaagguuacucaaguagaagccugaaaauuaaucugcuuuuaaaauaaagagcaguguucuccauucguauuuguauuagauauagagugacuauuuuuaaagcauguuaaaaauuuagguuuuauucauguuuaaaguauguauuauguaugcauaauuuugcuguuguuacugaaacuuaauucuaucaagaaucuuuuucauugcacugaaugauuucuuuugccccuaggagaaaacuuaauaauugugccuaaaaacuaugggcggauaguauaagacuauacuagacaaagugaauauuugcauuuccauuaucuaugaauuaguggcugaguucuuucuuagcugcuuuaaggagccccucacuccccagagucaaaaggaaauguaaaaacuuagagcucccauuguaauguaaggggcaagaaauuuguguucuucugaaugcuacuagcagcaccagccuuguuuuaaauguuuucuugagcuagaagaaauagcugauuauuguauaugcaaauuacaugcauuuuuaaaaacuauucuuucugaacuuaucuaccugguuaugauacuguggguccauacacaaguaaaauaagauuagacagaagccaguauacauuuugcacuauugaugugauacuguagccagccaggaccuuacugaucucagcauaauaaugcucacuaauaaugaagucugcauagugacacucaucaagacugaagaugaagcagguuacgugcuccauuggaaggaguuucugauagucuccugcuguuuuaccccuuccauuuuuuaaaauaagaaauuagcagcccucugcauaauguagcugccuauaugcaguuuuauccugugcccuaaagccucacuguccagagcuguuggucaucagaugcuuauugcacccucaccaugugccuggugcccugcuggguagagaacacagaggacagggcauacuucuuguccuuaaggagcuugugaucugugacaguaagcccuccugggaugucugugccaugugauugacuuacaagugaaacugucuuauaauaugaaggucuuuuuguuuacuucuaaacccacuuggguaguuacuauccccaaaucuguucuguaaauaauauuauggaaggguuucuaugucagucuaccuuagagaaagccagugauucaauaucacaaaaggcauugacguaucuuugaaauguucacagcagccuuuuaacaacaacugggugguccuuguaggcagaacauacucuccuaagugguuguaggaaauugcaaggaaaauagaaggucuguucuugcucucaaggagguuaccuuuaauaaaagaagacaaacccagauagauauguaaaccaaaauacuaugccccuuaauacuuuauaagcagcauuguuaaauaguucuuacgcuuauacauucacagaacuacccuguuuuccuuguauauaaugacuuuugcuggcagaacugaaauauaaacuguaaggggauuucgucaguugcucccaguauacaauauccuccaggacauagccagaaaucuccauuccacacaugacugaguuccuaucccugcacugguacuggcucuuuucuccucuuuccuugccucaggguucgugcuacccacugauucccuuuacccuuaguaauaauuuuggaucauuuucuuuccuuuaaaggggaacaaagccuuuuuuuuuuuugagacggaguguugcucugucacccaagcuggagugcaguggcacgaucuuggcucacuccaaccuccaccuuccagguucaagugauucuccugccucagccucccgaguagcugggacuacgggcacgcaccaccacgucuggcuaauuuuuguauuuuuaguagagaugggguuucacccuauuggucaggcuggucuugaauuccucaccucaggucauccgccugucucggccucccgaagugcugggauuauaggugugagccaccgcacccaguugggaacaaagccuuuuuaacacacguaagggcccucaaaccgugggaccucuaaggagaccuuugaagcuuuuugagggcaaacuuuaccuuugugguccccaaaugauggcauuucucuuugaaauuuauuagauacuguuaugucccccaaggguacaggaggggcaucccucagccuaugggaacacccaaacuaggagggguuauugacaggaaggaaugaauccaagugaaggcuuucugcucuucguguuacaaaccaguuucagaguuagcuuucuggggagguguguguuugugaaaggaauucaaguguugcaggacagaugagcucaagguaagguagcuuuggcagcagggcugauacuaugaggcugaaacaauccuugugaugaaguagaucaugcagugacauacaaagaccaaggauuauguauauuuuuauaucucugugguuuugaaacuuuaguacuuagaauuuuggccuucugcacuacucuuuugcucuuacgaacauaauggacucuuaagaauggaaagggaugacauuuaccuaugugugcugccucauuccuggugaagcaacugcuacuuguucucuaugccucuaaaaugaugcuguuuucucugcuaaagguaaaagaaaagaaaaaaauaguuggaaaauaagacaugcaacuugaugugcuuuugaguaaauuuaugcagcagaaacuauacaaugaaggaagaauucuauggaaauuacaaauccaaaacucuaugaugaugucuuccuagggaguagagaaaggcagugaaauggcaguuagaccaacagaggcuugaaggauucaaguacaaguaauauuuuguauaaaacauagcaguuuagguccccauaauccucaaaaauagucacaaauauaacaaaguucauuguuuuaggguuuuuaaaaaacguguuguaccuaaggccauacuuacucuucuaugcuaucacugcaaaggggugauauguauguauuauauaaaaaaaaaaacccuuaaugcacuguuaucuccuaaauauuuaguaaauuaauacuauuuaauuuuuuuaaagauuugucuguguagacacuaaaaguauuacacaaaaucuggacugaagguguccuuuuuaacaacaauuuaaaguacuuuuuauauauguuauguaguauauccuuucuaaacugccuaguuuguauauuccuauaauuccuauuugugaaguguaccuguucuugucucuuuuuucagucauuuucugcacgcaucccccuuuauaugguuauagagaugacuguagcuuuucgugcuccacugcgagguuugugcucagagccgcugcaccccagcgaggccugcuccauggagugcaggacgagcuacugcuuuggagcgaggguuuccugcuuuugaguugaccugacuuccuucuugaaaugacuguuaaaacuaaaauaaauuacauugcauuuauuuuauauucuugguugaaauaaaauuuaauugacuuug

SEQ ID NO: 192132 - RNA, 134211 nt, Homo sapiens
acguccuccagccccgcucccgacgugaggggcggggcuugccuggaggcggggcgcagggauccggaaacaccugaucaucuauagguuuagugccuaauggguguuguuccuggcuggacuugauguccagggccugagggguuuucucgccgagucuccuggggcgguccggaggcucgugcccuguuguggggcccccauuugccgccgccaugcccacggccgccgcccccaucaucagcucgguccagaagcugguucuguaugagacuagagcugugaguacccccucgcggcggggcgcaggcgggaggauggaugucugccgguggguguggggccguaggacagaggcuguacucugccuccuccuccuuccucuccaguucccaaaucccugucaaacacagccuugggguaagcuagcucccuugagcugugccugggcgccuuuccccuauuuugguacccuggacauugcagcauuugcagguccacuuacaagccauggcuggaacacgcuggaaacaggugcuugugguaccucaggaacuguucaugagguucucuguacgaguuacuggauucuuuucagcuuucagaaagucuguuaaaguucuagaguucacaaguuacaguacaggcagggguaugaaaaaaauuugaacuaugacuuguaacuuauuuuuuccuauuccaugguauaccaucacugcgauucaugugaauuacacuucuauuggugaacuuuuugguucucuuuuuuucuuauuugaaaggaaaggaaaacuuacuuuguuuaaagacagauaauuuguuuggauaacaucuugcuuuucacuugacuuuuuucaacauaacauuuacuuuuaaaauuuuauuacuuugaauggccauguaaauagugaauaagcagaucaguuuguauuucgauuaccaguuccucaauuaagggagaaugguguuuauauaacuucauacuugguccuuucuguggguggaaagcaaaguugguacaguauagcucuucuaaauuggggugccacagugauauuagggacuguguuuaauauuacccauuucaugcuaacaagauugcauaugccagauauuuucauaaugcucuucacuauguuauagagugcuuuauaaacuguuucucugaaacuuggguugucuccauuagaggaguaugagaaggcauuuaacaguuucucaguuauaacguaguccuaauagcacaauaaccucucccucagguuaacaugaguagagaauuguggaccuuaaauuaauuuugcugacaacuuugauuagaucuagagcagaaaaugacauuaucaaauauacuguauuugcaaguauuuucaguucucuaaugagacccauaaagaaguaucauuugucauugaaaugaaaccuauuuucuguaaaauaugcugcuaaauuucccucauuagaaacauaaauaacuuuuuuuuuuuucccuuugagacagagucuugcucugucacccaggccggagugcaguggugcuaucucggcucacucacugcaaccucugcuucccagguucaagaaguucucgcaccccagccucccaaguagcuaggauuacaggaaugugacaccaugaccggcuaauucuuguguuuuuaauaaaagacagggauucuccauguuggccaggcuggucuaaaacuccuggcuucagccucccaaaguguugggauuacaggcaugagccaccgcaucuggccguaaauaaaacacaaauuucagcccauuaaaaagcugaucacucaugaggacugcgugagauauuaguguucagaaagcacaauucauauuauagggcucuucugcucagaaaucuucaguggucccaauucugaagcaaguaaacucugaaucccuuaguuggcauucaaagccauguauuauuuguccucaacuugucuaucuaguuuuacaucuaauuuaauaucaauuaaugaaacauuuauugaggaucaaccaugugccuucauaugccuuauucugcaguaaaacuguauugcuuucaguucccuauaucugcccuguguuuuucugcuguucucuauucucuuaaugccacacccccucuuuuccugucaaaaccuugcugauccucacagcacauaucuggucaugccuugcaaacaguagucucucaauagauguggauuaaggagcucuaacacaaagagauagagguguguuccagaacucagcugugaccccucucaacugccuaaguaauggaaacuaacucuggccagcuuagagacaaaagguaaauuuaucagagggaugcuaggggagccauugcaugguauccagcuucuggaaaagcaggaaagagauaacagguuugagaacccucucagaguacugccaaaaacaguguaggugcugggagaaaaaaucugaucgacucaacuaugauugguuaucauccccugaguggacaaaucauucauggccagggggggucuggcaggaaugauuuagcuguggaaucaggauccucuuuguuucagcaaaugguuggggcugggcaaccacccuugaaaaugucugcugcauugaaucacugagucucgguuuuguuaaauaauuuuuuuuuuuugguuaaagauauaagcagaaagguuuuguuuuguuuuguuuuguuuuuacuaauaagcucaaaguauaaauaaauaagaaaaaggcauaaaauuacaggcaacuggauaaaugcuaugaauuaaaaaaacaaaaacuguaguagguuguaauaaugaggauaauagcucaaaauauucuacauauauuuuauuauuuaauccucauaagaccucuaagagaucaugcuguuaauucuacuacuauauauauuauuuaguaaagaaaaaaaaugaggcaaagauaauuuaaggcaguuacuuaacccauuuaugccagagguugcaaauuuuuuugugugaaaaaucagaccuuugcgaugaccuugagcaguaggauauaaauaacucccacaagcuuagcguuccaauaacggaacacuaggcauaagguguggugcaggugcuaagaauguauacuggggaaaggacagucucuucaauaaaugguguugagaaaacuggauauccaugugcagaaugaaauaaggcccuucucucuugccauauccacagaucaacuuaaaauggauuaaaggcuuaagugcaagacccaaaacuguaaaacuaccagaagaaaacauaggggaaaugcuucaggauauuggucuaggcaaagauuuuaugaguaagacuuuaaaagcacagggaacaaacccaaaaauagacaaaugggacuauaucaagcugaauagcuucugcacagcaaaagaaacaaucaacagagugaagaggcaaccuauagaauggagaaaauauuugcaaacucuucauccaagaagggacuaauauccagaauauaugaggaauucaacaacucaacagcaaauacccccagauaauccaauuaaaaaugggcaaggaucugaguagacauuucucaaaagaagauauacaaauggccaacagguauaugaaaaauuacucaaggucacuaauuaucagggaaaugcaaauuaaaaccacagugagauaucaugucaccucaguuaaaauggcuauuuucaaaaggacaaaaauuaucaaaugcuggugaggauauggagaaagggaauucuuauauaguauuggugguaauguaaauuaguauagccauuauagaaaacaguauggagguuccucaaaaaacuaaaaauccggcagucccacuacuggguguguauaugaggggauuucaaaaaguucaugggaaaauggaauuaaaagauaaaaauaacaaauguaaacuuuauuucucaagcuaacuuccgucaaggucaagacauuuuuguaacuaaugauaccagccauuuaauucauccacaaagaaccgaggguccugggaauuuaaccauauuggugcagucuuuuuuacucuguuaacuaaagaaaaaugggugcccuuuaaggauucuuuuuaagaugaggaaacaaaaagaagucagaaggagcaaaauuggaacuguaaggcagaugccuaauuauuuuccauugaaacucuugcagaauucccauguuugaugagaggaaugagcagcagcauuguugugguggagaaggacucugugauggagcuuccuggguauuuuucugcuaaaguguuggcugacucucucaaaacacucucauaauaagcagauacuguucuuuagcuuuccagaaagucaacgagcaaaaugcagugaauacacacacacacacacacacagacacacacacacacacacacacaauguugccaugaccuuuccucuuggcccgucugcuuugcuuuaauuggaccacugccaccuguugguagccauugcuuugguugugcuuugacuuuaggaucauacugguaacgccauauuuaauacaguucuuugaagaaaugcuucaggaucuugaucucacuuguuuaaaauuucuauagaaggcucugcucuugucugcagcugaucugggugaaacagcguugggagccaucaaguggaaaguuugcucaacuuuaaauuuucaggcagaauuguguaaguuguaccaauugagaugucuaugguguuggcucuuauuucugcuguuaaucaucuguucucuuuaaucagggaacaaacaagugaauuuuuuuccugaaaaauuuacauggguggucugcugcugugggcuuuaucuucaacauugucucaucccuucuuaaaguuauucauuuguaaacugcauauuucuuuggggcauuguccccauaaacuuuuaauaagcaucaaugauuucacccuucuuccacccaaguuuuaccauagauuugacguuuguucauguuucaauuuuagcagaauucauguugcucugacgggcuguuuucaaacugaucuguuauccuuccuaguacuucaaacuagauccuguucagacauguuauagcaaguuaguaucaguuuauuuuggugcaaaaaaauuuugaaauccauagcuuuuuuauaauacgcauuuuccaugaacuuuaucaaguccccuuauauauucaaaagaaaggaaaucaguaugucaaagacauaucagcaccuccauguuuauuguagcacuauucacgauagcuaagauguggaaucagccuaaaugugaauugacaggugaauggauuaaaaaaugugguauauauacacacaauggaauacuauucagccaggaaaaagaaugaauuucugucauucacagcaaauauggaugagucuagaggacauuauguuauaugaaaucaggcaggcacagaaagauaaauguucucauucacacgugggugcuaaaaaacgauguugagcuuauagaagcagagaguagaauugugguuauucgaggguaggaaggguaggaaagagggaaugauagggagggaggguuaacagauauaaaauaacagcuacauaagaggaauaagcucuaguguuuuauagcacuguaggcugacuauagguaaauaauuuaucauagauuuucacuuagcuagaagaaaggauuuugagugaucccaacacaaagaaauuauagauguuugaggugauggauaugcuaauuacccugauuugaucauuacacaguguacgcauguauuaaaauaucacucuauguuucauauguacaauuauuacauguuaccuaaaaaagggaaaaaugaggucaggagauugagagcauccuggcuaacacagugaaaccccgucucuacuaaaaauacaaaaaauuagcugggcaugguggugggcgccuguaguccuagcuacucgggaggcugaggcaggagaauggcgugaaccugggagguggagcuugcagugagccgagauugugccacugcacuccagccugggcgacagagugagacucugucucaaaaaaaaaaaaaaaaaagggaaaaauguaugauucaguagaucaggauuuugggagugacuuagcugagugauucuggcucagggucucaugaagucgcagucaagauucaacuggguugcagucaucugaaggcuugaaagaaauggcagauuuacuucccaaauagcuaacucacgugccugacaaguugagcugacuguugacaaggagcuuugccuucuugcaucauggacauuuccacaggacuccuugagugucuguccuuauaaugugguagccugcuucauccagagagaguuaugcaagagaaacaaggaggaaacugcaaugucuuuugugacugagccucagaagucacacucuuaucauuucuacaauauucuuacacagguuagcccuguugaguauggaagggggccauacgaaggacaugaauaccaagagacaagaaucauuaagaguucuuggaggcugcagagauuaaaguucacuuuugucuguaccucaauugucccauaucauuuguaaaaaugacuauccuuuauugaauuucuuuggcauccuuugaaaaaacuaguugacugaauaaauguggaucuuuucuuaaacucuuuccauugaucaauuuuuuuuuuuuuuucuaagacggugauuugcacugucgcccaggcuggagugcaauggcacgaucucggcucacugcaaccucugccuccuggguucacacgauucuccugccuuagccucccggauagcugggauuacaggugcacaccaccacaucuggcuaauuuuuuguauuuuuaguagagacgggguuucacuauguuggccaggcuggucucgaacuucugaccuugugauccgcccgccucagccucccaaagugcugggauuacaggcuugagccaccgugccuggccuguuuuuuuuuuuuauuuuuuuauuuuuuagugucauuaccaacuugucuugauaauuguaguuuuauaguaagucuuaaaaucaggaaguuuuccaacuuuauucuuuucccaaauuauuauggcuauucuagaaccuuuguguuuccauaugaauuuuacaauaggcuugucaacuucuaauaaaaagccuguugggauugugauuugaauuucauggaaucuguagaccaauucgggauaauugaaauuguauaaucuagaaagaggaacacuuuuugcuuccccaucuugaugccauuuauuucuuucucuugaccuauggcccuggccaggaccucuaguacaaaguugaauagaagugaccggaacagacauucuugucuuguuuuuuaucuuagagggaaaguauucagucuuucacuguugaguaugauguuagcuauugguuagauacccuuuuucagauugaggaauauuucuugcuuuggucugaugagacuuuauaaaaaaauugugaguggauguugaauuuugucaaauguuuuuuucacaucugcacaugacauuuucuuuauuugcguauuauggccaauuacauuaauucauuuucaaauguuaaaccuuggauuuuggagguauacccuacuugaucaugauuuauuacuguuuuuauauauugcuagauucuauaugcuaauauuuuguuaagaaucuuugcuuuuauuaauacauucaggauauuggucuaucauuuucuuaaugucuuugucugauuuugauaucaggauaacucuagcuucauaaaaugaguuaaaaaguguucauuuucugaaagugauuauaugauugguauugcuucuauuuuucaauguuugcuaggauucaccagugaaagauuugugaauagaguuccuuuguggggugaauuuugauaaugauaucaaucauuuuccauaacagauauagggcuauacacauuuucaguggaccuagaaucaguuuugacaaauuauauuuuuccaggaauuuguucauuuuaucuuaguuguugaauuuauuggcauuaaguugcccauaauauucccuuauaauccuuuugaugucuauaggauuuguaguaaaauuuucacuuuuauuucugacauugguguuuuguguucucuuugauuuugcuuugauucaucuugcuagggauuugaaagaauaaacuuuugacuugguuaauuuucuauauuguguauuuucugguuaauuaauuucugcuccuaggcuuauuuuuuuuccucauacgcgguuuuuuuuuguuuguuuuuuuuuuguuuuuuuuuuugagacggagucuugcugugucgcccaggcuggagugcaguggcucgaucucggcucacugcagccucugccuccuggguucaagugauucuccugccuuagccucccaaguaacugggacuacaggcccacgccaccaugcccagcuaauuuuuugaauuuucgguagagacaggauuucaccauguuggcuagccuggucucgaacuccugacuucaagugauuugccugccucggccucccaaagugcugggauuacaggugugagccaccgugccuggccucucaugugcauuuuggauuaaucagugucuuauuccguucaggcugcuguaacaaaaucccaucaacuaguuggcuuacgauuuucacaguuuggaggcugguaaguccaagaucaaggcacuggcagauccagugucuggugaggaccugcuguguccacacacaauggaaggagcaaauaaggcuuccuugaaccucuuucauaagugcacuauccccauucaugagggcucugcucucaggacugaaucacuuccaaaaagucccacuucugaauacuauugcauuaaggauuagguuucaacauaugaauuuuaaauguuugggaggacacagacauguauaccauagcaaucaacuuaucuuucucuagcuucauaagauagaaauuuaugccguugacuuaauuuuuuucuaauauaaaacauuuaaaacuaucaauguaaauuuaaaaguagucaaaagauuaaugacagauggugaaagucuuaguagccugaacaacagauaaagcaguauauccuuacaugcaaaaauaucuuauaaaaucaaucugaaaaauaaaacacccaauaaaaaggacaaggauaucaacaaguagcucacuaaaaagaaguuugaauaugaaaaaauguucaacuugcaaauaauuaaagcaauaaaaugaaaauagauucccuuuuucccccuguuagaauggcaaagauuugccaaagccguugcugggaaguauuugaaagaaaugggcauucuuauuuugguugguggggguguauuagagguugaguaucccuaaucugaaaauaugaaaucugaaaugcuccaaaauccaaaauuuuuuuggacaugacaugacaccacaagugguaaugccaacaacuguggauuguccacauggguggcugagcuagugaugucuuugcuuucugaugguucaguguacacaaacuuuguuucaugcacaaaauuauuuaagacauuguguaaaacuaccuuuaggcuaugucuauaagguguauaugaaacauaaaugaauuuuauguuuagauugggucccauccccaggauagcucauuauguauauuuucaaaaucuaagaaaacagaaaaucugauuuacuucugguuccaagcauuucagauaagggacacucuaccuuuaauuaguuauaaaggaauuaggagacacauuaagaagcaaaagagccaguggacaagaugggcugucucuuguccugagccuucauuuagaaauauaauuggguagacuugcucuggaggcgaaguucaggucguuauuguucucuguguauagagguggauuuugaggaauauuuggagaggaaagggagcuguguuggcagaugacaugcaggaaguguaguucuagcuugugaggguuggcccuuucccaaacuaaccuauucuuuuuggcaccuagcaccuucaauaugcuccuuagcucuugugacucgucugugguccuaauaugccuuguggcccaggccuaacgcagcacuaacagucauacagcccagugcaacuaggaguuuccagcagagauucagcaaccugaaguuauccugggugaaauugcaguuugccuuuacaagaaggugcccuugcuuaauaugugaugacauagggaccuuagcaucacaauaagugaccauuucauaacaaagaaaugaacacauaauaguugacguuaaaauugguagcuaaacagaacuaggucugcaugugucuauuuagcaggggacggggagaugaaaguuguuaggauaauuuuuacucuuacuuguucaagauuguuagcauauauguaugcauuuauugccugccuuguuccaaaaggauuuaaggaagcucccucccacccccaucacagaaaguagaauaaaacaagaaccacauggugaggaaaugcaccuuucuuaauuagccuugauuuguguaaucagugaaugggagagagcaauauaggguguaguugacuaaggauuggaaaaggaaaccaaaguauauaaagugagagagagaaacauagcgauuauauuaauaacugguuuagagugugugguuggaggugacauucacauuuguuucuacagaggauuugaagcuuccccagaguaaagcccugaaggucaaauggauagacuugcagaccucucuugagacucacuucccccuucugggcggcauuacccaauuacugggauuacuggacuaagugaggaggcaggcuugcaauacuguuagauugggagaagcaacuucauggugcucuuuacaaauaauacauuuaaucugaaaguucaggugaaguuuaacaugaauugaagcugucauacaaccuaaaauuucuuucaagaaggcugauuuuccucccucagaugaaaagugagugauuaauuagccugucauuauaaaagaagauaauguuaguagauacugaauuuccuguuaaauggauuaccuauuguauucuauuuggauuucacauauauauuuuagaaauacucaucuuuauaccaagucaccucuauuaaagcuauauugaaauuguaagcuuuugccugaacaaugacacuuaacuuucagaagagagccagcuuagcucaucuucuaucuuaacagguauuauuucaauguagcuuuucucuuugguauccuaauucuccaccugaacuccugccaaaucccaagccccagcauaucuacaaauacacaaaccuuuucccuagugguguugauucguaggcaccuacuugcauguauauaugccuuuagggagucuggcugaggcaugccugaucuauggaaauccugugugcuccaguuacugcucccuuuccuucccuauucuuggauauuuuauuuaucuccuuucccuaccauuugaacuaggggcccuuugcuucuucagacucugccaauacuugagaugacuuuucugucuucuuucaaucccuaguucuuacuacaaauuuguaauaaauugaacccugacuuuccccuagauguaaaaaucucucaacacauucacaccccuuaaguauucuucuggguuucaucuugaagcaauggcuuuaguccggacuggaugcucccaaggccugcacuacagccgccauucugggguuucccuucaccguuacccuauaucauacucucuaugacaguuucccuguuuuccuggaucccaucacuuccuguuucuugauuauggccucguuuugguagaguacuuccuuuaauuacuucaugagaaaggguucauagaaguucauuuuuuuuuuaagcccaugaguaucuaaaaauguccuaugccacccucagguuugauugauaaaauaaauacugaauuaaggauuggaaugaauuuuccuuuagaguuuugaaggccuuaugucauucucuuccaccuuccagcauuguugcugagagcuucuaauguuacucuguucuugaucuuuaguuugaagcuuguuuuuuuuucuuuucagaagcugugcuaacuucuuuuugugcucucuucuuuuuaucuucuucugacacuacagagguaucaggggcuucaaauucccaagccuuuuggagguucuauuguguaaauuggauugcuucuugacuuuaccauugccaguuuaggagucagcuuuguuacacaugcuuuucaguuucaaaugguuuuuauuuuucuccuuuaucuucuuuguuccuccuuuugcucuuggggcuugagccuaaaaacaaacauaaaaaacuuuacuaugguuuuaguaagauguuugggaggaccagagguguccacuccuccaucuuuauccaggauucuaccuguuuugcaccucagacaucucuguuguggaucuugcccccucucugucccugagacugcccacagaagggccacucacaagcgccugucaucagaugcucuguccuuaucgacuugacuucucagcagcaucugaugugacugcuuucuccuuucccagaugaucuuucuuugcuuugacgaguccaccucgugcugggguuuucucauucaccagccauuccucccaaucuucucagcugguuccuucuccguauccagccucuaaauaauggaguuccucaggcuagcuuuuuugggcucucgucacucucccuacucucucuaguagguuuaacccagucccauggcuuuaaaugcugcauacaugcugauggcacccacugagcucuuuuacccacugaguucucacuuggccucucugggcauguugugaacagaacucuugguuucccuucaaaccuguuucuucuccagucaucucgacaucaguaaguggcaccaucaucuagcuaucugcuuaaagguaauuggaucuauuacucuccuuccugaucccaucuaccaguaaguuauauauccaaaauauaucuucaguuuaucuuuuuccucaggcaucgagccuagugccugacacauaugaggcauuuacuagucagugguccaaugagugacaucaauagaaacaccaagaaaauguauguaaaaaaaugugggcuuggggccaggcaugguggcucaugccuguaaucccagcacuuugggaggccaaggcagguggaucauuugaggucaggaguucaagaccagccaggccaacauggcgaaacccugucucuacuaaaaauacaacaacaacaaaaaaaauuagccacgugucauggugcacgucuguaaucccagcuacuugggaggcugagggaggagaauugcuugaaccugggaagccaggacgcagagguucuggugagccaagauuacaccacugcacuccagccugggugacagagugagacuccaucucaaaaaaaaaaaaaaaaaaaaaaaguaggcucuuuaaaaauggggaagucaugaaaaacaaagccugaugaacuauucuagauuaaaagauuuaaaaagauguaacauaacuuuacauaaagauagguaguacaugauccuugauuagauucuggcuuuaucaaauccagcuauagaggguauuauagggagauggggggaaaauuggaauauaaauuguacauauauauuguauugaugauauuaugauuauguguuacgauaccugcaacucauuuccagagguucagaggaagaaagcaucuaucaggagugggggagggagaaaacaaaugcaacaaaauguuaacaguuggugagucuagaugaaggguauauggguguucguuguacuguucuguugucuuugaagauuuuuuuaaauuaaaaauugggaaaaaaaucaacaguggagaaaaauuuaguggagggaaacuuuagggaaauuuuuaauccccaaaaugcugagguccauuuugaagcauacuauuaaauguaacaaaggcugaggauauacaguguugauauauucaauaggaaggaaauaagaacgaguagaaacaaggccuuucuggaaguuaccucuuaaaaaauuggugugaaaguggauggucagcugcccaccagagggcagugcaggcagugauuccgcggucuacaguaggccagcugaaaagcagggguuuucuuucccucauaacuggcuccacaugaggucgcuauucucugcacaaaacguuuuuaggauucuuagacuguuugagaagagagagaaugcggguagguauagugcuucccauuucuuucccuccacucugaucuauuuccagauucuguggguuuuagccuuuggcuccucugauucauggauucuuuggaaggaucuagauauuggaaguacagaucugccuuccuaaguauguguuucgaaguccaauaaugcauuugcccaugagcaugucaggauuuauaucuguuuuuaaaaucacaaacugccaaaguaucaucccauugcaauuaaucuuuagguuucguaggauuuauuaaaauucuguacaacaaaccccugugacaugaguuuaccuauguagcaaaccuucacauauacccccaaaccuaaaauagaaguuaaaauuaaaaaauaaaauucuagggaauuucauuuagggauuuuaccucuuuuaaaccuaggauguuccuccuuacugagugguugacuuaaaagagccauuuuucuaugugcuuacccagaaaagcuggguuaguguaaaugucuuagaaaauuacccagcacaugaaaugauuacucugugguacauaguuguucuuucaccuaacacuuagcuaaugccugaggcaccauauugugcuacuagacuaggaaauuaaaauccacagagguuaaggaguuagccccagucucccgaggugcuuauaguagggggcagacaagccccaaacaaauuuagacaagacuuucagaaguaaguacuacauuuagguagaaacaaaagugcuuuggggagaacaggugaugaguagggauuggugcagguggacaugggugguucacuggccuugucuuggcucagugcccaaaguccugcuuagagguuccucaaggccaaauucagaaucaggacaacaccagccugcucugaccauccccagauaagucaaaugcccuuccuguguucucauggcaucuaguucaugccucuguuauagcaugcuauucaugauugucaauuugcaugcucuucucucccgaggacauagacugacuacuaacagauuggcgcauuuucccauugugaguccauucugguccugaacaugcuuuccucccuuugggcuacucucuguuuuccucuggcguuugucuuuuuccucaaauacaauggcauagucucacugacaucuuacaaagugaaggacagaaaaggaacuaacacuuauugagugucuuuuuugugcugacugcuguggucacuguguuaggugcuuugugaacgaacauuuucucgcuuauucuugugccuguaacaaacauaccaucuucuucccuuuucaguucuuugcaauugcuauuuccucuccuagaagccauuuuuuaaguccucaagaagggcucccuuuucugcuaacaagcacguauaguuuacaaaccauucuucuuaggugaacgcuguuagauugguuacccccucuccucucagugguggguagggugucagggacaggaauuagcugaagccuggcugagauucuuugacuuccuuucucuuccuguuugccugucugucuaacugcacccccaguacaucgaauccugucacuggaugucccaacuuaguuuacuaauuuuuauuauaauugcuuuauuucuaccucauuauaacucauagugucaucuagacuguaccucuccuaggagaugugggauugaauuucuugacuagcuuucuucuugaggucaggcuaacccaucauuuuuaacagauuguuuugcucuucauaacuuaucaguaaaucaggccuuuauaaacugauguguguguguguguauauauauauauguguguguguguguguauguguauauauauauguauagguauauauauacauauauacauacauauauacguguauauauauauacauauauacacauauguauacauacauauacauauauaccuauacauauauacauauauauacauauauauacacauauauacacauauauauacuuaauaguaaaaauuccauguauuucuacagauuuaaaguuaaaacaguauauccaaguguucauguuguaauauacaguaaauucuuaccuuuuaaaguguuaccuauucuugaagguucaauucuagacccaacuugucugacauuuuucucaucuauaguaagccacauuaaucuuuccugcgcugauuuccuauggucuacaugcuucauuuuggccuuuaauaucgaaagacuuguuuguuauuuaguugcuuuguguaucuacaccuuauauguccaauaguaaauggcacaaugugaguugauuauggcaguguuuucucaauuuuugcaauguuuaaaaagugucacuuuuuaaaggacuuuuugaagcgaaauaucuuuauuuuugcuaaugaaguacuuauuuuuuagauauaauuuuagaauaauucauuucauuuaguuuuucuuaaaagcauuuucauuuaaauauauuuuucuacauuuugauuauucauuuuauucucaguauucuuuuuuuuuuuuuuacuuuuaaguuugggauacaugugcagguuuguuaccuagguaaaccugugucauggggguuuguuguacagauuauuuugucacccagguauuaagccuacuacccacuaguuauuuuuccugauccucucccuccucccacccuccaaaagaccccagugucuguugcucccucuguguguccauguguucucaucccacuuguaagugagaacuugcaguauuugguuuuuuguuuuugcauucguuugccaaggauaauggccuccagcuccauccauguuccugcaaaggacuuuuuuauggcugcauaguauuccaugguauauauguaccacauuuucuuuauccagucuaucacugaugggcauuuagguugaauccaugucuuugcuauugugaacaguacugcagugaacauacacgugcaugugucuuuauaauagaacaacuucucuuccuuugaguguauacccaguaaugggauugcugggccgaaugauauuucugucuuuaggucuuagaggaauugccacacugucuucuacaaugguucaacuaauauacauuccugcuaacaguguauaaguguuccuuuuucucugcaaccuuuccagcaucuguuguuuuuugacuuuuuaguaauagccauucugacuggugugagaugggcuuucauuuugguuuugauuugcauuucucuaauaaucagugaugcagagcuuuuuuuucauaugauuguuggcugcauguaugucuucuuuagaaaagugucuguucauguccuuugcccauuuuuuaaugauuuuuuuucguguaaauuuguuuaagucccucacagaugguggauauuagaucucugucagauguaucguuaguaaaaauuuucucuuauucuguaaguugucuguuuacucucuugauaguuuauuuugcugugcagaagcucuuuaguuuaauuagaucccauuugucauuuuuugcuucuguugcaauugcuuuuggaucuucaucaugaaaucuuugccugugccuauguccugaaugguauugccuauauugucuuccagaguuuuuguacuucuggguuuuacauuuaagacauuaauccaucuugaguuaauuuuuguaugugguguaaggaagggguccaguuucaaucuucugcauauggcuagccaauucucccaggaucauuuauugaauagggaauccuuuccccauugcuuguuuuaguaagguuugucaaagacuagauaguuguagauguguggccuuauuucuggguucucuauucuguucuauuggucugcgugucuguuuuuguaccaguaccaugcuguuuugguuacuuuagcccuguaguguagcuugaaguuggguagcaugaugccuccagcuuuguucuuauugcugaggauuguguuggcuauuugggcucuuuuuugguuccauaugaauuuuaagauaguuuuuucuaguucugugaaaaaugucagugguaguuuaauaggaauagcaucgaaucuguaaauugcuuugggcaguauggccauuuucacaauauugauucuuccuauccaugaacauggaauguuuuuccauuuauuugugucaucucugauuucuuugagcagugguuuguaguucuuguagagaucuuucaccucccuaguuagcuguauuccuagguguuuuauucuuuuuuguggcaauugugaaugggaguuugucccugauuuggcucuuaguuugacuguuguugguguauaggaaugcuagugauuuuugcacauugauuuuguguucuuagacuuuacugaaguuguuuaucagcuuaagaaccuuugggcugagacuguuggguuuucuagaaauagaaucauauuaucugcaaaaagggauaguuugacuuccucucuuccuauuuggauaccuuuuauuucuuucucuugcccgauuacccugaccagcacuugcaauacuauauugaauaggaguguugagagaagacauucuugucuugugccaguuuucaaggggaaugcuuccagcuucuggccauuugguaugauguuggcuguggguuugucauauaugguuuuuauuaauuugagguauguuccuucgauaccuugcuuauugaguuuuuaacaugaauggauguugaauuuuauugaaagcaucugggucuauugagauaaucaugugauuuuugucuuuaguucuguuuauauggugagucacauuuauugauuugcauauguugaaccaaccuugcaucccagggauaaagccuacuugaucguaguggauaagcuuuuugaugugcugcuggauucgauuugccaguauuuuguugaggauuuuugcauugguguucacaaggauauuggccugaaguuuucuuuuuuuguuguaucucuaacagguuuuguuaucaggaugaugcuggccucauagaaugaguuagggaggagucccuccuccucaguuuuuuuggaauaguuucaguagaaaugguacuaguucuucuuuguacaucuucuagaauucagcuuggaaucugucuggaccuggauuuuuguuuuguuguuguuguugucauuuuuugcuuguaggcuauuuauuacugccucaguuucagagcuuauuacuggucuguucagggauugaguuucuucuugguucagucaugggacgguguauauguccaggaauuuaucuauuucuucuagauuuucuaguguaugugaauagagguguucauacuauucucugaugguuguuaguauuucuguggggucagcguuaauaucccccuuguugcuucugauuguguuuguuugaaucuucuuucuuuacuagucuagccuccggucuauauacuuuauuaguuuuuaaaaaaaaaaaauagcugccagauucauugaccuuuugaaugguuuuucgugucucagucuccuucaguucagcucugauguugaguauccuuguuaauuuugucuugaugaucugucuacuauugucagugugguguuaaagucucccucuauuauugugugggagucuaagucucuuugaaggucucuaaaaacuugcuuuauuauggccaggugugguggcuuaugccuguaaucccagcacuuugggaggcugagauggguggaucacaaggucaggagaucgauaccaucuuggcuaacacggugaaaccccgucucuacuaaacaaaauaaaaaaaauuagcuggacgugguggcaggcaccuguauucccagcuacucaggaggcugaggcaggagaauggcaugaacccagguggagcuugcagugagccgagauugcgccacugcacuccaggcugggcgacagagcaagacuccaucucaaaaaaaacaaaaaacaaaaaacuugcuuuauuaaucugaguguuccuguguugggugcauauauauuuaggauaguuauaucuucuuguugaauugaacccuuuaucauuauguaaugccauucuuugucuuuuuuuuuaaagcuuuguugguuuuaacucuguuuugucagaaacuagaauugcaaccccugcuuuuuucuguuucccguuugcuugauagauuuuacuuugucccuuuauuuugagccuguggguuucauugcauguaagaugggucuguugaagacagcauacugaugggucuuaguccuuuauccaguuugccacugugugccuuuuaaaugggguauuuaguccauuuacauucaagguuagaauugauacgugugaaccuaucaucaggauguuagcggucauuuugcacacuuguuuaugugguugcuuuauagugucauuggucuguguacuucaggguguuuuucuaguggcugagaauggucuuuccuuuccguauuuagugcuucuuucaggagcucuugcaaggcaguucuggugguaacaaauucccacagcauguuugucugaaaaggauguauuucuccuuugcuuacgaagcuugguuuggcugcauaugaaauucugaguuggaaauucuuuucuucaagaaggugaauauuggcccccaaucucuucuggcuuuuagggcuucagcugagagguccacuguuaguuugaugggcuucccuuuguaggugaccugaccuuucucucuagcugccuuuaacauuguuucuuucauuuggccuuggagaauaugaugauaaugugccuuggggaugaucuucuagugaguaucugacugggguucucugcauuucuuuaauuugaauguuggcuucuuuagauggguuggggaauuucucauggaugauauccugaaauauguuuuccaaguugguuccauucucuuucugguauaccagugagucguagagucagucucuuuacauaaucccacauuacucagaggguuuguucauaccuuuucauucuuuuuuuuucucuauucuugucuuauuucagaaagccagucuucaagcucugagauucuuuccuccgcuuggucuguucugcuauuaguacuugugauuacauuaugaaauucuuguaguauguuuuucaguucuaucaggucagaaauguucucuaugcuggcuauuuugucugucauguuuuaucaugauuuuuagcuuccuuggauuggguuucaacauauuccuguagcucaaugaacuucauuucuauuccuauucugaauucuauuucugucaugucagccaucucagccagguucagaacccuugcuggagaaaagugcaguuguuuuggaggaaaaaaggcacuucuggcuuuuugaguugucagaguucuugcacugguucuuucucaucuuugugggcuaauguuucuucaaucuuugaagcuguugaccuuuauauggccuuuuuuucuuuuauccuauuugaugaccuuaaggguucgauugugggaucagguggauucagucgacagguauuguuucuggaagauuauagggggccaacguucagcugccaacuccuggacugugugcucuaacucuggaauacucguauugggcucugacuuuguucucuggcuccucgagguuagguauccgaugcgcugagggugccaacguguagugacugcuggucacuaugcuuugauggguggugucagccaaagcauuucauggugcgguggcggugggauauguccucauucgcaugugccaguggcagcgaaagcaugguggcugcagcaggaugccagcaggugccugccuccaugugggcauucacagcagcagcagaggcagcauggcugagggggcgggggaggcccugcuggugacugugcaugcagucaucauggugauccuguuagcacaggggcagggcacugguaggugcaggucuauauacacucucugugugcugcaggcagugguggucacugagggcuggggaagguccacuggccucugugcauaguuucauucccauggcagcauuggcacaggggugggaugaggacggggcaggcuggcucugugcccaccaaggcuccagcugcaauggcagugcagcugaaggagggagguggauugcacccccaacugcagcaguggcaggacaggguacaugcgcacacgugcacugguagggcaaggaagacaaaacccaccugcgcacacacauguuggcagagugauguuggaaguggcagugagccugcgggaagcugcaguggagggagggagagggugggcugcuggguggccaugggggccaccccacuagagcucuucaccaaucaggugccaguccaccagcacagggucucugaugcaggcccccaggacaccuaaggcuucccugcaagcagggcuggggcccugggagagaggucagcagaccaaggggugcucagguugacuguccagucugaugggcaagagcgcccugcagaguucagguccgacaguuccccuagggcuaaagucuccuaugggaacaagucaacccuagggggaugagugucccuggcugugcuccacuacaaacgcucccauaccaaacccucugggcucugcauaagccagcguguugccccuaccacuucucugagcagcucuuccugccaacucgagugucugugauggucagggagucuccuucugucaggauuccagaggccuuggcgagaguaaguuucuccuuaccaguucaacucacccauucccccagagucacugggggccaggaaugaaugccagugcaugguagucccaugcaggguucccagcuucuucccucuucagcccagcuucugugucuucccuccaccacucucagugccuucccucugaagaucuguuaggagugcuccaguuguccuggucccuugguggcagcuguuccgccuggcugccucuagucagccaucuugcccagcaccccuucaguauuuauuuaauaagacuaaugugauuguguuuagucagaacgcuccaaggaacuguuuuaggaaagaaagaaugaugauaauuucuuguagcuuaucuauaaaaggucauuugggaaggacaaccauuuuaaucauuuaugggacuuuuggguagauuuuauaguuacuauauuaaagacauuugcagacauuuaugaaaauuuguaaguaguuuuuugauaagcugucaguacuuuaguagcuauaauugccuaagcguuccuaauuauauguugagcuuuagaauuuuuaccagagcuucuuccugguaaagcuuaaacaucagccuccaaucaguuagauuaaucucuaaauuuaugacaauuaaauucaucugaccugguuacugggcacauuucagacaucagacugaucuuuaucaugaaaccacuaggaauauuuuaauuuuaaaauugaccuuuuggagucagcuuuucuuuaaucugccaguuauacauaacagaaauauuucuuuaaaaaguaaccugacuuuauuaauguauuuaauuucaaaaacuaaagugguauaaaauguguauagggcaaaaugcuuugauaaacuaaugacauuccuuuuuauuuauagagauacuuucuaguugggagcaauaaugcagaaacgaaauaucgugucuugaagauugauagaacagaaccaaaagauuuggucauaauugaugacaggguaaguauccuccaaaccugacugcaaaaaaacuuucauaccuguuguuuaaaggacaugaaauauccuuacaguuuuuagugauauauuauuuuuaucauaaaucuaaaaguuuccguuauuuuucuugguuggcuagaauuugaaucuccaaucugauuucuagaaaucacuggugucaagaaguacgccagaauuauacuuugccccucguuuugacuuguuuucgaaaacacacucuuaggauaagauaaugaguauuguuucuuaaagagggcugacauuuuaaggauucaguguaacuuaauauuguaucugccaaagagacgaucuguuaugguucuuuaauaucaagcuacuugaagucagggaggacuucuaugcuacagacuuuauuuuccuccuaaaaaucaccucuaggaccuuuacugaugauuugcuauacacuaaggaaauguuaagcuguucuuauccagaguuagauuauccagagucaagaauacagaggcuggaauucagauggcacaaaaaccugaagcuguuagucaaaagugaaauacuauauggugguuugaacaguuaaguuuaacuguucacacaaaagaacucaaguuaucuuuuguguugaaauuccugucugugacuauuucggaauccauaaagauuccugguuucucaaauauguaguaacuacaguuuggaauccauuuucacuaagcuacuuguaacaaaacuauuuucuguguuguaauaauuuuagauaaauucuuuguuacgauuucccaugcuacuccugggguccauucugcuccccaccuaucugagcauuuuuaacaauauaauguaaugguucuuggcuuuauuuggagaucggagcaauuggucagagagcccuuugaaauguuaagaaaaucuaugggccuucucguuaaagaugcacauuuacucaaaauuuugcacauaguuuuaagggauucauggacucuugaaauuuaccuguagaucccuuaaaucucugcaucucugguuuagaguauaagguuuggacauuuuuuuuaguauagcagcaugauccaauaaccaaccuuaauugcuaauguuaaagaacuuguuagcuuuuuaaaauuguagcuuacuuguguacuauuauauacuucuguaugaaauagcugaugaugcuuguagguaacuuuuuaacuuucaggcacaaauaauaaauaaucuaaaguuuaagcacaaccuuacagaguaaaugugcuuauucuuagcaugucuauacucaacaagaaguaagggaacuucuuggccgcuuggaucuuggaaauagaacaaagaugggacagaaaggauccucgggcuuauuucgagcgguuucagcuuuugguguuguggguaagaaaucugccccccuucuuacaaucucuuguuuuuuguuuuugucuucucuacauagacuacuuaaaggaguuuauaaggcuauaaggcuuuaaaauuauaauuaccuguagcuuugguuauuuaaaacuucauuauccaucaaucagauagcaaacagcguuucuguagcaucugcuuaugcacuuagcacugcucaguuuuauuuaggauacaaacaaauaucaaaauguuuuuggccuuugaggagguugcugucugucucauugaugaaugaaaaaguaaaaauuagcuuggacuggacuguaaacauccacccugccauucgucagcuggaguaacaaaucacguaaaacuggauuuaaaauuaauaggaauuucuccuaagguuagucuauaguuauaaaaugucauaacccccuucuuuggaugacugcuuuuuuuuuuuuuuuuuaacucacugagaaacuuugguuucuaaaaucacagaccaucagaaacuucacuguuugaaauuguguuaguaagauaaaacaucccacauuuacuuggacaacccaagucacugugacacagagaagcagcuuugguuuaccaacucaggugcagagcuucagagacgagguuucugaacacaguaguccauagauaugaugauucuguuguuuucaaggaaacaggacccuuggucuacuucauaguccaaacgugauauugaucucuuuaaauaucaccuugcuuugguuugagccucuucauuuaaauuuuaccugagcuccaccuuucccccaauucuguaauaacuccuuuacuuuagcaagaugcuccaugguuucucugauaugcauugucccuccuuguggugaaucaauaaaccugucuuuacuguacuauggguuugucccugauuggucuguggcagaggauaaaauccaauguacaugaaacaacucuaagauuauaaguaagagccaagcuguguaguaugaauuaaaugguguuggaggucacagaagagguaaauuacuuggaccuggaauggccagggaagauuuccuauaguagaugagacuugagcuguaccuugaaggaggaacaagguauggauaaaugcagagaagaaaagagggaacuccaguaagggugacagcagaggcacauacaugaagguacccagaggugcugggaaugcuggggaguagucaggcaaggccagauugcuuugggcuuugaaagccaaagcagagggcuauuguauuuuagcaucucugcugccagcaccuuauuuugagucuuuuuuucuguaaacacuuaggaaauuaucucuguguuucuuaaaccuacuggacuguguguaauauuaagugguuguauugguucguucucgcauugcuauaaagaaauaccugagacuggguaauuuauaaagaaaagaggcuuaauuggcucaugguucugcaggcuguacaggaagcauagcagcuucugcuucuaggaggccccaggaaacuuacaauuauggcagaaggggaagggacagcaggugugucuuagaugacuggagcuuaauuaaggaauggugggggaggugccacacauuuuuaagcaacacuuuuaagcaaccagaucucaugacaacucuguaucacgagaacagcaccaaaggggugguuguaaaccauucaaucauccauccccaugacccaggcaccucccaccaggccccaucuccaacaauggaggauuacaauggaacaugagauuugugugaagacacaaaugcaaaccguaucagugguuucuacagauauuaacaaaauuaauauggacuugacuaugcuauauguuuuucagauucuuauuuugggucuucuguuuagcacuuucuauuuugugacuguaugucuaugaaaacuuugauuauauucugccauccuuggaguuugcuuuucuaagaauacugucguugcucuucauacguaaucccuuuaggcucauuuuguguguuagguggcugcaggggaagguaaagaguaguauaacaugacugguuucuucuccucaggccuggccccuuuucuaugccuuuugcuuagucuugagaaggcccuugagguuacauguugaauggaugaguguuugugggaauguguaugucuguaugugucacgugaguucaugugcuuaaaugccauaaaugccaguauguuaaauuccacuuucaguccugcuuauauuuuaaauuuaagaaaaaaauacuguaaauaaaauguguuuaaaauauaguagacucuaauuuaaauaauaguuacuuaauaguuuaagcuuaaauguugauaccuuauuacauuuuuuuuuuuuuuuugagacagagccuugcugugucacccaggcuggagugcaguggcgcgaccuuggcuaacugcaaccuccaccuccugaguucaagccauucucgugccucagccucccgaguagcugggauuaccagugugcgccaccaugccuggcugguuauugcauuuuuuguagagaugggguuucgccauguuggccaggcugaucucaagcuccuggccucaagcaaucugccugucucagccucccaaagugcugggauugcagaugugagucacuaugccuggccacaacuuuuuugauaggcauuucauaauguguauauacuauugaaugccuuauuggccagauuuuauuauucauaauugaaguuuucuugaugauuaaauguaacgaagugaaaaucacuuauugaacuguguggguuuuguuuuguguguuugugucuguguguguguguuuuuuuuuucuuugagacaggaccuugcucugucaucuaggcuggaauacaguggccagucauagcucgcugcaaccucaaccuccugggcucaaaugaucuaccugccucaggcuccugaguagcugggacuacaggcauaugccgccacgcccggcuaauguuuuuucuuuucuuuuuuuuuuuagaggugauggucucacuuuguuuuccaggcuggccucaaacugcugagcacaagcaauccuccugccuuggccucccaaaguguuaggauuacaggcauaagccaccgugcucagccugaacuguguuuaaaaauagcuguccuuggguauuccagaguuguauugggcuguuugacuuuacauuaaauggccucuagacugcuggacucuuuuguuuuuuuuuaauacuuuggucaccuuuuauuguucuugacauguuugcuuuuagcauauuccuagccucauuuuuaaucuauugauaaccaagcuuguaaaacuagaacuuuucuuugaaucaauugauaaccaaguuuguaaccagacguuuaauuuacacacaaguuuugguuaauaaacucugggugagggcugaaggugucuccauguuucuuuuaaaggugacauucuuagcuauuucuguugaaguuagagcccuuuuagcuuugagacugugcauguauggugaagucauuguaagauuaaccugcaaguaaaguaagacaauaacguacugguaaacauuuaguauuuuuauggaaaugugccuuauguguccuacuucagucauguaaauaaaguuaagaauccaugaaaaguaaacagggaguaauaaaagucuaugauuuuucuaguacaagcuuagaaauguaguggauacugaaauuauuaacacaaaauacuuaucuuugaaaaauguguagucuaguuguuaaaauaacacgugugaaaugacuagaaugguuguguucuauucuguggcuaaaauauuuucuucacuaacuuuuugaacaugcugaauugguggaaaauauuuuugguggaauguuuuggauuguugucaugguuuauuuaguacacaugucaugagaaucuagaacaauacuucucuaggaucuguaauaaaggaccauuuuucucccccucccucacauauaucacauguugcagaccaacaccacaugugacuuaaaacacgaguuuaauacuauccaaacuagucuaugcccugugugagggcagauucacugaucaugcacacagauguuguggggcaaucuaaauuguucuaaaguuucuaaauccuucgucucaauuuguuuacuugucuuuucacgggccgguucugaaagcucauggaccagcacuggucccuaggccauguuuugaauauuacugaccuagaggguuuuccuugcuauaaacggauugauccaguccuguagcugccuggccaauuccugaucuguuccuuuguuauuugacagccagcaggaaguuugggaaaccacuggaugggaucgugagcauccaucacuaaguuguuuuaugugguccuagggcacaugaauggaaugaccuauaguucauacuacucaguucuguuaucaucccagcuccuuuugauacacagcccuuagguacguguccuuuuucugccacugucgucugucagacgacacucuucuaagccucuaguauguugaaggggaguggcaaaauaagaaguaucaauacgguacacugugauggacuaagcuauuguuuaaaacaauacccuuacaaauagacugcagauccaagauaacagugaaaacaccaaaaaagugugagucucagacuaguuagggggcaguaugauuugguaguagagaugucacuuugguuccagagagcucuguuguacaaaggcacuggguaccuugcgggggguuuuguccuucucugcuggagugcuguucucaguggaggcuuucaagauaauagcuggcuggcauggugaccccccauacaggauauuacacuauucccuguuagugggcugaugaggguccucuccagccaccagaauugcauacuacuccauucucucauauuguccuuuuuaauauacuuugcuuggcuucccucucaagugacacagccuuuuuuauuuuggagagagaaaucacuuuugcaugacgaccaucaucuugucuucuggaaaguacucagugaaauuggucuggggucagaaguacauagaaugaagaugaagaaacuuguucugguguucaucauguuagaaggaugaacaggcugauucuugguggaugucuaugccaagcugaagccuuuaauuguugagagacauuuccaauugguaguaacaaggaaguggaaaauaaucucauuuauaauauacugaagccauuugugcuggaagaagagugucucuuuugugcaguauguuuacuuucccuuauacaaauuaugaagggaaguguagaaugauauaaauagccuggugcuaaaaacauaaaauuaaaauucaauuagaaugcagguugagagaaauuauuacuaagaauuuuuaucuaaaaaauaaauauacagcaagaauaaaaggaaaacuaauuuaucuuguaaauauuuauuauuuaaucccaauuacauuccauuuuuaaguuuuuuggugugugugcugcuucugaaaugcuuacuuuuguaaguuuuauauuucugaaaggaugacuacuuccuaaguugcuuuuaguaaaguugucaucagcuuuuuuuuuuuccuuccuucccauuccuguguccuccaacuuuagugaggucauuuuuggcgagucucuaaccuuuuuuaaaaaacacuuuguguuuuguggauuucuaaaauaccaauauuuuucauuauuuuaauagcauuuuuuucgcaguggcauggccgauaagauucuugaggcaucuuuccauuauagauuucagcucauucauguuaauguauucaauuagucauucuuuuuucaucagcugagaauaacaagacauagaucauagguauuugccaauucuagagcaaaaauucagacagagcaccaggauccuagcuuagacuuuauagacuauaacacucugagagagagacacacacacacauacagagagagaaacaaagggaauguauguguaagaaaguucauuuugaaagauagcuagauauaagauucuuauauauauauauauauuuuaguacuuuauggcaucccucuucauucuggcuuucauugcuucugaugagaagacagcuguauaugacuguaucuagcuugcccugugagugagugagcugggcagggaugggaccuuguguucuuggccugacaugccuggaguagagccucuacccugugagucggugcuugguugaaggaaggagcccagaccuuagccaugcuugccuggaauagagcuuuuacaacacagaguugguggggaugagaaaagcugguggccuaccccucaugagcagcaauugugguccuagacugggagcuggagagagaggaaggagcccugccuucuuggcggcaccugcccagaguagauauccugucaacgcugaacugggaggcaguguggaaggggagcaggccaugauccaaaugccacagacuugcuguucuuaacaagauuuauuagauuuucuuggauaaauguuucuccacuuucuguaugcccuuagggcaguuuccagaaacuuuuaauguuuuccuuuguuuuuauuauuuuuaguaguuaugguuguuuuccuaggaaagagucugcugagcuccuugcauugcuauuucagaagugucaccucuuccccaccaccaagaaaguuaguuuuaacucccaaagcaaaguucagggaaccugaaaguuuuugaccaagauuauauggcaacuaguguguugcugagaauauaaugcugcugaacauuaauguauauggcucuuucuuuagucaccaauauagaaccucuauauucuaaugaucugacauaaaauauaacucuauuuauaacucuccaauauucauuuaaaaacugaacuaucagaaaugauauuuguggaagauugcaugaaggauauguaauuuacuugauacauuguuuuguuugcccaaccuauucacuuuccagggaacuggcaccauguccccuggccucaucuaggccaccuaguuaucauauaaaauggcuuccaaugcugcaugauucuauuuuuuggccauaguugauugguccugggcugggccccugacccaaguugggucaguccaaguucuuccccaggaauucugaaauugaacuugauaaaaauguccuuuucuucccaguaaagguuuuggauggaaagcccagagcugucagcaguuguguuuccuaccacaugauccagagaaguggaggagcuuggucuauggagagagagaagaauggaguagauguucagagacaucuugacuaggcuuuuucugaggcccagucacacuguuucccauguguggaauggaucacuucaggauccuuaauauaaauuccuuuuuuuaguuuaagcugacucaaauugguuuuugacauuaauuaucaagaguccaugaaguuuguucuuuugggcaauauuucccaaaauauguuccucagaacguauauccauugguuuuuguuguuguuguuuuaaggcggggggugggaggagguuccacgaacaaacgaaucuggaaaggcacuugguuuuuaucucccaucaagauucacgguguacuuuagcacaguccuauaagguucucaggauuuuuguuuuaaguuucuuaguccaguauuauuugcucacugccacuccucuccccccugggauuccauuaacuaauauuucauggagaacacauuuggggaaauguuaccagagauacuuagauuuuuaucuucagaugaaauuagaccuccguucagcuguguaccuugccugcauucuucuaguuuguaaagaaugacauuuauugaauugugccuuggcauaugaaacagcauugagaaaugugugcuugacaucgcuggagaauucuccugagguuguucucuacagcacauaucuuuuuauguggacucacucugaaauugucucccaguucuuguaacugcuguagcuucuccaaguagugguuuaguuuuuaucuuucagccacugugcaugguauaauuggauguguguuccucuuugcauuaucuguuagaaaauggagagccaaauguggggaauaguacauaggaucuuaagaugcauucuuauguacaacuuuuauuuuuggacucaucuuacuauguuuuuaaacauuauuuccuuuacuguaauuuccucuucauuuuuauaauccuuuguguguguguguguguguguguguguguacauauauauauauauauuuaauuuugguaaaaaacagaauuuaccgucacaaucauuuuuaagugcacaguacagcaguguuaacuguaugcaucuugugcaacagaucuugagaauuuuuucaucuaugcaaaacuaaagcucuauacccauggaacaacaacuccucuuaaucuuauaucuauuugugcuuaaggcaccucaguccuauuugcagugagacuaagaggaaugaaugaauuaaauuguuuagaguaauuuuuuuuuaaaauuuaaguucugggauacaugugcagaaugugcagguuuguuacauagguauacacacaugcuguggugguuugcuguaccuaucaacccaccaucuagguuuugagccccacaugcguuagguauuuguccuaaugcucuuccucuccuugcccccaccccucgacaggcccuggugugugauguuccccucccuaugucuauguguucucauuguucagcucccacuuaugagugagaacaugcgguauuugguuuucuguuccugugucaguuugcugagaaugaugguuuccugcuucauccaugucccugcaaaggacaugaacucauccuuuuuuauggcugcauaguauuccaugguguauaugugccacguuuccuuuauccagucuaucauugaugagcauuuggguugguuccaaguuuuugcuauuguaaaaugaugcugcaguaaacauaugugugcaugugucuuuauaguagcaugauuucuaauccuuuggguauauacccaguaaugggauugcugggucaaaugguauuucugguucuagauucuugaggaaucaccacacugucuuccacaaugguugaacuaauuuccaccaacaguguaaaaguuuuccuguuucuccacauccucuccagcaucuguuguuuccugacuuuuaaaugauuuccauucuaacuggugugagaugguaucucauugcgguuuugauuugcauuucuuuaaugauaagugaugaugagcuuuuuuucauauauuuguugguugcauaaaugucuucuuuugagaagugucuguucauauccuuugcccacuuuuugaugggguuguuuguuuuuuucuuguaaauuuguuuaaguuccuuguagauucuggauauuagcccuuugugagauggauagauugcaacaaucuucucccguucuguagguuaccuguucacugugaugauaguuucuuuuacugugcagaagcucuuuaguuuaauuaaaucccauuugucaauuuuggcuuuuauugccauugcuuuugguguuuuagacaugaagccuuuguccaugccugugucuugaauaguauugccuacguuuucuucuagggauuuuaugguuuuagguuuuauauuuaagucuuuaauccaucuugaguuaauuuuuguauaagguguaaggaagggguccaguuucaguuuucugcauauagcuagcugguuuucccagcaccauuuauuaaauagggaauccuuuccccauugcuuguuuuugucagguuugucaaagaucagaugguuguagaugugugguguuauuucugaggccucuguucuguuccauuggucuauauaucuguuuugguaccaguaccaugcuguuuugguuacuguagccuuguaguaugguuugaagucagguagugugaugccuccagcuuuguucuuuuugcuuaggauugucuuggugucuuggcuaugagggcucuuuuuugguuccauaugaaauuuaaaguaguuuuuucuaauucugcaaagaaagucaaugguagcuugaugagaauagcauugaaucuauaaauacuuugggcaguaugggcauuuucacaauauugauucuucuuauccaugagcauagaauguuuuuucauuuguuuguguccucucuuacuuccuugagcagugguuuguaguucuccuuuaagaggucuuucacgugccuuguaaguuguauuccuagguauuuuauucucuuuguagcaauugugaaugggagaucacucaugauuuggcucuguuuagaguaauauuuuuaagugagguaaaugucaguauagauagucuuagagaauaauccuaagacaccugaaaauuuguauggcuauaaaucauagaaauaauaaagugagaaauguaucaaaggucuuuggccuuuuaaauaggcaucuaaaagccauuacuaaguuuauaaagcauauuucucuuuauuuuuuguugcauagguuuugucagguucuuagaaggcuauuauauuguguuaauaacuaaaaggaggaagauggcggauauuggaggucaugcaaucuauaaggucgaagauacaaauaugaucuauauacccaaugauucuguacggguuacucauccugaugaagcuagguauguauggugguaacuaccuuuuuuuuuuuggagacaaggucuugcccuguugcccaggcuggaaggcuggaauauaauggcauggucauagcuugcuguagccuuggccucccaggcucaaguacuuuuuuuuaaugucguagaucagguagaaaauaaaauacaguuuagauauuaugaauguuauguaaaaagaucaaauguuggcucagaauuuuagaauuuuuguuaagagcuguuaaagacuccauuauagcaauuggcaagaaucaacaauggcuacuauuaggugagagguuguuauugaggaauagaauaaucacauagucccaacauuuuaaacuccauggaucucuuuguuauuuacagaggaauaaguauuuuuaugaugaaaaaaacagcagacauucuuauccaaauaaucaaacuucacaucaccaauaaugagacgaaacugacauuguuugacucucagugggaaggacacaguuuaccuuaguaguuaaauauugcuaaaaauauuuaacuugaaucuaagcauggggaaauaaucagauaaauacauaccacuggacuuccugcaagauaacuggccuagauucuuaaaagaauguaaaagucaucaaagacaaaaaacaaaagacuguuccagauuuuuaaacagacgugacaacuaaaugcagauuuuggucggauucuggguuaaaagugcauguacuuguacacacauccucacacaaagaucuaaagggcuuuauuuggacaguuuguauguggacuacauacuagugaucuugaaucaguauuuaaauuuggaguauaauaaugguuugcggucacugaggagauuguccuuguuuauaacagauacaugcuaaaauacuuaggagugaagugucaugaugucugcuacuuacagucaagugguuuagaaaaauaaaauguauuuguauauuuaaagagagauaauauuuguuuauguguuuaaggagagagcgcuaaaagugaauucagaagaagggcauagugguguuaauuguacuuuuuuuucccugcaauuuuuccuguauaucugaaauguucaaaaguuuuggaggaauuauuggaaccuuggaaacgugggaaaagcuauuaacaaauugauaaaauuguaaagguugaauugauuuaauauuaugaagauuaaaauggaacaaagaaauauuuauaaguuuuuaggauagguaacaguuuagauuuuaauuauauccuguacuuuuguaguguuccaauacaugaaccaaaauuuaaaggugaugcagcccuguugcuugagaccaucuuagacagugguuuucugagcccuugugauguugcuuuugaugaugauuuggaaggggguuauuagaaaauaauuuguuucauuugaggauaaguacaguuuaucagaguagaccuuugucuugcacuaacugaaaaagguuauaucugauacagcugauaggaaggccuauauaguguauugacuaaaagugaaucagauugaccagaccaugcgaauccagggauaggaaaauuucaagaaguuaauguuguuuauaagucucaucuuuaugauacuuuagccaagaauacuaauacaaauuauguuguuguguacagugauuuggauaucuuuaaagaauaaaauuaugaguaauaacauguaaauggacuuauucagaauaagauacaauuauauuaauaguuuuuuauagguaaacugaaguaauauuacuaauuaggaaaaacuuuuaauacuuauaaaacuauauaauccaauaguguaucuaagcaaaacuauuugguaaaauauuuggaaauaaaauacaguacuauuaaacauuucauacauaauguuuaucucuguaaugcaugauuguuaccaauguuagaaaauuuacuagaacaguucaccacauuaaaauauugcuggaaaaauuaucuucuuaauguuugcagaaaacauauuugacaaaauucaauacccauuugugauaaaagguuuuagcaaacuaggaauauaagcagacuuucuuaaucugauaaaugauaccuauuaaaaaccuauauccaaaauuguucuuagaagugaaacuuuaaaagcauuacuuuuaaucaagguaaggaacaauacagagguaucugccgucacuacuaacauucagccucauacugaaagucccuaggcagugccacaagacuagaaaaauaaggcauaaagcuugaaaagaaaaauuacugucauuaugcaaacagcaucauuuccuacuuggaaaauuugagaauaucuacaaauucucggaacugaugaaagaguucaguaaggugacuaagaaaagauggcugggcaugguggcucaugccuguaaucccagcauuuugggaggcugaggugggaggauugagcccaggagguugaggcugcaaugagccauguuugugccacuguacuccagccuaggugacagagugagacccugccucaaaaaaaaaaaaaaaagauuaaaagaagaaaaaagaaaagaucaacauguaagacauacaggaaccaguaauauuuccacacacuagcaguaacgaacuagaaaauguauaagguaccugccaauaaauauaacaaaagcuauccaaaaccuuauggaaaaaacuucaaacauuauuaaaagauuuuuuaaaucucuacauaauuggagagaugucccuuuuucauggaugagucuugauaucuugaagauguuaguuuucuccaaaauuaauuuauaauuuuuuuuuuucuugagacaaggucucacucuguuacccaggcuggagugcaguggugcaaucuuggcucacugcagcuuugaacuccugggcucaagugguccucccaccucagccuccccaguagcugggacuacagacacaugccaccacgccugacuaauuuuuguauuuucggcagaaauagggucuuucuguguugaccaggcagguuuugaacuccugggcucaaacaguucucccaccucggccucccaaaguccugggauuacagacaugagccacagggccuggccaguuuauaaauuuaauguaacauugauccagauuccaagaggauguuuugagaauggaacuugacaugauuuuaaaagucauauggaaaagcaaaugucuaagcaugguccagacaauugaaacaagaaaaacaagaagggauaaagucaacaagaugguaagaccuauaauaauuaagauaaucagguaguaagcuauaguaaauaagacugcuaaguauugguggaggaauugaugggggucaaugaacaguguugagaaagccuagaaaaagauccauuuuauguggcaaacuggaauaugauagagugagcauuacaagucauugggggaaaagaugggauaaauaguguugguuuuccaguuggacaaaaaugaaauuugauuccauucucugauaauauucaggaagcaauuccagaaguacaaagauaauuuuaagaaaauaaagguaaauauuuuuauaauccugguauggaaaaggauuuuacaaacaaaauacaaaaugcauaaaccauaaggcaaacaaugcuauauuugauacuguaaauauucaaaauguauuuauaaucuagacaaauuuuaggaaacaagcagcagucugaaaguagauauuuguaacauauaacaaugauuauuauuuagaaugugggaagaauuucuacaaaucagugagaaaaaaauacaacauaacugagaaaugauuaaaaggaacaggcagcucacaguagagauucugaaccuuaccuaguaauuugggaaaugcaaauuaaaaagguaccauuuuauucucauuagucaguuugggaauaaucagaauaucugcugucaucaaauuauagcagagaugugggaaaugaguuguauacuaugaguuauacacuaugaguuggagugauauuuuaaccacuuagaagaacacuuuggcaauuccagcauaauugaaaaugcacguuaucuauagugcacagugguucuuguuuccguguaucugcccuagagaaacucuugcacauguguaugggaaaacaugcaugggaugcucuuggcagcauuguaucuuauaguggagaacuaggaagaaccuaauggucuaucagcagacaauggauaaauaaagugugucauguguaguuggcuuuccuuauccauggguuccaccucugugaauucaaccaaccacagauugaaaauacuugaaaaaaacugugucuguacugaacauguacagauguuuuucuugucauuauucccuaaagaauagaguauaacaacuauagaauuacguagcauuuacauuguauuagguauuauaaguaaucuggagguaauugagaguguacaggaagauguguauugugcauuaugugcaaauacuaugccauuuuauaucaggaacuugagcaucugcagauuuuguuaucugagggaggaccugaaaccaaucccccacagauaccgagggaugacuguauauagugaagaccaaacauugauuacaaagugaacaaauuaaaucuauaacuuucaacguaacuagguuucaaaaaaugagugaaaaaaguaggacaguauacaaaguuuguaaugauuugcauacauauuuuaaauauacaauauaaugcuauguauuauuuaaagauggcucuaaugugauaaaaguaaagagaugcauggacuggaaggauucacaucagugacaggaaaaugguugcauuuggagugagagagccggacuggggaagucuaaagggaauguuaacuuuuuaaauuguucguuauuuaucuuaaaaagguugaaauagauauuuuaaaaugugaacacuuauuaaucaugagugacagaaaugugaacauuuuauucuauaccuuuuuugguguaaaaacuuaccaacuuaaaauuguggugacccacauugcgcuuguuguuguugcucuccucucuccauccucaaagcauuugcaaagcauguuguaaaagcaaaaacagcauuuacuucugucuugcccaaagucugcugugcccccuacauguagaugcacgacuuugccucucacuggcauaaucagugguaaggaacagccaaacuauaaaguuaaaggucuccaaagggaugaucaauagaccuagaauugcuuuggauguaaucccuauucuagauaugguuugaauuccucagcuuuaaugagcauauuuacaaauauaaauguacauauggguacauguuaaacugugagaaauaauaguauuggacaaaugaaauguacuuuguuuuuuuuuuuuuagguaucuacgaauauuucaaaauguggaccuaucuagcaauuuuuacuuuagguaagugugagguuaguuuugcuccuaucaaucacauaaacuuuuauauuauuuuccagcggguaaaagcagaaugagaacauaguaguacuucucuuucauuuuagucaacuuguuuuaucuaaaaucauuaaaauauagcuauuucuuccuuuuaaaaaucuuauauuugaaaauccaaauggauaaauuaaaggauauuuauucacauuauaaaaaucaucguuguuuuagguaggacuuaauguauuuuaaagaaauauucucauuuuguaaucuuaaauuacaaaaaugaaauuuacauucagccuguaauaagaguuguaacaauuucauuguucaacuuuuaguaaauaaucuggcaaaauuggguaaaaacaaauuaaaaauaggaagaacuguugcaauacugauguacugcugguggcauuguaaauuaacaguuuccugagaaggaauauggcauugaacauacaugaaaauauguccuaagaaaauaaccaggagcaaaaauacaacucuccauugguaaagagacauuuauugcuucucuauuuauaauagcccaaacaagcaaaccagauaauccagggacgucccaaauauugauaauugaagaacaggcaaguagauuauuacagcaucaugauaaguauuuuacuaccauugacgugaccaguaugugggccugauagaugcaauuauugugauagauggaaaauucuaucagcuauaauauccaaaauaaaaauagaacacaguaaggacuugagucauaaagacuaaaggaggaccuagagcauuuguagcuguugguguuacauacuacugacagggugcuuugcauuaaaaauuauuuuaaauuauuaauauaguuaaccauuucuuuaugaaacaaagaaaaacaugucuacuacauggggugaauuaugucuuuauugaugcaaaccugaaggaaguugauuauuuuaacagaaauggagugaagggcuccuaaagaaauaguuuuuacuuccacacacguuuauugaauguauauuuucauuguauuuuucgccaucuucuaguuuucagucuuuaugccuaacuuuuuaguguuugugaauuauuauugaagcucagugcuauuguuagaaauggccuucuucuucauauuucucaguuuugucuguauuuuuauacugaguugugaucaagucauucuauaaguaaauacauguagguuaaaguuuuugugccucauaaguaggcuuuuaaaaagguuauaauauauucuuaagacucucuagaaaaaaggaauuguuuuaaauagaaauaauugauuguuaaaaaucagaaaccaacuucuuaauauagcuuuuaucccuuugagauuagaugcuguuaaaaugaauggauccaucaagcaaaaaugauacaauugaacuucacagaugaaacaaaucaauuucaaucaaauuauaugaauaaauaauaauuaaaauaaugugugugacucuccagacacaauuguaccauuuuaaaauaugacuaaaauacuuuaaaaacaaauuuguauaaaauauucaaaauaccuucugaaauucugugcuaaaaauauauagcuaggcuccuuuagaguuucuaguaaaaacuggaaagcccccucaacacuuaagaaauauauauacacacacacacuauacauauauauaguauaguauauauacacaacuauguauguaugcauauuuauauaugcauauuuauauagaguaugcauauauaaauacuguauauaaauauagaguauaaauauauuuauauauagauacuuuuaaaauaucucuagcuauauauauaaagagagcuagagaugcuuauuuaaaagguauuaugugagaucaaaauuguaaugaaauuuaauuugcacagagacgguuauauuuuugaaaugccuuuuacucuucuaaaacauguuucacuguaauggccuauauuauuugcuuauuucuguuuuaugaagucaguuaugauaccaccauuaauaauuaauagaauuauuuuugcuccuggguaaacuaggguacagaacuaugcaguauugcaguggauguuauagaucuauaaaaccccauacagauucauagaaggugugacccuguuugcacaagaccaucaacuuagauugauuucaguaugaagcaaaaaaugcacauuguacaaaucaaauaacguagguuacugacauuguauuguauauuuccagucaugcagaugccuagucaugcagugagguuuuuauuuccaauuacauuuauauuuugcuguguuuuacagugcuuauuugaauagcauugcuuccaaauaaaguaauaggugcuaaguaauuuaguucacagauuuuaauucuauaugggcgccaagaccaugaaauaugcuuugcuuuuguaauucuuauuaaguuucaauucuguucucaguuacagcuaugauuugucccacucacuucaauauaaucucacugucuugcgaaugccccuggagauguuaaagucagaaaugacccagaaucgccaagagagcuuugacaucuuugaagaugaaggauuaauuacacaagguggaagcgguagguggucuugauauaucuaauguauauuaaugugguauccaugaagugauaucuuauuaaauucacucacauuucccucauauuuguccaucccucuuugcuguuuguccuuacgugggguuguuuuggauaugugaaguugaucaauucauuuuuauagagauauuaaucaccaugugauuucauuuguaggccaaccacaaaauuguaugcugacauuuucuagcaauuauucacguacuuuuuauugaauacauucaagccuagacuuuuacauggugugcagaggugaaguuuacauggauaauuuuuuuuaauauuagguaauacacacuacuuauuuuccuucacagagaccaguuuguuauggucugaguuuugaaaaagaguuaccauggguugccuauuaugugcuagacauuuacauguaauaucucuaauccucauaaaaacucugcuuaguagguauaaugcuaguuuuauagaauuaaagacuaaguaggaaauggaggccuggaaaugaagaucauacagccaugucagggaaucaaugcagcaagucagaggucguuauuacuuugaucggucccagcuugacccaucaguccugcauaggucuugccucugcaggacugcugugggaccacucagugccucaucuagggugccccugaaauccuggacuaaaccagucacgcaauaccuuuaucgccaaauuuuuggguuggucuagcacuguaaagcuagaggcauugcuaguaugaauguuguaagggaagcauuucaauaguuaagacacuuuaguuguguucagcugacuguggaaaguaagucaauagugucuuugggcuccuugcucugugcaacuuaaaugauagugaugaacaugugggugcagaggugcagagguagaauccaaucuaaaguagucccagaagaucugcccuugcagcacucucaaaaagaggcuguguucuguuaaugguuugccaaagguugugaucaacucuaaaaagguuuaggcuguuacuuaaacugaauuuaucccuggcauuccccuugacucuuguuaguuuacuugauuaucacuugagcuaaggucaaacccagggcacccucccuacucccagaucauuagaucacauacauuugcccugguucagacacucuggugguaacccauaccacuagagacagauagagggcaagacaacugguguguuugaauauuugcuugcaacgcuucugaaugucacaauuuguaauacaaaagcugaaaguaucacuaaauuugccccacaugccauccaaaaucugaauuugaauaucuguucugggaugugaauuaagccuccaaugcuacuaaauuuuuugccaucucuggagcaauucuacuugauagauaugaauaacaggguguauuaguuucuucuuguugcugugacagauuaccuagcuuaguugcuaaaauaacauaaauguaucaucuuacagaaguccacaguggaucucagugagccaaaauuagcauaucagcaggauugcauuccuuuccagaggcuccaggggagaaucaguuuucuugcccuuuccaucuucugggggcugcauucauccccuggcuuauggcucccuuccaucuuuaaggcuacauuacauuaccugacacucauacuccuguuuuccucuuugacuuacaaggacccugugauuauauuggacccacuuagauaaugcagaauaauuuucccaucucaagguccugauuaggaaccuuaacuucaucugcagcuuuaauuucuucuugccauguaauguaacaguucauauucacaguuucuggugauuagccugcauacaucuuugucgaaggugagauuauucucuuaucgcacagggguaaacugauaagaaauggagugaggguagaagguaugagaguagguugaaaaggaaaacaauaaauuuuuaaaauaaucuuuacugcaugucagguacuuugcauauacuauuuaaucugaacaauaucuuugaggugaguaguauuaacaucauuuucuaguuuagaaaguugaaauucaaagacauuaaguaacuugccuaaagucacagaguaagugacaaaacaggacuccuauugaugucuuuauuauuaauucucucguguaaugcauugaaagggcagagaaaguuuagcuuuuaugaaucaaaucuaagugugguauaguguauaaacaaauacucuuaacagaucauguuuugagaaaaaaauggucuuuauuaacugcuauucagaaccauuacagucuuuuaagcuauuaucuuauaaacauacuuuuaauuuuucacuucauguaaguuuuguaaaacucauugcuguuuaauacauuuaucuggauaugcuaaaauuauguuugaugaaauuaauuuauucauagagaaaaggccugacaucauaauaacugccaccuauuggaaguauuuguaauacacuaggcuuauucuaggccccuuacgugccuuauuaauucauuucguccuuaaaacaaccacgugguacaggugagggagcagaggugccgugcucccuaaguaacacucuugauugugccugacccugcugaugagaggcagagccaggaguuggauccaggaacuuugaccucauagcccugugcucaaccgcuacuuccugccaccucuugacuuuauuuauauauuuguaacauguccucaauuuccuugucauuuucuuuucucucaagaacucucacaagucagaaaagggauuucuuugacuuuuuacagaaucaacacaauguucuggacaugaaaggaaugauauccacugaaaauggcaaugcuauuaaccaagcauguuacuuugaaguuaaaaacagaaguuaacuuaaaaaugaguugaaugucagccaauuuccauaucuuucugauaccaaccuuuuuuuuaauugauacaaaauauuuuguguauuuauggacugauacagacuuuuauuuuucagggguauuugggaucuguagugagccuuauaugaaauauguauggaauggugaacuucuggauauaauuaaaaguacugugcaucgugacuggcuuuuguauauuauucauggguucugugggcagucaaguauccuuucugaagaaaaaguaagauacauauuacuaaacuuaugauguaucaauuuguagacagcuacauaugaauuauaugauuauaauaccacucugugcaccccaacaggaaaaccugcccaugauacuauguagcagaaauacaaagaagaaugcagacuauuugaacaggccuguuauauacacauaaagaugaauaaauaacaaggaagaaaaugcaaugugauauagguaauaagugucaugcuuaucugggagaaggaggagaauuacugauaguuggagaggaugggacaggcccaugggaauaguugaacuuggccugggcccuaaacaaaagucagugccuuagcagcgagagagaucaggccgagcagagagagagagaucacagccugggaaacacuguguguguagagguggaaaaacacaugggaguguucucauggcuugugcauaaaacucccaggagguaggauauagugggaaggagauugguaugugggagucagauggccagucaccagauugccuugguggucaagcugaggacuuuggguuuggugcuagaacuuuugaaagguuuugugcagaagaaugacauuugcaaaguaguauuuaggaugcuugaguugacaaccguuuucaagcuggauuaaguaaaaugaaacuagaacaaguaacaugaguuaggaaaagauugcaguaguccaggcaagagggcaaaauagauuaaagagaaguagguucagcuuuggguuaagcugaugaguucaauuuuguaaaaacuuuuauuuccuucaguagcuucaugucucauuaauuuguagcuacauugaagccuuuuaauaaagugcaauuaugggguuuaagaaggcagcauguaccaucuagaagugguuuuucgauuuuuucuaucaccuuuugagaucacguagggcauuuuugcauucagcauguuuucuaguauguuagacuuuuaaagaaaaaggcguuuguacauuuuccccccacagauaagaaguauuuguaauggauuuguauuuuucuuaguuuuauucucuuuagacauuuaaaagaaccaaaaaagaaacuuuugcuucuucauuuucaguugggauuugcaguuuaauggccucacaucuuucuccagauccccaggguuucuuugucuuauuuauggagaaaaaccagucacuuuguccagcgcacugugaggccccacucaggccagcccuggccccccuugguacuuggaaccgaaguuacagaucuauauuaaaauaauaauaauguacaaaaaaaaauuuaaaggagugguugcuuugagacuauuaagugggugaaugugacugaccauuauuaugcuuucuuguaccaggagcauuugagaggaguggugccaagggcacagcuggcgagguuagccuugaagagcagcagggcugccuucugugagggggacgaaaggcuagauaaaagcacagagggauuuugaaaugaagaucagugagauuuaugugcuacacuugaaaaucaggcucauuacuuuauaaucacuuucaaccagugagugguauuaucugguugaucauuacugcauaaagagauuugauccugaauuacuuuuuucucuuuccaaaaguaaauucuaccugggaagaacacagguuuuucaccaccaaggauaccaaaaagaaugugcuacaauuucuaaagguaguuccuaaaagauaguucuaagcuguuuuguauuuccaagagcuaacucggguccuggcacauauuaaacauaguaaauguuuguuuuuuaaaauagugagcaccaugauagaugaucauuuuaaagcucguaaguuuaaacaaugaaucuaguuuccugguuaucaagcguuuaaugaauucuggaacucuauaugauuauaaaaagaguagcuuuugauaagaguaguuuaugaauacuacaggccaggcacuaguuguacacacauuacuucaccuaguccuccugaccaccuuugguuacuuuacuguuacuccauuuuauagaagaugagacuuggcucagaaaguuaaguaaggcgacauaacuaauaagcuguauauugguuaagcaguucacaauaaauuauucaguguucagaauuugcagguaggugacaaauuuugacugcuuuuagagucuuauacucaguuugucaccucaguauuacauauuauucauaauugaaacagccuauuaaaugacacauguucucuuugagagguguaugaucuuggaagacuaaggaagguguauuaguccauucucacacagcuaugaagaacuaccugagacuggguaauuuaugaagaaaagagguuuaauugacuguaggcuuaacaggaagcaugacugggaggccucaggaaacuuacaaucaugguggaaggugaaggggaagcacgcaugucuucacaauggcagagcagaagagagagcgagcaaagggggaagugccacacacuugcaaacaaccagaucuugugagaacucacugucacaaaaacagcaagggggacguccgccuccaugaugcaaucaccucccaccagacccuacccugacacguggggauuacaauucgaaaugagaguuggcuggggacacagagcgaaaccauaucagaaggauuaguuguacuuguuuacauccuuacuuggccauagggcuuuccuuggccaguaacccuacaccugguuaccauuuucucugaaauuuauggaaagcacuccuuagucagguuggauauugccuucccuuuguagcugcacugcaauucugaagaaccauuagaucaagugcuguuccauucuuggguggagcuuuugguguucuuuaagccauuggacaagcuguaucuaaauguuuauuuaaggaauaaugacucucuuggucuuaugugacagucaugaaugcuaaacaaccuuaacuugauuuccaagagcuguugaucuauggacgaccaguguaugucacucuaauagcuagaagauccaguaaauuugcuggcacccguuuucuuaaaagaggugcaaacugugagguaagaugacaaacaguaucuucacugaccuuuuaaccuuuuauaucagcuuugcugauguagaagcacagugaaauuuuaagaagugguauuucuuaguuugggauauuaucaagagaauacaguugccuuuuaguaucaacaagggauugguucuaggaacccucuucccauccaaaauccacagaugcugaagucucuuacauaauauggccuagugcuugcauauaaccuauguacauccaucuguauacuuuaaaucaucucuagauuacuucuaauaucuaauaugauguaaaugcuaugcaaauaguucuaauacuguauuguuaagggaauaaugacaauaaaaaaggucugcacguauucaguucagaugcaaccaucguaggccuaacuacauuuucugucugagauugguugacucuguggagggaacccauggauguggggggcugacaauaauuaauacuccagugcaucugaaacaugugagaaauaugacuaauaugcagauguucugaaaagucagcuaucuuagaguuaugcagugcuuugaggaauuauaaaaugucuaauguuguggagggugagccauuucuauaauauaugaaaugcgguacauguuuaauguagagacaaaaauagcaaagcaccuccacccaaguagaaggcagcacucaucacgggaagucaauucuugauaagaagacgaaguggagcaagguucaggaaacgcuuugcccucuuugucuuuuuugcccauacuccuuuuucuguucaucgcuaggaaauaacaacagcaaaaaugcagccauccuuccaucagccguguucuguccuuugagugcuccgucucuguuugcaauagacaacuugaguuuugaguggaugugugauuugguagacagauugagugaggcacuggguuuugauccuggcuuaaaauagcaacauuguucuuaaaauuauaucaacagugaaaauuguuacagcuggugcuuuaaaauaucagaauuuugcagcuauauuauuuacuuuugaauauucaaaggauaaucagacauguuauuacugccucuaaaauuauucuuuauuauguccuuauauacuucuguaaguaccucaaaacccuauuuuuuccuuuuguccauuaggcauuauuugaaucucacuccuuucauuucacuuuggucuucagaauugaauuuugauauucuucuagucuuccucaccuccuguauaauuucauguaauugucauuucuuucccucucucccauuuauuuaaaccagcuguuuccuaucugacuuguauuauuagagauuaauuuguuuuuuucuagucuauucucugcuacuuuuaauugccuucuuuauuauauuuuaaugguuuugcuuuucuaaugugcauauugaauauugaucaauauuuaccucucaagacuuucaaagaauaggaauuauaacuucauugaaagaauaggaauuauaacuucauugaaaguuauuucauuaaacauuucuaauaacauaaaauauuuuucaaugcaccuuucuuuucagggugauguugcaaaugaaguggagacugaacaaauacucugcgaugcuucugugaugucuuucacugcaggaaguuauucuucauauguacaaguuagaggaucugugcccuuauacuggucucaggacauuucaacuaugaugccuaaaccaccuauuacauguguguggagccauguuuuuaauaauaacuccuguccucacauuuagagauaaugaacuguugucacagaaaucucauaaaugcuuagguuuucaggagguuuuaguccuggaagguagauaauuuagaagaggaauuuccguuauucuuauguaauaaauuuauguuuaauuuugacuguuaaauaaauuauuuuuauuuugcuucagaaauguaagaaucauucaaauguaauaaauacaugaugaauaagugucuagugagcaucuuaagaaggauuugggaagugaaacuauugaaagauuaguugaauugcauuucuuuaaaaaaacaacccuaugcuucuuuuauuuugcuuugcaauuuucauucaggugcuuuuucaucuuuuuuccuucucaguggaucaggcagauccauuugcacauguggcugcccuucacuuugaccagauguuccagagguuuggcucucccaucaucaucuugaauuuagugaagguaugaugugcucaucuguuugguuaugagauucagacgcucugggaagccucuuccucaacacagaggggguuaacaagccaugcuuucccucuuccuaguggagagacgugcagauuauuaugcugggacagcucacugugucugagcugagucacuuuccuuuggccucagauuccauguggcuucucugcauggcugaaaaaaaugaguaguauauaucuaagggaguagagugauucaguauaucaggaaaucauuguguccugauuuccuugugugaauuagauauaggucaaauuucugccuuaguuuccaggacaacuuggagaaagaagcaugaaaucaaacugucacagccucaccuuuacagucaucucccuugaaaauccauaagcuccccugggcaaauuaauuuauaguaauaggaucaaaggcuagauucauaaacugggguacuguugugacugaaggaucaggugggcaugugagaagcccagacaaggugguauuagccucauaguucccugcuuucuuggcagaguacacugacuggucagcauaucuaucuauaugaaugggcauacaggucaaaggcugaggauaggaggcagggaaccacagaauaaguuuuaucugcaucuguugcagccaagugaauugaaagacucucagucagaagccaagaauacccugagaguaugaaaagcaaggguguuguuauguuaugugcucuuggugguguccaacaaucuaguagugucugagguuauucugagagguugguuaauaaauguagaugaguuuacugaaaaaccaaggaagccugugacccuguguguccauuuagucagucauuuauuuuuauuuacuuauuucuuauuauacuuuaaguucucggauacaugugcagaacgugcagguuuguuacauaaguauacaagugcugugaugguuugcugcacccaucaacccgucaucuacauuagguauuucuccuaaugcuauccuuccccuauccccccaccccccaacaggccccagugugugauguucccguccuuguguccauguguucucauuguucaguucccacuuacgagugagaacauggcaguuuuugauuuccuguuccuguguuaguuuacugagaaugaugguuuccagcuucauccaugucccugcaaaggacaugaacucauccuuuuuuacggcugcauaguauuccaugguguauaugugucacauuuucuuuauccagucuaucauugaugggcauuuggguugguuccaagucuuugcuauugugaauagugcugcaauaaacauauaugugcaugugucuuuauaguagaaugauucauaauccuuuggguauauacccaguaaugggauugcugggucaaaugguauuucuaguucuagauccuugaggaaucgucacacugucuuccacaaugguugaacuaauuuacacucccaccaacaguguaaaagcguuccuauuuuuccacgucaucuccagcaccuguuguuuccugacuuuuaaaugaucgccguucuaacuggcaugagaugguaucucauugugguuuugauuugcauuuuucuaaugaccagugaugaugagccuuuuuucaaauguuuguuggccacauauaaaugucuucuuuugagaagugucuguucauauccuucgccuacuuuuugaugggguuguuuuuuucuuguaaauuuguuuaaguuccuuguagauucuggauaguagcccuuugugagauggagagaugcaacaauuuucucccauucuauagguugccuguuuacucugaugauaguuucuuuuacugugcagaaacucuuuaguuuaauuagaucccauuugucaauuuuggcuuuuguugccauugcuuuugguguuuuagucaugaagucuuugaccaugccuauguccugaaugguauuuccuagguuuucuucuaggguuuuuaugguuuugggucuuacguuuaagucuuuaauucaucucgaguuaauuuuuguauaagguguaaggaaguaauuuauagauucagugccauccucaucaagcuaucauugacuuucuucacagaauuagaaaaagcuacuuuaaauuucauguggaagcaaaaaagagcccauguagccaagacaauccuaagcaaaaagaacaaaacuggaggcaucacgcuaccugacuucaaacuauacuacaaggcuacaguaaagcaugguacugguaccaaaauagauauauagaccaauggaacagaacagaggccucagcaauaacaccacacaucuacaaccaucugaucuuugacaaaccugacaaaaacaagcaauggggaaaggauucccuauuuaauaaaugguuuugggaaaaccggcuagccauaugcagaaaacugaaacugggucccuuccuuacaccuuauagucagucauuuaacaaguauuuuugagaguuuccuaugugcaaaggcaguucuagaaacagcuccugccuugagcuaacagccuguuguaggagauggugagguaaugcagaggcaacaauauaagguaaauggugcaacaagaguuuauaauggagagaagucuucccugaggacgggaugaguuagcaucagccugaaggaagaggcauuaaccaggucacugggaaagaaugguauucaacucagagcgcagcauguacaaaggcccuaggacaggaggaagugugguggguuggaggaagaaaaggggguucccuguggcuggggcccagagggugaggacaagaugcuuguuuugagaugaggcuaaagagaugguuauggccagaccaugcagaguauuguaggcugcauuaaugagccuggccuucuuccugagaguaauggaaagucauuaaacaucuugcaugguugagaggaucauugucagauuuauguuuugaaaagauuacugugaccucaacauagaaaacaaauggaucgguacaaggcuaaugucaaugcuggaagaccagauaggaggcuguuauaauuguccagaaaagaggugauuaugccuuaaaccagggugguaugguggagauguagagaaguggacagucaguagaguuggugaugggcuggauuugaaaugagggaguagggggugucaggcucaauucucagguuucuggcuuacucaggugggugaauggugaugccauucacugaaauacagaacccugacuggguuuguugggggaagaucaugaguguaguuuggacaugcugagugagguuugagguaugcuugcguccucuacacuuguucuuagccaaaaggccgagaagcgaugcuugaguccucuaaacggagguaacaggucagggcaugguucuggagcucagaggagaggucuaggcccagaugugauuuuuguaacucuguguacagaugacauuugaaggcaugggcauggaugagaugcccauguggagaguauaaagugagaaggaaaaaccucagagcuugucuuggggaucuccugcucuuaaugcccauuuagaguggcugaaucuccaaaggagucagagaaaaaaacauccagaggaguaggaagaaaaccaggaagugcugugucaggaaugccaggagaaagcguguuucacaaugaaggaaguaaaugaucaacagcaucaaaugcugaggggucaaguaagaugaggauggaaagauuguccauuaguguuagcaucauggagggcacugauugaaguagaccgagugugggauaacagugaguaagugauguacuuuucccccaauaggaguacccagugaaagauggcauuuuuauuuuuugaaagagaucauaucgauauguuuaaaagccuauggggaggauacaugugaaagggauaguuguaugacacaggagagaaaaggaaugaucagugauuucauguacuuaagaaaguaggaaaugaugaaaucugaagcauacauaguagaauuauuauuuuauuuuugaggcauggucgugcucuaucacuuaggcuggagugcaguggcaagaucauagcucgcugcaaccuugaacuccuggccuuaaguaauccucccaccucagucucccaaagugcugggauuacagucaugaaccauggcgccuggcuggaauuauuuuaauggagagacagaaaauaguaaggguucgggcauguguguauuugugagcaugcacauuccauucugauggcuuuaauuucuccuuaagguaggaggaauggucaucugcugagaguggagguuugaagggaguggagaagguuuaagucuuuuguacgugggaggguaaguugacuagaaaccugcaggaaguaccaagagccaauuucaaguuggugaucaugauuucuuaaauggaaccauuuugcucuugccugccuucuuccagcaggcuugugaaugaguauaagcacagguaaaauaguaauuggguuuauuuaguuuugccacacaggugugacaugaaaagacaggaugaaaggcauuuuggauuuuggcaauacugugaucgaagugguccaugaaaucucagccaaguaaggacagggcuuaaagaacagggcugcuggagaaaguggagaugucaguggauugcaguccucacgaggugggguauuuaaagcaagcaguguggaaauaaaagaggucacgaauaagaaauguugaagaaagagcagccugugauaaugaauugguguaagaugugauagugggaauggggauuuagaauggaaaaggagguggagauacugaaagucagccaguguauuagucuguuugcacacugcugauaaaaacauaccugagccuggguaauuuauaaagaaaaagagguuuaauggacucacaguuccacguggcuggggaagccucacaaucauaucggaaagcaaaagacacguguuacauggcggcagacaagagagaaugagaaccaagcgaaaagagaaaccccuuauaaaaucaucaccucucgugagacuuauucauuaccacaagaacgguaugggggagaccacccccaugauucaauuaucucccaccagaucccuccacaacacgugggaauuaugggcgcuacaauucaagaugagauuugaguggggacacagccaaaccauaucacccaggauggaggcaaagcuugggguggggaagagacaguuccuaggagaggacuguauaacuacaugcaugggcucaaaggagcucuguguguguguguguguguguguguguguguguguguguguguguguguuuuaaaucaagaauauggaggaauauguccccaaacuggcaguugggggagaagagugaaacagugaggcagucagcuuuauuucuuccuguguugcucuuuguaauuguaucccacuagggauugacuuuguaaaauaaaucauucagauauuaaauaaucauuuuucuagacauuuguucauauuaauucagaaguuucauguucacaucucucuccauaucaacucagaauaauguaagguggauaaucucuaaccucagccuaguauuaaacaguagcuguaguauacauaauugcaaauuuaaaauaugaaaacuuuagugaaaaugcucauggacaguuuuccaguaaauguauagaaaauaagauauuguuaguauggaaauaaauuauugccaaaguguuaaauuauaaaguguuacuggauuagaaaccuagauuugaauuaguggauuuagacagagcacgacccugccucaauaauaaaauaaaauaaaauaaaauaaaauaaaaaguaaguucauguuuuacagaguucguauagugugguugaaaagcugucauuaaauggagauucaugucuacaaugcuugaaauaauucucuuaauugugcacacucaaaaaauacuaucauacaugugaucauaauguauucuuugccagguaucucacauguacauuuauuuuuuugaauauuuaaaggucagucaguggauuuuaaaguuguacuuguuuauuguucuauugcaauaaaaauccugacaaugacuagaaguuagcuacagaaauaguuuggagauuaaguugcuguuucauggaauaggaaaauauuuuguuguuuauagcacuaguuuuauucauaggauuaaagaagauguuuauucaggccacuugguagaagaccuuauuaauugugauuaaagagccaaagaauacauguguguauagaaugauaccuaggggauacucacucuuuauucuaccaccauaugaagaaguuaauaaagcgaaaugcuuuucaugauuucauuucucuuuuacccuguguugcgaacuucuucccaguugugaaaguuugaggcacugguugaaagacaguuugcagcaauccaugugccuucaaugcugcuacuguaucaacagaaggccaaccuaggaucaaguauaacuguacaucagaaguuuuuaaucugugggccaugcauggcuguuagggggaucuuggaacccuuugaaaugauaugcagcuggaugugguggcucaugccuauaaucccagugaccugggaaacaggcgggaggcuugcaugaggccaggagucugagagcagacugggcagcauaggagacacagucucuacaaaauuuuuuuuuuucaauuaguugagcaugaugcacaccuguagucccagcuacuuggaggcugaaguuggaggaucacuugaguccaggaguuccaggaugcagugagcuaugauugcaccauugcguuccagccugggcgacagagugagacccugucucuuuauaaaaaaagaaaaaagaaauguuaugcaaaaucacuuguguaguaguuuuccuuuacuuguuaggggucuguggcucuaaagagguugacuaacaacccacuaacacuauuacacuauggacagacaaugcauacagcagauucuucacacagagaugauacgaagguugcucaaacaacauuuccucuccaucccacgaaaugucagauuugauauaagcauuucaaaaagauuuuguuucccuaguugauuuuaaaugcuuuugagaaaaauuucagauauauaauuuaauuuucuccgauauauaaauaagcaaaauuuauuuucauccuaaacugauuuaacacuguucuuaauucuuaucuaauuauuucauuugauguauucagcugugcucaauagcuaccccuuuuuguuucuacaguaguuaucucauuaaauucaugacaauugaaaaguaaucuccaugauugaaaacagcacaaucuaauuuugaugccaacaauagugccuuaacaccauuucagucucacuauugugaaauuaauuguuuuucuuuguuucuaagugaaggcuugaucagggugauaaugaaaauggcaaauuuuuauaaguuacuucccauaugccagcuguucuauaaaaacucaccaugcucugcugcuggauucgguuugccaguauuuuauugaggauuuucgccucgauguucaucagggauauuggccugaaauuuucuuuuuuuguugugucucugccagguuuugguaucaagaugaugcuggccucauaaaaugaguuagggaggagucccucuuuuucuguuguuuggaauaguuucagaaggaaugguaccagcuccucuuuguaccucugguagaauuuggcugugaaucuaucugguacugggcuuuuuuugguuuguagccuauuaacuauugccucaguuucauaacuuguuauugguuuauucagggauuugaccucuuccugguuuagucuugggaggguguaugugugcaggaauuuaucuauuucuucuagauuuucuaguuuauuugcauagagguguuuauaguaaucucuggugguauuuuguauuucugugggaucagugaugaucuacccuuuaacauuuuuuauugugucuauuugauucuucucucuuuuuuucuuuuuuuuuuaaguauuuuuuuucuuuuuuuuuauuauuauuauacuuuaaguuuuaggguacgugugcacaaugugccgauuaguuacauauguauacaugugccaugcuggugugcugcacccauuaacucgucguuuagcauuagguauaucuccuaaugcuaucccuccccccuccccccaccccacaacaguccccagagugugauguuccccuuccuguguccauguguucucauuguucaguucccaccuaugagugagaacaugcgguguuugguuuuuuguucuugcgauaguuuacugagaaugaugauuuccaauuucauccaugccccuacaaaggacaugaauucaucauuuuuuauggcugcauaguauuccaugguguauaugugccacauuuucuuaauccagucuaucacuguuggacauuuggguugguuccaagucuuugcuauugugaauagugccacaauaaacauacgugugcaugugucuuuauagcagcaugauuuguaguccuuuggguauauacccaguaaugggauggcugggucaaaugguauuucuaguucuagaucccugaggaaucgccacagugacuuccacaaugguugaacuaguuuacagucccaccaacaguguaaaaguguuccuauuucuccacauccucuccaguaccuguuguuuccugacauuuuaaugaucgccauucuaacuggugugagaugguaucucauugugguuuugauuugcguuucucugaugaccagugaugaugagcauuuuuucaugugucuguuggcugcauaaaugucuucuuuugagaagugucuguucauauccuuuucccacuuuuugauggggcuguuuguuuuuuucuuguaaauuuguuugaguucauuguagauucuagauauuagcccuuagucagaugaguagguugcggagaauuucucccauuuuguagguugccuguucacucugaugguaguuucuuuugcugugcagaagcucuuuaguuuaauuagaucccauuugucaauuuuggcuuuuguugccauugcuuuugguguucuagacaugaaguccuugcccaugccuauguccugaaugguaaugccuagguuuucuucuaggguuuuuaugguuuuaggucuaauguuuagucuuuaauccaucuugaauuaauuuuuguauaagguguaaggaagggauccauuuucagcuuucuacauauggcuagccaguuuucccagcaccauuuauuaaauagggaauccuuuccccauugcuuguuuuugucagauuugucaaagaucagauaguuguagauaugcgguguuauuucucccauccaaguacuaaccaggcccgacccugcuuagcuuccgagaucagacgagaucgggcguguucagggugguauggccguagacgaugcgguguuauuucugagggcucuguucuguuccauugaucuauaucucuguuuugguaccaguaccaugcuguuuugguuacuguagccuuguaguauaguuugaagucagguagcgugaugccuccagcuuuguucuuuuggcuuaggauugacuuggugaugcgggcucuuuuuugguuccauaugaacuuuaaaguaguuuuuuccaauucugugaagaaagucauugguagcuugauggggauggcauugaaucuauaaauuaccuugggcaauagggccauuuucacaauauugauuguuccuacccgugagcauggaauguucuuccauuuguuuguauccucuuuaauuccguuaagcagugguuuguaguccuccuugaagagguccuucacaucccuuguaaguuggauuccuagguauuuuauucucuuugaagcaauugugaaugggaguucacucaugauuuggcucucugucuguuauugguguauaagaaugcuugugauuuuuguacauugauuuuguauccugagacuuugcugaaguugcuuaucagcuuaaggagauuuugagcugagacaauaggguuuucuagauauacaaucaugucaucugcaaacagggacaauuugacuuccucuuuuccgaauugaauacccuuuauuuccuucuccugccugauugcccuagccagaacuuccaacacuauguugaauaggaguggugagagagggcaucccugucuugugccaguuuucaaagggaaugcuuccaguuuuugcccauucaguaugauauuggcuguggguuugacacagauagcucuuauuauuuugagauaugucccaucaauaccuaauuuauugagaguuuuuagcaugaagcguuguugaauuuucucaaaggccuuuucugcaucuauugagauaaucaugugguuuuugucuuugguucuguuuauaugcuggauuacauuuauugauuuguguauauugaaccagccuugcaucccagggaugaagcccacuugaucaugguggauaagcuuuuugauguguugcuggauucaguuugccaguauuuuauugaggauuuuugcaucaguguucaucaaggauauugggcuaaaauucucuuuuuugguugugucucugcccagcuuugguaucaggaugaugcuggccucauaaaaugaguuagggaggauuaccucuuuuucuauugauuggaauaguuucagaaggaaugguaccaguuccuccuuguaccucugguagaauuuugcugugaauccaucugguccuggacucuuuuuaguugguaagcuauugauuauugccacaauuucagauccuguuauuggucuauucagagauucaacuucuuccugguuuagucuugggaggguguaugugucgaggaauuuauccauuucuucuagauuuucuaguuuauuugcguagagguguuuguaguauucucugaugguaguuuguauuucugugggaucgguggugauaucuccuuuaucguuuuuuauugcaucuauuugauucuucuuuuuucuuuauuagucuugcuagcagucuaucaauuuuguugauccuuucaaaaaaccagcuccuggauucauuaauuuuuugaaggauuuuuuuuugucucuauuuccuucaguucugcucugauuuuaguuauuucuugccuucuucuagcuuuugaauguguuugcucuugcuuuucuaguucuuuuaauugugauguuagggugucaauuuuggaucuuuccuucuuucucuugugggcauuuagugcuauaaauuucacucugcacacugcuuugaaugugucccagagauucugguauguugugucuuuguucucguugguuucaaagaacaucuuuauuucugccuucauuucguuauguacccaguagucauucaggagcugguuguucaguuuccauguaguugagcgguuuugagugaguuucuuaauccugaauucuaguuugauugcacuguggucugagagacagcuuguuauaauuucuguucuuuuacauuugcugaggagaacuuugcuuccaccuauguggucaauuuuggaauaggugugguguggugcugaaaaaaauguauauucuguugauuugggguggagaguucuguagaugucuuuuagguccgcuuggugcagagcugaguucaauuccuggguauccuuguuaacuuucugugacguugaucugucuaauguugacagugggguguugaaguuucccauuauuauugugugggagucaaagucucuuuguaggucacucaggacuugcuuaaugaaucuuggugcuccuguauugggugcauauauauuuaggauaguuagcucuucuuguugaauugaucccuuaccauuauguaauggccuccuuugucucuuuugaucuuuguugguuucaaaucuguuuuaucagagacuaggauugcaaccccugccuuuuuuuguuuuccauuugcuugguagaucuuccuccauccuuuuauuuugagccuaugugugucucugcacaugagaugggucuccugaauacagcacacugaugggucuuuacucuuuauccaauuugccagucugugucuuuuaauuggagcauuuaguccauuuacauuuaacguuaauauuguuaugugugaauuugauccugucauuaugauguuaguugguuauuuugcucguuaguugaugcaguuucuuccuagucucaauggucuuuacauuuugacaugauuuugcagcggcuggugccgguuguuccuuuccauguuuagugcuuccuucaggagcucuuuuagggcaggccugguggugacaaaaucucucagcauuugcuugucuguaaaguauuuuauuucuccuuuacuuaugaagcuuaguuuggcuggauaugaaauucuggguugaaaauucuuuucuuuaagaauguugaauauuggcccccacucucuucuggcuuguagaguuucugccaagagauccacuguuagucuguugggcuucccuuuguggguaaccugaccuuucucucuggcugcccuuaacauuuuuuccuucauuucaacuuuggugaaucugacaauuaugugucuuggaguugcucuucucgaggaguaucuuugugguguucucuguauuuccugaaucugaauguuggccugccuugcuagauuggggaaguucuccuggauaauauccugcagaguguuuuccaacuugguuccauucuccccgucacuuucagguacaccaaucagagcagauuuggucuuuucacauagucccauauuucuuggagucuuuguucguuucuuuuuauucuuuuuucucuaaacuucccuucucgcuucauuucauucauuucaucuuccaucacugauacccuuucuuccaguugaucacaucgucuccugaggcuucugcauucuugacguaguucucaagacuuggcuuucagcuccaucagcuccuuuaagcacuucucuguauugguuauucuaguuauacauucguuuaaauuuuuuucaaaguuuucaacuucuuuguguuugguuugaauuuccuccuauagcuuggaguaauuugaucgucugaagcuuuccuuucucaacucgucaaagucauucuccguccagcuuuguuccauugcuggugaggaacugcauuccucagauggaaaugcagaaaucacccgucuucugcgucgcucacgcugggagcuguagaccggagcuguuccuauucggccaucuuggcuccucccccucucuuuuuuucuuuauuagucuggcuaacagucuauuuuguuagucuuuucaaacaaacagcuccuggauucauugauuuuuugaagaguuuuucaugucuguaucuccuucaguucugcucugaucuuaguuauuucuuguuuucugcuagcuuuugaauuuauuugcucuuccacuaugaucaagucagcuucauccuugggaugcaaggcugguucaacauaugcgaaucaauaaacguaauccaucacauaaccagaaccaaugacaaaaacuacaugauuaucucagcagaugcagaaaaggccugcaauaaaauugaacacccauucaugcuaaaaacucucaacuagguauugauggaacauaucucaaaauaauaagagcuauuuguaacaaacccacagccaauaucauacugaaugggcaaaagcuggaagcauucccuuugaaaaucaacacaagacaaggaugcccucucucaccacuccucuucaacaugguaugggaaguucuggccagaacaaucaggcaagagaaagaaauaagggguauucagauaggaagagaggaagucaaauuaucucuguuugcagaggacaugauuguauauuuagaaaaccccaucaucucagcccaaaaacuccuuaagcugauaagcaacuucagcaaagucucaggauacaaaaucaaugugcaaaaaucacaagcauuccuauacaccaauaauagacagagagucaaaucaugaaugaacucccauucagaauugcuacaaagagaauaaaauaacuuaaaaauacaacuuaaaagggauaugaaggaccucuucaaggagaacuacaaaccacugcccagugaaauaagagagggcacaaacagauggaaaaacauuccaugcucauugauaggaagaaucaauauugugaaaauggccauacugcccaaaguaauuuauagauucagugcuauccccaucaagcuaccauugacuuucuucacagaauuagaaaaaacuuuaaauuucauauggaaccaaaaaagagcccguauagccaagacaauccuaagcaaaaagaacaaagcuguaggcaucaugcuaccugacuucagacuauacuacaaggcuacaguaaccaaaacagcaugguacugguaccaaaacacauacauagaccaauggaacagaacagaggccucagaaaugacaccacacaucuacaaccaucugaucuuugacaaacuugacaaaagcaaguaauggggagaggauuccuuauuuaauaaauggugcugggaaaacuggcuagccauaugcagaaaacagaaacuggauccuuuccuugcaccuuauauaaaaauuaacuccagauggauuaaacacuuaaauguaagaccuaaaaccaaaaaagcccuagaagaaaaccuaggcaauacuauucaggacauaggcauaggcaaagacuucaugacuaaaacaccaaaagcaauggcaacaaaagccaaaauugacaaauaggaucugauuaaacuaaagagcuucugcacaguaaaagaaacuaucaucagagugaacaggcagccuacagaaugggagaaaauuguugcaaucucuccaucucacaaagggcuacuauccagaaucuacaaggaacuuaaacaaacuuacaagaaaauaccccaucaaaaaguaggcgaaggauaugaacagacacuucucaaaaggacacauuuauauguggccaacaaacauaugaaaaaaggcucaucaucacuggucauuagaaaaaugcaaaucaaaaccacaaugagauaccaucucacgccaguuagaauggcgauuauuuaagucaggaaacaacagaugcuggagaggacuuggagaaguaggaacgcuuuuacacuguugggaguguaaauuaguucaaccauuguggaagacaguguggugauuccucaaggaucuagaaccagaaaugccauuugacccagcaaucccauuacuggguauauacucaaaggauuauaaaucaugcuacuauaaagacacaugcacacauguuuauugcagcacuauucacaauagcaaagacuugaaaccaacccaacggcccaucaaugauggacuggauaaagaaaaugugguacauauauaccauggaauacuaugcagccauaaaaaaggaugaguucaugucguugagagugauggaacuaccuaauguagauauugggcugauggaugcaggaaaccaccauggcauguguauaccuauguaacaaacuugcacguucugcacauguaucccauaacuuaaaguauuaagaaaaaaaaagaaaaaaaacucaccaugcucugucucauuuaagucucacauugauguuguaaggaagauacuguuuuuacccuauuuuauagaugaaaaaauggaggccuagggaaauugagaacauugcccaaggucacauggcuagugaguggcagagucaccauuccaaccacagaacuguacaguaaaguacuagcuucucuugaaugagaggcagugcagugucuaacuaaagagaugccccaggcaaggaggcagaaggcaagguuuaguuccaugaaugccucuccaccucaauucauucaaccacaguguaaaaagaaaaagaaaugccuguuuugguuaucucacagaguauuugcaagucuaauuuaugaaguccugugaaggcugagaagcugcuuucugcugugcuaguuugggaauuguucauccagacuaguugauuucuuucuggccuccagcugguuaaaguugggggcucccuucuucugguccuugggagggaucuccucugucagagucagguguggagugugugggccauggcccacguuggguaagcuggguuucucagggugcagggagaguaccaggaagaaaccugaucuccuagaaucuucaaaguucauuagcuguucacuuuaauacaauggagcauuuauuucuuuguguuuuuauuauuucugauuauuguagcuagguuucauuuuaguauauuuaagacuuggauuuuuuugucuuagcuuagcuuaaaaguaaacauguugagccuguuccucugauuuaaggaaauuagaacacugaaaauguuuaauuuuugauaaaggaacgagagaaaagaaagcaugaaagaauucugagugaagaacuuguugcugcugugaccuaucucaaccaauuuuugccuccugagcacacuauuguuuauauucccugggacauggccaaguauaccaaaaggugaaugauacucaucugucuggcuaugaucguuuccuuuucuugugaugagaaauaacaggaagcugaccucugugguaaaguaaauguuacccuguuaauuuccuucaugaaccuguugaggggcuguuuugagugcaucaagaaacuaaccaaacauuuuuuuuucuuuuugccuaucauauauaccauuugcaaauuguuugaaauauuuagucauuucagaacaucucuacaacuguuccuuaaaggcauuaguuuugcuuuuuucuauaucauucugucucacuauuuaaacacuuucucagaugucacucguggaugaaccugugauaauuccugacuguauauaguagauccaaacuccuuaguguaaugucaaaggcucgucaucugguuggcuucagaaugugaccacuuuuuauuuaucccaagggcuguucucuuccagaaaacugaauuuucaugcucugccacaaauguggcagccaaagucccauccuaagccuccauuccucuucuucacccucccugggaugcuuucccaccucucuuuugucuuucaagaucugauucaaaacucaucucuucuaaggaacuuacuuuuguuaaaucuugcauugucuuuuuguucacuuacuacagaaucauacaagcuguagguuuacuuaaggucuuauuuuuuaagauguuacuauaucguuuuguacuuauuguacuuuuuucugagucauuuuauacaguuagauacacacacacuuucucagaguauaaguuuguuuacaaguuauugccauucauauuauuuuuuuaauuaucauuuuucaaacauagucuugcucuguugcccaggcuugagugcagugguacgaucucagcuuauugcagacucugccgcccggguucaagcgauucuccugucucagccuccugaguagcugggacugcagucaugcaccaccgugccuggcuaauuuuuuguuguuguuguuguuguuuuuguuucuguuuuuguuuuuugagauggagccucacucuguugcccaggcuggagugcaguggcgcaaucucggcucacugcaaacuccaccucccggguucacgccauucuccugccuuagccauccaaguagcugggacuacaggcacccuccaccacgcccggcuaauuuuuuauauuuuuaguggagaugggguuucaccauguuggccagucuggucucgaacuccugaccuuaagugauccgcccgcauuggccucccaaagugcugggauuacaggcgugagccacugcacccagcugccauucauauuauuuugcaguuuuuucugcucugccaccugcacugugcguggugcucuuuucacagccguuuuaugaauguauauugacuugacaacucuugaggagugaaaggcuuuggagaaagcucaggcagggauguuauaugccaagauuaaggaucaccaauauuugauauuaaguugcaggucuuuugugucucuuucacaucaaauguugcugguuacugaguacacauuauauucuagacauuguuacauguuucuaucaaguaccagccaagagauuuuaaaaauuacaucuuuaaguaucauugcuauagacuuuacuggcuuuagauauaaggauaaauauauauuaaaacuuggcuucucacuuuucucauucuuccuucucuccucagcaagcuguguaauguucuugaucgacuaaaugugauugcagaaaguguggugaagaaaacagguuucuuuguaaaccgcccugauucuuacuguagcauuuugcggccagaugaaaaguauguaugguauuuuaaaacuuauaauaaaugaugauuuuugcucuuauggguauucuaaauacagcaguuuguacuacuuggaaauuggaugaauuuaguccuggggggaggcacacugcucacaugacugagugcugaauguucacuggggcaugggaauuccuuuggugguuaccuacauaccuugagauguaagccaugggaucugcaucucuugcuucauagaacaaauguuacauaaaauauuucuguaaguaaaauuuucaacagugaacuauuuuucaguauugaauagaaacagacauuuuuuucuuauagauuacauacuaacauuuuuauaaaaauaguauuguauuauaguuauucgcucacaaaucuuuuauuacuauuuugggagcuucuucagaucaaggauuuaugcuuuaucuuuuaagaaaccaauacuauguauuuauggcauuuuauuuucaguuaauguaguuaacuacaaucauaagacaauaaaaaagaacuaacuacuaguguauaugucuuuggaaguaaucccuuuguuauaguuugcauuguuugcacuuguuuauuugaauuuuaggguacccaugacaggggucccccaagacuagucccagauuucagugauucacuaggagaacugaaaggacuccgccuauuguauucuggcuauaauuuauuauggugaaaggauauaaagugacauuaacaaagggaaaaggcaaaaggggcaaaguccagaggaaaccaggcacaagcuuccagagucuucuccucaguggaguugcauagaacacacuuaauuccccaagaaacagauugugaagcaugggugaaauguugccagccaaggaagcauguuggagacucuguuuuuuuacuggaggcuggucacauaggcagccucugccugacauauaccaaaauucuugacuuccagagggaaagaagguauucaggaaaaaccauauuauuucuacaaaccauuucagcacaguuagucacucuuaucaguucugggaaugguggaaacccuccugaaauuuaaguugccagacauuggccaagggccaaccuuauaagcaggacuuucuaaggauagcaguuaggccuguuagguuaacucuuuucugcacagcaccuucuuuuaaauaauuaaaauauuaacaucaucuauaguauuucauaacaaaacauauuccuauguauucauugcacauggagaaaauaaguagucucuaaaaggaaaucuacaaaaccaaccaaagaaauauaacaaagccucuaugaauaaaagcugggggagguagagaauccuaauguugaguugggaaggcuaaggcuuggaagauuuuauuagaaagaugcccuacaauuauuauucauguguauagagaccaaacaggaauuggguuugaaugaaagcaagggagauuuugguugagcauggguaacaaaaugccagaguggacacucaggcaaauuaaaaugccccuuuccuggacugucuuugaggagagugugguaagcagucugccucagucauuugcauguucacuuaccugaaagaaugagaguaggcaggaucagcugauuuuucaggagccuucagcucuauuacuuuaauucuaugauucuuaacaaggaucugguacugaaaauaaauauguauucugccauuaaguuuuuuaaaaguguuuauuuuuaaacacagguggaaugaacuaggaggaugugugauucccacuggucgccugcagguauacacaguauuacaauucguaaugaauagaaucuguauccauuguguacuguauguuuucuguaagcaaucauggaaagaccuguaucuuauuuaaugcagaauuauuauuugagaaugauuguuaaaagccuuacuucuagucuuuaaugcuuaugaaaaauguguagcuggcugggcgcgguggcucaugcuuguaaucccaacacuuugggaggccggagugggcagaucaugagaucaggagaucgagaccauccuggcuaacauggugaaacccugucucuacuaaaaauacaaaaaauuauccgggcuugguggcaugcaccucuagucccagcuacuugggagucugaggcaggagaaucgcuugaaucugggaggcggagguugcagugaggcgagaucaugccacugcacuccagccugggugacagagcaagacucugucucagaaagaaaaaaaaaaaaaagaaaaauguguagcugaaauaauauguccuauggaauuuuucuauauauuaaauguuauuacuggaaauagaaacacaaacaagaacaugaaaagaauaaguuagagugacuuuggaaaagacgccaaguguauauacuauauauguuaacuaugcuuuaagaaugauauggcccuaaccacugaauauuuacacuguauaauaaggagauaggucagaaaaaagcccauauuuugcuaacugguaaauuagcaaauugucagcuauuuguuuuauuuuguuaaacuaacaaaguaaauucaaauauagaccagaagauuuaacggugcuguuacagcaauguauaaccuuaugcaacuuuaaacauguucuuuauuauuuugacuuuacauaaaacugaauaauauuuguucaggaauaauaccugcccacagacuuuuuuuguuuuuguuuuuguuuuuguuuuuguuuuuguuucuuaaagaaaucuaaaguaguauggaaguucuuuggugauggaauaaugauugaaaaucuuaagguauuucucuuuagacuggcauccuucgaaccaacuguguggacuguuuagaucgcaccaacacagcacaguuuauggugggaaaaugugcucuggccuaucagcuguauucacugggacugauugacaaaccuaaucuacaguuugauacagaugcaguuagguaagucuuauuuuuugcuauuugaaugcugauaauggcagaaggcaaaccugguuacuaauaagauuuuuuuaugaaagcguuucuacuuuuagcuucucaaaaauuauguugcuagaaaacauuauucaaacucguucuguuuuucuuauauuuucuucuaguaguuuuauaguuuuuggucuuauguuuaagucuuuaaucugucuugaguugguuuuuguauacguuaagagacggguucaguuucauucuucagcauaugaauauccaauuuucccagcacccauuuguugaagaggguguccuuuccccaguggauguucuuggugucuuagaauaaauauuucuauuaaaaauuuguguauucuugccaugguuugggcuuuggguuuuucuucuguuguuguuguuguuuuugcuuguguuaauuaugaauaaacaccacauucuuuagauaaauccaaaguacuuagacaaacuagugggcauuguuuuaaaacaaauccagauggcauuuuaaaaaagaguacugugucuucauacauacuaaaaaucuaagauguauaaaagauugauuuuucauuaaggauuacuauuucuucacugucuauuggaucuaugacaguccaugaaguauuauuuuuuugaaaauacaauuaaugauagcugauacuggucaucggaaauugucauaaaggcucagcugaggaaaguaaucaguuuacaaauggccacaccaacagauaucacugcacuggaaauauuaacagacacuugaagaaacacagguuucaaaaguacauaucuaagaaagaauaugguuucuuagucugcugugaucugaauguuugugucuucccuaaguucauacguugaaacccuaacccccaaaugguugguauuaggaggugggaccuuuggaaaaugaguagagcugagaggaaccgucaugacugggauuaguguccuuauuauaaaagacugaagagagcuagcuagccccuuccaucaugugaggacacagugagaagaccaucugugaucuaggaaaugggcccucaccagacacuacaucuaccagcuccuugaucuuguacuucccagccuccagaaaugugagaaauguuugcuguuuauaagccacccaguuuauggugucuuguugcagcagcucgaauggacugacaccgugacaggagcauauucuuuuuucagaggcaauucagagagcacaguacauuccguuaugggaagugaauugcucuggcaggcugcagaaaguuaggagucuuuaagugugguuagaaacaaccuggucuggcuuuggugggccauguuuuuggugccccugcuuccauuuuaguguuuucuauggcuuugguguuuacuggaauaucacucuaaaauauauuagcguuugcauuuauuugcaagauauugaagaaucuaacuugaaaggcucagaagaauuuuuaaaguauaagacuuguuuggaguuuggcuaagugaauaacuugugcuuugauuuuggugaaauucuuuaaucggguuuuucuuuuuuuagguuauuugaggaacucuaugaagaucauggugauacccuaucccuucaguauggugguucucaacuuguucaucgugugaaaaccuacagaaagauagcaccauggacccagcacuccaaagacaucaugcaaacccugucuagauauuacagcaaugcuuuuucagguaauucugaaguaauagcuauuuuuaagacuuacucugaagugcauuuuuuguaugucuuuuaaagcuaucuggcuaagugaaauuaaaauuuaauauuuuaaaaguuuaaauaaaacagucugucacuuagaaggugcucaguaaauauuuguccaauaaaugaaugaauaaacauuuguauuuuaaauaggacacuuuugcauuuuggcacccauaauuagaguuuuuauauaaugcaacacacuuuaauuccuuggcuucugucucuuucuauuuuucugcuugcaguauauagauaaaauuuuuugaggguguugagucauuuuuuuaaauaggguucaaagucucgacaauugucuaagaauguaaauaucacugaauuuuuaaaaugucaacuagaaacaaauugugauauuagcacuaaauuauacucauuaaauucuacuguuuuaugacuugugaauacuacauguaacaggguguugaaauggugcuuuuccugccuccauucugauggaauugccaauacaauagguaucacagaccaaagugauugugagacaaacccccaugcacagaauuuaugaaggaagugcucagugauugauuucaugagucuucagcucuuguaccagauuaaggauagaaaaguuuacauaauauggagaagauuaguaaagagguccuuggggcugggcgugguggcucaugccuguaaucccagcacuuugggaggccgaggugggcggaucacgaggucaggagaucaagaccguccuggcuaacauggugaaaccccgucucuacuaaaaaaauuacaaaaauuagccaggcguggugaugggggccuguagucccagcuacgcgggaggcugaggcuggagaauggugugaacuccggaggcagagcuugcagcgagccgagaucgcgccacugcacuccagccugggcgacagagcaagacuccaucucggaaagaaaaaaaaaagguccuuaggagugaacuauugccugcaauaacacccacccucagugaaaagagagugggcuucaacaggacucugggugagcuugacaugguauccugcuguugaagagacgcagcauguaggccuuggacuguugcacagcagaucugaagcagagggaugggcugaggagagugugccacauugggaauugucugcauuccuccaguugggugggccaaaggauacuugaguguugacugguaaccggaugugggccucguggaggagggugccagcaugggguuggccuggguccuggccaguaaggccccuggaaggacagagagaccuuagcagcaagauccaggagguaaacacuggauaccuaaggagccaaggaaggaauuauaagaaacugccugauaaaagggaauuguaagagaguccccagugcuggcagcuucagaagcaucugggaaagcauccaucagagucagcuguccacauuuucuaggcccagagaguuugcaaagcuggucuguuaugcuccuguccaacuguauuaguuuucugcgcuguguaacaaaugacuguaaauguagcagcuuaaaacaguacacaugcauuaucucacaauuucugugcaucagaaauuuaugcacaacuuaacuggguccccugcuuagggucucucaaggcugccauugagaaagaaccacuucccagcccacgugcuggcagaauucaguuccuuguggcuguaggacucauagcagcgugcuucuucacagcugacaauaggaugagugugcuggcaagacugagucuuacaaauguaauguaauaaugggagugacaucccgucaucuuugccauauuucuuuggucaggagcaaaucauaggugccccugcccacaaacacgggggaaauccacauccauuuccuagggcugcuguaucaaaacagcacaaaccgguggcucaaaacaauagaaauguauuuucuugcaguucgggaggcuaggagucugaaaucuaaguguugacagggccaugcucccucugaaaacccagagaggagaauccucaucggcuacuucugucaugugcuaauacguacauaucccucaggguguauaucaccaugaaaaagggcaucuguucuuuugcccucuccuguggucguugucccuguaauaggggucauuauugacacuuaaggaucaaguaaugugcuuuuuuuuuuuuuugagagggagucucgcucugucuacaggcuggagugcaguggcucaaacucggcucacugcaaacuccgccucccggguucaagcgauucuccugccucagccuccggaguguaaugugcuuuuuaauaagacuagaggacggacagaaugacuguguagcuguccauguuuaaaaaagaaaggaguaauauaaaagauaaagauauucugagaaaaugaugugcacaaauggaaagguaaggcaaaauuaugcacaacugaaagaggaacuaccgugaaaggaaugauuuuaugaauaauguggcuaaaacaggcuucuuuauuuuaagaagcaugauaucauugggguguacaacuuauuuuuaaauuacaauggguauuauauaaugguggcaauauagaagaauuuucuuuaaaccacucaagacaacuuugcaaaacuuaaucaaucuuuucauguuaugccucugggcuaggcaggaacauacugauaaacuagauuaaaaaaaaaaaaaagcgcugggcacaguggcucacacuuguaauccugcacuuugggagaccaagacaggagggcugcuuggcccaggaguuugagaccagccugggcaacauagugagaucccaucucuacaacaaauacaaaaauuaaccaggcaugguagugcacaccuguagucccagcuaugugagagccuaagggcacaggauccccugagcccaggaguucgaggcugcagugaacuaugaucauuccauuguacucuagccugggugacagagugagacugucucucaaaaaacaagcaaacaaaagcaaccagaauagugaaauuagguuguuaggaauuuuacccuugguuuauguggauggacugaugcuauggggucaacucaccugacccuuuuuucuauucauuuuaaaaacuguucuugaggcuucacaugcuagcaugcauguuggucuaggaagcaccuuuuaguuuuuaauauaacuaguuacauagggaguuggaggaugcuuuacagggaaagcauagguaucucuucagauguuagggagagcuuuuaauucccuuaagggccuugcuaagcucuuucuauuuuuuuuuaaaugcaaauuuuuaagccuggauuuucuugcuggagcuuguugaauuuaaauccuauuauaaaaaaaagauaagaaaccuacagcaguuaauaauagaucugcuguauauacguguguguguguguauauauaugccuaacauaaauauguacacccacaugcgugugcauaauuugaauguagugaauguguguaugcaugcauggaggggaaucauguucucaacagggaucuaaagagaaaagcucccaagguguguuagguuguuuuugcguugcuauaaagaaauaccugagacugaguaauuucauaaagaagagagguugaauuggcccaugauuuugcagguuguacaggaaacaucgugccauuaucuucucaguuucuagguggggccucagggaacuuuuaauccuggcagaagaagggggagcaggugucucacauggcaaggggugaggggaaggaggugccacacacuuuuaaacaaccagaucucuugagaacucacuaucgcaaggagugcaucaacccaaacaccuuccgccagacuccaucuccaaaauuguggauuacauuucaacaccagaguucggcagagacaaauauccaaacgauaucacagggucaggguuucaaagcuuaucacguguggaagacagugaucccagaagauggugcugagguggcuucaccuggcauuaugauaguacucuaaaggacugccagcaguuucuuccccuuucugcucacugcugaaagagggacaucaaagggaacaugcugagaacauuuuaauuuaucaagaauagugagauagccuucugagguuauccuucaaacagcagauugugagugaauaagcuguauuuggcaauagcagaaauaaaacaguuggaaaaauguuuuguuuuaauaacguuuguuuuaauacccuugguaacuuuuguuaaagcccaacucuucaccucuucugcaaccaaagcaguuguacauggcaagagaaaaguuuguaauuuauuacucuuaaacagacuacaguucuccaaaggacaacggacuguccugugacauuuccauaguaaguucauucuuccccucuccaaaaugacuauuucauaacuuguccucucuccuuaaaacuacaacaccucagucucaucugaugaccuugcuucgugcuucagugagaaaauaaguuauugaaagggaacuuccucuaauucuuuuuuuuuuuuuuuuuuuuuuuuugagacagagucucgcucuguggcccaggcuggagugcaguggcacuaucucggcucacugcaagcuccgccuccuggguucaugccauuccccugccucagccucccgaguagcugggacuacaggugccugccaccgcgcccggcuaauuuuuuguauuuuuaguagagacgggguuucaccauguuagccaggacuuccucuaauucucccaucaaaugcagagggcguccuuuucugcacccauaguuucuacccuauauuguauuacaaugcuugugguggcccugcuccaucuuaagugaaaccuugccuuuuucuuugaaucccaugccuucuuguguucccuaacuauaugcuuguugcuguacaucaucaguuucucugucucuaaugcaucauugccauuaacauaaaagcauaccuuagcauuuuccauccacccuuuccagcuauuccuaaucccacaugccccuccagccacaguccuauuuuucugcucucaugagcaaaaccucuugaaaggguugucuccacuguguucucucuaccugcuccacuuggcaacugcccugccaugacaccgaaacuguacuuguccagguuaccaacaauucccacauugccaaaucuaauguuuacucuucugacuccaucuuacucaaccuuucaacaacuuucaucacaguugaccacuuccucuuucuuaaacuucacuuugugagaucucucagugggauauugagaucucugucaauaggagagagucucagucuccuauugacuuccccugcuguguuucuaaaccuuucucuuuuuccaguuuuguccuagggauaucacauucagcuuuugacuaccaugcauuugacacucagauuuuuagcucuaacuuuaacuucucaugaacuccagacucauuuaucuaaaugucuaccuagcaucucugcugggauauugaauuaguuuuuuuguuuuuuguuuuuugagauggaguuuugcucucguugcccagacuggagugcaauggcgcaaucucggcucaccacaaccucugcuuccuggguucaagagacuccccugccucagccuuccgaguagcuggcauuacaagcaugugccaccaccuggcugauuuuuauuuuuaguagagacaggguuucuccauguuggucaggcuggucuugaacucccgaccucaggugaucugcccgccucagccucccaaaguguuaggauuacaggugugagccaccaugccuggccauugaauuaguuuuuuaucauugccaugacaaauuacuacaaacucagugguuuaaaacaauacccauuaucuuagaguuucugaggaucagaagucuauggacacagcauuacugagcuguauucucugcuuagguucucacaagacuagaguaaaaaugaugucacaugacguuaaaaugaagucaaaaugucagcugaccugggcuuuuaccuggaggcuuccuggcucauucucauuguuggcagaauuccaugcagcuauuggacugaugucccauguccuugcuggcaguuggcugggggccacugucaguuccuagaggcugcugcauuucuuggcuuguggccugcucuauuuuaaagccuaccacagugcaccaaauacaucuugugcuucaaaucucucugccuuccccuccugccuuccucuucagccucuaaaggauuaaugugauuacaguggacccaaccagaugauuuaggauuuuucuaucuugcaguugaugaugaguaaccuuaauuacaucugcaaaguccuuuuuaccauguaguagaaaauauucaugguaugauacuagggagcaaaggucuugggggccaaauuucuuccuaccacagaaaucuaacaaaaucacaaacuuaccauuucugagacagaaacucuugacucugucucaaguccguuucucuacuuguuuuuucuacuucaauacccauugaucaauucagaaaaccuaggaauucucccugcauuauuucuuuuccucaucacuguuccccaaucccaucugucaacaaaucuuguugguuauaccuccaaaauaauaucuucuguguuucaucccuacuucugacacgcuaguccacacagccacggccauccacuguuaucuggauggcugcagggguuugcuauucuuguuguuuguuuguuugagugaagucuuacccugccacccagauuggagugcaguggugcuaucacagcuuacugcagccuugacuucccagacucaagugauuuucccaccucagccuccugaguagcugggaccacacucgucuaauuuuuauuuauuuauuuauuuauuuuuucuguagagauagggucucccuauguugcccaggcugguuccuaacuccugggcucaagugauccucccucuuuccagccuuccaaguagcugggacuauaggcgugugccaccaugcccagcucauauuuuuuauuauuuuuguagagacagaaucucccuguguuccccaggcuggucucaaucuugugagcucaagcgaucugccugccuaggccucccaaagugcugggauuacaggcaugagccuccaugccuggccauuuuuuucaacuacuaaaguauauauguuaauuauacaaaguacagaauggcucacaaauaaaucauaugauccccaccuuccagagauagccacuuguauauuuaggggaacaugauccuucugguuuuacuauaccuguaauuuauaauaugcuuuugcucuuuuagauaauguaaugaaucuuuauaaccuuaaauauucuucuauaacaugauuuuuaguagcccuaugguacucuaucuuugagaagcaucauaauuuaguuauuugcuuugugcauuuagaguuguucuaaacaaacaucuuugaacauauaccuuuuugcauauuuugaucuuaugaaaaguucagaagcaaauuuauuaggucagaggguaaaaauaauuuuuagggcuuaaaauaucuaucuauauauauuauauagauauauauuugccaaauugccuuucagaaaggauguaaacaguuaauguuccccuuggcagaguaugggagugccuauuuugaaauguauuugccaacuuaacagacagaaaaugguauguuguucuaauuugcaguauuugauaacuagcgaaguuggauuuuuauauauccauuggcuguuucuguuucuuuugaaaauuguguguaccuguuuuucuauuagggguuaaucugugucuuuccuacauuuaguugguauuuauuucaaugucugaugugagguaggggucuaacaucauugucccuuccacccccaccccaauacuauuguacuguuuauugaauaauacuuccuuucauugcugauuucagaggacacuguaucauaaacuuaauauuagaauaagagcuauuucaguucaaaaaugaauuuuuuucucuaauuaaaaagaauuguuauauuuaaaccugaucuauuuaaauguagucaguaguaaaauuggcuaauguuuaaccuguuugaaugguauuuggugcauauucuuucuucccuucaagcacaauuaaacauaaaaguggcuaaucauuucgcccucuuguuauccacaaccacagagagccuaccaguuuuaaacccuuguucauauccagaguaccaccaucuuccuggaggugauuguuuuauuugcagucagaaguagccaggagaagauccuugggcucauuagggcuggccuuauaucucaagcuuaguaagugaccguaaacaucauacauguauuuucaguugcagcagcaguacuuccaaaaaggcuucuuuaugauccuuugaaagaauauucuuuuuuuggcuauguuucucacaucuuacauuuuaccauacuugcuaaaaauuaaagguaacugcuguuaaaggaugaaagaaacuccuagaaaauguggcugaaaagugcaaagcuucucuagauuauauuaagauauuuugagguacuacguagaaugaacuauuaagugcuauuaaggcuauuuaagaagcagaaagaauguaauugccauaagagcaucauguuuacuuuuguauuauguaaagaggguacaaauuggggcaguaauguaugcauuauuuaaugcuugauguuuucucucaacaagugcaaagaaaguccccaaaugugcucagcauauaaacaugucccuuuuuauauauuacuuuuagcccgaaagguaagugcuguuuuaaugggaugcuuccugucuaauaucugaaauacauguuugauguaccguauuucguauuucauucauuuaguuuugcuguaaugaccaaauaacccaaugagaacaguguugcuaauuucagguauaucuuguucgcuauaacuguuggaagaaaauugauuuuauaauaauguuaccuuguuccaaaugcagucauuucuacugugcuaucuuuuuaguucuaugcucauuuuuggaaagagguuauuauuuauauuguggaugucugccacaaacuucaauauacagggcucugagacaagaauggaaagaaggaaacgaggagaaagaacgaaggacacuagggaggagaauguagaaugggaugggugguucaugagaccacuucagugcauauuaucauuguuaccaaaagauaauuaggaaaaggaagaggaaguaaaacauacacagagucaguuuuguuacuucauaguauaguuuaaaagguaauuuuggaaugcuugaauaguuagaaugaggcuguuaccaugugccuucuuugccuucauuuucaaccacaaaagagaaugggccaggcucacagcugacagggacaaaauguguuguaaacauugucucuguuaaagaaagggagaguaucuuuucaaggauuaaaaguggagacaaugcaacugacuuguucaagguugugcaacagaauauggauagaaauugggucauuuuauuugucucugaagucucugcuugucuuugcaauaaagugaagauacauuuacuucagguaaaauaacaaauggugaggauauauuuucauuuuaaaaauaaaauugcuaucuaagguauuuacuaucugaguucuuaaagauguuuaagugucuccaaauucaacaagcaguuuauguucgcuaucaucuguauauuuuaugagagguauggaacaaagaggaaacauuuugaagcaagauuuuaauucugcuccaaaucuugguaacuuauguguguguguaugaaguauuuguauuuguauguauuugaacuauaaauacuacuuuuguaccacuauccuccuaagaaaauauucucuugaguuauauauccaucaguaauggauuuucugaaauauauauuuugcuuuuuagaugccgauagacaagauuccauuaaucucuuccugggaguuuuccaucccacugaagggaaaccucaucucugggagcucccaacagauuuuuauuugcaucacaaaaauaccaugagacuuuugccaacaagaagaagguauuuuucuuccuagucuguaauauaaacucccauuugguguuauuuugaauaugagauacuuuucauuuugagaaaucauaggcuaaaauagucaguuuuauuuuauuuuuuaaaauuuuuaaaauuuuuuguggguacguaguagguguauauuuuuaugggguacaugaaguguuuugauacaggcaugcaaugggaaggaaguacaucauggagaaugggguauccauccucugaugcauaaagcagucagucuggccacaugcuugccaugaguuccguacuauugauguccugauaguagguuggggaaaauguggcuagcaauuguuguuuuguauuuucucuaagauaugaaguuucagaacuuccuuguuaaacagaaguuguagcuccacuaaagcaaaccaacaguaucaucuuugaguguuuccuacaaacuugaaacucucaaggacucuaagaugcagagagucagucuuagauuuuucaagugugacagcuaagcagcauguaccuuguaauuccaauauucucuccuccaggaaacaaccagucucagugacacugggaagacgggaagcuagagcagugcuacuagcuagcgucagauaaccacuuucauguccccaccacucacaugcuugagucacuugccaguacagguuauuuugaguacaguuaaauugguaauauaauauucucagaagaaacaaacaguuuaccugaagcaguuuagugugaugcucuguggugugagccucaggaucagguagaguugaguuggaaucucugcaguucugugaccugggucgaguaauuuaaacucucuaagccuuauuuuccuuaucugaaaauguaaaugccuggacacaccucacagagucauugugaggacuuaaugaggaggcuuuuuaguguuuuuaacugaggagucauguacuauaauaauauaaucaauuuugccacaugaacaaaauuuuuuacauaccauacaugaaguuagagccuaguccauugcacucaaaggccucuaaugucaaguucucccaucgugcuuuucucuuacagcaucaguuugauagagcccuaauuuugcgcaaagauaccuaccaggccgggcgugguggcucaugccuguaaucccaacacuuugggaggccaaggcgggaggauuaccugaggucagcaguucgagaccagccuggucaacauggugaaaccccaucucuacuaaaaaaaaaaaaaauacaaaaaauagcugggcauggugguacgugccuguaaucccagcuacucgggagucugaggcaggagaaccgcuugagcccaggaggcagagguugucaugagccgagauggugccacggcacuccaaccugggcaacaagagcaaaccucugucucaaaaaaaaaaaaaggauaccuaccaaacacuacaggaaucauugccagucugugcuaauuguguguaugggaccaugaacaacugacagaguugcaaguacagcucuugcaguuguuuuuuuuuguuuguuuguuuguuuuuuucggagacagagccucacucuguggcccaggcuggagugcaguggcgcgaucucagcucacugcaagcucugccucccggguucacgccauucuccugccucggccucccgaguagcugggacuaugggugcccaccaccaugcccagcuaauuuuuuuguauuuuuaguagagacgggguuucacuguguuagcuaggguggucuugaucuccugcccuugugaucugcccgccuuggccucccaaagugcugggauuacaggcgugagccaccgcgcccggcuucuugcagcuguuauuaaguucuguguugcuucaggaauauuuaaaauauuuggaaggucucagaauuuguauguuucucaaauuuauucuuaucaaugcauauuauuggaauaaccaacuuaauacuugagcuuacugucccuauaaauggagcacugcuaauuuuuacauuaaauuuauuauuaauaaaauauuauuuacaugaauuuuugcugacaaaaaauuugaaacuuuauuuguugagagauggguauaaauaccuauauuuauauuuauugaugacaguuaaccauagguaaauaugguugauuuucugaaauuuuguauuacuuuaaaguguugaagcuauuuagauacagcuugggaacagccauaacucaauuuuccacugcagaaauuagcuauguauuaaaagcauaauuuaaaccccuugcucaccuugaguuacaucacaaaggcaggugguuugagaguuuauaugugggaauaaaaggaagcugguauuacauccccauuuucuaaaaaaggaaauugaggugcagagauaaugucuuggcuaagauuauucaguuagaugauucagugagaaucagcucuaagccuaccacugaaaauaaaauuguaucuaaguagauaauauggcuuacucaguugauuuaggucuccuuuuucuguuuguuuguuuuuccucuagaaugucaaaauucugaaaacuauuuuuuggugucaggggaagagggaauugauacugugcauaaacaauuuuuauaaauacuguaagauaaauuucaguggguuuuuaaaaaaacuuucuagugucacccaccuguacagguuauuuugcugacaguuaaagcagcauuacaguucucaaaagaaaugaacaguuuacccagaggcagcaacaggacaagagcacagagcucaggcucacguagagcugaguuggaauuucugcaaguguauguggccugcgacccauuaaccucucaaccucauuuucucaccuauaaaauggagaugauuauacauaccucacagggucauugaggcuuaaaugggaaaauauauggaaaguacuuaauacugggucugacacagaauaaacccuguacugaaguagccaggcucuggaaagccugccuccaguuaauaccugggugaccuugggcaagucacuuaacuggucucauucuguuuccacaucauuaaaacagagacaauaauaguaccuaacuuacagcuuucucugagaaucagaugagaucauauaaaugguuagcaccuagcaaauacaauagguguuaguauuguuacugucuuuguuuuugagucagagucuggcucugucaccuaggcuggagugcaguggcgugaucucggcucacugcagccucugccucccagggcucaagccaucuuuucaccuuagccuuccaaguagcuaggaccacagguggacaccaccacacccagcuaauuuuuguauuuuugguagagacuggguuuugucauguugcccaggcuggccuccaacuccugggcucaagcagucugcccauuuuggcucccaaauugccgggauuacaggugugagccacugcaccugcccuguuacuauucuuuaaggagauaacauucccuaguuuuuaacauuuauuaaagaucauacgggaugcccauaaagucuggaaacuuagauaaugugacuuauuaauguaauauuaauaaagacuuuauuauuuauucaugaguguuuugaaauuuguggcaugcuguaucuuauacuguguuuaucaaugauacaggaaugguauagauaauggcguggcauaucuaugccaugaaauaauacuuuucuugcacaauaagggaagagggaauaaacuuaacucuaccuagagucauuggaacaagguccucuugagauaaguacuucgaugacacaaaaucucacauugacugaucugccuaaaaccacuaauugaagcuuuguucugaauuugauuaauauggcauacaaucaucuaagauuccaucuaaugaacugguguuuagaaugucaccaagauguuuuuagguauuaagcauuaauuauuucauugacuccuagaguugggagauuucuuggccugcccccugucugauaugugaguucccuuucuguuucccuagggagagagagagguaaucuggccuaugcuugacaaguucuuguuugucaacuguugaagaggcaguuguuuuggaacaguucacuuacacaauucuuccucaugucaugcugagaucugcuucucuguaaucuuaccuauuaauccuaguuaaagaccuuaaaaacaagauuuccucauccacuugauaaucuuuuaaauauuugaaguugaguucauacacuuucaaaaucucuucuucuacugguuaaauagccccaguuucuucagcuguuccucauaugcugugguuucaaggcccuccagcauucggaacaacacucuccucuguguauauuccaguugaggucaauguucuucuuaaacuguggcccccagaucuggguccaauaauggucagcauuuggucugauuugugcuagcuguucugagaccacugggaccaucacuccccuuguccuggaugcuguguuuucauugauaagcauaaggucacaccagccauccucagcauugccaucacagugugcauucuccaagcuuccugucuguuagaacuccuaagucuuuuuaacaugugccgcugccacucugccacaucuguaccauucuugucauguucguauaugcuuugccuacuuccaaaaaaaguauugaaauguguaccuuuaaugaauacuucuagcuuuauaguuucuucagauuuaaucaguugaccaucuugauccuaauucaaguacuugaugaaaaauguugaguacaguaggguaaauggcagaacccauugauuucuacccacagacaacuccuuccacauaacauuguuuagugccuuugauuguaaucauuuaaacagcuguaauuucacuuaacuacacuauugcccugcccauauuucucugucuuguucacaaauauugauugcucugcugacauucaugaauguuucagggggcucccaaguuagcuaggaaaauuagacaguguaaaaauuuucccuaaccuuccuauggaaccgagaacucuuaauaauacuaggaacugaaaaagaaaagagaaucugacuuacuagcucuuuuguaugcaaagaagggagugacacuaacuugcaaucuccuguuuucugaucccuggucccaaagcagguuucugacccagugcauuguucuuccucuggauaaauguaccugguaguagaggugguaaagauuccccuaucuugggcuuagucgucuuagaugcucuuauccuccauccauuuuagcuuaucuuccccaaggcagauauuucuuugcuucugagacucacccaaaagacuuggaaucuuuuaaaaguguuguuaaauugcuacauauuguaagggaaauacaauuuaguaauauuuuuaaaaaguuuauggccuggucuuaaaucaugaauacaugauuaucuuuucauuuuugcucaccacaagaauucugaguuaaaacacauuuuuuguaaugucuacuucuucuuccuaagcaagcugauuguaagcaacauucuuuagggaauuucucauauacugauaacuucucuacuuuacucgucugccaguguuagaucaucacagaauuagauuuacucagaugcaugcauacacacaugcauacaccccucuuaaacaauuaguccaugucuuuuucauuccccugaucugacagucugauuuuccuauuaggaaaggaaaugauauuagcuugguguggcuuguuuuugugaauagaugugaauucagagaaugcauuggcuaucuuuuuaggucacuuacaacacaucucgaucucauauuugauucuguuauguugcugggaucaacaucacuuacaucacuuguugaugucugguuuuuggaaucugucacccucucacugcugagcaucaagacuacuguuauccucagcaaacuaaugcaggaacagaaaacuaaacacugcguguucucacuuaaaagugggagcugaaugaugagaacacauggacacaugaugggagagaacaacacacaccagggccugcaguggugaggguggaagggagagcaucaguaugaauagcuaauggaugcugggcuuaauaccuaggugaugggaugaucugugcagcaaaccacuauggcacacauuuaccuauguaacaaaccugcacguuccgcacauguaccccugaacuuaaugaaaguugaaaaaaguaaauaaauaaauaaauucugcuaaauguaaaaauuaaagacugcauuggcccauuuccaguaucagcuccauguuucacuguuccuuaaagauuauagaucucagcuacaccgggacacuagccucuuguagagacgcucuagcgccuccuucugucuucuggguuguacacaguucccucuuguguuuuuucuuucaggugcgaaacuuguuauggcuagggaggauagaaacaguacuggaauuaaguagcucuacuuucucugucauugcuuucagcuuggcacuuucaacacauagagcagugucugacacauagcaggugcuuaauaaauguggaauaacugaaugaauucuucacaagcagcagccuuauccuugcucuguucuucucauauucaaagccuuguuauugaaaagggguuggaggaucugccccuuugguuuugcucaggaguuugucauagaggcagaaucucaggccccaccuacugaaucaucugccuuuuaacaagaucccaaagugauuuacaugcacauugaauuuugaauagcacugcuguaaagcauaacuucagucuaaaacaaaacuuuaggaaccuuuccuguuagaacagugauuugccccacacaauucauuaggcuucauauuccuuuuuucaucauuagugguuguguauucugcuugccaucccuaggagaguucccuguguugccaguuucauuuggauacuuuccuguugcuucauaaucaggauuauucaagauuguaauuucagcuuuauauuuuuagaaagccuuucauuuauauuaaaaucucuuuuuagcaauuuuuggcuauaggcucuuuuuuuaaucuuuagaaaucugauuuuuaaaaaauucuucuccuuccuagcucucaugaacuuugacauauauccuuuuccucuaaauauucauuucauuagaauuugauugagaauuaaauuagguguucagagagaaggccacuuaggauucuuucagauucuuugcuuauagcagacgagccuucuagcagaaauccagacaggugacauucuuuacucuuacucugacuagcuucuguaaucaaguagcacauauuuacaguuaaagaauaacggucuauacugcuuucuaagggaacuuguucguuaggacugucuaauucguuccuuaaugauuuugcuuaacuguuuuaacuauacacacagguguguacuauacagcagaguagauucuaacuaucagauaacuacacgcaagggaauccugguuguaggacuugggucaaggucccacuacucaccugguggcagaguaagucacuguaggcacagucccugggagaaguuaacagcaguucauagagucagcuuauuaccuucuaauccuuuuuagcuaaaaguaaauaauaucagagcaucuugacucucagguguauucauggcauuuuuguagaucugcaacauaguugaaggaagaaagcaguugggaagggaauuaccauguugaagaccuacugugucaaaagcuuugcaaacauguuuuaaaaagaaaaauauuaacuuugaaguaggaacauguuacuauagaccauauaaauuauuuuauccaguaaauuuuagaaaaccaacauuuacauuugguucaucuuuuuuuuuaauuuuuauuuuauaguuauacuuacugguggacaccagaggugauaaagcauuuaccauugcccuaugaugaagguagguaacuguuuguguuuuaguuuuuacacuaacauauuuuggcauuauaccuuaaugaacuugaagcauuaaauccuuugcacauaguauuuuauuagaaacaaaugaauggcuguucaguauuauguugcugcuuuaauagauaggauauuauaacaucucuuagcuuuuuaaagggcaggaauuauauuauacuucuuuuuaucuauguaggccaauaccuuguauugugucuuacaauuauuaugugucugucaaauauuuagucaguaaaauaugauauaucggcucaucacuuuaaacuaauacaguuuauauuucuacauauuuugggagaaugcggaggaaguaaggaccuauucacaaggagaacuuaaaacuuuuuuccugugcuaauaagcagugaaaaaagguacagaugcauguauaaaaguacauuuuagucacauuuaaauuaaauuucauuaauuugucagaggggcaggaaacauucuauauuaaaggaaaaccuucaaguguauaauacauuagaaugauguuuccaaauuuaaauaauugccaaauuuuaaauaaagcuuaguucuggcuuuguuacuaacuccccugaccuugagcaagcucauuuuccauuugguaaaggguuccuagcaagaucuccugcgaaucuggaaugcuccaauugaggacuccaucuagucaugcuucagcaucccaacuuuggguggggaaggccauaaaguaagauuacaaaguauuuuugguucuuauuaaguuauaaauucauuuuggaagguauuuguaacuugaaauucugggcaaaaucauuacucauauugcugaaaagguuuaguuguucugggagaaaggaaaggguuuuaacuaacaguggcuauuaacagaauuugaaauauaaagggaaacuuagggaaaaagcuguacaauuuuuagcuaaaacacaaagggcauuuauuuaagagcaaaaaggaauuuaaagaaccuccucuaaauaacugccugcucccauuggacuuccugaggcccuccuggcuccuuagagcuuguugaacucagcuuugcauuguauuuucuaugcaucuaucucaucuccuuucuaacuguguaaguguuggaggcaggagcuuacccucggucagggcuguaucccccacagagcuuaucacagugcugucugugaacacaguuaauauuauggaaauguuugcuugcuauaaucucagacuuuuagaguaacaugcaguaucucucuuaguuaucugugcugugaacuuaaagaaguugauagugaagaaauuccacaaauaugaagaagagauugauauccacaaugaguucuuucggccauaugaguugagcagcuuugaugauaccuuuugcuuggcuaugacaagcucagcacgguauguuguguguauucugauaccauaaguauuugagaacuguaguuuuccuaguuuguauauauaugucugucuuuaccagaaauccauucuguaggccuucugucagguggguaguccaccuuugaauaccuccugugauggggagcccacuacuucaagaggcagccccuucuauuguucuauugacaguuggaguugauuucuccccuuugauagguugaaaucugccuccuauuaguccuaguuugccauuuggaauaaacucaguuuuuucacugaacauagaaauugagaguugacauaaauuagugggaaaagcaucaucuuugguacuagaaaggcuaggaugugaaucuuaguucagccacuuccugugugaccuugggaaaauuauccaacuuaccugagcauuauuuucuuaaucugucuuucucugucucucuucuuucucucucccccacacacacacgccccgcaagugccuuuguagugccugguacaggcaggugauugauaaaugguagcuauuauuauuacuauuauuauuagucauaggacaaaucuaguuucucuuuugccucaagauauuugaggaagcaguauucauuuuuucaggguaaauauccuucauuuguucuuccauaacuuauguggcaugguuuccauucucucuccauccuagucucucaccuucagacacauuucauucucuguaucucuuuuagaauuugaugggacccuuuaggaaaaacgcugggaccagaauaagaaaaucgagcaaagaaaauuacuuguuauauuuuauacuaaaauuuaauuuuuuauauuucacauuuucuucagaugugguauuuauaugcuuauacuuugugugguacauagaaacauauucugugguuuuguuuccuagaaaucacucuacauuuugcuucaguuucagauaguuaggaacaguucgaaauucuuacuugcuugauuuuucaaguaaacuuguuaagguuuagcaguuuuaacuaugagaccuuugucauuucuagaaguuguuaacucagcaaaagauaaaugacauuagguauauguguucauauacauauaaacccucacuucacaucuuugacagcuucuuggaaacugacuuuaaaugaaaugaugucggaaaaaacaacauuauuuaaggaccugcuguacauuguuucacuggaagucauaguuuccaagaaccuaucaaugacauuaagugaggacuuacuguaguuaauuguguuugugguagcuguguucuauaaagucauugcaaacacugaauuaguaaauacuggaccauugcuucuaagggaaauacaggguuagguuccugagagccucuggucacaucauauuugucaaccaaucaauacauaaccuaguuuuguguauguuuuuguuuaaagacagaaacguaguuaauauacaaucagucccugccuuauaaugauucaacuuacgauuuuucagcuuuacaauggugcaaaaguuacaugcauuagcuagaaacuguucuucgaauuuugaauuuugauucaaaauucuuuauaauaacuuuacuauaaaacaggcuuuguguuagaugacuuugcacaaccauaagcuaauguaaauguucugagcacuuuuaagguaggcuacacaaagcuaugauguacaguagguuagguguacuaaauacauauucaaguuacuauggguuugucaggauguaacccccauucuaaguugaggagcaucuguauauuguugauuuauuaacauaacacucauggccaacagcacuauagcucaugccugaaugaagcuuaucuaacacacauguuuucucugucaggugcauccaagcuuucuugugcuuaguaacacuaaacagcuucagcacuauguguggggaccaucuuaaauagcaagaucaccaaaaaaggcaccaaaaaugugaaaaacauggugucaaauagacugugaaaaagacacucauuuacgauaggagagcagaaauuaagaagcggaguaccccuuguucagccucagcugagaacauaagcaagggauucaaaguuuucaccacucuguacaugcacaugucugcagugacugugaaaguaccacgaggauugauuuggggguuacagauacaccuuagugagcaagcagucucacaaacauggaaugugcaaaugaaaacgaucaauuguguauguucaaaaagaaaagaauuuaagccaguuacaucuuugaaacauuugcaaauguuaaaauagcuauuuuaggccagaaucaagauuacuuucuuuuccuucaaauaaugugauauucagucacacgcuuggagcaguguccuugccagaagccaggagucuuauccaucagaaauccuggaacuguugcguuuuuggcaucuacuguggaaucuggucuggcuucagcaguaauggugagguggccuuugcauaauguggaagcuuuagcuuaucucaguaagugguaaauuaaaagaguuucuauuuaaaguguuccggcaguguuuuaaugaauuaaccucagccuaaugagguagauguugguauuucaguucauaccacuguguuuuugaucauuaugucuaccuccuuaggugguauagcuuaaaaauguuguccaugaaacugaacagcuuaguguuuugucauuggccuuuaggaauuuaaauuuuaccugagaacuaaucaugauauauaaccagauuaaccagaugguauacaucuuagcagaaguucagaugucaacacuguuauaguagaugauacuuaaauucaaaacuacugggccuugugaucauagagaauucacaguuaagacugauaacauugaaauuaucuagugcuguuaauuaaugguuuuaugucccuauugggccucgugaucauagagaauucacaauuaagacugauaacauugaaauuaucuagugcuguuaauucaugguuuuaugucccugacaaguuggcucagaauauguaauauguaacuccuagaguuaagaaggaauauuguaagagugugaacugagauggaagccaauaucaucuggauggacaguaauucauauguaauuguguuuucaccuuucuuuagugacuuuaugccuaagaccguuggaauugauccaaguccauuuacugugcguaaaccagaugaaacuggaaaaucaguauugggguaagauuuguguauagaacgaaacuuuaaagauuuguguaaaagaauaguacuugcaauaugauuuccaccaaaaacuaauaacuucaggucauauauaguuuauuaauaacacugggaucacuaagguguucaauacugaaaguagaauuuaugggaguuucagcaauacagugcauuuuauuguuuuaaauugggaauauaacagaugacauaaaggcaggugacagauaugaugucuuauaaauaacucagcauucucuguuucccaacaugaaauaguuaaguaaaaauuuguauuuauuauauuuauuuuguuggcauccucaguaacauaaaagcaaauauacccuguuacggaacuuaauagauuuuucugugcauugcuauaacauuauuugggggaagacuauuauuuuauucaguccaguaaagaagaagauauacuguguuugcaucuucaugcuuaagagacuggagugaaauguguuguuuccuggcaugagaaccucuuucccuuccacugaccugccuagucucagugacagauuucuucuagacucuggccacauaccccagccagacugcagauacagaguccuaauuguauggaaucuuaauuguauucuagcuaugugugauuuauccaaugggacauauauugauauuuuccagaaacacuauuucuguggcuuuuauauguagccuuuaaauagcucauguuaagcccugaccagaugcuaugaggaauuuaaaagaaggaaggucuucaggaguuuggaauucagggaauucccagaacaaauaaguaaaugaccagcuauauuagugugugucacagaaacguuaccaacuuuaauuuuuaguugcaaaaggucagagacugcuuguuuucugcaauaucuaacccauggucacauaaaauugcauuuuccuuuccuagaacauuucaaaauauuaugguauuuuuagcuccuuauagagaauuuuuuaaagagugaaauauuaaacauuuuucauaaagcaaaaaguauuacuauaaaugguuuucugaauuuaaaaaacagcauucuuacuacucuuccaauuuggcauuaaaaugaaaguaaauacuuuuauaaguguaggguuuuccccccuucuauucccuacuauuaaagggaauguucagcaaauacacuuguuuacuaauaacacaauaaaauuuaaaauguaguuuauguucaucaguuguucauuauuuggauacacuaugauugauaaaaaauuuauaggcgggagagaaauauacauagguuuggcuacccacuuuuucuuggaccuuuuaugaguuacagcuaauuuuaauaauaucccaaacauacagucuucuauaauuguaggguaaguuuugagaauauugauaucaguuaccaaaggaaggcaugguaaccaaguggugagaagauuuuuucacgcucugcaaguaauuuucauuuauuuuuugaauuuauaacagggcuuauauucauauaaggucagugcauggacauggagaaauaugaaccuuuucccuguagcacaaccugaauccagaaacuagugucacagucauuuucuuaugcuucacuaggccuaaggcuuugggacagagugauagacaguggguguugaggguuaguuuaaagaugcuucacuuccauauuauucuuuuaaaagaaacaaaagcaauagagaagaagcuguauuacagcggaaaacggcagccagcgccccgccgccccccagcgaggaggcuguguccagcagcucugaggaugacucugggacugaucgggaagaagagggcucugugucucagcgcuccacucccgugaagaugacugaugcaggagacagugccaaagugaccgaggugcgggggagggaagccuguggcauccagccugaagcccuggaaaaugaucuuuacaacuccgcuuucaguuaaaaggcugagagcaagaaaaugucacauuaucucacuguuguguuugaggcacugcauaagaugaauacauuuagcauuuacaugauuuuauuucauuucaaaauaaaauugguguuuuugcucgcauguguaauggugaauuucugauccuuucagaauuuucaagugaauucuggcccucuuugaucagcccauccgcuugagguccauuuauucucuuacugggcacauuguuggaucacaggauuuagacguggccuucacaaucuuugaauggcugcaaugggaaauucauccuguucaauucaauauuacugauagauugggggaaacaaauagaaauaagcaacaaaaggaccaacucuagcuuuggggaaauuugauuucuagaaauauccaaaacucauuuagaaauggauaaggcaaauaaaaauguguuaauacaagagcuaaauccauguuccagaaguuggcaaacuaugacauauuggccaaauccagccugaugccuuuuuuuguaaauaaaauuacacuggaauccagccaugccuguuuguguuuacucauuguaugugacuacguuugcacuauaacagcagagcugaguauuugcaacagagacagcauaacccaaaaaaguuuaaaauauuugcuaucuggccuuuuacaggauaagguugccaacuccugcauuauacaaaaacaccuaguaauuauuuaacagcuuuuuaaaauccuagaauaaacuauuuuuagcagaaauggaaaucaaaauuuuuuaaaaccaucaacuaagaaguuuaaugaacagguuaaagaagcacugugauugcuuuuguggaaaaauucacaguuucauuuuuuuggggaaauuauugauaugcuauaugucuaaaaauucuuccugguucuucuuuuuuuuuuuuaaaccccagaaugugguccaacccaugaaggagcuauauggaauuaaccucucagauggccucucagaagaagauuucuccauuuauucaaggugagauacuuucauguagauauuaaagaaaaaugaauauuuauaauuacaguaacuucuaacuacuauaccuuuuuuuuuuuuuuuuuuuggagacaagagucuugcucuguugcccaggcuguagugcagugguaugaucucggcuccugaguagcugggauugcaggugcacgccacuaugccuggcuaauuuuuuauauuuuaguagagacgggguuucacuguguugcccaggcuagccucaaacuccugagcucaggcaauccgcccaccucagccucccaaagugcuaagauuacaggugugagccacugcguccagccuaauauaacuuuuaagaaaugaaaauagucagcaauacagaagaaaaugaauuccacuuaaaaugcaguuucagcauugaggcggucaaauucugaaacauugauuuauauacagaguuaaagugcuaaaugccugagacucugccccucaaugauaaaaauuuaugaugcaugcagguaucugcacugcucauauguaaacuacaaaccaaaguaccaguacauuccugcauuucuaaauccucaagaucaaagucccuucucacaaaauaaaucugggauauugacaaaugaggaccuugcaucacuuuagguccuggaugcuggugggaguggugacugaggaggaaaaagaaaacaguaauaauagggugcuaauucacaauguuauaggccuuuauuaggcaaaucuaguugaaaggaggggauacccauaaggcauucccugaaaucaugugcauaauuucguguguauguguguccuuuugagaagauagauuuagcagauucucaaaagaauccuucacucagaaauccccacgaaccugaugagaacauugcaaacaccuccucagcuuaauacauggauuuagaagacuugauuauugcauaugaauacaguuccacuuauacaaauuuguaaaugugucuguaaaauguaaauuguauaauauaaaaugagcacugaucuucaguuauuuuuaaaugagggcauuucauuuacagaauccauugaauuagauauugucagcuuuucauuucaauuaauaaaaacuacucuauaauauauaaaauauaaaaugcacagcauuuccugacugccaaagcagcuccuguaacuugcacuuuuuugaauaugcgucauugacuggaagccaauuuagucaucagagcacagccacacccuccucacucugacacacaaacacacaguacuuauucaucauggcugucagaacucuguagccaaacucuguaguaguugaagugggccuuuacaaaccauguggccugaagaaugaauuaucugaaguuacugacugaguaauaugacuuuguuuauugcagagggaaugaguguaugugccaaggauugaagggguuacuucaggggagggaggaacccauguccuagaauaaaauucuguguuugauauucugaagauaauaccuccuuucauuguauaacaguuuacacuguuuuguuuguucuuuaggcaauucuguaguagauuaaaaagauauuauccccuuuuaugggcuaauagcgcagcaaguagagccauuuagugccuuauccaggagucauauccuguguuucuggguaccgugggauuuuaggcuguucccuccuuuuuguucucuugaucauaaucagcugccucugcuuaugaugcagaccuugggggaaggggagaaacggggcugaucauucuuucccugugaguaccccuuccugugggcacacugcccuuacugccuugccugcccuggaauaucuccccucuccaucugccaugggcauugcaguaggcagaggaauccucccuccaucaguaucugugggguaacugugccagagggugaccaagggauguucagggacugauuggcacccacuuuuggcucagcuaggcucuggagcuuucuuagugccuccucugauccaaaggggagaguuucaaggcagggcuagagcccagguaguucugcgcugaauuggcaggugccccugccaccccguuucugcacucaguuggcuggcuauguuugugcacauaguagacagugaccuagccuggcuugcauguaacagcucccaccuggccuaucacagaaccaguggagaagggaagccacacagcuagaagugguuuccgcagccugucuuccagcuucccauucuucugccuguuuuuccuaccuuaggccuugcccaccuuuggacgccuaaggauuucucgguuuuguaguuuuuuucuaauugcugagccccgcugucuaugucuuccuuuucccucaccuuuucuaguaucuuugguuugcuauuuuaccagaccugaaagcuuucuacuuacuuccucaaagcuucauacacuugccaguuuuuuuuuuuuuuuuuuuuuuuuuuuuuuuuuuuuuuuugagacggagucucgcucugucgcccaggcgggacuguggacugcaguggcgcaaucucggcucacugcaagcuccgcuuccgggguucacgccauucuccugccucagccucccgacacuugccaguuuuuagaaaacucuggcagugauuguacaccugauuuaagaaguuuaaaguucuguacaaauaaucaguacuauguggcauucuucccaaaaaauggaucaacauuuuuuacuugcugaagauauaaaguuggauaaaaguaagcuguuugaaaguuuuucuuuagcacuguaaugauacaauaauugguaguuucuguaacacuuucuugaccuuuaaaaaagcuaaugaaaaacaaaugguaaacuuuuccauagucuucaaagaaaauacuuuuaaguaguuaaaaaaauggaaaggaaauaaggaaaucuguucuuuugguuucaguccuuuuuuuuuuuuuuuuuuuuuuuuuugagacagucucucucugucacccaggcuggagugcaauggcaugaucucggcucacugcaaccuccgccucauggguucaagcaauucuccugccucagccuccugaguagcucggacuacaggugcaugccaccaugcccagcuaauuuuuuguguuuuuaguagagaugggguuucaccguguuagccaggauggucucgaucuccugaccucaugauccgccugccucggccucccaaagugcugggauuacaggcaugagccacugcgcguggccuggaaaucaguucuucagaccugcccuguaaccucccaugggcaaauuagaacaaaacuacaaaaccguauccuugaaggaaagacagauccaugcaguccaagcaggcuuccagcagauaugcacuccagaaagcugcuggguauccucucugccugcugaguuggcccaggccauuuccucuggcucuuagcucaaagccugccuuagugcuguucaagucugagaagugcuguucaagaccuuucagaagaggucauauggccguugugcucaucagugggucuccccaaccuugguugaaaguguuccucuuugaaguggcuagaguacuugguggggggauucuugugguccagaggaaaccuagucuguggccggcucuuagcagugucccugcuucaggagguggauccccagccugauccugcccuuuccacgucacuugucucacugccagcaccauccugcaugcuuccccccaugcuuccugcauuccacgcauuagauauuugucacccuuagaugugugaggcucugcaagaucaucuuccuggcuucaggaacauuucuguucaaguucugcaccauguuuaaauuaauagaaguucaauggcaugcacauuugauuucauucuuuuauccaugguuaugacuuacauuuuaaguagaaucccuuuuccuacuuuuaacaagcccacuuuaaaaucaggcaaagucuuauguuacauacaguacucuuagguguuuuucugaaauaagcauacuacugaaauuugaaagcuuacaccauuuugugugaucuacugaauuaauugcaaguacucccuucuuuagcugacucuuauccauuguaauuuguagauuuguucagcuggggcagagucaacauaaacaagacaagaauagccagcagcccuguucuaggugcucagauggaguuauaaaacuguaaguacuagauuagaucuuuaaagaaaucuuuguauucaugccacucauagggcuuucuuuaaagacuuuuuaagaaaaagauucacucuugucaccaaauuaguauaagcaccaaagugucuccuugugguaccuuacuugaggaaaacugggucucugagggauagggaagagguuggcagcccuaaugguccugaaaugcaucuuuggagguggguuuggcauuguuggaggcuuccaaccaugaacucugcccuccacuggguagaagugggauggugaaacagcucugauccuggagacaugcucaaguuuaauacaagaccuuugaggauauggaucgauuugucucuucuagcuguauauccccaucaguucuaauaacuugcuguaaguuaaacagguguuuugugaaaucuuaaauaaacggaacuauguucaaaucauacuacuucccaguuuuuuaccuugagcaaaugacuuaacugcuguguuguugaguuuccucaucugcaaaagggaauaauaacaccuacuuuguaggacagugaugagacucaaaugaaauaauguacacaaagugcuuagaguagugucuagaauacguucugaaauaguugugaucaccaucaucauccucuucauauucaucauuauugccugcuuguugggaccuaacaaagcaaaggguugugaccagaagaggcucccugaugccguaugcucaguugaguugcuuccauaaaaugggucacugugggcggggcaugguagcucacgccuguaauccuagcacuuugagaaguugagauggguggaucaccugaggucaggaguuugagaccagccuggccaacaucaugaaacccgguggccacuuaaaauacaaaaauuagccgggcaugguggugcgugccuguaauuccagauacucaggagguggagacaggagaauuguuugaacucgggaggcggagguugcagugaacugagauugcaccacugcacuccagcuugggugacagagugagacuccaucuccaaaaaaaaaaaaaaaaaaaugagucacuguggaaauucagugagguaguauaugugaggcaucuagaucagugucuggcauacacuugacauuuaguaaauguucucuuccguuuucuuagaucaguuuuaucaguuugaucaauuaauuguuuauuugaauagguauugauugccuaacuucucugugucucacaucugcagguucuuaauugauggcucacaguaauuacuauuaguaauggcucauaguaauuacuauuacaguaauacagcaaaagccuuuuagagaguaguagcugugaggauuuugagaaugggauggaucuggaaaauaaucuuaaguggugaaauggacagaacuuggauccugacucagagaguggggaacaagaggguguuauuaaggaugacccuuagguuuuuugguuuguguaacaguuuugauugauucaugcauucauuugccuacucauucaacacauagguauugaauaugucuguguuaggaccauuuaaagcugccauucacugagguuaggagcacugcaagaggaccugguuugccuuuaauguagcaucaaaguggagaaguuuaggagacaguuggaucaaccaaucuggaacucagaagagaaccugggcuggggauguaaaugcucaugaguaauaaugaaagucaaggauaaguuaaggaugagacuaccuaggaagcgagacuacagugagaacagucugcagcugaucuuggcagggaucugggucuaauggcugagacagagacauagaaaaaccugcaagggaaacagagauggcuaaucagagaaguggaaagaaccccagaccauauuuuaucacagccuucaaaaaugcuguuuauccuucuuucucuccccaacacuauuuuuucuuuuuuuccucuuuuuuuuuuguuuggcauauaagccccuauuaauuuagagaccacuuuguguuguuauaacuauuuagcauauggaacuaugggcucucaaaugaauugaaauagauauguccaaggaaggaaacuauuuaaaugugcuaguaaaauaagagacucuauuaaccaaauuguauuauacaaagugauuauuccacuaaaauaauaugauacaacuuaggaggagaugaugaaaugaacauagcauacaaaauaaaaacaaaacauuucccccguuuucuuaacauuauuucugauuugaucuguaauugaucuuacaguuacuacuugugcauucuuuuucuuaaaauauuuaguauuugccugugaguccuagcacagaugaaaaccacguggaucuagaauucuuuaaccuuuuccacuuaauuaguaaagaaucugucauaaugguguuuuuacacagcaucuucagcaagauaacaaagagcuugguagcucagcauuacauugucauggcaacugcccaagaauguuuuugguguuuuuggggugugugugugugcacgcacgugugcacagggacgugcuuuaaauugaaacuguagucagguucuuaaaaugucgacuauucauuuuuagauuucuaaagcuauguccaaaccaagagaaauuacauuuauuugggauucuugaaauucuccucuugcuauguuuuauuuucuaguauauuuaagagucauaauaaguucaaguucauacacauaugcaucuacccaucucuggauaguucauaaucuuacucaguuuuucuugaaaucaugaagaaaccauuuuuuucuuuucuaaauaugagauauuuauaacaccaaauguaaaaaauauugacaguaaauaauuggcaagaagccaguggaacaggggcucuugaaaugagcgugcagagacaugaaugggcagcuggacacuuucaaccacggucuugcaggacuuugcuuagaaguggauguuaaaccccaaacuggucaaugucuguacugucagcccaggcacccuaagcuguaguuugugugagugggaccccucccugugagucauaaccacucccugaguguagggguggugaucagggagaaagggcaucagccaacauugaccgaacacacugugugaugggcacuguucuguguaccauagccuguucuaaguucucacaauaacccuauaaaguacaucuuauuaucaucuccauuuuacagauggggaaacugaggcacagagaaguuauguaacuugcccaaggugauacagcuagcaaguagaggaaccaggauuuaaacccacacaggauggcuccagagcccaugaucuccaucacuaagcuaucaaugcccguuguugccagcugcuuuccaaucacugggguagcaaugcuuuauuauuagcauuaacagaccucauuuugggcaucugacaugaccuggauuuuuagacaccucuauauucagaaauauucagaaauucuaauauuucugcucugucgaucuugaguuuuaaaaaauacuuaaggagaacauaccuuuauucuuuccucaguaccuagcauacugucccuaauguagacacacuuaaguuuccugggcaagcauacuuugcuugacugauuugguaacauggcauggagguuguuuagccaccacuggaacaguguugcugacauuauuguaaucuuacaagguuauacauuuuuagagggcaacccaucuuugugucucuagaacaguaacuuaaauugagugcucaguaaauauuuacugaaaugcacugacucucaucccccaucacacccaugaccaucagggccugguugaggccccaugagcaucccuagaaugcucccuccaugucccacugguuuucaagggggcauccuugaacacuuuuuaguucuuucucuauuguguuuuuuccuuauaaacccuuugccccuccugcuuuuuuguuccccuacugccuucugagagagagaaaaaaaauaagcacaccaaguuguuagcauuuuuuccccuuuagucugccucuacugcaccugugaccaaaugccaggugagaaggacuggaguggcaagacuugcugugccuggcaggcaggugcuguggggccaggcagugauucacuauauucgugcaagaccaacacguucucauuuuacacuccuaccaguucuugagagauuuuaacuaagccaaucagugguagguugaaaaggcaugaacacauaucauuagugcuugcuuuucuaugguucaccuauucuaggaauaugucucauuuaaaaaucaccucuaagaaaugguucaaaauauaauacaguuuguauaaauaccauguauuuuaggauucuuccagcgcaggauaagcugacauguaaugcaggguaaauuagugugcuuggccaggcgugguggcucacaccuguaaucccagcacuuugggaggcugaggcggguggaucaccugagguuagaaguucgagaccagccugaccaguauggugaaaccccaucucuacuaaaaauacaaaaauuagccgggcaagguggcaggcgccuauaaucccagcuacucgggaggcugaggcuggagaauugccugaacccaggagguggagguuccagugagccgagauugugacacugcacuccagccugggcuacagagcgagaauccaucucaaaaaaauaauaauaauaagugcgcuuacaguuuuaggaccauacgcuugcauuuauccccuaagaaucucucguaaaaagugguauucauucaagacugggugaaugccccucggugugggcuucuaccaggggaaguguuuuacagaucagagcaugcuguuacacagaauuagagcacuucuucacacugaugagaugggcaugacacaauggccaugauuaacucaacuucauuuacuuuucaugauguuaauuuucaauaacacauucuucacauacaagucacacccaggaccucccaccuccauugauuucaucuggaacuuuguagauacugcuguggucucugugcagcaagcugaauaaguauuucugccuuaauggauaauucuuguuaucuuuuccaaacaccuggaauacagucuucaaacauuuaaggauuagagcagcuuggaggcagugaucagugauuaaucagcuaauucccuccacaggcggagauaauaagugauaagagcuccucagcccaaggaaacugggaugugaccucuccucucacuccaggaauuaccaagauaggcuuucuuccucuuucguccugacauuuacuuucuuuucucuuuuccuuuacccaucucugacuuuuuccagauaucuuuucuauuucuaauuaccucuuucuccccuccccauuuauuuuugccuuccuuucgcuuuucuucuuucccccucacuguccuuucuguauccccuccaggguauuuauagcucuaaaaaaauacaguaauuacucccaaacacaaguuccugccauacauauucuaggucaguguuuuucggacaauucugaaaauuaguugugaaauuaauuuaguaggccuaugcagugaaaugaaauagcacugaacugaauauaaaguaugaccacaaggcacauauuaugaauaagucuuguuucaugaaacuuguguuucugugcaaaaguuuagcauguguguaccaguuugccaugcaacauguauuucuuacugugagugacuucacuguuuggauuuauaugaaugcaucucuucuggauccacaagaauuagaaaacuuagcucuguuccuggcaucuaggcacuuauuguuuguugaaugaaugaaagacaugugaaugacuccuguuggggauaauuagaaaaagagaagaggaguaagugguuucugugauacauccauaguggauaaaauaaaugcaggccuuggaaaauaggcuuccauuauuuccagugaauugggagcugggauaagcaugugagggaagaaaauaguaagaagcucccagcugaaagucaaaaugaaaaaaccuuuuuuuuuguuuuguuuuuacaauuuaacauauugcccguuuuauuuuggugaguacaaagcauaucacgaacgagagcuuucaugggcucaugucagagcuuagguacccccuucacauggggagaugguccuguugcaccacuuuuggaaaaccauacauaauucuguguguuuaauccaagggacagguagaaacaagaucaggaagagaugcuaagggagagaguauugccuuuauccuaaaagcucuguucuaaucaggggagcgauaggcuuacauuugcguuuuggaaaggucacucuggaaguaguguggagaguggauuagaggcagggcgauaaacaacauaucuguuggaaacaucaggacaagaaagugauuggagucugcuguuggcaguugaaauagagaugggguauucuuuuacaaagguagaaucuguaagucuucucaaaacuuguuaguggauuggguuucaggaauauuugagaggccagggguuuuauagcuugguugaccagcuauaguggcaaguugccaggauagcaaauauacaacaagggcaaguuugggggcuaagguagugaguuucagacaauaaugggaaaccuaagaugauaugucugggccucaagugguuuuagauuagagagauucaauaauuuggguuuucucggcuauugauuuaaaaagcaaguaaguuaaauuucuuuuuucuuuuuuuuuuauuauacuuuaaguucuaggguacaugugcacaacgugcagguuuguuacauauguauacaugugccauguuggugugcugcacccauugacucaucauuuacauuagguauaucuccuaaugcuagccuuccccccuccccccaccccacaacaguccccagugugugauguuccccuuccuguguccaaguguucucauuguucaauucccaccuaugagugagaacaugcuguguuugauaguucauguccuuuguagggacauggaugaagcuggaaaccaucauucucagcaaacuaucgcaaguuaaauuucuuuaacuuucucuaaacuaaaggggcccaaguuaaauagauuauuuauaugugguuuaaacauuuucuaaggauucuugucagauuaaagggaaaacauucuuuaaugacugauagagaugaagacuuuaugguuuuuaauguauuuuugucucauaagacacucuuaccuuuuacaugagcaagcagguuaaucugggggagcagauuuggauaucugauguggucauaugagggguauuacucauugguuuuccuugcucuguauacaagaaccacauuuuuuagugguuuaaccuuuaauauuuuguuaguuuaccaaauuaucaucaguuuuguguauggaaggugagugggaggauuuggggcagauggagugauuauugagccuugugcugugucaccguggcuuccugacaaccauuccuuuuguacaaugaagaugaguguccagguaugauguauuuauagcccuugucuucucugagcauauacuagaagucuuuucaguuaagauaaacuuuuggcugaaauacaagaaaacacauuucaauuuuauauuuaaauauagucacacugcccuuugcauguuacucagaaccuuaaaaaguacaaacuucauuaaguccaaauuguguuuaaaauuuaccaacagaucuuuuaguauuauauaagcaauuuuccauguuaaguauuuuaauauuauuacuuauuuuccuuagggucuuaugaagaaauuugagaaaucauacucuggaaaucaauugcauucuauuuucauaauuaaagaucugcucauauuuuauaaacaccuuucugcuaucccucccaauuuuaugggaacagaaaguccuuguaaauggaacccacuaugugguauuguuaaucuaaaacuaauauaaagagacuuugaguucuugagagcaaggcccaucugucuuuguauccccaguccauaccgugauacuaauaacauuaaauuaugaaugaggaauauuuggcauucaacaauuuuaccucuuuuaggaauuuuaugcaguaauugugagggagagaugcaagguuuaacaaauuggagcaaaugacaaggcagaugauaaauauuuguaaguuuuuacuuuacuaugguuuauuuucaguuuuagguauagcagcucagaguucugagcagaaucccuugauauucccaacugacaaacuacuccaguccuuauuaguugaguuacacauuguguuagaaggacaggauacaagggaccaugguuuucugauuuuuagauucccuacugcuaccaaaugucugaagcucuuaaugagagaauuuccucccauaggcaauuagcucuugaagucccuugaucaacauaacuggagaagaaccaugauuuccugauuugcauuugccuauuguuuccaaauacaugaagcucuaaaagaggauuugcuuuguuuuuauauuuaacuuacuuuuagaauccuaugauuuuagaaaacuauugugguuugaucuuacuuggaaagaguagaaauuuuuauauucuuaaaaaucuugccucucaaacccacuuucuguuaacuugcaaaaaacucuuuauaagaugguuuuacauccauuacuaaaggguugcaguuucuauuccguaugugugaugucaccaaaauccuaauuaaauccugaaaugucugaauaaaauguauccuguccuuauucagaaaaguaauugagaccaucuugacuuucuuaacgauuuuguuuuacucuucauguuaaaaauguauuaaugucaaaauaaaaucaauucaugcuuuuuaagcauuguauaucagagaaauguauuaguuuuuuuuacaauaaaacuuuuagguuuauuucaaaauauaaauaacuaaauugguagcucauuuauuaugugacuugaaaauacaaaaguacauuuaauagaguuagugugcucaaauacauuuauuuuugauaauagaauagagcuaggaaaaucguucugauaaucucagaagcuucaguaaauguuuaacagauagaaaaaaacaaaaaauguaauuuuagaugucuuuuugacagcucuacauaaaauuauauugaagcuucuuaagcccaguaacuuuguuuugcacaugcuuaucuguucauuauuauuccuauuggccuaaagauuuugcuuuuacuuguuuuaaacaguuuuaacucuucuuagacuuugucaugcuauaacagaaucaguuacugguuuguuuauaaaucauguaggugauuuaauuuaguuuauuguuuguuagguuuauuguucaaccuuuaauuuuauuuuuguuuaucuggaaccuuggauauguuucccugcagacccauaauaagaaacucaaucgguguaaucugaauuauucacauacuuauuuauucccaaagccccucuauaaugacuucuagagauacaaagggauaaucacacuuguguggagaggugcaagauggcauuuucaggaugccccauaaugugcacacaugugugcacacacgagugugugugugugugcaugugcuuguguaguguauuaagacuaugaaaucugagaacuggaagaugauuagggaucaucugauuccauccucugauuuuauaaggaguccuggagagggucaguaguucauucagguuacuuuuuuuuuuuuuaauuauacuuuuaaguucugggauacauguacagaaugcauagguuuguuacauagguauacaugugccauggugguuugcugcacccaucaacccaucaucuacauuagguauuucucuuaaugcuaucccuccccuaguuccccaacccgcaacaggcccucccuguguccauguguucucauuguucaacucccacuucugagugagaacaugcaguguuugguuuucuguuccuguguuaguugcugagaaugauuguuuccagcaucauccaugucccugcaaaggacaugaacucauccuuuuuauggcugcauaguauuccaugguguauuugugccacauuuucuuuauccagucuaucauugauaggcauuugguuugguuccaagucuuugcuauugugaauaaugugugcacacaauaaacauaugugugcaugugucuuuauaguagaaugauuuauaauccuuuggguacauacccaauaaugggauugcugggucaaauggcauuucugguucuagauucuugaggaaucgucacacggucuuccacaaugguugaacuaauuuacacucccaccaacaguguaaaaguguuucuauuucuccacaucuucuccagcaucuguuguuuccugacuuuuaaaugaucaccauucuaacuggcaugagaugguaucuuauugugguuuuuauuuguauuucucuaaugaccagugaugaugagcuuuuuuaauauauauuuguuggccgcauaaauguguucuuuugagaagugucuguucauauccuucucccacuuuuugacagguuuguuuguuucuuguaaauuuguuuaaguuccuuguagauucuggauauuagaucuuugucagauggauagauugcaaaacuuuucucccauucuguagguugccuguucacucugaugauaguuucuuuuacugugcagaagcucuuuaguugaauuagaccccauuugucuauuuuggcuuuuguugccauugcuuuuaguguuuuaguccugaaguguuugcccaugccuauguucugaaugguauugccuagguuuucuucuaggguuuuuaugguuuuaggucuuauguuuaaguauuuaauccaucuggaguuaauuuuuguauaagguguaaggaagggguccaguuucaguuuucuacauauggcuagccaguuuucccaacaccauuuauuaaauagggaauccuuuccccauugcuuguuuugucagauuugucaaagauuguagaugugugauguuuuuucugaggccucuguucugaacagagcagaucagaguuacuuuuaagugguaaagcuggcacucaaauucauuucuuugggacucaaacagaaaguccaauaacacaaucugcugagccaggcaccuggaauuuacccaaccugggcaccuacuggguucagcuaaaaguggaggagcacucacaggaagcauggagaguagcaaauauccaugugagcaaauggcuagcagcugucaccaaaggaagaagagggaaaagauagaaaacauaaagcaaagguccucaaaagguggucugcaaaacccucaaaauguggucuguaggcccugguuccaagacccuuucauugggucugugauagcaaggcaguggcaccaaaguauauuggugaucauuauuuucuucacuccuacacacucacagcaaaaaaaaaaaaaaaaaaaaaaaagagagaagaaagaaaaaaaugccaguuuuauuaagucaugacaaagcaguaaaaauuauuaaauaucaacacuugaaugcauguauuuuuaguauucuuugugacaaaauggaaaauaugcauaaggcacuucuugcauaucauaauacuuguauuucaaaguacuaugguugucuugaggaaaaggacuuguguggugauugucuaaguugugagcuaacucauugcuuuuuuuuugugagcuaauugcuuuuuucaccaaacaccaauugaaauaaugacagacagacaaacuauguuucuuugggcuuggauauuugacagacacuuuuucaaaaaugaacaaaguaagccugucacuucaagaaaaacaauuuacaguguuuguuaccaaugauaaaguagaucuuuugagugaaaauuagaauuuuugaacacguauaucuaccaccgugaacaauacuuaagauuguuuuaugagaucaguagcagucuuaacaaaugugauuuuuuugauguauaaucagauauguuaccauuuagaagaucuucauaucugggugaaccaguauuuuccaaaugaucaauauaugcuguuaaaaacucaugcauggguaaaaagcauucauuccaagugugacaugcaucaauggauaagagaguaugagaaguucauugauauaguuucaguucuacauugcaacuaaccuuuaagaaacuugucaaauuuuguuguaguaucaaauaaaaauauuugaaggcuuauuuggaaggcuauuaaaauacugcuuccuuuucuaaccacuuaucucugugaggccauauuuucuucauauaugccaaccaaaacaauguaucacgacagauucugcaaaagcagauuugagaauccaguugucuucuauuaagccagauauagaaaagauucgcaagcugugaaacauugcuucuuuugccacuaaguuuuuuguuuuaaaaauuguuauuuuucauuaagaaguuguuuaugcuaucauguguuggguuuguuauuuuaauaauuauuuuuuaacuucugucuuaaugucuuauaugguaaauaucacuagauauaacccauauuaaccaaagcuaauuggggucuucaguaaugcuuuuaagagugugaagggauucugagacugaaaaguuugagaacuuguucgcauaggguaguugauuauuuaugucaauaugcauuacuaaggcaaccagggacguuauuauguuacagccuugcucaguauuugccagcaggaugauaucugugacugguugaagaaaucuuauuuucuaugauuuaugauuuuuuaaggaauucaggaagcaaauguucucuuuuuaaaggguucuaucaaaaacugucugaacuucuuaggaugcuuucagcuccaaauaacagaaccucuaacucaacugguuuaaacaguaagauaauuuauuaucuuacuucccugaaagauugcagaugggcaagcuccagagcugguggauucaggggcuucgugugaucaugaagugcccagguuuuuccaucucucugcucccccauugucaguauugccccaucuucagaccaguaggaagauggccacagcaguuccaggugccacagucagacacaguagugcccagggcagaagggaaacacugacucugugucuccuccuuaggggcaaggagucccagaaccugcucagcaaauuucucaugucaaauggccaggauugggucacaggcuaaccccuaaguauguuacugccaggcuauguaugggcugauggugauuggcuuagaauacucauucagggugcauggauguagggaaguugaucacagugacuuaguuauuaaaaacaaaauccuucguacuuuuccaguuaacuggaaauucauuugcacaggugcccaaaaagagagguagcaugaaucuguggaaagaauucuaggccagagaaucaggcacccugggaucugaucccauuccuuccgcugcugagcugugaguccuugccuguccaggucguggcugccuugcuggugcaugggcuagagcauuaguucugggauugucugguucauugguucauuuauucccuugcucacuccuucauucaauaauaauugagugcucacucaguuguuuaagucacgugaaggguacaaaucagcacuaaaaugcugccuguuuagccacgacagacauucuuccuccugugcugcauacgcauucaaagcccaaugggaauuaagauccaaacuguuuguucacucauggaauacucaugcaauaaauuguuuagugcccucagcaaagaguccuugccacaaagcuuauuagugagcaguccaaguuuucccucaucuuauuaaauauaaaauuuguuuagaagugaaaacagaaaaauacguucugaaaaagguaaguuuuugucccaggaaagaugcuugugggccuagcugucuauaguugucccaguucccucaguaucagaaagaguaugaggcagagaaccaggcuggucagagaacagaaagacagcugugagaaaugagaccacauucucggaauauccaaggauacucuuguguuguaguucccagauaagaugcuuagaaagguuuuauuuuuuuaaaaccaagcugguaaaauuucacagaccuuucucaugugcaguguugguuaauuuuucaugucacgugcagugcugagauaacugggaguauuuaucucagaaaagagaauuaggaaucaugugaucauucccucaaguaauauucgaaucacugucaagugaagcagagcuguuugaguugcuucagggaccaauaagugaaacauauagggaggaagauuuaggguugcugaagaggacaucuuucuaacaaccagagcuauugacaaugaccuguaaacauuccaugauugaaaguccuggguauccauuacucgaguacucaagcagaggcagaugaccuucuaucagcaaugugauggagagcaucuucauuugguuugagguuggacaagaugauuggaauaaaggucauuuaaagauucuauaauuauuaucauagccacaagucaucuaauaguuggaaucauuaacagcuugaaagaacguaggugauucauuuauucaccaaauaccuaagcaccuacuaugugucaggcacuguucuagucacuggggacauaguagaaaacaagacugacaagauuccccagggcccuucuguuuuagagugggcagacuaguauugaccuaauacauguauaaguaagacaguuucauauuaggguaaauacccugaagaacacaaagcaggggaaugcgagagagugcuuggagcagguacaggucaggagcuguuuuaaauuaggcuuagaggaaaguuuucucugaggaguuaauguuuaagcugagaacuuagugaaaaagagcagucuacaugagaugacuggggaagaguguuugaagcagagagaacauacacaaaagaccagggcaggaauaaacuuggcauguuugagaagcaagcugauaugguuaggcuuugugucccugcucaaaucucaucuugaauuauaauccccuugugucaagggagagaccagguggagguaauugaaucacagggaugguuuuuccccaugcuguucucgugauagugagugaguucucuugagaugguuuuauaaggagcucuucccuuucgcuugucacuucuccuuccugccaccuugugaagaaggugccuugcuuccccuuuuccaugauuguaaauuuccugaggccucccuagccaugcugaacugugagucaagcaaaccccuuuucucuguaaaucagccagucucaggcaguucuuuauagcaguguaaaaauggacuaauaugcaagcugaagccugggucaaaggcacagaggcaugugcugugggauggagugaggcauagguaggggccagaucucagggaaccucucacaggagcuuagcuguuacucugaacucauccagaagguuuuaaguagagagcugcaucucugauuuacaucucuaaaagaugaccaugggugcuuucugaauuguaguggacaaggauguaagcaaagagggaaauaggaggaaacucaagaggaguugguuucaugggagccaagagaagaaaguguuucaagaaggaaaaugggcagcaguguugaauacagaaaaaugauuauugguuuaggcaacaggaagguuauuaaugauccugaugagaguguuucugugggugguagccuugcaagcccacuuggaaugaauuuaggaaaaaauggcaaguaagagagcaucaggaguagaagccauucuuucaaaaaauguuacuauaaaggggugcagaggaauaggacaguaucuggaggggaauaugaacuugaggaaugaucguuccucagacaggaguuacacagcagauucucuguaugcugauggcagagacagaugcugggcacuggacagggugaauaacugcaggagagagauccucgaaaaggcacugaaucauuuuguauucuuauguaaaucuagaauuucauuaucuuugguguugauuaguuuguuguaauuuucucauauuaaauggaaccauaugaaaucaccaauauuuacacuuuuuaccuauaaaaguagcaguuucauauaauucuaccuaauauuuuaaccuagacaauuuuauauuuauagguccuuuuaauuuauauacauuuuaaauugggaaucucaagcuuaucuaaaaguuaccauuauaaaacagagaccauucccuccccacugccaaucauuugagagugaguuucaggccugauauccucucucucucuaccacuuuuguggguauuuuuauacauaagaauauucuccuagaaaaucacaauacaaucaggaaaaucgggaaauuaaccucaguacacugcaacuuucuaauccucaaacccauucaaguuuuugccaguacucccuaaaauguccuuaauugcaaagggauccaguccagcaucugauggugcauuuaguugucaugucucuuuagccuuuuucauucugguacacuucuccacucuuccuugauuuuuaugaccuugacacguugaagaaugcaggccaguuauuuuauagaauaggcauugauuuggguuuguuaugauuaucuucagcuuaugaaucaggggauaacggugugguagcucaccuucaaguuggccccaccuccuguuauucauauccucuuguaaucuccucccacaugguaccgggauuggucuuugugaccacgagcauacagcagaagugauaagguugugaaaguuaucucuuggaucacuugcuccaggaaacuagcuuccauguugugagcagccauauggauaggcccauaaggaacugauguguccagccaacaacuagugagaaauuggagccugucaaccaagugaguaaacuuggaagaggaugcuccagccuccguuaagccuugaguugacaguagcuguaaucaacagauugacugcaaccuccugggacaccuggaaccagaaccacuaaacuaagccccucucagaucccugaccuccagaaacugugacauaauaaauguuggcuuaagguacaucacaaauacagacaggaauaucacaaaagugauggugaguucuuuuuauugcauccuaccaugggcacacaaauucagucugugccauuacugaugauguuuauuuauuuauuuaaagacagucucgcucuguaacccaggcuggagugcaguaguauaaucacagaaccuugaccugcccggcucaagcgauacucccaccucaacuucccaacuagcugggcccacaagcacaugccaccacacccagcuaauuuuuuaauuuuuuuuguagagaugggagucucacuauauugcccacgcugauuuugaacucccagacucaagugacccuccugccucagccucccaaagugcugggauuauaggcuugagccaccgugccuggccuaaugauuuuuuuuuuauccuuugaguaagcaaugucaucugagcuuuucuacugugaaguugcuuguuuuuuucuuguaauuaauaaauauuuuauggaagguacuuugaaacuaaaaauccuucaucauauuuccauuuuuuucauuguuuuucuuacuaugagauccuaacguccuguguauucaaugggauauacuuuguuacugacauuauuuguugugaagcucagaguguuccaaauuucaccagagucuccucagccuggcuucuguguucuuuggauauguccucaucagccuuugaauacuucuuugauuucuggcacaagauguucuaggcucaucauguccuuugucugucccagcccugaaaucauuucucugaggcucccugauuauuuuuaguggaaaaugacauuaaagccaagaucugagcauuagguauaccuguugcaauuggagggucacugcccccaggcccacucaaaaaacauucacaaauuuauguguacauguacauauauguguaaauguauguauaaguauauacaugcauaucuauuuuauauauuauaucaaauauuuuuauaaauaaaauauagcuaaauauauauuuaaauccauaaguucauacugauucuucuaacuguaggguauccaggguuuauucuagccuucuccaacaguuaggaaacuggacucccauuacccucguuauguuuauuugauuuauucccccauacauaaccaguuggcugucaccacugcauccaccccuucccagacaugaacgcccuuccuucaggcucugacuccacucauggagacacccacccacagggaugcccucuuccucuccuugggcuccaggccacccuuccauauggacucccaugccugccucucccugcuugggcucugacauacuuccuccggcugcguccacaugcaugcucuccucuccccauccagguucucacucccuacacuggaucuguccucuggagggauggccuucucuugccugggcucuaacuccccacuccaggcugccccccccacccccccguuaaugagagugcccuccucaugcugcuugguaccaccaucccccagacugucacaggcugccucuccaugcagauuauacccaucugagggcucuaggacuggccugugcaguggagaaggggaagagcacggcuuuaugaucacauaaaggccaucggcacugaaagggacauugugcuccccaacagcugaauuuuucauuuuuucuguaguaguggguuccaguuuuccaguuacacuggcauauuuuaggaaacuuguugaaaugcaaauucuaaagcaagcaaacaaaaaaaaacaauaaaaacagggagcaaccagaguguuccuagagcauguuuagauuaugggggggggcacucaguuuucauuuuugacuuuugacuacuguuuaaauuuuccacauuuauacuuuuauuuauauuaauaauacuaacagauuauaggccauguuuucuuuauaauugccaguauuaaagauaauuagcauuauuauuuuuuaaaagauaaaaaaauacagaauccaaggccccauugcuagagauucuaauccaguacacucgggccaaagccuggaaaucugugcuuuguacaguucuccauuugaauguaacaauaagccaggcuggggagcugcuccacuggauccuucacaggaauguccucaguagccgauggaacauccacugggcagagcaccccugacuucauccgucugcaaccucaggacacuuaggucuuguuuuggaggcucaugauccuacugauaccuucuuccaaaaaacaguuuucugugauucuuaggaaaacucugaaaagaugcagguuaagcaucccuccaaaccaucaacgucaucaaaaacaaguaaagccugagacucacugcccagaggagccuaaggagacgugaugacuaaaugaaaugugucccaaaugggauccugggacaguaaaaggacguuaggcaaaaaccaaguauggacuguagguaauaaucacguaucacuaucaggucaugaaguauagcaaauguaccguacuaauggaagaagguguuaauaagacaggaaauuguauccugcacagacccagugcugugugggauacccaguccuuguugccuguggcucacagccaagcccucucucauuaaacaacauggaauauguaggaacucucuguccucugcacgauaauucuguaaaucuaaagugguucuaaaauuaaaaguuuauuagaaagaagauggaagucacaagaaguguaaugaugugacaugacaaagucaaugguagcucuuuauaaauaaccagaaaaagaugagacuaucagaacgcacaugaagaaccuaaguagggcgucaucaccuccaugugggagauaagacacacgccauuacugcaauccauuggucugaguuuccaggagugacagcaggaguggcuaccgcugcuucuguucuaggaaaugugaggacagaagggacugauugcuccaaaaggucgccguauaaaugucugauggaugaccaguugugcagaggaagcaucuggcccugcauccaggcagggagaaaggaugacucugguaggagcacuuauguucuuugcccuuugagaacagcuguugugugcuugauguaccaccuguccuuuguuggcagaaaagcccuuucagagcagacccaguacugugcaggagaaccaguccauguugccuguggcucagagccaagcccucucucauuaaacaacagccgaaauguuugaguuagagccuacaaacaaugcagccgaauauugguggaugcuucccgaguguuugugauaauaaacgcagcugaaacagagaaaagcugcacuucuuuuuauacuaagguagacaauguguccagcauaugggagggaaauuguacuguuuauaaauugcauucugaauuggaagcauuuuaccuauuucaggucagaaaaucaucaagcuuuauuucucuaaagccaaaaguuauuuuuaaaauacaaauaaccuuuuuauuuuacagcucucagagaguguguaaaaaaaaaaaaaaagaguauaauucuaccauaccuggaccaacaugaaauaucaauggcaaaggcuaaaacauaaaaagugccaccauugccacucauauaugugcguauggcagacuguccuuucucucuccuugaggagcaaacauacaugugcucagcugcugaaaggguccacucucugccagaagcaucuaggaacacaggucuccuggcggccugggagcuugcuccugguuaaaauaagagggcuggugcuggauuucuuuaccuguuagcuuggcuguguuggccaggguucagcugcagaaagcauaaucugcucuagguaaauuaaauagaaagugauuuauuauaggauuuuagguagcuuucaggaucgcuggagagcugaagaaguagacccuagaccaaacuuccacaaaugacucccaaaaccauauggcaaaccaucagaggagcugcugugucugccuucaucaggaagcugucacagcagcugcuggcuccaaaaccagccaccucagcuauacaguugucccccuuuauccacaguuucucuuucugcaguuucaguuaccugaaguacagaacaguaagacauuuugagagauggagacgcuauucacauaacuuuuuuuuuuuuuuuaagacagaguuucgcucuuguugcccagguuggagggcaauggcgcgaucuuggcucaccacaaccuccaccuccuggguucaagcaauucuccugccucagccucccaaguagcugggauuacaggcaugcaccaccaugcccggcuaauuuuguauuuuuaguagagaugggguuucuccauguuggucacgcuggucucgaacucccgaccucaggugaucugccugccucggucucccaaagugcugagauuacaggcaugagccaccacacccggccucacauaauuuuuauuacagaauauugucauacauguucuauuauauuauuagguaggcuguuaaucucuuacugugccuaauuuauaaauuaccaugucauagguauguauguacaggaaaacaggauauaugaggguuggugcuaucugcaguuuccagcguccauugggggucuuggaacauaucccugaaggauaagggggaauacuguauucaaaaagccauuaccacagugcccaacucaagagcacaucaccugugccacuaaucugcaaaacacauacccugcauccugcugcuuuccauaugacccaguuucaaaucaaagcacuugaguacaagucgcagguagaaccuaaauugcauucugaaccugaauugcaagggauccugggauauuaguuuuugcuuuuccgcugcugcacacuagacggggaaugcaguggaugcugaggagccucaucuaugucaugugucacugucugcccuuuagcuucccaguuauccguguauacucuucuugcuguaaguaggacccacuccauucccuguaaauuucugcaucccauucaaaguccaggaucucuggguauguguagcucucuucauuagguccagauagagcuuuuuaucaccuagugaccuauaaauaaagacugccucugcuccugauauacagugguggcaaaggaaaauuaaaacucucauucagaaaggaggaguaugggaaacauacaacugcuauuuguccuuaguagugaccucaucccacuaggcaacaaugguaaaggcaccuugcucagauaguagagugagguccuuggguagccauccagggcuccuuuguccaugaagcccaaggcccaaaucaguuucaguugggucacauuuugccagaaaguaacuuuugguuauuauagcuuuugggauuucaggauugcagauaggaauuauguaucuguaauuuuguuuuuguuuuuguuuugagacagagucuuacucuguuguccagacuggaaugcaauggccugaucucggcucacugcaaccuccgccucccagguucacacaauucuccugccucagccucugaaguagcugggauuacaggugcccgccaccacgagcugcuauuuuguguauuuuuaguagaaacgggguuucaccauauuggccaggcugaucucgaacuccugaccucaggugauccgccugccucagccucuuaaagugcugggauuauaggcaugacucaccauggccauguaauuguuaacaauaguucaccuuuacugagcacucaggcacuaugcuauacauauaaacuuaaacucauuuacuccacucaacagcugugugagguaggaauucuuaguauccccuacuucauugauuucuacuaaaucuuucuuaaaaagccauugagucccuaccauaugccaaggaaaaagagcaaaaagucuguacagccucagcaaaaguugcucccacucacaugagggagacagaugggggcacagacauaggugugcacaaggcuaugggaacagaggagaggggcaugcccuaccuaugcaucaggcagggcucccaggcagguacugguccaacucuguccuccaggcagagaaaaaaaccagcccugaguggacuggggaggucauuccagcagcuuguuaauaguaaaccugcuucuucaaucuagcgacugucaaaugcuucugagaccacagcucacaugagaauagaugguauaccaucuccuauuagcugcaauaaaaguauaucugauaaguagucauuuaaaacauuucucuaacucuucuuguaccucuacugcuauguaggcaauaccugauuagccacaugcagaugaaccaugagauuaagaguguuaccaccucacccgcaccccccaagucucccaucacucagauagccaguccaucugaacaucugcaguaugcguugucucugaagggaacagguccggcaagaguagacgugggaguugagcugggaaagagcuucucugagagcagcccuggguaaggaggggugguguagcagugccgaucuccagaacaaggaaaauggagcccugcagcugacaguauggcaaauguagggcucaguuugagggaugggugaaaaauacacuuuuaaaaauagagccuggucgguucuggaagaaggcagcagcagcagcagcaucauuuuaaaaucucucugaauccucacacaaaaaaacagaacaacugguuagcaaaaccaggcaccuacagacaacacuuaccucaaaacugugcgauacaguauccucacucacccccaaaucuaaagaggauguggaaguaaaccccccacagccauaaagaccugcaugauagcagugugugugcaagaggaagaagcaggaggaaacaguggggcaucugagaggccugagaauaggagaaccccaaaauagcucacagguagucgccagaaaucauugaagcugaaacagaagggguucacccaauucaauaccaggggagugcaagggauuuuuggugaguucugaaaggggcugaggccgucugggccacauacagucuugaacccaaacggccaaagcucccuaccuggacauggcaggagaaauugcugauaguggcauuaaaauugagcaggacaauggagaugaaggaaggagaaagcccagacaacauugaggaaggggagcagagaggaaaccucagagagcaagcuguggcaguuuucaacacuucacugaaacaaccaaagagaguucugugaaguuaaguaaaucuuuccugagcaacaucuucuuacagcucugcaaaacuaauuuugcacaauaagcaacagaaaaguaucaagggccaaucucaucauagaauuauaaagaacagagcaaaauaacauuccuacagacaaugaaaucaugccagaaagacaaguuaauaaaagagguuaaaacagaaacauacuauuucaaaaugaacuaaaauacaaagcuuuaaaaagaaaugaagaaagacauuaaaaaggacugaagaugaagugucaagugauaauuugacaagucccaauggguuacuggaucuaggcauuggccucagugacuguuaacauaaaaaagauaagcaaccagagacugugacccuccugaugaagcaauacaccaccagccauaguguuaccaaagcaaucgaaacagcaucucaccacccucuggguccaacugcugacccacagcgcauauaaagggcagaggaacacuuugaacugcaucuugacuaugcaagcagcuaaauccaaacugagggaaacucuacaacccagauucuucaacagauaaauuguaagaaaaagaaaagugagaggccggguucaguggcucgagccuguaaucccagcacuuugggagggcaaggcaggaggaucgccugagcccaggaguucgagguugcagugagccaugaucgcuccauuguauuccagccuaggagauacaggaagacccugugucuuaaaaaaagaaagaaaaagaaagaugagagcaucuguagauuaaaaagcauaucacacuuuugaaaugagcaggacuauagaaucuaggggugcacauuugaacgacagugucuuuuuuuaaaagugcaaacaagugauuacuauagaagucaggauaagguuacuuaugagucaggguaggggauugugaugggguuggggcaccuggaaggggcuuuuggguugguugucagaauuucuguuuguuuaccugggugauguucacuuuauaauaauuauguguuuguuuugugugauuuucuguaucgauuuuauuuugcaauaaaaaagugaaaagcacugguaaaucugaaacacaguaguuuuucuaugauaaauauuggguaaauauuguuaguuuuuauauuuaauuaauguguacauaaugguauuucaacugaaaacuuuaccaaccuuguagcagccucuaaaucucuauuguguauuucauugaucuuugcuauauaacaguguaaaaaaacagucacauuuuaaggacaagauguuccagcucuaccuaggaaauaauagggguuacaguauguuaucuagauuuauuggcuccaaaccccauaugcucauuaacuauauuuuuguucuaauaucugcacaauagaaugaccauuauaaaaguucacauggcuucacuuaaagcacauuacuugguggggaugguugaaguguauauauauguguguguguguauguauauauauauauauauauauauauauauauauauauauaucgcuuucuucagcauuguuuuuaaagaauacauauacauauauaaguagguauaaagcauaacuauauauauauaguguguguguauauauauauacaccauaucucaucuacacacaugcauacacauuauuuuuuaaucuagugaaucugaugacaaaugagucuacaaaagauagaguuuagcagccuuagacauaacaaaugcauacauuucuuuaauaucuauuaaugucauuguauacuuugaucuauaaauaauuuuuuugugcuguugauguugccuaggcuuggcgauaaaauccucaaccuuugccagacugcagugucuuucuuguuggucugucauugacauggcucccugacagguugaagacagaucaguguuugagaaacacguacaguaagaauuuugcuguccucaugcucucucuauaaccaaaaugucacugacucucuuccuaucaaagucuuuaaagacccagccuacucugaggagcugaaauuccuuauugcugauccuuugaagggccucaugagcagacaaccugcucuccuggucaccccuaguucuguguuauuuuaaugcaauugaauguagucuccagucaucucaggaugugucauuguuguggauaaaagcaaaguacaguaagcuaucuuggcuguuugcugggagcauuaaaaagacccacauuuaauuguagcacauccuaugaagauagagcccuuuugggggguuuuacuguacaacuuccaucuuccuuuguaugucaccguacuaucuaguguccagugaaauguugauauuucaaguacagacccagcugggucugagguccaguucugugucugacuacagggaaucuccacaggggucccagcuaaccaguuuggcauccagggugcauuucugauuccucugauaagaugcacccuagcaaggcugaggucucagcucagcagaauagauucuccagauuuucuuucccuguguuaucuugggcacccuguuauggccaaccacccgcauucucacagggccagcccugagccaaguagcagaguguguugucauugugccccccagccccucacacugccuuguuagcuuaccaucguccccuuuuugugaccuuccuggacaugcucgugugcaugcacacuccguacacacacaugcucugcaucacaccugacuuguugguugacucaucccuugaaggcuuaccucuugcuaaggaugucagacacggagcugcauuucaacaaggccuuucuggagacagugccuuccccacggggugcauggaaauuuuaagccuguggcagcccaaguggggugggaauggagggauauuuuugaauagagagauuauugggugcuuuucaaauuacccgagaaaggaaggaaguggccuauuacagacccacaagccaucauccaaaagccggaggcuagaugagucgcagaauuccgaauugucagcauagcaggaugguacauacaccuucuaauacauccccagugugauuggaggccauguccaauaguuagacacauuaauauucacgggaagugggggugauuauugucagcucauuaggaugugccacaaaaugaguuucaguuggguuauauuuugcaagcaagguaacuucugguuguuucagcuuuuaggauuucagaauugcgguaagaaauucuguaccuguaauuauuaacaacaguucacauuuacugagcucccaggcaguacgcuaagugaacacuuuauacauguaaauaugcauauaagcucauuuauuccuguuuacaacuaugugagguaggcauucuuauucucccuugcuucacugauuucuacuauaucuucccuuaaaaaccagugagucccuagcgugugccaaggaaaaagagcaaaaagucuauacagccuuagcuaaaguugcucccagucaugugagggagacagaugggugugcagacguggguguacacagagauguggaaacagaggagaggggugugcccugccuaugcaaucaggugaggcucccagagguguugguccagcucucuccuccaggcagagaagagaaccagccucgcaaggacuggggaggucaucccagcagcuugucaaaagucagccugcuuauucaaugccagcgacucucaagugcuucugagacugcucccugugguccuuccuuauauuuucuuuaaugcagcccucucuuuauucaucuuuuauagaacacccaucucggcuuucucgcaagauaacaucuaugaaguucagcccccaagaguagacagaaaaucuacagagaucuuccaagcccacauccaggccagccaagguaucaugcagccccuaggaaaagaggacuccuccauguaccgagaguacaucaggaaccgcuaccugugaaaagagcgcagguccaccugguggacacgucugauuagcuuagaaccugucuugucucaucuucaaaagguaacuuauuaaaaguccuuugcgucugaagccuuucuccuuuucugucacuugcaaauuccaaauuauagcuaauaaagaugacuagauaauuugc
